United States Patent 7,868,149 (PLANT GENOME SEQUENCE AND USES THEREOF) - sequence listing, part 84

SEQ ID NO: 44461 - DNA, 14764 bp, Oryza sativa
gatttctctgtacatatcaaaatttccgagttgcagtaaatccttttgttacccatgtatggatagattcatataagtacccaacaggattaggcaacagcaggtcacggcttcactgctcaccatttgatttgttccttttagagcagaaaatctactcaattttatcttccacagatgtaggttgacataggatcagtataaccatgatcagtgatatgctctgaatatttccaccatgtgtaatttgtagtatcgttgtttttggcactgtaatagtatactactgtatcaaaaaacattgtgaaatgaaagtattgtattgagagggttatttaacaggatcttctggaatggaattgaaggtagatgaaatgcaggtcagaagcgaggaattttatggtccttgagaaagtagcttgaggtaatttagtatcttaagatacttagtgcttagatgtaccaaattttatactagaaaatatatagataccttctaaaggatagtaaaattatccccaaaagcaaaggatggatggtgggcgcttgcatcgagaacagcttcgccgtaagccgccgccactcgacggagatgtggctcaccttctccgtctccggcgcacggcgtccagatacttttcctccttttctgcttcgattggttcctgtttaaattggatctagcggctgaagttggatcgttcgtgtggccaaactgcccaacttggatcttaactcgcggcccaaagttggatgggcggcagaatcaggattgaaatcatttcacttttgtttttgtttttttgccttttttgtttttgtttctgataatggaattcactcagcctctgaattgaaaatcatctcagtttgaacctcagaatgttttgtggacattttacaccaattactctctcaagtagctggagctacagtgatgaatccctgaatccatttggtccggttatgagtcgattcaattagttcccccagagaatacaagcagtacccaggcaaatatatttgtggtaacaaagtttttaaacatcttcgctaaaaaagaaagctcttaaagacttaaacatttggatagatcgagtttcatgacggactaatccggtttaatttgaagcagcaatcagctccagcctccagacagtgtcaagactgtcagttaccatactcaagctgcaatttgctccaccaggttttcaccggactctgccacggtattaccctcagatggcttctccacaattgaagccttggcaacatcatctgcattcttgatgtcttccaggatgcttgagctccactcagaaagctgcttcacacttgcctcatctgtgaatgaacaatttccactcattaatacttaacaagcaagcaatgttggtgaacagttttaagaggagtgaaaagaaaaacaagatggaatgcaagtgctgggtagggtgcatgcataccaagcctagggacagtgtggccctggggatgtcttatgatgacagggtcctcaaaggcagcggccagctcctcggaaggcactttgagccaatccttctctccaatgaaatgcactgatttcaccttgatcggatccttataggctacattgcatatgcttgggtccctgaacttgctcccagctattgagaccatgaacttgattggtggatgatcattcagtactttgccctaagtcattcagcttaagtaagaatccagatggaactagatactgcagactttgaataacatctctcatataaaggacttatcccataaaagaagtaccctgctcaagtccatgttctagtgaatgaaatgttggtgcagcttacaaaagctagcacctagctaaacgatactattcagtatttaccatagcctataggagtgggactttatatttgtactagcatttaacaatttgaagccaaaacacatcaccaacaactgaatagctcatggaaactgctaggttcaaatatgggaccttgatgtcacagtcgtttcatgaatattcacacattattgccctctgttccttcaaactacaaccaaaattgaaaccttctgcaaaattaagagtacaagtgtacctgtgcttggtaacctatcaaaagagcagaaagagttgcaccctggaatgaaaaagaaattaacagatgagctgaaggacatgagcagttgtaaacaagatgttaaacaaacagtaagggatttcggtcaaaactgaattatgatattgttcagtaagtcagtactgattaaaaaatctaaaggtctgaccacaacccatgtcttttggctttcctatgtgagtgtctggtccaatagaaaaacgtgagtacacaggattctgtaaaaaaaaatgcgaaagtttttgcaacttggatatagaaataaaataagagatcgactgcaaggagtgagtgattatctatatacagcagaagcttcagataatctagtgttgctcagtgtgtcggaactgaactcataaattacagcacctcaaaagttgacaatttaaatggtgaatgcacttatctggaatttcatatgcaaattcttggcccaagatctctagcatgcacataataataacactcaagtaccaagtgggtcaaatacgtttcatagctaggttccatttttacctgggagaatccaagcaggccatcaaaaggtccatttttcaccatgtaatcacacaggtatgaaatgcactcatccagatttgtgtattcagtgaagtcctgtgtaggaacatgcaacagtaaataaatgtttgtctatctttggtttgagccaaggcacactgtatagtatagcaacaaaactgaaactatagtacaaagtaagatctgacaacgctattgcaagtgttgtttcagtttgggttccatctgaagcatttaaccttgttgaactgaaaccactcaaagtagggtgggggaaatatgccttctatctctgatttccctccagctgggaatatgccatcagggaagacctgaaaaccaggaaaatcatgtaaacaatcaacaaagcaatacaaaaacctgatctttggatccagcgtagtaccatgtcaaattgttggaagatggaaggattccatttgctgatttgcttcttcagaaaactcccacttgtccggaagccgtgcaggcaaagcaccttaaatttcttgtccagctccatgcgcaatcgtgtatgactcttacaagcacagaatacattcagaaaaaggccttaagaaggccaggagcatgtggtagttgctacctactgccatactctcagaggctgcacgcagctatcagtctatcattcaacacttataattactagtagttgttgcaacctgccaggcaaccctctttgaaaggcatgcctgcctttcccatttgctcaattcaaatccaattcaaaccccaaaagatccttctctgcaattgaacaaattcttctgcatacaagcagaagaaacatatgtagatcgaagaagagaccaatggaataaaaaaaataccagatatccaattgatactagactcgagcataaattgatgaaaaaatatataactacatacaggcccaactgcaatctggacataccaaggacaagaattactggttcacataaaacacaagagatctgaaaacacacttcagaggaacatagcaggaaaatcctttttagcgactacagctagtaggatgcttcactggaaattgataaaacaagtgttgcatcttaactaggactatgcaacacacaatctcctctgccttagagtatggttccatggctcacttggccatcatgaccttcacaaactcctcatagtttatctgaccatcaccatcaacatcagcctcacggatcatctcatccacctcctcgtcagttagcttctcgccaagatttgtcatcacatggcggagctcagcagcggagatgaagccattttggtccttgtcaaacacccggaaggcctccttgagttcttcctctgaatcagtgtccttcatcttgcgagccatcagattgagaaactcaggaaaatcaatggttccattgccatcagcatcaacctcgttgatcatgtcctggagctcagcttccgttgggttctgccctagtgaacgcatgacagttcccaactccttggttgtgatgcaacctgtaaagttcacaagcaaccaattgtacaatcaattgctgaacagtgtagtcattataactagatactaacagaaaaactaggcacacactacacttcctaataactaataataatgtcaacatgcgtctaattggatccatacggaatggactgtctgatcctaacactgaagtccaaacgtaattacttgtttggtttgaagaatggaatgtgttggtacatagcaattgcatcctcagaagggcatgctaagaagaaaattgaagaatgggatcatcccaacaaaatcaggggatgactcaacaataaccaaatcattgtaggatgattatcctaaccaaacaggccattaggggatattaacttaaaaaagaaaaagaaaagggactccttattggctcatcaccagttgtaaagagtttgaaatagtacgattatgtctatttgaatatgctgagagtattccgttaaaagttacaaggctgagtgatatttgcatatttggatgcttttaactgggtgattcaccctgacagtaatatcaagaagggattgctgcagtcaaaacatttcagcacaaagtttcaaggtgggtatcgatcaactttaaagccatacttaatcaatcagtgagctaaaatgttagctgttcaacaataactagtccaagacaatttccacgaacatttcagctcaaaatttcaaggtgggtgttgttcaaccttaaagccgtacttagtgaatcagtgagctaaaatattaccaggttaacgagaaaccagtcgaagacaatttccaccaaggtaattgcagggttatggtctttaacaaggtccaaggtaaaccacaaaattatttgcatgtacttgctgtataattttttcaacgtgcccccatgaaatttatacaggatttccctgtggacaaatttctaacggagaaggtattccaagggctaggaatccaattacctaaactgaacagctttcagtagcgatcaagttattgatacaactacagcccaccataaaaaggttgaagctaccaaatgcactaacctaagaaaatgaccaaagttgcatgcgaaagggagcagttgatagctaagctacatccaacacatacactcctctctgttttcgactatgtaataaaccttttcgtacataaaaatcattgtaatgaaagtatattattctttgctgagcttattaacggcatgattaattaactactgtaaacttgaaaattaattttttaaaaagaaaattatatatccgaagtttttgcacgaaaaagaaaaatgagggagtaactaagcaaactagctgaatcaaacagggcctaatataagttgaaaagttattatgatgtagagtaagtgttcccgaaccaaacaggcagcgagacacgattgcgatagtgaagtcgagggaggtggcgcagtcaggaaatggtcaagtcagcacagcagataagcgttgcgtccatgtcggacaattcgccactggacacacaggacgatgacagcgaccggtttccgtccagatccgtgcccggatcggatctgccacccgacgacgcgaggaaggaagggcacccgcgcggtggaggcaatgccacaggcgcgagacgccagcgtgtgcaaacgagagagatcgatccaacgaacagatagagatggagaaagagagaacaaggtggtggtggtggttgttgttgttaccatcgccgtccttgtcgaagaggctgaaggcctccttgaactcggcgatctggtcgtcggtgagctgatccgccatggcctcctctgcgcgcggcgggtgagtggatcaacgaagaagaagaagaagggaagcggagatgggaggaggagagacttgtgtggcgtggcgtccggtggaagtttcccacccccgatttataccgcgtcttccgtcacctccgctttaccttcgaccacctgcttttcccaaactacccctcctcattagtaatgggtataatgtttttcaaaacatagacatgaaaatagtttcattttattacaggatcatatttttattaacatttttttacactttaaaccaccccgaactcttttatccatctacacctaaattgtcatatgtcaaaaaacatataatcatgatagtttattaaggaaccgacatactcaaaatcgctctcatatgtttcagaagagagttgaaatgatctaaaatatatagtatataagaagataaaatggtccaaagtaaaatttacttacttatttggtaaagttgcattttctttagcttgtcaatgtccaaatcatcctatatttgtggtggcatgagtttgctttgagccaatccctcaattggtaggataaaaaaaaatcagtccctggattggcgggattctacctagctattccctcagtcctttcgcttaaaaatatacttcctctgtcccattttaagtgtaaccatgagttttcgcgtctaattttaaccgtccgtcttatttgaaaattttttataattagtattttttgttgttatgagatgataaaatatgaatagtactttacccgtgacttatgtttttaaattctttattttttcaaatgagacagatgatcaagttgggcacgaaaaatcatgtctgcacttaggctctgttcgtttcaggcagttcggaacccaactcccctgcacggaaaacggagcaatccattagtgtgtgattaattaagtatttgctttttttcaaaaatagattaatttgatttttaagcaactttcgtatagaaactttttgcaaaaaacgcatcgtttagcagtttgaaaaacgtgtgcgcggaaaacgaggaatagaagttggaaacctgcccaaacgaacagagccttaaaatgagacggagagagcaactatctttttatttaaaatagaggaagtactattgtacatgttccattgattctctatgtatgcacaaaagcaaattctacaggattttcacataaaaacagttttattctttcagaatttacgtaaaactcatcccaaacgtcaaagtacagcatgtgtgtgagggcatttgtgtaatcttgaatgttccgtcaaggacaagcctctgtgactttacggcatgtgggcctgtaaaacggtggaattttccgatgatggatgctttcttgacatttttaaatgagcagaatgacgtatgtaccctcgacgcggtttggacgcggagtgcattttatcagtaaagtcccccgactttccaagctttcgtgttatggccttgtgggccatatgaaacgtgttactacaacttgggcctttttcctggttggatgctcgtactgggctttgggcccatcgcctttatgtgggctcaatttaagctttctgatatcatcgtatcatgacaaactgaaaagggattggtatgccctttgattagaaatcctctttctccctacaaaatatacatattagagaaaccgaaatataacaaagggataacaaatcttggaacgcaacaagataagagatgtgagcaaacgaacacaactacaaaactgaccaaccctgacacacacacacacaaaaatgtatgaaagagtatcgatcaccatctttattcttctggtagatccttaatatggcgtcagcaaacaaattggtgactgaaaagcacatcaatgggtctgtttttgttcctaacactgatgaaatcatcacggtccacgccctcaagattaccattattattactattccaaaacaatgaatgaacagaatgcatgactaatttgttctagcattgccagctaataaagctatctgtcctctctttggatggccttgtagaggactttggtgacaaacttggactggaacctgaaggtggtgccgagggcagcgaccatgggtggggtgcccttgccgatgaagacatggccgaggacgttgtgcttgggcatggcgcactctccctccttcccgccggagcctcctcgcgagttgagcacgcccaggtggagctgcggcggcagagcgggaggctccttggtgaactccttgtcgtcaggagccaggaaaccgtagctggagtccggcgatggaggagccatcagctctgacacactgtccacgctatccgggacataatcctgcaagcatatgcacaccagttatacattcaggcaatacgcaaacactgaattttcaagaagcagagataggtgatgcattcgtagtgtgtgtttcaaatgctagcagataaatcatgatgtgtgggaatgatctgtgcaatgcccaggctttgtgctccttctttggtgctttgagttgtagtctaatcctaattacattagaattgtttctctcatatatatgtgcctccaagttagactcttgcaagacacaatgaagaacataattttattgattataacgaaacaaggggacaattggttatactagtgcaacgattatttgcatcattcaattgattcttactaggcgagaaatataattttcagatatctgagcttggtccctttcttaatcatcatcaagtacttgagtgggaatctccctagcacattttcttgggtttaaataatcatggtcaagagtaagttttgctgatcaagttcgcacaaacaatcgtacgtgcaacggggaaaaaagttgaatgaaaaaaaaatactcacatgaacatcaataagatttgaaatggtgcccataatgtcagcttcacggggacgatcaggctgaaatcttctttctccatcaacaatgaatctataacggtaaactccagatgcaagccctaacatgacgcagtgatcctttccacatttatggacgagttgcctgtgatacacactaacaatgtcagaacaaaatcagttctatccttaagcttcagtttaggtactagaaacaaaagggaaatactatatgctatctctccaaaaaataaaaatgtactttgatttccagttatcccatgatccttctatatagacattcttccctccaagagtccacacaagcagagtaggaatcagcttgtcagggggaccatcgtgatcctcctcttgttcactcgttaatatctggttaaatactggaggaggtccatctacagctctatgcaatggagttacaggactctgcagtacatttatatcagtgcattaaaaacacaaaacttagaacaatgacatttgggaagaggtagactgacttggcaagaaacaaggtaattagatcatctgaagcgaccgtaagattaaacatgttcgctagtagagcaactgagcaaagttgtatgcctgtactacctctgtttaatacatgagacgtcttatttttttcaaatatatataaaaaatcatgtctaaggaactgataaatcaagtcacaacataataaatgataattatattaattttttataagacgaatggttaaatgtatctcaaacagtcaacaacatcatatactaaaaaggaaaaaggagggagtattattctagataaatctgataaaacaacagtacattattctacaattttaattgtcaaagttgtaacgaatatatttcatattatgaactttctaaagaacatatatttcagatcatgtttttttaaaaaaaacaaattgttagcaaccaaaataaatcatagaatcagcgaggagtccccaaaatgcaacgccgatgaaattgtggcatgcacattacaagtgcgacgcgcgtcacatgcactgatcgatcaagaggatgtatattgcacatggatgggtggaattgaaatcgagatcgaattgagtttagcgtgatctgacctgcggcacgaacatgcgcggggagtgcggccgcgggggggtccccggcggggacgacgaccctccgccgccggagtaccccgctgccgacgacgggggccgcaccagtccgccgcttcccccggcgccgccgtacggcgggaggccagcacggtccatggggcgcagcgaggaggagtagtccccagcgccggcgcggttgccgcctccgccgccgtcatccatttcggcgtcggcgatgtcgtccagcctgccgctcgcgttgcccatctccggccaccggcgccgcaccaccttaccaagattatatacacacacgcggaagaggaggagaggaatgggcctaagcccattttttcacttatgggcccaaatatctgttgggccgaaaatgtggctctgcagtttgggcttgaggaagcttgttggtctttataagtcaagatttacattttaaaacttaaactgattttatgttttttaatcgtggttaatttaataatatttgtttttatcactaagaacacatataaaattttacctataaattattatctattatattattaaaggaataaaaaaaggagcttccacgttcgctctcatggtctagaaattctcacattaatcggagaaaaagaaaaagcaaagtccacatagaaatacaatttagtaatagctgaaatttggaattaaaaaaaggagcctccacgttcgctctcatggtctagaaattctcacattaatcggagaaaaagaaaaagcagagtccatatagaaatacaatttagaaatagctgaaattcagaattaaaaaataaggaatattagaagagaagactagagttcatatagaaatgcaatttagaaatagttaaaattcggaattaaaaaataagaaatattagaagaggagactagagcccatatagaaatacaattaggaaataactgaaattcggaattaaaaaataaggaatattagaagaggagctagaatccatatataaataccattaggaaataatagaaattcggaattaaaaaataaggaatattagaagcagagtatagagtacatataggaatttaaaactaactaaaatttggaataaatgtaataaaattaaaagtagagtttagagtctgtataaaaatacaatttacaagtaactaaaattcaaaattaagaaaaacatgggaagaagagtttaaagtcaatataggaatacaatttagaagtaactgaaatttgaaattaaaaattaaagaatattgaaatatgagtttatatagaaatacaatttagaaatagctgaaattcggaattacaaaataaggaatattagaagaggcgactagagtccacatagaaatacaatttagggatagttgaagttcggaagtaaaaaataaggaatattagaagaggagactagagtccatatagaaatacaattaggaaattactgaaatttagaattaaaaataagaaatattagaagtagagtatagaatccatatagaaatacaattaagaaataataaaaattcggaattaaaaataacgaatattagaagtagagtatagagtccatatagaaatacaattaagaaaaaaaatagaaattcagaattaaaaaataaggaatattagaagtagagtatagagtccatataagaatttaaaactaactaaaattcagaataaacataataaaatgaaaaatagtgtttagagtccgtataaaaatacaatttacaaataactaaaattcgaaattaagaaaaacacgagaagaagagtttaaagtcaatataggaatacaatttagaagtaatagaaatttgaaattaaaaattaaagaatattgaaagataagtttagagtccacatacaagtacaattagaaataataaaaattcagaattaaaaaaagaaatattaaaagacgagtctagagtccatataggaatatatataatttacaaataactaaaatttgatattaaaaataattaataactaacacgtatataaaatacaatatgaatattacacattagtagtttcttaaagttattgcaaaatttaaaattatgttgtcattgtaatatattttaataatataatgagaaaacatatatgctattatatgagaaagaatataatgatgctagccacatgctagttttactaatataagcggtacaaataagcataagaataaatgaaaaggtggatgttggtttctcatacaaaaccagctaataaaatagagtggaaatggataatataatttgaattctaattgataatttaaaaacctctcataagtgttttttttcataaaattggttggggcttttcttcacaccggcctgaccgaaaaaataatactaatataataatttgcaaaccttcatatacaataattttacagccctgcagtttcaactagacaaaacttaattatttcactatgagtgaattcaattgatttcctagataataatataatttaacctccatatatatacattattattcatctactaattaggagtaatagtgttgtctaccagcggtgcccttgtccgccgtgatcatacgactgaaatgtttgcggcggcaacggcggagtcagcaccggcggtggtacagctgcgacgggaggcgccgccgccgtggccgacgcagcataactggcacagtatgctggaggcggcggcggcggcggcgggagatcaatggtggagtcaacgtagtgacggtcggcgatgttggagtggcggccggtgagctcctgcacgacggcgcggaactcctcggggctcgccgtcagcttcatggggctggctatgtacaccaccctcacggcgccagggcattgcggcggcttgtacttcctcgccgccgccttccccttcttcgccggcggtggcttcgagatgccgtgccgctgccggccatgctgctgcaccccgagcatgttatctagagctttttgtgagcgtggtgtgcagccgtacgtgcaatgtgcgtgcctttatagaaacagtagccctgtttcggaacgatatcctgcagtaacagacgaaacagtggtaattttctgcagtaacagacgaaacagtggaaattttgggagaattggatcagagcattttcattgggcggctggggtgagagacaggagtagatattattgtgccagttaagtttttttttatatgatgaatattctggccttttttttaaaaaaaaaagaactggcattttcttcaattaagatagaaaccacttattacaaaattttgaacgtaatgaccaaagatgatgagagagtaagttcgaacaacaaaaggagaaatcttattcaatcctatgtgtaaactttcatccaaagttaagccaatatctacattaatggacttcaaattccaacatgcagtatgtataaatcttttatccttatcacacatttgtagttaagttcagaatctgagctagtatgctatgctaccttgaaaaaatcctgcctataaaatttagttggagatttgtaccagctagctactgtagttattaattttaaccatagaaaaattcacgcatggaaggaaggaagacaagacaagagacttgttggttcgagttagagggaggtcacccagtcaagtactcttacccaaaggataggttggaattaactgagataacccattcaaagtccagattcataggatgtgtttcatctatctacaaacaagaagttatctaggtaaaaagatgaacggtaaaaccagattgctagctagctagctgtctcacggctattcgctctctccagtcagtctctagccaattggctagcaggtaaacacaagttattctcttcagtcaaaaaatgaagtcgttttcgagtatatatattatatttggattctttgaaagcaaaatcatccagcgcagcattgatcgtcagtgatgaccgtcatcgacgatggcatcgcaaccgctcgacgacgaattgaagaaggtgggtgtgctagcctgctactattttttaaagacttgagaaattcagagctagaaaatcatccattcgttttgagtttgacctgccgatcgattaattatattccttgagatcgatcgataaattgtctcattcacacggacccaaggcgctcgtacatttcaacatccgtgcgcacgcgcgtgcgactgatcaggatatatagtttttggtgatcgataaaattcccaggtagctagcatgcagatgcagatcatacttatgtgcctaatgcatgcctagactagatcaatcgatcgattgctgatcgaggacaaaagcaatcaggaatccagatgcatgcattgtcgattcataattgactaattaagcaaacgcatatccaggatcagatactagtccaattgagtgattattgaccatatagcttgagtacttttatggtacattctagaccggtatacgtactaatagctgctgtttgcagtcaagatacatatagatactagtactacagtcaatgtctatccctttcacgtagctaccgccagtaaaaggcagaacgatgagagagaatctcattgttcatatatgggctttcaattaattcctcgcaatatatattaccagtactgtacgaatactagtattaccagtcat

SEQ ID NO: 44462 - DNA, 2852 bp, Oryza sativa
gggcctcattcttggtagggaagcaggtggaaggaggacaggaaggcccaatagtaagtaaaatgggccgtcggatgacatgtcaggcccaagttgaagtgagcccatacagcgactccggccttgttgacgaacgaacgaatgatgcggaggtgagggatctttctcttggcttcactcgtcttccaatccttcttcctcctccctcctctcctctcctctcctgcagcagcgcccaccgccatcggagcctcgccctcgcgcggccatgcttggtctgaggggagccagggcggcgcagctcccgtacgcttccgccgccgtcgctcccacccccacgccctcgttttccggcttcgcgcgccgcctcccgctcctcgcctccgcggccctctcgcctctgccgccctccttctccttctcctccgcttccgccgtcaggagggatagggaccctcccatgcgtcccgtctccggcgccctctccaggtccaggccaaccaccaggggtgagtcctcgtgctactcatttacctctactctgctgctgtatatgtatcgtatgtccaccagatatctagctattctcgcatgtgccatccgtatcaatactaggttttgcttcattttatttcctactatactatccggttactagttagtactagtgttgtttgcatttgtgtgcttcttgcatggtgccacatggtttcatcaagtaattgacatgaacacctgtttgttagttttctgctctgcggctgctactgctcccagggagggcaaggagttgcttgtccagcatctgctcgtcggcgaacaggatgtcaggcttttggtcgatcttgaaaagaacatcattacaggaggtactagtactagtattcatgtggatgctgatatacactttcacataaacatggagactaattaaaaggatattgctcagcatctagcttttttgtgtgtgtttcaggtgcagacttgagcgatttagctgtcgagtactctttatgcccatcgaaagaaaatggtggaatgctggggtgggttcgaagaggacagatggtactccatttacatgcttttctggcatggtagtagcgacttttcatctaggactttacatattgttaattgatcaagggctgatcaaaactacaaatgagctaatcacatgcctaaaatgtactatggaaccatccagtttctctgactatgcttggtggtgctgataaggtccatactccatacaagatgcagttggaaaccttatgcttggcagtataaatttttactttaccactaaaatttggcttgactttcgttggtcaacttacttctttatgatggttccaatttgttaggagttcccaacgtcaccaattggcgaactagaaaaatgtagaattaattgttttggtattggtacttggttgcttgccttggaaactaactgctgtgaattcatgccacaagttttgtcttttcttattaagcgcattgatactgatgtatgtactttatctaattaatttcaggcctttatgacatacacacctaaatccatctgccccttattctactctatgctagctctcttctcacaaccattaaattcaagtgtgacaatcacttgctagcttgatgtgtgaagctccaccaattttgtgtgtgtttttttttccttttctcttttctgtaagcaccgtgaaggcattaacaatgtcttcaatggagtttgaacatttttacttgaactgagcaggttccagaatttgaggaagcagctttcggtgctcctttgaacaaggttgtacggtgtaagacaaaatttggatggcatttgttgcaagtgcttgctgagaggtagatacttgtaacaaaattatgttctatgtatacaaacaatatttattgatttcttttccacctaacttcagagaacaatgcgtagtggaagacattccaccagaggagcttcatgcaaaaatgcaagatcctaactttcttgaagaagctcagttgattgatgttcgggagcctgatgaagtgtaagatttacctgtgtcctgattgctagaataatactcataattacgcatcagtgaaatgatagacatgtttaaccaaaatagtactactaggacctgtccatttcttttaagagctgtccttatattgccatcctcacacagaaaatgagcttcattttgacattttgtacttttctaaactatattccagtgaataactgttacgacatcttcgttgtggttttcaaaatacacattatcaggagtaaagaaaaactgttaagatgatcaaacatgaagtatttatctccatatccatgatgttgtggttacctagttcagtacagttactgttattgttcgcctattcgcatgaagcttatgttgagttttacttcttgcatggcagagataaagcttctcttgaagggtttaaagttctacctcttcgacagtttggaacttggggaccagttatgacagatgaatttgatcctcagaaggacacttatgttctggtaagttggttactcctctaatgaaacttgctgccagtgtgcatccataaaggccaagtacctgtcaaatgaaaaagagagcaccagtacctcctacatattgtgattttgagttgatccggtgattgcggaaggaagtaatatgcacacatcattggtacacacatttgcatcaatgtgttattattattcattctaacacttgtcctttcatatttgcccccagtgccaccatggtatgcgctcaatgcaggtagctaaatggctgcaatcacaggtaattgaagtactcgcatag

SEQ ID NO: 44463 - DNA, 15683 bp, Oryza sativa
  unsure (1)..(15683): unsure at all n locations
agtatagaatgataggattttccacgatgattttgtacggaatatcggtaccagaaattcagagttaagttttgtcgttctcatgctgctgtcatgtactagcagttctcttgaaattttatatggaggatatatcacttttattagtttgaatacaagggaaatacctgggaggaacttgtgggactgatccaggctcatggcctaaatttcattctgaatttctgatcaaacatgctttgatcattttatttacaaaaaaaaagtgctttgattattgggaaacgctgaaattctatacggaggttaccattttgtcagcccgaatagaagagatacctgggaggaactcgcgggagtactgatccagtattgggtctcatgaccaaagtttcattctgaattttctgatcaaacatgctttgatcattgaaaaaaaaactttgtgattttatcagtttcattctgaatttctgacaagacatgctaacttaaaaaaaggaagtggaggtgcggggaatcgaaccccgtgcctctcgcatgcgaagcgagcgctctaccatatgagctacacccccatttgtgctattcgttgaactctcacttactaattatatgtaaatacaccatatttttgtgagatgatttgcaccatgtcgccgtcgcctcctcctcctctgtctgcgccgccggccgccggcgacggcttgctcaccaggcgttcctcctttggtgtcccggcgttttcccttgagttgaagtgggcaagtcaaagacggagattagcaagaggaggaggagttggtgagcggaggctaagcggcgggccccaccagcgccgcctgcctatccacaaagttgcgtcacgcgacgagccaactgttgctgggcccacctgtcatcctcaccccaccccatgcaccgagtccaccccgccctccccccactttggcgccttccctctctccacctcctccactctcccaccaccacgagaccttctcgaagcttcctcccccccaaaccccttccgctcctcctcctcctcccaaatccaccacggcgacgccgccgccgcagagcccctagctcccggaggtccctcgcccccgccagctccgacggcctcacggaaggaggagtaacgtgggcgttgattggatttttttgttttccccccaccttgagtgagtctgtgccgtttccccggcggcgagggagggcagagggctgatcatggtcgtgcgccgccggtgccttgccgagatttcccccaaccgccaccgacgatcgttcactgtatgcatgctctcgctccccttcgtttttgagttggtttcgattatcaagtagtatgtatcaggccgggtattagtattaccaccaaattctcttatgctagtgtgcgcccgctattgctctagtatttacaagctgttatttttactccttagtactacttgttttggtcaaaattcaaaacgtctactgtacctgttgtattggaaattttaaatggttcatgaatgaattcactacccaagaacaaagcttgtccagtaatgacattatctattggctcgatttatgtttggtccagtggcacaaaggggagtagcactgtccaagctgttgtggtccgtcagggagattggccaacctgtggggtttcagatcgacataagtacgtcagtgtgcgtattcttgtccccacgtgcttatcatttaaattcttctactattatgttttctactatgtacgattgctgtaactcctgaggagttactgtctttgattagaaagaatttggcgcaagcatgtactgtacgatatccttagctgtttgaggtttcagtatgtaagctactaagtcgtcaaagatttcccttcttttttttaaaaaaaaaatgatctgtagatttcagccatcgatcaatctggcggttcatagggctgtgcttgcaacctttctggcagaaaggagagagcaaagtgatttgctgtctcctgttgattgtggcctgttgaggcccagtaatggcagatgctagttcaaggactgacacatcgattgttgtagacaacgacgacaaaaaccaccaggtaatcctttttgaggttgtcatctttcctttacacgttaagatgccatcaaattgactgctagagctcaagaatagagctggtgctgttagggtagtaacttcttttctcgttttctacttgctatgagttggataattgagagatactcaaccaatagtcttatggagaatggagataccactgactatgacagtagtaagaagaatcacatgtaattgaccgtttaaaccttgcaattcttgtgctgtttcatctactgacactgaagcactcatacttttaatctattttatttactgattcgcaatgtcatgttttgctgtagcaccctgataacatattgatactatgaatccactgccaaatagtgctctaaatatgctcagttgctcaaacttgcagttagaaaacggacatagtggtgcagtcatggcttctaactcttcagatagatctgacagatctgacaaacttatggaccaaaaggtgacattttagttccgtttcttttcgtatacaatgtcacttaatcttgtgtgattaatttcatattgtattttggcatgcaatagacaattcggcggcttgctcaaaatcgtgaggcagcaagaaaaagtcggctgaggaaaaaggtactactgcagatttgctcttatgttcgcttttgctctgaataaaaaagccttgtttggaaaagcataggattaattctgtgaacttacctgtgcaaactaggtctatctaatttgaattgtcgcagttgttatctcttttatatgggatggcaagggcttaagtcaaatatgaatcaagtttaattgtttaattgcagtttttagtgatagttagttttgatccaccatgacatgtattttctctttgaacatttaaggcatatgtgcaacaactagagagcagtaagctgaagcttgcacagctagagcaggaacttcagaaagctcgtcagcaggtaaaatctttatggttgcatgctggatcatcaaaaaatagttttgaaaaatactaccttctgtcctcagagaattcttggatattcaattgcagggaatcttcatctctagctctggagaccagacccatgccatgagtggaaatggtaatttgtcatattttcatcgcttggtacccattaacattttgtgtcttgtgtacttacattgttttatctttttaacagtttatattaactgtttgctgcatgctttctaaaacattaagcttgtgttttgcaggggcattgacttttgacttagaatacactagatggctcgaggagcaaaataagcagataaatgagttgaggacagcagtgaatgctcatgcaagtgacagtgaccttcgtcttattgttgatggcataatggcgcattatgacgaggtattcaaggttaagggtgtagctgcaaaggccgatgtgtttcatatactttcaggcatgtggaagacacccgcagaaagatgcttcctgtggcttggtggtttccgtccatctgagcttctaaaggtgaccgcagattaaatctcaatattttcttatttgtctgatgcccctttctggtcctgtaatttatactgatttcaccatatggtacaaaatttcagctcctagcaaatcacctcgaacctttaaccgagcagcagttgctgggattaaacaacctccaggaatcttctcagcaggcggaggatgcactttcacaaggtatggaagcactgcagcaatctctggcagatactttggctggatctctcggttcatcagggtcttctgggaatgtggcgaactacatgggtcagatggcaatggccatgggtaaactaggaacgctcgagaatttcctttgccaggcaagtatcttcaccttctaagtgtcatcgttcttctgcctgacaacatggatttattaactggtgattcgtgtcagatgtcgcctttgcagtgattaaagcttagattttgactattcttttggtttcatttttgtcaggcggacaacctgcgacagcagacattgcatcaaatgcaacgaattctgacgatccggcaagcctcgcgtgctcttcttgccatacacgattacttttcacgcttgcgtgctttgagttcgctgtggcttgctaggccacgggagtaacaaaatggtcatgtgtgcctgtgacgaggttagacgctcattttgatggactgcagataattgggtttttccctgtacaattgtgtttggcagctgtggactaaagttaaaaactgtacctaaagtggtgtatgcaaataggtgaagcctctaagtaagttataacgattgcattattgtgttagcaataaaagttgggtaattcaggatgtgtcctgagttgttttgttgtagtagaagaactgcatgtagtggctggaaatgcagtgttgaatgtaactaaagctctgctgctcacgttgcataatgttgtgtagtaatagttagctagtgatgcccattttacctgcactcctctgggaagctgaaactgcaacctgaagcaaccacggtgcagaagaccgcatgcatggtaaatgattaaaaggatatatatgggctcaacatcgctgccaaatcctgagataatgaacaggcatgctaaactgctacttccacatgaaacctcccagttgacatgaagaatgagctgttcagttttatggtttctgtgttgcactgtacataattcctgtacgggtctgaatttatcctgaaatcatgctaaactgcagaagcatatgaaatctccagaccggttgacatgaaagatgaagtgtcccagtttttacggttcccgcgttgcgttgcacatgttttccgtatgtttaacgggtccgagtttatcctgttatagtattgacaattactgtaccattcacaggtgattgcgacctaagaagtcatgacatgtaacagtaacgaaacaagaagaagactggggattcgtgtgacaattttagaaaaccgtcggcagacaaggccgtctgccccttgtactctagaaaaaaattgactaattaatggccggttagccaaaatggccgggtctccctttcctgatgtgagtactgaagttaacggcaagacgatggcagcctgcagcgcgcggcggtcgctgtcccaggtgactcaatgcacacatatatactacgtatatgactcatttctacgtgctcatccaagctgagctgagccgtagtcaagctaggcaggaaacacattacacatagatggatggatagacggtggatggagtgctccttccattccaaaataaatataagtatttttagcgcagtgataagtcaaatattttcaactttaactattaataaaaaaataaaaaaatcaatcacgtaaaattgatgtcactagatttattattaaataaactatcataatatataactcttttatttaaaatatcttacttttatatagattttgttggtcaaaatagtatatcagaaactatgttagagtctaattttatgactgagggagtacctgatttgtcgtcgcccgagcggtgagggcgatggtgaggcgacgaatgaaggtacgtgccatggttaggagggagcaagacagtgttgacatgcatgcatcgcctactctcaaactctgttttgatttgatctgtttccttatggttttcgttcagcgcccttcgaattgcctcacgaattaatcctcaggcagccaggcgatgcttactttgaacctggcactatgacaagggggctactacttgctccctccgttttatattgtgcatcatatatttttttttaaaaaaagcaaactactctgtgcttcatttaatgtaagtatgtgatgaaaaaacataaaaagagacatactgacttgaactccctctacaacacttacattaaatgttcgcatgcaacatagatacaaattacaataagattacatgtgtcaaacaaaaggaccaaggccatagttcacgtgccaaaatttttctaagtatacggacacgtatttgaagtaacaaaacaaattacatattaataacaaaacaaattacagattccgcatgtaagctacgagacgaatttattaagcctaattaatccatcattagcaaatgtttactgtagcatcacattgtcaaatcatagcgtaattaggcttaaaagattcgtcacgcaacttacatgcaaactgtgccattggtttttttcgtcaacatttaatgttccatgcatgtgtccaaatatttgatgtgacggaatttttagaagttcgaaggaacctaaacactgcccaaggtaatattaataataactttagaaatttctatttttggataatgtgatgatcaatatataacggagagactactttactaaccgtactatttgttacttatcggatgatgcagtttgaattggttaagtggatcaccggtgcaattcaagcagcaaaagaaagaaaaaagaaacgggtggataattaaggtaggtagtacgtggacgtggttgaagatgaagggcgttggccacgtaccccgacaggtgtgcaaattcgattgcgactcaggagacaggagagtgcatgtgtcacccgtccatcgtcatttgcgcgcccaatttccaaaataagtgcagtcgtaaatatccgtacccaacgtttgactatccgtcttatttaaaaattttatgaaaaatttaaaaatatttagtcacacataaagtattattcatattttatcatctaagagtaataaaaatactaatcataaaaaaatttcaaataagacgaacggtcaaatattgaacgtgaacagtgtaaatgtgtacttattttaggacggagggagtagtctcaagttttgtttcggataaggtagcgtactcgatccatgatccgtcagccagtaattgaattgaattgtcctaagcgtgggcggtgcaccgaccaaaccaccccctctcctgtgcatgtgctgctgatgctgatcgatcgtctctggaacccattcttggcattcatgtcaattaacggcttgatgatgatcgctttccaaaccaaacgacatgtacatgacaacatccgaaattaccgcttcattctggatcaagacgtatctgatttccttcccttttttatactcttatcttctctttcatttttcataatatctcttgtttagatttttcttatatcatacctttcattctttaattttcacatcttaaaagaaaagatatagtctacaacacaggcctaggtacgtagttacatgttcagatcaggacgctaagttatcaaaatattgattgtcttcctccctccgttccaaaataagtgcagttttgcactatttacgttcaacgtttgactgttcgttttatttgaaatttttttatgattagtatttttattgctattagatgataaaacatgaatagtactttatgtgtgactaaatattttcaaatttttcacaattttttaaataagacggacggtcaaacgttgggcacagatattcacggctgcacttattttgagttggaggtagtacaattttataacttgacaatcttatttaagatttttgattctacaattctatatgtacttagagcttgaaacttttagttcagaatcgtgattttaacaacactgagaaagacattgacaatatcatagaagctagtacaaaggtatatagaagaaaaacctttattaactacaaaatgtatcagcagtaacgtacatgtatagtaggcagatctgtttatagttagaccaaccatatacgtacgtatttacaaactgaatacagactttgggtgttccctcgtactaaacaaaagaaaaaaaaacacactcaaaagtaagaccatgaccgatatatctgcaatactaaaatgtttatgcagatcatgtcccctaattaatcatagctagcactccttaataagcgccaattattattgtagctatcaagacttgacggcggccactgccggcgacgagcgcgcctacgcggcggagggcgccgggaagtacttgacggcgccggcctcggcgagcgccgtccgcatcggctggctggcctcgtcggcgttgtcctcctcctccttgtagtcgaggctctcgtcgttgtagatgtcccaccacctcttcaccagcatctttatatcttctctgttcatgttctcctccttcccggtgaacctccatggcttcgaaccctgcaatcaaatcatgccatccatcgctcgatcagataatcgatcattcaccgatcgattcatcgaattatcgagatgatcgatcatgtaatgcttaccgctgcacagtaatggacgaccttgacctggtcgaggtcgacgttctccgggtgcctccagagcatggcgagaacgaggttgtagacgttggggatgggcttgtactgttcgcggaagaacatgttgaggaagtcctgctcggcgaacggggtgggcggcgtgacgacgagcgcgtcgagcaggtccttggcggtgccgaggccgggctcgtggacgaacatgccggcgttgaagtagagcggcggcggggggccgagctcgcgctccggccacgccacctcgtcggggcgctgctggcagtagccgatgtcgtactgcggcgtgtggctccacgtcttctcgcagaagcagtccttgacggcgtagaaggcgcccttgtcgaggtcgaacaggtggtcgatgttgtcgaacacctgtatgtcggcgtcgaggtagaccatccgctcgtactccacgaactcccagatgcggagcttcgagtagttgatcacgtagtaggccatggcgaactgcgtctggctctccggcgggtacaccggctgaatctcccggaccacgcacccctgctcgaccagcttccgccggtgctcgccggggacgtccgggagcacggcgaccaccagcgggtacgccgagcggacgcggcggagccccttggcgagccccacgacgcccttccagtagtcgccgtcgccggccaggaacgtcacgtacgccctcctcttcgccgccgccaacgccttcttctccgacgacacgttcggccccatcatcgatcgatcaacaaacaagctttgcaaatgatctagctagatcgaaatttgcaagagaaatgttaatttgcttcaatggattggtgtgctgcaagattttgatgaggagttcgtagcgggaggaggagtttaaatagggagcctggtcgcctctacccgtggcggttttgcggttgaggacggttatctcgggggatctgggacgtacacgtgtccggcacgggagatcgaacggctgcggtggaaaggacgggcctcggcaggttggcgcgatatttctttctggatttatgaagtggggtccactgattaagtaaggctgggtgcgatgaatattcggcgtcatggtatggccggtgattacgtgagcaaaatcgaaatggataaagtgagtaaaaaaaggaagaaattattactgacctggttggtaaatgtaaattaaaggtaagaaagttaaggcggttggaatgtggtagatagctctctcgatcgaatattcgatcggatggtgtttttttttactgcctttatccgttgcagtttggaatgcaatggggatccttccatatttattgatttttctttccttttatttctggccagccttcaaaatttaggctgttgattttaatcggggcgggtttactgggatttgatcggaggctaccttcaattcctttttttttatctcctacattcaattccttcaattcctactgccttaactgaatgaaaggaaatgaattatcgaaaagaaaagaaaaagtaacggaaggagctagaagctggaatgaggagcactcagactatatggtatgaactttgggtatgttcagtaaatgggggtagaaaaataatatcacatcttttaaaaataatattaattgcatcatagttatttatttttcacacctcgtttaattctagtcattcattcaatcgcccttttcattcttatacatctcatattacctcgtttgccaaacacaccatttgtggtttaaaaaatctggtgttcatttattcggaaaataaaaaatggtctaagagacgacgattacgccatttgcataatatattataataattcggatggaaataataaagggaacacgtagtatattaaaaaaaaaagggcttgcatgtgtcgctggagtaaagaaccaacctgaggaaacaatattccgatggttcgctttatatatccgtgaagggaggcacgtggtgaaatgggaggggattgcatggaaagaatatgcaaatctcatcttcatttttttttggttggggataaacgtgcatggccggtatctgcagaagcctctcctccagtcttttaatttgtttctagagtattttggcaatctggctactagctagagagtaaaaattaagaaaaagaaaagaatctggaactgctgctggttgtagatgggcatatcaagggcagacacatgtacgtacgcgtgggtgcagaattaagaaacgattgatccattctgttgcaacaacacacgtagtagatcagctggtatacctagcttacccttgttgggtcaaattaaaggtctcaaggatgacatatgttgcgatctggtcggtgtgtgtgtgtcattcatattcggtcctgctatgctagctgcttctgcttcttcttctccttctccgctatatgcgcgtgactcgtcggcatggccgcgtgcgcgctgtcctgtacaatatctactgtccgtaataaatataaataatatgagcctatttagatcgtagctataataaatcttatcaagtttcggtaatattgttaaaattttggcaggatttcttacgtattgaccaaatttagcaacaaactaaatgtaaacattttttttaactttgtaaaaaaatggtatggttgaaatggtatcaaagtgaacatgccctatataatatagctagataatataagtttatataagttaacatggtttacgataatttaaaccgtatacataatgatgatccaaatgtaaaagtaaggtgatgtggctttacgagagaagaaaaaaaggaaggtaatttcgatcgtagcttaattaatcatctaagggttaaaaataattaagatgatatagcttaggggcatccacaatgtagtgcaaaagtagtccataagcaatacaatattttattcagccacctagcaatattgtggaactagtccacagaaaagaataaataataaatgctacccataagtatatgggatggccatagagaataaaatatgttatttgtctctactttctctctctcctaatattatttgctatatatatacattgtgaaggttacaatagttaaagctcatatatatatatatatatatatgggtcccatctatatggactagtttttctatatacattagtgttgccctgatgagagtataaaataagaaaaaaaattggactatagattaatcatataagggcttaaaaaaattgatacgttatggcttaatgagagaagaagaaaatagcattaactaagtgatgatgaactctgtaggtatatagagtcctatgaaaaatagtgaagaaatatattcaaatattatatgaattatgtgggatgatgattttatagaattatagataatacaacatacttgtatgatattttagaatggtgcaaagaaataacaaatcctatcatatcttataacccactaaattctaaagttcaacatgcaagtccttgcatgttaaactttagattgcatgttgaactttagaatttagtgggttataagatatccttgcatgttgaactttaggatttagtgggttataagatatgacaggatttgtccttacaaggtttggttcacttcaacaccgatccacatactatacacattttggctgtatatatccacacctgaacacattggcttctgggcatctcagtgggggtggctctgagcatgcgggataggagcttgactagcatgacgaggcagaatccccaaccctcacgcgcacaagtgaaggcgacattatagttgcagttgggacccagccgccacacgtgcacaggtccatgacgcgatcactcccggccgttgggagccactcacccgggggccttcgtcgctgagcttgtccccgatggctgccacccttctcccctactcattgtcggctgacctggaggttgcgttgagatgggaaggaggtggaagaagattgccagttgatatgcggggtctacatgggtcccacactgactcaaccgtcaagtcaccaaaactggagagcgatactgtcttataaccaaatgtgacatggttttacaagattctggtattccggttcaaggacgggtttaacactcgatgacaagataaaggactgcaggtgaactttttccgagatgaaaaatttccagcctcatgggcctgtgcatatgacccataggccataggcaggccgcaggcggcagcagagcgacttccccaatccatcatcccgtctccgtcctcgcccgccgccgccgccgccgccgatctccatcctgcgaggtggcgccggcttccgccgcatcatcgctcaccgttgagcatcctaatccatcccatccgccctcctcgcccgccgcttccgccgatccccatcctagccatcaccatcacgcacgccacgccatccgcctccatccctcgccgccgccgtgcaccaccgccgtcatccgcctcttcctcttcttcttgctccacaagtaatctcatctccctcgatctcctcttctctccatttctctccgtgtagagaaaggaggtggagacaggggttggggaacaccgccgcgtagataaggcccttcttccattcggtatgcctatcatttttcgattttgcgcaacacgtgatcaattgttctgattatatttcaaataattaatcaaattatccagctccgtaataattagggttccccactttcttcatttttttgtacactgataattgcttcaggtcaaaattgatacaacaaggcaaacacgcactatctttgcaatacattaattttaatactacacaaggcaaacggcaaacttctttattttagtaatcgtactacatttcagtgttgttctttcgatgttcttgaaaatcaccacaaatttagttttcttgaatgccagtttttagtaccgcaatccaaattcagactttcaatatcaatcatttggcaattaaaaaaaaatcacatatagatacaaagagattcattttactttgaacgctcccatatcatgatatggagctaatctgctagtcaaacacttctaaaagggattatgactgattaaggggaaatcaagattcagagccttaccaaattgtttggtgaatttgttagtgtagactatgacttcagtaatgtgcaagagtagcattaaagtagaaaagtacaacgtagagttctaacacctgtttagaccgtgctcaaatcctttcctcgttattgtggcatggtgcttatattataactgattcaatattctgaataaacctattccaggttctatcacagagatgatggctgtgacaaatggagtaatccatgcatcttctagggaacccttattttccttcggtgtcattgctgatgtccagtacgctgatattccagatggtcgctcattccttggtgtcccacgctactaccgtcatagcatcagcgtcctccaaagggctgtcagcacatggaacaaacaacacaacatcaagttttcaatcaactttggtgacatcattgatggatattgcccaaaggacaaatcgttgtgggcagtgcagaaggtccttgatgagtttgagaaatttgatggcccaacttaccacatgtttgggaaccattgcctctataaccttcctcgtggcaagctagtatcgttgctgaagatgccaaccgattctgatcgtgcatactatgacttctctccatgtcccgagtacagatttgttgtcctggacgcttatgacttcagtgcacttggctggccccgtgaccatccagtgactgccgaagcaatgaagttcctggaagaaaagaacccaaactctgacaagaacagccctgacggtctggttggcgttgaccggcggtttgtgatgtttaatggtggagttggtaaagagcagttgtcatggctcaatgatgtcctccaggatgcatcagcacgccggcaaaatgtcatcctatgcagtcatctcccaatggatcctggctcagcttcttttgcagctctcatgtggaactacgatgaggtgatggctattgttcgccagtacaaatgtgttaaggcatgctttgccgggcacgaccacaagggaggtcactctgtggactcgcatggcgtacatcaccggactcttgaggctgcattggagtgtcctcctggtactagtgcattcgggcacatcgaagtgtatccagacaagttgttgcttgtgggttctgataaaatggctgatactgagatgtgttttgagccctagagtgaactgtgtagcggagggaaattcatccaacttcattgttttgattaatattcagaaacatgtgacttcattatactcattttctggcagcataattacatgtatgtaatagcatggaaactggaggtggcagcagctgctatgcttgccgcttaatctcccctcctctctcccaagaggaaagaggcagcaagatgaaaagcaaccgaaaggtaaataaagtaggataactttttccatgataatatcacaaattagaacatgcttgtttcttgaatattggacaaatatcagaaaatagagtgtggtaattttagaaatgaatcaatccaacgattgcttcttgcctgttccctttgtttcacaaccacctatgggtattcaatatgctaatatttatctggcattgtttatgtgccatatatctcactgtaactgcaagatgcagagaatactatcttcctggggtggtaccttagcttttgcccagtaattttcaccgttaaccatattttcctgaccctgtttggatttgtaatgttttcaattttcctttaagagaattgaaatggttcctgtagatagtcttttctgtctctctacttgtgtgaactctgaaccaacattggtcaaacttatgcagccaatttgacgatcaagtgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 44464 - DNA, 794 bp, Oryza sativa
aatagtggaggatgttctcatcattcccacccccttcacaagggccctgctctgataccaaatgataacaatttggcccaggtagggtcagccgaggcccaataacttaaggttgcctggaccccaacagttctttaggcacacccactaagggaaaggcccaatctccctgaaagactagtccaataggggaagggtggctctcccttttaaggtggcttcctcctcccaagctaagcaaggtgggattattcaaagtctcacacggtcgccgcccgactttggcgtctttgccagcgggcaatagtagaggatgtcgtcatcacgcacgatccggtgacggtgacgggagcgggcggcggatccggccacggcgatggcgacaaagacgacggtgacggcgatgacgatgggaaggcggtgacggctagtgttagggtttcattttttcatttttttttgattttttatttttgcatgtgggcgacaaaagcaccagcacgcgaaaatccgattttcgcgtgcaattgcaccgcacgcacgcacagatagcgattttcgcagacgaattgctccagacgggctgaagctctgcacgtgaaaatatgttcgaccgcacttgaaaacattttgtgtagtagtgatggtgacaagggtaaattttagattctattagtaattggatatcgcacgagtgcaaagcatatatataagcaaacaccggtagaagaatggtcgatctgcaacctttatcctcagcatatatagaggaaagcatattaaaatgttgtggg

SEQ ID NO: 44465 - DNA, 5804 bp, Oryza sativa
ccccttccgggggggcccgagccatcagtgagataccactctggaagagctcggattctaaccttgtgtcagacccgcgggcctttcctgcgcagcttaggtggaaggcgaagaaggcccccttccgggggggcccgagccatcagtgagataccactctggaagagctcggattctaccttgtgtcagacccacccgcgggccaagggacagtctcaggtagacagtttctatggggcgtaggcctcccaaaaggtaacggaggcgtgcaaaggtttcctcgggccagacggactgggttcggtttcctccaaagaattagattacattgaattattttgaaacgaattagcaattgaaccgctctgagccggctgaaccgggcggtttttgggcgaaccggacattaaaccggcactagttggaccggtagccatactaatgggctgtctaacggcccatatggtgcagctgggggttattttggcaaaaatatgaagaattggtgcacctagtgggaatcgaacccaggtccgctagctgaaagtgccaagcgctagccatcagactatccgacagcatgtgatcatgagcaaatatgtagtgtacttgtatattgagaatcgtggttcgatcgtccgggtcaccggtcagaccggcggaccgctgaaccgagaggtcggccgggtcacccgccggtccggttttttatactatggttctgagttctaaaagctcctttggttgtctcgtagcccatccacacatgctactgacgctacaagacttattatagtggagtacatcccatgccaagggaaaacaaaacccatactgacaccactcctacatctcacacactgccactagagctgtcactacccccacccccacgctgtagaacagtaatggtttcactcaggtagcggacgcggtggtacaggcgatgggtgaggcgctccagaaacataacttcattctcactagagcgaacaatagtcagcagttctgcacagagcttctcagcctccaccaccctaccacgcaagcgcgccacctgatggcgcagatgctgcacctgagggtaattgacatcccttatctcaatttggcgctctgctgctaaggcgtgtatagccatgagtgaagcagtttgctcagcttcagctactgtggtcttagctgcctcataataaaggtagggaacacgatcagccggaccaaggttaacctgcacccctacaacatgcagtccagtggaactatatatatgcctcccagtaatagtcagtggaccaaggtcaagcatgcgtacaaactcttctaaaaagactttagcaggaacctcaatgtactgcgtcatacctggaaaaacaatcatacaaacaatttatattatttaccgtagaaagctgacatgtatcatcctgacctaaggctatatatgaccagacctagaaactatcaacctatagagtctcacattttactgtaccagttcaactagacgacaactacccatgcattaaggtctcctgtcttaatatgcattaattttatctcctttttcaatttatattattgtcaaataataatctaattctaatatggaacctggctctgataccactccaactgtcacgacccaaatatatatatatatacattttttttttgacagtctgccatatccttatacgcatatatactagtatttatatatgtctacaaggatacaaggcaagatgcaatgtctaaccatcacaactggagcttggacacctacaacagtggttccgtttattattattactttttttaccagctacactgcatattacatcagttggttcactgaccaacttattgtcactaggacaaaaccctatacttagcatgcaagtatgccctctggatgtctctaaagactaagtagaccacactccccactgggtctgtatgtcatcattcccctctgacatctcatattgactagtttctgcgcacatcaaatagtaataatatatgagtatgttatacatactcagcaagattagtacatatagctatatatatatatatatatatatatatatatatatatatatatatgtttataaagacagaagaaaaatactattacccatagatattaatagccaataaataataaaggacattaaatatagtaaatgaattaaaaatacactgcagaggtattaaaataatcgttataatctcgttccttcactccgtttttcccccaattagtgataccctcatctgagaatcacgccgccggattccctacttgtgtgaggcattcctcatctcacactgatatcagccaacccgatatcgttatttcaggtatcggccgtctcaggctaagtaacataatcacgttatgattctcactgatgaaatcatcaatccattattcgagtgttaataatgtttattgttagattgttagtaccaccatcttaatataatgttggtaaacaaattcagttagaggtgattaagtaaaatagttgatgggctcagtcttgcctggtttcctgctgttttaccggtgccctagtcaaatatgcaaatctttcatattaatcaatgtataaatttgcatgcataatagctactaactgcctactagagtatagctagttgatgtgactatactagagggagggaaccaactagtactagtagatgcttgcatgcatgcatgtagctgctgctagccactaaaactcgatgcatgcatgtagctgctgctagccagagcattagtcttttcactaacagttatattttctacactaatccatctacttatagctagacattagatgtttattctagccatgcactcaataaaatcaaaggacaaggttctatgtattacctgagaggcttctattagctctaaactctcaagtgtctcacagaactcttgccacagccagagcagggagaagtactactgatggacaagagttgtagggtcacgtacggcttaaatagtgcagcttccttcagtgtgaagcagacacctatccaagccatgatgatagggataggattcaccctccctcttccttacactggaagggttcgatcctatccattaacctcggtgatatttatctgtcctcctcccaaaacaattcaagaatgtttgaacggttccctgctgctactgctattactactactactactactattattattattattcactactactacatttttcatttttttcctagtttcgtcagtaagaggccgcccagtccgccgtgcgcataaatctttctactttcaagtgtgtttgtctctcttttttgggagtttaagggaaaccgggatcaagtatgaccggtaaacatttggtatcagagccaagtcgatcacgtgcggaagtccaaggcgcaatagctgaagtggcagtacaacttcatcgagttcaaccgtggaggaattctcccttcggctcagctgcatcatcacgtcgttggcgacgctcaggccccaatccctgagtccaaggtagttgacaagctcttgcgggttgtgcctgagcatctctcgcacattgcttgctccatgaagaccctcctcgacattgacactctatcactctatgaggtaactggccgtctccacgacgacaaagagcacaagggtcgctcctgagcctattcatctcgcaaggccccctcaagcccctagtcccacgcatagtagagaaaaccgtaccggacgtcaaaccattcaagcccatggtatagtggtctagcgattgaaccggcgattcacacaattcaaatgcaaaactaggacaactatattatatgcatattcctcgtacttcatttattactacttaaaatgttactccctccgtcccatccctccgtcgtagaatataagcatttttttagagttggacacggttattaagaaagtggatagaatcaaatatgagagggttgtggttggatgaaaagtgcaggtaagcataggtgtatctgtagggtggtcccggtggtccccagaccaaaaaaaatagtgattgatcccactatatattggattttagaaaaaaaaagaagaagaaaatcccttacgcagtcattgcacggcgcatgcggaaaggcgaaaaccgaagcgtcgcggcgtgcctcagagcaagtataatagtgagctataagcctactataagcttaggtggaggagagaggtagtgaaaaattaaggatgttggctctcatgcaagagctagcttatcacaagctccaagacaaatacattaaatgtataagtgagagatagagggaggagaagaaaattatagctaaccttagagcgggtacaatagcaggctataagccagctataaacatattttaaagagataaaataggagagagaagagcagcgggctacagatttgtagccagctgcagcacggactctaagacacagtgtgtgtatgacaggtgggaccatgtattaatagtatagtaagcaactattgtatgaatcgactattagagtggctatagatgaattggagctagtagtgggctatactatatgttggctttaagataggctaatagtaggaagttggctatattattatccttgctctcaccttactcgatgcctcgacccctttttttcgtcatgccgcccgcattagcaacaagtctaccaccaggttaggaactgtcgatccaaggagtcgagaaacggaggtcgtcaggtcggagattccgctcgttcgctaggcgcgatcatggagtgccgaccaccgccgcccaccggcctgccacccgctgccacccgctgccatgccgcttgcgcccaccacgatggccggcagcgatgcccattccatgaggtgtgagacgagatcgcgacagccgacgctctcgtcgtcgtcctgatcgatcatcagcaaccaccatcagcgatcggtggctcgtcccggtagacggcacgatggtaatcttcttcaaccttttcaaacttttctagccgtataagcttttttaaatcaaaattttacttatttactaattttatgtattaagatgtgttattaatatatcacgacatatttttgggtatattctattatgtctacttgtattgtacattgtactactccctctgtcccaaaatacaaaaagttttagggttggacacggttattacaaaaagtaggtagaagtgagtggtcgagacttgtgaatggatgagtagttgaggtatgtgagaaaagtgaatagtggagggttgtgattggttgggaagagaatgttggtaaagaagttattatattttgggacaaatcctgagggctaaaagttgttatattttgggggaaaaagtacgaattagccccccgaactatcgaggtcgtccgaattacccccctaaaccataaaaccggacattcttcacccccaactatacaaaccggatgaattacccccctcgatccaaatccgcggtggttttggtctacatggcatacacatggcagtccagtcagcattttatttattaaaaaatgtgggacccacctgtcatagtctctcatctctctctcactcatcctctctctcgctggtggcggaggcaaccggcagcggcggtgcacacggcgggcggcggtgcacatggcgggtggcagtgcgggacgagcggtcggcaggggcgcgcgggtcaagcgggagcggcggcgcgcaaagcgggcagcggcgcgggacggacagtgggca

SEQ ID NO: 44466 - DNA, 1490 bp, Oryza sativa
tgttcctccccatcacgatctccctgttcgtcggcgacccctctcctccctccaccccggacggttgagacaatgtcactgttgccggtcgctagcgggccccgtagatcaagagggagaagccatcgccgtgctgcatcttgcccaatccatgacggaggagccgctagcccacgacatcgtcgacgaggccacggacaccgacaaggacgatctcgccttggccagccgccagcaaaagctcgaacaggaagacgaacacctcacgcgcgagagagaggatgagtgagagagacagagagaggagagagatgagagactatgacaggtgggtcccacatttttttaataaataaaatgctgactggactgccacgtgtacgccacgtagaccaaaaccaccgcggattgggtcgagggggttaatttgtccggttagcatagttggggggtgaagaatgtccggttttgtggttcaaggggggtaattcggacgacctcgatagttcggggggggtaattcgtactttttccttattttgggacggagggagtatatattagcatcgttagatttgcggtgtttagaaataatttttgagtcggaccacccatattctaaaaccaagattcgtcactggaggtaggtgggaaaattgaatagtagagggttgtgatttgttaagaagagaatgttggtgtataagttattatattttaggacaaattttagatgctagatattattatattttggaacggaaagagtactaaagatggtgattgttctaccaccaccaccctagtcactgacattgggccccacaatgtcagtggaacattataggcttggagtatcacctagatgtatcgggctactagtacaacagaatggtaacgatgaaaatgaatcgattaacaactcaatattggtagaaatataacaatgttgcgtcaattgctcttttaactctgctttgaaggctaactacgattatgatctcactcttttaagtttactcatgtgacaccacttttcaaaatcagggttggtgttgacccagttttcgttacacccatacgatatcataaagaaaaaaaataaaaaaaatgtattgacaagccaaacttacgaaaatgtctgggagtacacaacgcctatccccaaatttctgctcatccacccctgagcctattcatctcgcaaggcaggcatagaggaaggtgcaccggacggtggcctgggtggaggatgcggcagcgctcggagggagcaggggcggctgctgaacacggaagtagcggcggcggcggtgcacagagggagtggcggcgacggcacaaagaggcaaacaacagcacgggaagggtcaaaaacttcggcgctggcgctaagaaattgagccatcgagcgacacgcagtgggtgtgctcccgcatcgagctcggcatccacctccgtcgccatttatccagatctaggcgtccctc

SEQ ID NO: 44467 - DNA, 6573 bp, Oryza sativa
tctctctctcatgatacatatatgtatatatatatataagaaaaagtacgaattacgatcaaattacccccgtgaacccaaaaacagacattgttcaccttgaacttttaataccagacgaattacccccctcgacccatccagagcggttttgtcctatgtggcgtacgcatggcaatccagtcagcattttcttattaaaaagtggtgggtccacctgtcatactcttgttggtatttcttaaccttacagataaaatccgcaagcgcacggaaaataccgatgtagcacttcaaccgggagtattcttaggtatcgatttccacagggaacttgtgtgtcaacgccggttcagattcatccaaggacatgaagctatagataggcaaaagatagagaggtttcaccggtgaagaacagtgtctatggaaagcttaactttaatcctaatgaggtacttcgggcactggccagctcgctgctcctagatatcgctctactgcgcacccagacagggaggactttagtgtcttgagggttgtcaccacctctacaaccacctcacacctactgtgggatgcggagcaaacaccggaaattatctacctagacaccgcgcctaagcatattaatttcttactttaatgttagctacacactaaagcaaatcactatattttagttgattatagtaaacgatgatcccatactttgaataggaactaaccaagaaataattctcaccgagcaaaactaaattactcaaaagataattctattataatcggagtaattaacagagcagaaagaaacagggataggattaccgacaactggaatttcttccacttcttctactctactctcttcctattctagtatacaatatagtactatagagcatcttataattcagctcaagcttggagtgtgtgagtgaagtgaagaggtgaagtctttatatagcggcaggtgtaacggttatagaacgcaaaaggtcaattttgccctccaaccgccattcaggagctcatccagaccgtccatgcaaaaccccaaatcatacggctacagaggtggttcgactgaacccgaaccatgggttcagccgaacccatggcaggcccaacaggcttcaactttggcctgttgctcctcctctgcctcctttatccatttctgtgagtggaaggaccattgaagatgtattctagtagtttctggcccactctttatatggataggaactctccttcacttaagtctatatttcatccaactttggcggtttattacctgcattcaaatatacaccaaaacttgcggaatatgttagaatttaaccctatcactatgttggatgttttatccctttgatttatgcaggtattggcggcataaaatttgtcaataacaaccaccaacaaccctctcatcctctctctctcccgtcgggagctcctcttcctatctctcttcctacggaagcgacgcaatggctggtggcgagcgtggcgggggaggtgagggcgcatggtgcgacccacgatggcgactacaatgagcggcggcaactgcggcgagggcacctagcgagtggctctcccccttctctctatctctctctctctctaggcaccatcgggagagcgcacgcagaggccggcggcgcgtgtggcggaacggtgagggcgcgcagcgcagcccacgatggcgactatagcaagcagcggcaactgcggcaggacgccaggcaagcggctcttccccactctctctctctctggtaccgtcaggagagtggacccgaggtcggtggcgggtgttgcgggggcggtgatggcgcgtggcgtggcccatgacggtgactacggcgagcggccttccacacaccctctctctctctatgtgtggcgcagtcgggagagcggaccccgaggccggcggcgggagtggcgggggcgtttagggcgtgtggcgtggcccacgatgaattgatcggcagtcggcgaccggcgacggaggtcctcctgcacctctcacccgccagcgcttgagcgacctccgcatcccttgccgggggatgccagaaatctctatgatgaatctttcccgacaacgatgccagaaatgcttgttggtatttcttaacgacaatagtagaaatataattcccagtactggcgcataaatacttctggtatattatggttacagagttcatccgcaagcgcacagatataccattgtagcatttcacccgagagtattccaagggtatcgaatttattttatcccgtgggaagatcatgtagagagaacttgactaataatttatatattacttgtgataatcatattctaagcaggggttaagataattgaagggtagagtgacacacaagcattagctactcattctcataatatattatctaggctaagtggaaagaaaagagaaagaaaatcaattcctatacttttaatattacatagtatatatacattctagttaaccgatatactaactaataccctctatctgatgccctcctggcatttcgagaagccacccctcctcgtggcatttcgagaagccacccctgattgccgagttccttacgatagcccgtcatgaccatacaaccggggctaaatacggaggaataccctccccagggaattaacttaggattatataccggcgcggaggaatacccgtactgagctgtcaccatcagcggcccacctcttatccgcagcatataaccccaaataatgatatcccataatctagacaccatgtctaaattactagatactactctaatatcatcgtcatgacatagagtaattgcatatgcaaacattatacccgcaccaaagcatctcccagataagctagccgtataatcagtataacatgaacataatgtaaagtaggtactcatatactcggaaagtatttcaataccacaaatatatatagaagagtattctaataaaagtagaaagcttacaaaagaggaaaagaaagatactatagccatacccaaactcttccgaagacttctcgactcctgatttctactctatttccatttcaccagctagatactactaaactaaacttgagagaaatgagagagctcttgcttgaggtgtgtgttgaagtgaagagagtgaactccttaaataggcaggtaatgatggttatggtggttggaaaggtcggtaataccctccaactgccatagggagtgaatctccactgttccctcaaaaccctgcatccatcggcgctggcattggttcgaccaaaccctgggctggcccaaccagcccacaagttggctggtggcctcctctggtgtttctctccgtagacttgtgaattttggcctagtgcgtcgtgtcaattctaagttcttggcccattcatacataagtctggttctcgacattgtccgattgatttatcatctgagttgatgtggattctcctccactttattgtcattctctgtaaaaagttagtatacctaataatagtggaatattattattctaacatatatatgcattgcaaacatcactagttctcctctattttagtaatattgacggtcgaaactgatctataacgaccgtcaacagtacccagtcttgtgctgtctcccaccccagagttggagtatgcatcggatggtggctactcggaggagtaggcttcgtccgtgccgtcaaggatgcctgtggaatggtgtcgctccgctgttagcgttaagttctagaataagctcgcttttattttccacttcatttatgtaggatttttatatgtttgtaagacgtagttctgtatatcaactttgtcgtttgtgtaccctggctggtcctgaacaggtgtttaatgcacattctgcttggaattctattcgggaatttccgggcgtgacacgtatgtgtatactatatacacacacatatatgtgtatatattgtatatatgtatatatataatattttttatgaatatatttttagtgcataaaaagttatatgtcgtatacaaattttatatatgacatatacaaactttgtatacatacatattaaaaaataataaaactagaaaatacgtcacatatacaaattttgtatacgcacgtatacaaaatttgtacatgtatatacaaaatttctatacaggtatacaaactttgtatacgtgcgtaaaaatatatacatgcatataaactttatacacgtttacatatacaaactttgtataggtgcgtaaatatataggcccacaacgatcacccgcccattagcgatgccctaaatatatcggcatgtttggctgctagggttgcggctgcaccacagccaaccggaacaggccggcaagctccatgacaactaggccatattaagaaatttcacaaaactatatatactttgataaaattatcacaaaactaaatatttaaaaaacgatagatttagcgctaaatttatcccaaaactatatatttaaggtagagtatcacaaaactacatatttaataataaagttatcacaaaactacagattttagagtttaaatccttagcactagcattatgtttgagttatatacgtgtaagttttctgattaaattatcactaaacctgtagttttatgatatttttattactaaatctgtagttttacgatactccaccttaaatctgtagttctgtgagaaatttagtgttaaatctgtagttttatgatatatcatcttaaatatatatctatagttttgtaataatttgatcaaagtatccaaatttacttccatattaatataacccaatgaactttgatatctcaaatatatacaaatttctttcatggaaagttgccgtaggaaattaaaccatttaatggtaaacttgttgttttttaaggcaaaaaggcagcgcacatgtgtcatgtgcccttgagcgctcaatcaagaccaaatttcatcttatcatatattgtttgctgcccacccttaccgcgtggtgcccagtacacgtgaagagcgccctaaaacgacgtacaaaccaggttaggctaacggtacggtacaaaacggaggacgcaaaattccactatcttcgtggctgccaatttcggcccggcccatacgatgcacgtacccggccactaggcccattaaaaccagatgtgatgccacagccacagcgtgtatgtcaaccgacgaaaatatatacagtgctatctcataaaaattttacttagaactagaaaaattgcccgtacattacaacaggtgaaggctattttagtcatattattgttcactacgagaattcgcttggatatatttttttctaaaaaatcatgtcaagttagcatgcaagtttttttataggagatatcatatacgactccttctgtatttccaaaagtaaatgaacataaaacccgacttaaatacggatctacatttctaaaagcgaataaactgtattttccaatacggttaaaaattgattcatatacggatgacgtactaaaataccggcaaaaatatcttcaatttttataatagtagagataagatgaacaaatatcggatattttttattccacggtatttttaaatttacacatacacatatgatatacgctatatattttcccgttattatttgtggcgctcaccggtgtcgaggccactggttttgcgcgtcacctcggcctggttgaggaagagcagtgattgcagccagcggaaaagagagaaaagggagaaaaagaatggcaaaatactacacacttcgtttcatattataaattatttgacttttttctaattaaacttagtcaagtttataaaaatatttaacaacaactaaaatatgaaattatttttattaaatctaacattgtatatatagtttaataatatgtttgttttgtgttgaaaataatcggtagcgctaatacaatcgctgcgcgttaaacaataattaacacgcctcggatctcgctcccacctccccttttctcttttttttttctggttctcttccgttcccaccttccactcctattttttcgttttctttttctatcccctcctattcccgtcccctcctactttagctgtctgcatctgcgttgttttgtttcgagtaaaataattactccccactcctatttttccgttttcttttctatcccctcctacctcggctatctgcatccacgttgttttgtttcgagagaaggcaagtggatcggatgaggaggaagagaagagaagagaaatgatacttgataagtggtatggattttttttatttagttcggatccaccgtaatgcctcctttgctatgcatacattgtattaaggctttattagctaaagaccgggttcatatgaagccacctatacaagtagatattatacagtgctgatgcccttacaagtactctctccgtcccataaaataagggattttgattttttgtttgcattgtttgaccactcgtcttattcaaaa

SEQ ID NO: 44468 - DNA, 17701 bp, Oryza sativa
attttagtggtgataatgttaatattcataccactttggattctatggtaccctctcctaatagcaacaaagttggaaagacgggtaaaaagaagaagaagaacaataaaaatcagttttaaatgaaaggaatcttttcgaattgtgatgggtttaaggacccaaaaaaacataagtttatttccgacttaaccaaagaacatctattggactttattgttttgtctgagactgttaagaaagagttttctccggctgctcttaacaatctttgtgctggtaaagatttgttttggcattgtaaaccccctaatgtaggtctggtggacttcttttgggtattaatttacttaatgccgacattggtttgattgatgagggcgatttttatattaagtttcatttatgtaataaggtttataatttcaagtgggctttagttttggtgtatgggcctgcgcataatgagtacaaggatcaatttattgctgaattagttaatttgtgcagtcattagtctttactagtgcttattggcggtgattttaatattcttagtagcccaatgacaactatgatgatagatggccctttctgtttaatgctattattgatgggttgtgcctcagggagttacaaatgtctggtaggaattttacttgggctaataatttagcaaatccaacttatgaaaaaattgatagggtcttaatgtcgacggagtgggaacacaagtttcatctatcttctgtggttgctcttaatagagatatttcggatcatactcctttgcttctaaatacaaaatcttcttctaataatgtccaacatagttttaagtttgaacttggttggcttttacgtgatggttttgttgatatggtgaaggaagtttgttctagtgttgatgaaggaaattctcctatggaacgttggcaggcgaaaattcgtcgatttagacaacatctcaagggttgggctaaacatacaagtggtttgcacaaaaaaaaagaaaggagattttagataggttggacttgcttgataaaaaggcggaaacatttcttttgactcaggaggaaattgatattagatggttttataggaataggttatcttcgattttaagggaagaggaaataaagtggtatcagagggctaaaacaaaagatattttggaaggtgattctaatacaaagtattttcatttagttgcaaatggtaaacatagaaaaatgagaacttttcaattgcatgatggtgaccaagtaataaatggtgatgcgaatttaaaggcgcatattaccactaattataaagtctttttggtcctcctaatgattttgatctaaagtttgatgaggataatattgctgatattccccaagtttctcttttggagaatgaagctttaactcaggagttactgaacaggagattaaggaggccattttccaaatggaacacaacaaagcatcggatcctgatggatttctgtcgacgtttgatgtcgcgattccggtatttgcatagtatggggatcgttggtacaaggatatatgcgagattgaggtaaaagagacagagacgaggatttttatacaggttcgggcccctgaattgtcaggtaataaccctatatcctgttggccgaagccggttgttgctcttattcaccataaacacaccagtacaatatttggggtcgcctatctaaccgttgtcgacatggcggtctgaagctctgactcgtagtcgacaacagggtagtcttcctccttgagttcgtgcccggcgagatcagagacaacgcaatgtctctcctatcagtatccggagacaccgtaggggactagccgtgcctatctctaaactcgatatccgacgtcttgtcttggcgtatgttggcttgtatgttgatcttgtgtattgatctattgttccgtgtatgttgattgtctcccctctcctcctaggggatcttgtatttatacccataggttcccccttgtccaagtagaactagggaaaccaatatggatacaatcctagtagtccttgtcgtttccatgtagaactctggttgtctttccttatccggaactccctccatatccgaagtcagttcccgtataagacatggtatgtggtgggtcctgcggagattcagtcaactactattaggtatgtggtatccataaccctaacagtagcccctgacttcaatgcaaatgaacaaattcatattctcaaccgcaaaccttggagtaactgttatcgagctcacgtgaccgttctcggtgagttcagagataacgttagacttcctttatcagcctcgtgcgggcacctaaagggtttgtctgagtccatctccgacgtcaaccaagaaagtacataacatacgactaagtctcccgtcttgctgtaatcgagaatttggattgaagtcaagaaattttatctcggcaggtacaccatctcttcattccatattccttgtcgagatccactaaccgttctcgagtgatcgagaaggcgcagagtctgcgacggagccttgtcaacatttgtcgtactcgccttagtcgatcttggtgtagaaccatagagacatgaagtctttaacaatgtcgaatagaattttcctgaaatcaatactcagaaaagaatattagatagaaatagccccagagcgaacgctcaaagggtgacatgttataatatgtatggaaatttaaaaatgaattaaatttacagaccaatgttttgtgtacgagcgtcttctcttttaccgacttcgatcagtcagtttgttgagtcgtacactctctctagcccccagcattgttgtcagagaatcgttctcggaggataaggctcttggacccttgacctgccttggttgaaaaagcactgaccctagcccccagccgtgaagttggaaaatccaatttccagttacacggcttggttaatacgcatggcgagaactcttacacgaccagatcttacatggtcttttgtctcttcaggatccgacaaggccttatcggctctgggcgtccccagccgaagttcccttaggttcctcggaggccttgtcaagacggcgtaaaaggacatgaggataggtttcaacgctaggtgtcatcgtggtaagggatctctgggtaaaacacttagcgatattgtgtacctcatatcaactttgttggagtagaggtagtgggaggatcactacaccgctggtcgaaaaccagttgtagcaccaactggaccacttgaagtaaaggtagcgggagaatcgctacaccactggtcgaggactagatagtagtcgtaactcgaccacttaaagtggaaaaagtgggagaatcgctacacctctggtcgaggaccaggtagtagtcttaactcgaccacttaaagtggaaatagtaggagaatcactacactcctggttgagaaccaagtagtagtcataactcgaccacttaaagtggaaatagtgggataatcgctacaccgctggtcgaggaccaggtagtagtcgtaactcgaccacttgaagtagagatagtgggagaatcgctacaccgctggtcgagaaccaggtagtagtcgtaactcgaccactctcgaccacttaatgtggagatagtgggagaatagctacactgctggtcgagaaccaggtagtagtcgtaactcgaccactagaagtaaggcgagagagatcactatgttctaatggtttgagaaccaggagtaggagtctcttaatcacctatagggacgctaaagttggtttattacatgtgcatctcatgtggccagcatgagcatacccaaattatagcatatctgaatgtccgttcgcaatcatgtcgggtgatcaagccgacgacgttcgtgaggaattatccattcacaaccttttctcgagtagtccagccatggccggtgctatgagataggtcgtcggtcttcgttggtaggttgggcgcgacgactctgcatttgtcgagatcgttctcgataatggggtgtactcgaccacaacctactcgagtgctcaattgttcctgaaaaatattttctagaaagcaagatatatagcagagaatatcgagtatgtactcaaaaaactgcatggatcttctagtattatcaggatataacgagcagattaaatatcagggattatataaaccgtaaacaagaatgatttatacggaagaaaatagagcgagcccccagcattaaaccgtagtcgatttaacatcggggacacttgcacaatagatattgcataaaaaacatgatctaggtaaacataataaattattgatctgacaatattgtataatcagaaaaataggtacgataaattatatataaaccattgcgtacctgtgtagatatatgccggatatatctacggaattagtagatcaatttaaaaaaccaatcttccaattaccttgctgcgtactcgttcgatatcatgtgatctgacatcttttggtacgccacggagcttgaggcttgaatgatctcgatagaccaagttgttgacaacgatggttccgatcttgtcggggcacatactctggtcaagttagatcctccatagccgaagttatcgagtagtatgttgtcggagaatccatctcttaaacccatctcgtcgaaaccttgaagcaccaaaagatcccctacctggcgcaccattgtcgacgtttgatgtcgcgattccggtatttgcatagtatggggatcgttggtactaggatatatgcgagattgaggtaaaagagacagagacgaggatttttatacaggttcgggcccctgaattgtcaggtaataaccctacatcctgttggccgaagccggttgttgctcttattcaccataatcacaccagtacaatatttggggtagcctatctaactgttgtcgacatggcggtctgaagctctgactcgtagtcgacaacagggtagtcttcctcctcgagttcgtgcccagcgagatcagagacagcgcaatgtctctcctatcagtatacggagacaccgtaggggactaaccgtgcctatctctgaagtcgatatctggcgtcttgtcttggcgtatgttggctcgtatgttgatcttgtgtattgatctattgttccgtgtatgtttattgtctcccctctcctcctagggggccttgtatttatacccataggtgcccccttgtccaagtagaactagggaaaccaatatggatacaattctagtagtccttttcgtttccatgtagaactctggttgtctttccttatccggaactccctccatatccgaagtcagttatcgtataagacatggtatgtggtgggtcctgccgagatttagtcaactactattaggtatgtggtatctataaccctgataatttgctgctgagttttatcaagtattttggaatgttattaaatttgacttgttagaggtttttaaagattttcatagtgggtgtttacctttattttccttgaacttcggaaccattattctttttcccaagtgcatagaggctatgaaaattcaacaatataggcctatatgtttacttaatgttagttttaagatttttaccaaggttgctactaatagaattatgggtgtgtaacgtcccgccttcccccaggccgggcccgcttacatctgatagctttcataggtcatagactgccctcacagaccaacacatgtcttttttgcacactttatcctcactcgtccgcacccgggaagaatttcccggtcggtcacccatcccaaatagctccaggccaagcatgcttaaccctggagttctttagaaatcggcttccgaaaaagaagttgcaacaggcttaaaaataaattttcacaaaagtgaattattttgttttggtcaggcaaaggagtgttatgatcaatattctaatatctttggttgtaagttaggctcttttccggttaagtatctaggaattccaatgcattttaggaagctttctaataaagattggaaagttattgaagaaagaattgacaaaaaacttagttgttggaaaggtaagcacctatctgttgggggtagattggttttgattaattctgttctctcgagtttagctatgtttatgatatctttctttgagatgccaaaaggggttcttcaaaaaattgattattatagatcacggttcttttggtagggggacgatcataagaaaaaatatagatttactagataggatattatttgccaaccccaggaccagggggccttgggatatataatttggaaatacaaaataaatgttttttttgagtaaatggttgtataagctaataaatgaggaaggggtttggcaagacttattgaagaggaagtatctttataataagtctataacccaagttgaaaagaaacaaggtgattctcatttttgtcagggctcatgaaagtcaagagtattttttaagatatgggttcttggattgttaataatgaggaacaaattagattttgggaagataaatggctaggcaacttggccttgaaggataaatatccatctttatatgctattgtctgaaggagatcttcttctattgccactgtcatgggttctgttccacttaatgttgctttcagaagagttttagttggtcagaatcttgtatattggcatgagttgtgcgcttctattgtgcatatccagttgaatctttcttctgattgttttagatggaactatcatcagaacggtaggttctcggtaagatcaatgtagctagctttaattaataatggctatgttgagagaaataagtgtatttggaagctcaagatgccacttaagattaagatctttatgtggcacttgcttaaaggggttctgttaactaaggacaatttggcgagacggaattggaacggcagcttgaggtgttgcttttgtatgaataatgagtctattcaacatctctttatgaattatcattatgcaaaattcatatggagaacagttcagttttcttttggttttaaccttccaagtagtatatctcatatttttgataggtggcttttggggttgacatgaaaaagagtaaactaatacttgtcggagcttcggccatttgttggactctatggttgagtagaaatgatatggtttttgacaaatcgctatctatttcctatatgcaggtaattttcagggcaactcattggctccggttttgggcacaattacaaaggcgtgatgaagatggagagtttctgaaagttgcatgtcgcaagttggagacaatggttatgcaactttatgccaactatggatggagattcacaaataggctggaataaatatgttctccttattttggctttttctatttaagtgtgttatattttatttgaactacactcttatctcgagtgctactttgtaataattggctgtagctcttcttgagcaaaggccgggatattatatttgattatctaaaaaaagtagctgatgataagtatgcagtattattttgtttttcaaaaaaaaaaaaagccatgcagatgtgtcatgtgcccttgcattgatagctgattgatttgccagaccagattcaaatcaaaggatgttcgcttaccacccttgccgtgtggtgcctagtgggcgcgaagagtgccttacgacgacgtacgaacctggttaggaagacggtacggtacaaaacagagcatatgcacaaattccacaatctccgtagctgccgatttcggcccggcccacaacgtagccactaggcccatttaaaaccatctgcctgcttcagcgcgccggcccggccgccacattgatcgatcgactgccgccggcacggtggctggccgtgccgcacgtacgtctcggttggcgctcgccggcggcgatacgcggcatgcgtggccgctcctgtcgcgccgcgtcgacgttgggagatttgcaataatgacactgcaaacattaacctttactataatgacattggacgacgttggggaaaggcggcaatatccactggaaacaaaggagtagcaaaattgcaaaaacgctaattaacatcgcgatgtaattaacaaatttggtgagattctcaaatgttggccttaaggcaaacggcctagggctccataagcactgatcaagcttaccaaagtcacataacaaatgctagctttaggtttagggcacactatactatagaaaagatttatttttgcggtcaaaaccaattttcacagttgagtgggtggttcgtctacactcaggtgtcttcgaaaatcggatttttgcatacggatagagcaaccaaattttctcttctggacactgaagacatccgactgcaaaaaggaaaatcgcaaaaaaaaaattgcaaagatcgaaactctaaccctagaatatagaagccgtcgctgtcgctcaaaattggtggtggatcctcgcgcgaggggtggagaggcggcaggatccgtgcaggacgggatggggtgccgaatcctctcctcccgtcgtcgccactcatggatccgtgcgggaggagaatggggtactagatccgcccctcccatcactgctcccggaggatcagcccacttgtttgatcgctccttccctggcgagcgctagcagctcaattgttcagccgccgccaccccccgatctccgaacgactgagttgctggcgcctgtcagggaaggagcggtcggacaagtgggcaattcatcgtaggaggtggagagatagaagggggagagaggtgaggaaaaagaaaaaagaagattaggatgactgacatgtggggttgtatttatttaaggagcggccggactagcgggcagttcatcgcaggaggttggagagatataacagggagagaggtgaggaaaaaggaaaaagaagattaggatgactgacatgtggggttgtatttatttattttatcaatcatgagcgccacgtacgatgaaacagttatccatacagttgagagactcgatttgctttggtttttgaagatggaagagatgttatacctggtattgctagtgagagatgcgatttattcaggggcaagagttaagggaggtaaaatagactatttatccaacggtggagcagcccacggcccaccgttatatgatttgtatctcgtcccagttgtggacttgtggtcactggtcagtggtggagcacgcagctggtggaggcgtggagcagctataccgacgcatcggtaggatggaccgatggagagtagaaaatcgtgatgaatcagagggtgagaaattcaaaattactaggtgaaaataatgtacgataacaataactaatgtataaaatagctagacaacataagaatatgttaaagtggtttacgataatttaaatttaaatagtatatagaataacgattcaaatgtaaaagtaaggtgatatgactttattagagaagaaaagtagggagacagtttgaaccataaattaattatctatgagctaaaaacaattgaggtgatatggcttaatgaaagaagaaaaggtatagataatttggaccatagattaattatttaagcattaaaaatagttgatatgatatggcttaatgagagaagagagaaatatcattaactaattgaggatgaactatataggtatataggatattattaaaataatgaagatatatattgaaatattttatgaattatgtgagatgatgatttaacatgcttgcattataaagctctaaaatttaaaaaattataaaattatatataatatagcatgtttgcatgatatttaaatgtaatgattgtcaatggatattgatgtggcatgttgttagtggatgatgatatgacatctttacatgttaagctttaagagttagtgggttataactttatagtaagagaggattgggtagtatattttttctctttaacaaagcaggagtattggttcgattaaatatatactatcaagagatttttctctactactattgtacaagatatactagcttatattcttaatattttttagtgatgtggactgcaaaagagtttgctatgcctcttccagagaatttggaaggtgttaagctgatttaatttaataattagagtaggcatttccttcaaaaaaaaaaaaggaggcatgcgttgaaagtttcatgtttagagaaatgaataacgcaaccgaacattcaattcatttttttttcatagagaatgtatcctattaccaacgaatgactgaaaattaattgcataagctctctgtacatgattgcaaataattatattcatttcaatcctgctggcgggtatgttattagtatcaccccagctgccgtacgttcaagagtcacaatctgaacatatataacatggcaattcagtagaattaattccttgctcgagtgactcgaggtacttaaataggcaaaatgtctgcattccttttccttaaaaaaggagtcaatagaagagctatggtctgtttctttcggcttgagattattataatctagattattgagttagattactataaactagattgttataatctgtagtagaataagcggttagttgtttctttcatagattattacagtctagattatttggtttgcaagtctaaagagagagtggggtggcatggtgggtaatttttcatccaataatctggaaaaagctcatctaaatgagcttatcagattataataagctgggctctagattataataaactattttaataagttgtctgtttctttcagcttactcccaataatctagattataataatcataagctgaaagaaacagcacctaagcacatcatgtagccaggggacgttcggtagtgctttccagttctgcagtagccacagcatcaaagaggccagttactgtaatgccgcggctgcagctaggagcctaggagcgagcttggcttgcataggctcaaactcggtacaagcttgagccaagcctttaaaactttcgagttttcagatagactcagttcgatcttgactatcgagcttgatttgtaagtagaaaaatatatattttaagaataatcttttaaaaaaaataatttctaatttatcatattaatttaagaggaaaaaataaaataaatatatgatgctaatacaaagtaatttgttgtatgggatgcatacaaataataaatttgattccttaatttattaaataacaacagaaatcatatattgttaggcattagaagctcaaacttggctagacaaagctcatgagctttgcaagaggcttgggctcggctaatctgaagctcaagctaagctcgaattgagtttaggacaagtcaagctagagtagcccatgagtctcatgttttttttttctttgacagccctagctgcaacacagccgcagcaagctctaacaaatcaagaagcaaggttgcagtgttcgtatgtgtgctagtcatcagagcataataaatacaccctccattttaggcactaccatcactaatgcaaatactaagaaaaaaattatcaccacctcgattgaatattctcgatgcaggtaaataatgtgattgcagggtttgatagtagagcatttaaaataaaaacgaatttacagaagaagaggtcatatttcatgtatgtatgcatgcactaaatatattatgagatatggagaaaaaatggttgcgccgtatattttatgatagagtgagtgtagttagggtgtgttcagaactgcaggtttctaatctctctttttccgcacataaattttacaaactattaagttgtgtgtttatccaaaaaccttttataggaaagttattttaaaaaatcattttaatctaattttatgttttttaaattaatatttaattaatcatgcgctaatgagttaggctattttacttgcgtggaagccaacgacctttttgccagttgtgtctaatcggtaaaataccagtgttgacatccaaatttggtagcagggataaaatataagtttggccacatttgaaatatggccaaatttatattacccgagccttttatatgggggtctgactagcggcatgaggctggtcggaccggtggcataggggcggtccgaccgcagttacttagcaggtccaactggtggcctctgagttcaattaagataattcatatgtttctttgtatgagcccaagaaatttctaaccttaataagacgcgaagaaggccttgtggatgcaaaaccaacctctttataaaggctatggctgattcgattctaaacaccctgacaacaaccctaacaacaatcgaattgttcttttaattctacttttcagcaatgttttctactttacctagttcattcatctttgccaatttgcaccgtaaatcgtatgccttcactgcgagagtgcaataccctttgtaggtttgttctgtaaaccttccgattcactcacaaaacgggtttttacccccatatcgatctaaatcgacctagaggctggtctaatctcaaaatcggctccactagctgatcgaatattttctaaacccattttgatcgagagatttctagatcgaggtggttggtgactctattaacaccacaaattttcagctgggtccgtggttgccgaaaagttgccaacatgatgagtacatcctccactattacccgctggcaaagacgcaaaagtcgagcggcgactgtgtgagcctctaaataatcccacatttcttagcttgggaggaggaagccaccttaaaagggagagccaccattcccctattgtactagtcttttagggagattgggtatttcccctattgggtgtgccaaagaactattggggttcaggcaaccttaatttgttgggcctcagccaaccctagctggaccggattgttatcacaacaaccacattattagaaggtataactttttttgtttgtctaagctatatagatccgaatccactagagaggagaccaaatttatcaatactgccgttggatttggaccaatctgaggcatccttctattcctacagatgactacagatgagatcatggcacctcaccctctcctaattgactcccatgatctggtaaatttggagggaaaacacttctgtttttaggtgttgcctccataaccaggattactcccgtcaacacaatcgaaaacatataaatcctcttctttcccaaacaacatatgtgagattcaaacctaagacttctcaacacatgcaaaccaatcttacctatagaccacatgttgatatatatgtcatcagatgttattcttttaactattcttgtccaaatatgaaactcaagatgacatgaaatgagaatgctttcaactacaaagttgcagatctcatcgagctctaccactttagtgtaaggtatgtctcatccaagatcagttgaaaatttcaaaaaatatttttgaaatagaacacatcacttataacacatattcagggatgaaaacaattttaaatgaaaatattttcaactaggttatagatctcaccaaaccctttgactttgatataggccatgtctccatttgagatcatttgaaaaattcgaaattacgtttttcaaaatagatatcaccacttataatgcatatttgggcatgtaaactatctcaaattcaaatgttgtcagcacttgcaaaattacatttttcgaaatagatgtcagcacttataatgcatattcgggcatgtaaactatctcaaattcaaatgttgtcagttttaaagttatagatctcatcgtgatctacaactttgatatagggtatgtttctatctgaggttgtttgaaatttcaaaaaattgaatttttttctcatctgtgacggttcgtaactacgttatccgtgaagggtggtaattaagatctgtcacggatgagtgctctcatatttgacgggtcatctcattacatccgtcacggatgacatgctatccgtgatggggcatggttgtgacacgttataggtcatccatgacgtgatagaattacgacccgacaaagatgaccttatatcagtgacgggtcatccctgatagtcatccgaaatgaggtcgcattagcccgacacagatgtttcgtcaaggatgcccggatctatactagtgtcacatcttatcctttaaatatgccatacaattagatagtgaagaacgtataactaacatattatgggttgatgcatagatgctaatagactatgctttatttggtgagtataggccttcaggagtttccgtaggatttaaatactttcgagaagttgtgattgtttttttgagttgctctgttgtatgatcaaactgcagagtccctcgaaaggttatttgaaaattttctagcattatataatcaaaatcacccaaaaatcattttttactaatcaggacctaaaattgtgaaaggctattgatcaggtttcttatgaacacaacacacagtttgtgcacttgcatataaatcacaatgcaataaaacatccaggctaatgcgattagatgtgttgtgtttgtgctatgctacaattattttgtatgcaattagatgctatgctatgctacctcttttctcatgtaaaatttattttccctcatctcgagtaaaacaattgtgcatagatgtgttgagttgaccttgggtaaagccctaaagctaaatatgtggaggtgagacctttgtgaattcaagcaagtttccagttcattctatgtatttagccataattaataatggacaatttgagaggaaaatatttctatggaaactaaaagtggctcttaaaacttgtgtggtatctgctcaaaggagtaatattaactaaagataatttagtgagaagaaattggaatgacaaaaagagatgttatcttttatgaagaataagatgatttatcatttattctttcagtgtcattttgctaaatttctttggaaatcactacatacttctttttgacaaagatcccatattacttctcatatatctggaaattagcttatggatattgattaaaaaaactaagaaacttattttaaatggagtatttgctatatattaggctggttttgatgaatcctcatctaaatcttatgtgataattgtgcttttgatcttattctgaagtctaactactaacttggcccctcttttccaattttgctcatttgatcctgcttttcaaaaactgacccacttctacctgcattgctaggagtgttattagaaaatgcatttagagaattaacaagaccaaaatgccccccggaaatatatgtcaaacctacatcagtttcatcacatactttagttaaattccatcgcatattttatggggactaagtgaaaaacctgggtcgaataaacaaaaaaaaagattaggatcaaatggcaagggtataaatggtattttccccttatataacaccgttagttatcttcacgaaatagggtcggacctgatctccatttttgaaaaagagggtcaattgagcaagctttaaaaaacagggccaaaataatagtttggcttaaaaaagggtaacaacgcaattgcccccaatgttatatgcaggcaatgtaccggcctcagttctagacataagttgaaagatgtgatgagtacaatgaactattggatgctacgtgccaaaatctagctagagtcaacggttatgcaaatatttgctaacttcgtgtggagatacaaatagacttgaataaacgtttacctcctttagtattggtgctatgagtgttgcatcgtcatttcctgggttttatatgtactctctgttgagtggaattatatggtggttgtagctttgcaaaagctataactcatttccattatcttaaaaaaatatatattcgaccaatttaccctgagatgtagcatcattttttaaaaaatgttactatctgaacttttgtacgtatgaatatgattttgtagtaacacacaatacatcttcaagattaagttgctgagacgacgtacattacaaaacatcaaaattgatgccgcagggacatacacccatacaaaaatacagttcttatatctgaaaagggcttctcaactttcttcagtgaaaagcaagcagggtgtacttgtctatttgggcaccaacccacatcatgcaatatgtgggggcgaaaggcactggtgtcacgcctcaatctaatgtgttgttatatatcaactaagacatgtaagtagcttaaacatcgtatatatatttatgctttattgcttccttctgttctcagctttcttttcctttccattaattccatctctgtcatgcttcgtccggacggtgtgccgtccatttctttttatttatgacagtctttgcattatttatgcattacccagatttttaggtgattttctggtggttatttttttgcttgtactgaaccggtttggagtgtttcaaatcataccagcattaagtggaacttagattggtcaagcaatagcagggagtgaatgtgaatcatcggacttccattgttgtgacctggttatagccgacattaccgtcggcaaattacctgaatgctgatggtaaaaagccaaaggtacacagtacactcttgatcacatatttcgatatcgccgatgcactactacacgattgatttttcctagacgctgcccctttagtttccatgcggttcgtaagtggaaccgcacggaaaaatatgggaccggcgtcgggttgttgcccgcacgggatttcccgtgcggtcctcttaaatgaactgcacggaaaaataagccgatttttccatacgggcctattaagagagccgcacgcaaaaataatcattcctcttttccctcctacccacttcaaaattttccctttttccacgcctcggtcccctccctctcctttattctctcacacattaagtgctctctctctcctattctctcctcatgcgtcacgcgcgcctctcctatcctctcctcactcctctctcctctcctcccgcggcgacagagacgacggcacgcgacgggtgtaggcgagggcggcggcccgtggcgacggcgacgacggcgcgtggcgggcgtaggcgacggcggctgcccgcggcgacggggacgatggcgcgcagcggcagcgcggcggccgtggaggcgcaggatacggtgggcggttgcgacgacgaggtggcgtgcgacggcggcggcgcctccaaccgatggaggcccccccccacgcggatccggtggcgtgacggtggcggcggccgccccccgcatggatccggcggcggtgcggccacccccctgcgtggatcctgcggcatctggccctggtggggtcggccgagtcccaataacttaaggttccccggaccgcaacagttcataggcacacccactcagggaaagggctaatctcacacccactcagggaaaggcccaatctccctaaaagactattcctacaggggaagggtggctctcccttttaaggactcccta

SEQ ID NO: 44469 - DNA, 7373 bp, Oryza sativa
  unsure (1)..(7373): unsure at all n locations
ccatgagattcatagttgcattacttatagcttccttattcgtagacaaagcggattcggaattgtctttccttccaaggataacttgtatccatgcgcttcagattattagcctggagttcgccaccagcagtatagccaaccctaccctatcacgtcaatcccacaagcctcttatccattcccgttcgatcgtggcggggggagtaagtcaaaatagaaaaaactcacattgggtttagggataatcaggctcgaactgatgacttccaccacgtcaaggtgacactctaccgctgagttatatcccttccccgtcccctcgagaaagagaattaacgaatcctaaggcaaaggggcgagaaactcaaggccacccttcctccgggctttctttccacactattatggatagtcaaataatgggaaaaattggattcaattgtcaaccggtcctatcgaaaataggattgactatggattcgagccatagcacatggtttcataaaatctgtacgattttcccgatctaaatcgagcaggtttccatgaagaagatcttgttcagcatgttctattcgatactggtaggagaagaacccgactcggtattcttaaaaaaagaggggaagcagaaccaagtcaagatgatatgggtcgccccttcttcttgcgccaaagatcttaccatttccgaaggaactggggctacatttcttttcaatttccattcaagagtttctatctgtttccacgcccttttttgagacctcgaaacatgaaatggacaaattccttctcttaggaacacatacaagaaaaaggataatggtagccctcccattaactacttcattttcatttatgaatttcatagtaatagaaatccatgtctctaccgagacagaatttcgaacttgctatcctcttgcctaataggcaaagattgacctctgtagaaagactgattcattcggatcgatatgaggacccaactacgttgcattgccagaatccatgttccatatttgaagagggttgacctctgtgcttctctcatggtacaatcctcttcctgctgagccccctttctcctcggtccacagagaaaaaatggaggactggtgccgacagttcatcacggaagaaagaactcacagagccgggatcgctaactaatagaatagtactactaactaatactaatatatagaaatagatatctagaaatagaaacgaactaatatatagataatcgaaattgaaaagaactgtcttttctgtatactttccccgttctattgctaccgcgggtcttatgcaatcgatcggatcatatagatatcccttcaacacaacataggtcatcgaaaggatctcggacgactcaccaaagcacgaaagccagttagaaaatggattcctatttgaagagtgcctaaccgcatggataagctcacattaacccgtcaattttggatccaattcgggatttttcttgggaagtttcgggaagaaattggaatggaataatatagattcatacagaggaaaaggttctctattgatgcaaacgctgtacctagaggatagggatagaggaagagggaaaaatcgaaatgaaataaataaagaataaagcaaaaaaaaaaaagtcaaagatagaagagcccagattccaaatgaagaaatggaaactcgaaaaggatccttctgattctcaaagaatgaggggcaaggggattgataccgagaaagatttcttcttattataagacgtgatttgatccgcatatgtttggtaaaagaacaatcttctcctttaatcataaatggaaagtgttcaattagaacatgaaaacgtgactcaattggtcttagttagtcttcgggacggagtggaagaagggcggagactctcgaacgaggaaaaggatcccttcgaaagaattgaacgaggagccgtatgaggtgaaaatctcatgtacggttctgtagagggacaggaagggtgacttatctgtcgacttttccactatcaaccccaaaaaacccaactctgccttacgtaaagttgccagagtacgattaacctctggatttgaaatcactgcttatatacctggtattggccataatttacaagaacattctgtagtattagtaagaggaggaagggttaaggatttacccggtgtgagatatcgcattattcgaggagccctagatgctgtcgcagtaaagaatcgtcaacaagggcgttctagtgcgttgtagattcttatccaagacttgtatcatttgatgatgccatgtgaatcgctagaaacatgtgaagtgtatggctaacccaataacgaaagtttcgtaaggggactggagcaggctaccatgagacaaaagatcttctttctaaagagattcgattcggaactcttatatgtccaaggtcaatatggaaattctttcaggggttttcccttactttgtccgtgtcaacaaacaattcgaaatacctcgactttttcagaacaggtccgagtcaaatagcaatgattcgaagcacttctttttccattacactatttcggaaacctaaggacttgatggtatggatatggaaaatacaggatttccgatcctagcgggaaaaggagggaaacggatactcaattttaagtgagtaaactgaattccatactcgatctcatagatccctatagaattctgtggaaagccgtattcgatgaaagttgtatgtacggcttggagggagatttttcctatctttcgagatccaccctacaatatggggtcaaaaagccaaaaaaataagtgattcgtttttagcccttataaaaagaaaacggattcttgaacctctttcacgctcatgtcacgtcgaggtactgcagaaaaaagaactgcaaaatccgatccaatttttcgtaatcgattagttaacatggtggttaaccgtattatgaaagacggaaaaaaatcattggcttatcaaattctctatcgagccgtgaaaaagattcaacaaaagacagaaacaaatccactattggttttacgtcaagcaatacgtagagtaactcccaatataggagtaaaaacaagacgaaataaaaaaggatcgacgcggaaagttccgattgaaataggatctaaacaaggaagagcacttgccattcgttggttattagaagcatcccaaaagcgtccgggtcaaaatatggctttcaaattaagttccgaattagtagatgctgccaaagggggtgggggtgccatacgcaaaaaggaagcgactcatagaatggcagaggcaaatagagctcttgcacattttcgttaatccatgaacagaatctaggtatgtagacacatggatccatacatctcgatcggaaaagaatcaatagaaggagaatcggacgatatctttctcgaaacaaacaaaaaggaaaagaaagagaaaacagaaatcatgatcaactaagccctctcgggggcttgcttaagaataagaaagaggaatcttatggaaatagcatggaataaggtttgatcctattcatggggattccgtaaatatcccattccaaaaatcgaaacaatcgggacttttcggagattggatgcagttactaattcatgatctgacatgtacagaatgaaaacttcattctcgattctacgagaatttttatgaaagcgtttcatttgcttctcttccagggaagtttcattttcccagaatgtatcctaatttttggcctaattcttcttctgatgatcgatttaacctctgatcaaaaagatagaccttggttctatttcatctcttcaacaagtttagtaataagcataacggccctattgttccgatggagagaagaacctataattagcttttcgggaaatttccaaacgaacaatttcaacgaaatctttcaatttcttatttttttatgttcaactttatgtattcctctatccgtagagtacattgaatgtacagaaatggctataacagagtttctgttattcgtattaacagctactctagggggaatgtttttatgtggtgctaacgatttaataactatctttgtagctccagaatgtttcagtttatgttcctacctattgtctggatataccaagagagatctacggtctaatgaggctactatgaaatatttactcatgggtggggcaagctcttctattctggttcatggtttctcttggctatatggttcatctgggggggagatcgagcttcaagaaattgtgaacggtcttatcaatacacaaatgtataactccccaggaatttcaattgcgcttatatccatcactgtaggacttgggttcaagctttccccagccccttttcatcaatggactcctgacgtctacgaaggagtgtggttcgttcgacaaattcctacctctatatctatctctgaggtgtttgggttttgcaaaactccatagatatgcagaagagaaatgctatccccactccgaccaagacagaacttttaccaaaagtttattgtgatctttttgttcaaataacaattaaggtgaagcagggtcaggaacaacgaatctctttatgataaacagatccattttgcaagctcgttattacgggtagttcctacaaagaatcggactaatgacgtatacaatgcttgaattatcgacgtagatgctacatagtgggttctcatccttcagagactacgagtgtaataggagcatccgttgacaaaaggatcaccctaagatgatcatctcatggctattgggaacgaatcaaatcagatggttctatttctcaacctttctgacttgctcctacggaaccaaggtcgaaaggattgaaaaagtcagtcattcacaaccactgatgaaggattcctcgaaaagttaaggattagtagttctttttcgaaatcgatttcgaaaaagaatggattcggtcttatacatacgcgaggaaggtaatcaaaaaagaaagaagacaagttcttctttcttttatcacttaggagccgtgcgagatgaaagtctcatgcacggttttgcatgagagaaagaagcgaggaatcctcttttcgactctgactcccccactccagtcgttgcttttctttctgttacttcgaaagttgctgcttcagcttcagccacgcgaattctcgatattcctttttatttctcatcaaacgaatggcatcttcttctagaaatcctagctattcttagcatgatattggggaatctccttgctattactcaaacaagcatgaaacgtatgcttgcatattcgtccatagggcaaatcggatatgtaattattggaataattgttggagactcaaatgatggatatgcaagcatgataacttatatgcttttctatatctccatgaatctaggaacttttgcttgcattgtattatttggtctacgtactggaactgataacattcgagattatgcaggattatacacgaaagatccttttttggctctctttagccctatgtctcttatccctaggaggccttcctccactagcaggtttcttcggaaaactctatctattctggtgtggatggcaagcaggcctatatttcttggtttcaataggactccttacgagcgttctttctatctactattatctaaaaatagtcaagttattaatgactggacgaaaccaagaaataaccccttatgtgcgaaattatagaagatcccctttaagatcaaacaattccatcgaattgagtatgactgtatgtgtgatagcatctactataccaggaatatcaatgaaccccattcttgcaattgctcaggataccctcttttagctgctaggtctatttcttagttcaagatccctcttactaactggaataaaagaattagtagatctgttccgcccaaaatgggaatgggcgctagggtaatgaacttataatcatggaatcgactcgatcatcagattataagttcattccataccggaccagaccatgcacattcttattaagagaaggggtcattcgagcctatggaaataggatactctgtttacatagaaatccccacgtccttacattctatttaggattaggaataggtgtaatcagacctgcttttgacatatctatcctatccttatttgggtaccatatgcacctctttgggcttctattgaatcgagaaattggattgtacatctttttgattttgatacatataaggtgtcctacggataatgcaaatcgaagctatttgatgtctgactcaggcctatatgaccgatcgatcgaaatactccaagactccacctttgtcatatattccatatatcacattagatagatatcatattcatggaatacgattcactttcaagatatcacattagatagatatcatattcatggaatatgattcactttcaagatgccttgatggtgaaatggtagacacgcgagactcaaaatctcgtgctaaagagcgtggaggttcgagtcctcttcaaggcataatacggagaatgcgcattcaatgagcattccccgtagagtattccggaaatctgcgcctggcgctctcctctatcttctgagggccttaaccacttccctgagaaaaggagacagtaaaagccaaaatagactaaatatagcctgaacgatcctaaaaatccctcgaaggagataatataataaagaacccaaagcagacagtatcctactgcaagggtggtgttaagaatccaaaagaggttgctcataagagatagatgtatcccaacctctattgctctcgcgtaaagccttttttttacgcgacaggaaaaagtgactacgaattcccctttttgtttgcgaatccctgtttgtatcctttgagcgcacgtccataagtagcgatcaaggaaatcgatcaaacgatcccaataccgtgaaagagaaacttcccagatccagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 44470 - DNA, 8939 bp, Oryza sativa
atatatatatatatatatatatatatatatatatatatatatatatatatataaagtgcctgtaatatcatgaatcgtcatatattcaaatggtacgatgtaccagttgtgaattaatgatgaagtatatattaattacaattcggtatccatcggctaataggttaagttgttattaatcccatgacagatcgagttgttgtatgcttgctttaatatttttatccaagattagtttagcccctccaagtacaaagtacagagcaacgatactaccctttaacaacggaaattatatagtagaaacataaaaactactaccataagataaaaatacacgtctgagattaatttgtccacatgaccatgagtaaaattaaagttttactaggggtaaagttttacatatggtgaggtggacaaatatcatatgttcatttttatcatatagccggtagtttatacgtttccagtacatattttcgtactttgtagtagggataattttttttagatcggtatgcaggcatgttaattcgagaggggtgtgacttatcaatcttcttccgttgctcatttgcgatctattaggttaattatataattgtttgagtttttttcatgcatgggaaactacggtaaatatcatcattttcctttttcttgataatatgccaaataaactttttcttatttataaacaaaattttccataatgtctatctcctaattattggaggtggactctgagggcagatataccaacacatattcaagccctacataggaccaactggacgtcgttttggcttagacagtacaacacaaatcttggaggaattatcttttagatcatgacaggtttcaacaatatcaaagtgtctcacggatttggaccctactagcttgcagggtaaaataagactaaatttcatcatataggtagacaagacaagaactggtgacttaattattcggttagccaaacgtgtcacaactaacggcaaagaagttcaggcggctgttcatgttattgtttactactaacggcaaagaagttcagagtagtataattgctcgtagcacacagccatacaaacactaatctacccatgctattctggctgctatctgctctgcatcctcctgctttatccattaggtatttatattattgttgttaggcgtggtaattgattactagttagtgtgaaagtggatgaagtacggtgctcctacctgtcatgatggggtgccagatttactattagagatatttagaggagcatatatataagtgtgttaaaattgaatcattatacgaaataggatgtgtgcgtgcagtttgtcatgtaaaaatttacttgtagtcatagaacagtagaagtatttctaaactgtacatcgcgataattaagttgcatggagtacgtagcatgttcatctctaaaaagcttaaattatgcttaagctcgcagttaacagataaatcaattgtactaattcgatatatcatatatatacaccttacatgagtgtactgttcaggtactaaggtgcgcaagaagtggaggattcgaatttatttcaaggtaaacggatcagcggtccacttaaagtcttttattgaactaagccaatagatggatggaatggtcagttatgtacatcttgtcgaaacaaaatactccctccgtatatgaaaaaaacgtcgttctagccataacctcgtttgcgatttaaacgacgttctgaaccgcagcaggctatgtggacggaattacccttgtctgttcgatagccgctcccgcaattaatccgcagcacgcccgcgctcgcctcgtttaattccttaagcgtcgcatgcaggcatgcagcacgccgctcaacctcgccgctcacgctcgccgccgccgcttgcgtcgcgctcgccggccctgctcttgtcgctctcgccgccgccgccgccgccgctttcgtcgcgctcgccggccgcactctcgtcacgctcgccgccgctgctctcgtcgcactcgccaccgccgccgcttgcgtcgtgctcgccggccccgctctcgtcgcttacgtcgcgctcaccggccgtgctctctcacgctcgacaccgccgccgccgctcgcattgtgctcaagatgcttgacgagaagcgcgaacgtgagctcactcccaggaaggatgatgccaaagaaatggtaagataacacaacttaataatcgcattacaaggatgtctctattaattgagtgcggaagctaactagcttcattctaaatgttcgatgcagcaagagtagccttggcttcatctaggaaagatggttgacaaactgatctgcaacaactcttgtatctttcttgcctagtttcctattcttgcttctagccaacaaagcttgataaacttgttttctcacttcttcggtcatgtctttccttccttcgatggtttacttcaacgggagccacgacatgttctagcaaaaggaagaaaatcaagttcattgatagtacaaataaccatggcatgttctagcaaaatctaattgtatcaaaaagcaagttggcttaccagcaaggtgttgtacataatcgaaatcgactgcaccaaattcatttagtggcaagttcaaatcaaaaccagttaaaaaaaaaggaaaacaatgatatgagaaacgatagagaagaagagatagtacagttgccgtacaaacatgcacgagagaagaaaaatcctgtcaaacagagaagaaaagtaccattgccgtgctccaacggaggctcgttcagatcaaaggcaaactcgccatcgccatcttcggccatgtgtactgcaatagtgagagaaagctagctagaagcctagaactagaagatgagatggctcagtactccaaacgtgaaagcaagttagcgtatatacgggcaagcagtaacccaagcgtcggcattctcagcacgcgcgcgcgaaaaacttaccacggcataggcgcgcgaatagcggtaacgagcgccaggcaaaaaaatttaagcatcacgcgcggcagtgaacccaaactaaaaaagcaaaacaaaaaacgcgcctaaacgccacctgcatgagcgccatgcagtcaaccaagtatccaagcccgcctaaatcagtgccatgcaaaaccaagcaaccagctcgccaggattcgaacctgggtcctgcggaatccagcctcggcgcactagccacttgagtaaagtgtttttctcatatggaaggctacgcgcaaccgtatttaataggggtagacagggaaaaatacctataattaatcacttcttggtatgctaaatgctgtcctaaacgtcattttttactagtatggagggagtatggttgtgaacttgtgattcctcttaacatcagtgagggcctgcatatttaaacaaaatatggttccgaactggggtagtgcagatcacatttagcggtaaaactttcggaatattagttaattggttcactgacactatactagtaatatttttgacaaactttggagatgtttggtagcctaatacccaaaaaagcgtgggcaactggggcatgtgccacagttgattttttcagaacaacaaaaatataatccattaaaacagtcgctaacgctgtacattttaattattagtgaaaacgaaatatacaatattgtatactgacattaatgttattatcccaattaacaaaacacgagaccacattttatactgacacatgtggcctgtagtaagccgagcagaccgagcaaagcgcccccacgtaagccgattcgcgacgagttcatcaccgcgcctcggcacacgtgcccccacaccaattaaaagctgcgcacgtcggccatcgtcgccgtcgaccaccaccgaaccaaaccaaacctcgcgccatcgatcacctccaccttccattaactcagccgccccccaccacgcctcgctcgatcgctcgccgccgccgccgacgacgaccttgctcgcttctgccggcggcggaggtagttgttgagatggggaactgccaggcggccgacgcggcggccgtcgttatacagcacccgtcgtcgtcgtcgtcgtcgtcgtcgtcgtccgggaacggaggaggcggcggcggcggccgcgtcgagcgcgcgtatggcgcggtctccgcggccgccgtgatggccgccaaccccggccactacgtcgccgaggtcgttcgtcccgttgccaccgcgccggcggcgacggcggcgacggcgtcggcgcctgcggcgaggcggcggctgaagctgctccggcccgacgacacgctagtgctcggcggcgtctaccgcctcgtcaccttcgaaggtgcgtctacactacagcctcttcttgcatgcgtctcccgccgccggcgagcttgatactcacacggatgacggatcaatggcgatgatcatctgcagatgtgctgaagcagttcgtgtcgaagcggaacgccacgatgagccgcgccacgatcgccaccgctgccgaggacgacgatggtcaccggcgacagggtcaccgcggcggcgaggcggcagcggcggcgccagcgaaggtacgaccatatccaagcattcttacgtgtagagatgagatgagatgagatgacgcgtatggtgtacgagttcttggtcagccattaatggcgattggtgcgtcacaaggaacaaccgagacgaacgctataattagcgcgacttgttgggagctgtacgagcattggttgcgagcttggtgacgtgagttaattaattaattagcgaaacatttccatcgttttttttaatttcccttttgaggtagacgacatgtcggcatatgcatatcatccttcgtttttaggtaggactgtagcgtcccgaagtactcaaattaacctactacagcgaacactgcacatttgaaagtcaatatcagagcttgatatatgtgtatgaaaaataacagccaaaataaattgcatcttgttatatcaggaagaccgtaaagtcaaaatgtaaaattaaaaagacaacagatgaataattttctacaagttttattgtcgtgatatagtatgaagaatacataataaacaaattctaggttgatacatatatgctaagaatataaagctttttagtatcagacacacttattgaaaaatctgttttggaatataagaatttttttagtgttggacatagtcattaagaaagtacgtgatcaacctataacatgttttttttttaatttcaattatataaaagacccatactattatacacgtactccacagtaaacaatcgtttaggctgagttcgttttgaggagatgggaacaaatctcctgcgcacggaaaacggagcgatccatcagtatgtgattaattaaatattagctatctttttgtaaaaatggatcaatatgatttttttaagcaacattcatatagaaattattttgtaaaaaaaacgcaccatttagtagtttgaaaagcgtgcgtggagaacacggcggggaggagttgggaacatagccactatattattgcatacaccacttattttaattattagttcagtttatttcttgaaatatttaatttattcctataattaaatactccctctgtcctataatataagggattttgagtttttgcttgcaaagtttggccactcgtcttattcaaagttttttgaaattattatttattttatttgtgacttactttattatctacagtattttaagcacaactttttattttttatatttgtaaaaaaaattgaataatacgagtggttaaacgttataagaaaaaaaaactcaaaatcccttatattgtgggacggagggagtagataatatgtaatccgctcaagaagctatatcaaactcagccgctttatatgcctccaaaatcaacattagtttgttttacatgttgagtggcccaacatacatcttacttgtactttcatcattgttttatgtattaaaaaacccctaatagatgatggttgggaacctacataggtagcaaattttctaaccggtgccccgctatgcggcactgataacaagcatcatgcacaatatatcatttatcgtaagacatatatggggtagcaaatcgagcatcatacggcaaatctcgacttcttttcaatagatagagaagcaccaaaattaagtagtaaatgaaaatcaaaaacgaatcaaccacatcatacgaatgaactgcagacacacgtcactaacccaaagtcaaatgttaaaccattaaattattactactagctagctcagtactccacatgacacacactaacaatcctactcaatgtatacacaggtggcggcccagtctcgtcaagagaatccatccagcccaagcccgaccgatgaggcccggcctgagcctgaacccgagcccgagcccgatctcgtagcgacggccatggcgctcggcgggaggatgagcctctcccggcacgggcagtggaggccggcgctgccgagcatcgccgaagggagcgtcctgtgcttttaagggagggagatggctgaccaagtgaccatatgttcaaaatatgttacactctgatctgcagagcttgctcactgcagccgtgggttatattagctgtcgtgttatacgagagtctctgcatatatttttctgccctgttctgtttgaatttgaatcggagtttgtcagtttgaattagtcatggcatacgtaggagataattgtttttttgtgacggtacgtttaacacacatgtatggacctacttcttgacttgtaattttattttattttgtcgtcacccatcgatctgtgcctaatctcgtcgcagaatatgtagctcaatgatgggctgatctgtaatttatgggtatgttcgataggctattgctgcagcattctaggctgtgctgcaagttttgccttgggatagcaacggggcgggtttggggctgggttggcttggaacagccccgtccccgacccccgaactctccacccgcccccgcccccgcccccgcccctgcccccagcctctctaggcctcacaacccgaccggggctccgcattgagtaacaactccatccagtcgtctgtgcaccgctgccatctctctgcacgccgtcgtcgccgtgcctgtgcgcctatgtgcagccgccgcgcctggggcccaccgtcgtgcctttgcactgcgccgtgcgttgcccgtgcaccgtcccgcatgctgccgccggaggagaggggcatgcgaccggagtccagaggggaaaggaggggaggggactgtgaagagggcaaccagagggagaggggactggggagagcggtgagtcggcgagatccgaacttcagattcgaagtctgcgcgtgagcgccgagcgcgtatgcggctgtgtacggcgcgcctgtgctgtgcggcggcgtggtgggtggtgggaggggaggtctggttggggtaggttaggtttttttttccttaaatatgttgattctagtgggcttcttgggcctgtattcctgtaatgggctacattttaagagttaatatacctctccagaggcccacggggtcacccacaggtggaatgttctccccatcccctcacccgcaaaatgcggggcccctgccccgatggacccgcggggcagaaatgtcacccgcccccgcttccgtaggggtgggtcctcgcagggaacccgccctgtgaagaaaattgccatccctggtttagccattcggcttcaggaaacagctgctagctactggatggctgtatagtaactcctatagcaaccggagggagaggggactggggagagcggtgagtcggcgagatccgaacttcagattcgaagtctgcgcgtgagcgccgagcgcgtatgcggctgtgtacggcgcgcctgtgctgtgcggcggcgtggtgggtggtgggaggggaggtctggttggggtaggttaggtttttttttccttaaatatgttgattctagtgggcttcttgggcctgtattcctgtaatgggctacattttaagagttaatatacctctccagaggcccacggggtcacccacgggtggaatgttctccccatcccctcacccgcaaaatgcggggcccctgccccgatggacccgcggggcagaaatgtcacccgcccccgcctccgtaggggtgggtcctcgcagggaacccgccctgtgaagaaaattgccatccctggtttagccattcggcttcaggaaacagctgctagctactggatggctgtatagtaactcctatagtggctggctagctggctacagcgtagccgtaaggctgctgcagctagatctttagaacaaagggttatggattttctacatctagttactaagccatccatcatttgcacgtgacttaaatagttacagaaaaaattaaaaatttaataacattaattgagatgatccataactagagaaacaaaaataataaaatcgggtaaatagtacttgtaaagttgctacccactaatactcctaaaacacaacctgtaaatatgccacgtcatcacgtactagcaactattactctaaagcattacatgattaatgctgatcacaattagaaccaactgtaactttcttactcctttccatcccacccactgaggcatgcacatgttttaaggtttaagtccttaaatatttaaccaataaatagtgtggagattatgggtatcccatacccacacggcatggttatccgactagtcataggggatagcttatatctatggaatatgtaacagatcatgacttggatattacgtttccttttatattatggagcggcctaaagtcctgatttgataatattgt

SEQ ID NO: 44471 - DNA, 22356 bp, Oryza sativa
  unsure (1)..(22356): unsure at all n locations
ggattcaaatccccaaacaggagtaaggtattacctctcattgagagggcctgaacctgtctaaatccttgtctctgcatccatccacttttaggtctcgtgcactaccccttttattattgccgaattcatgtttcgacagttggcgcgctaggtaggggtgcgtcgagtttcccgtcgaaaagtgtgatggaatcaatttctccggtatcatatttgttcaagcagcctagattctaccgctgctggcatcatcttctgatcaaatcaatctacgaagagatattgggtttgtcgttccaatttaactctcaatagattaatttttaattatagattgatctacgtactcgggtattatttttgttaccagtgtcgtcgtcgttgccgagcaacaatatcagcctcctcccagtgcaaatccgagcccacacagtgcgagttcggatctacgcctacaccgggaaccactcggcgaccacgtgacatgctaaagctcgtaggcctggatcggttgctgccttgctgctacctgcaactcagtacacaggagatttggccatgctgcatgccgagcgagaaagcacatgcctgcatgttgccttttgcatgtcacctgatgattgttctcgccgggattcgtgccgtatattggcctgagtgcacatctcctgaccgtttcataattttccatatttagattgatttctaatctcaaattaatctctcgttgtttttttttgttgttgttcgcatataattacgcggcactattgaggcgattaatgctggtcatggactcgaggcgtctcagctttccggtcgatcagccgcgagtccattccgccggcttgtcgtcgccaccgccattgctgatagcaacaacgacttcaccgccggcttgcctccgtcgccgccgattggtgtctccgcctacacggctagcctgttatgccgccgtcgttgggcgtctacggcttcaccgccggctcgcttccgtcgccgccgactggtgtcaccgcctgcacgggtggcctattatgccgctgttgttgggcgtctacaacttcattgccggcctgcctccgtcgccgccgactagtgtcctcgcctatatggttggttggtcacaccaccgtttatgggcgtccgcgtcttcaccgaccgactggccttcgccgccgccgactggtgtctctgcctacatggctagcctattatgccgccgttggtgggcatcttcgctttcaccgtcgaccgccttcgtcgccgccgactagtgtcttcattgttattgatggacgactttcttcccacattggccacctctgccatcaccaaggggaatattacaaagctaagtcatcattaattttctttatatgatattttcctttccttctgcctcactacatcaactgtttcgccgttgactagtgagtcgggggctacagatgttatgtaatatttttaaacaattttcataatatctatcttgattgcttgtgaaataatccgagtaacaataaagttcctatcgagttatggagttctatcttcctatgctttccgtttggtttgccgatggatagttgtttttgggccgattcctagcacccgggggctcgttggatggaccgagtaacgcaaggtgctaagtattattcggaataaatcaaaagcatagagataagataaatttattttcttctcttaacaattgcaaaagtactcgagtagtaaattcagattcgtgaaacttttgttccattattgacgaactcatgtcactcatatgcatgtttgggaagtgcctaggctgactcccggtgcttgggggcaatgactagtcggacagagcgtttaaacgtaatgagtcatctgctcggggaaatcaaaattgacaagagaagaaaaacatattcacaaacgttttaaaatgtttgaattttcctcgagtattatatttatatcagatactactcatcctatatgtttgttctgtaggatccagatcctgataggcacaaaagggattcatggctttaagcttatctcttacgctctaggaatggatcagtcagaacatcaccaccggcttgccgtcgtcgccgccgactggtgtttccgcctgcacggctggcctgtcatgccgccattgttgggcgtctacgtcttcaccgaccggcttgccctcgtccgccgccgactggtgtttccgcctgcacgactggcctattatgccgcctttgttgggcgtctacctcttcaccgactggccgcctcgtccgccgccaactggtgtttccgcctgcacggctggcctattatgacgccaactgatgctaccttcttcacggccggctacgtcgccgtcaccgctaataggcgtcatcatcttcaacgcaagctgtctacgtctgctgccgactagtttattcacttccatggctacatgattctaccagtgttgattggccttatcttgttcaccgccggtcatctcgtctgctgttgactagtgccctcgcctctatgtccggtttataccactaccactactgatggacatcatcgtcttccgtcgccgactggtgcttttatcttcacaactgcgcgtcttcaccaccggtttgcttctgttgccgccgactcgtgttcacttcatcacagctatgcaactttgtcaccatggtgaagcgacttcatctatattatcttcggcaccggcaaacctaattgccgctacttcgcaagttttgctacttcaccaaccacgacgtctacaagagcttcgacatctcggcatgcacttccatattcgatgtcgtgttattctactacaacaagtggtgttccaatcttcaatatttctactcggacatcttcaaacgtatcttcactcaactgatggctactcgatgacatgaagctacagttctcgactctatgttcagttgtttctcaactaaccaaagagtcgggggctacacaaataccagactcaaaatttgacaagctttatgtcaagacaaagcaatcaatcagccaatgagttctatagaatctacctcgggagtcatcagtttcgtcttcgcttcagagcagacgttctacttcagcaacatcaattatctttataaatcaagtttgatggattattgtcactgacatcatcatcagcacatctacttcatcggtcctgatgtctccgccgttgctaatgggtgactacgtctttgcctccggttgcttccgacattgccgacttgttatttcgccttcacggttgatctattattgccgatgagcgtcttcgtcattatcatcggctgctacaccgctattgactggattaccgacatcgtcatcttcatcatcttcatcaacatcctgtcaagcctcttcaacatagcccactctactgctattgatgggcaacttcgtcatcatatttaatcatctctattgccgctaatcatcattatcgtcggatgcgtttgccatcgccgactattttcttcatcttcactgttagttgatctgactgctgtcgactggtttcttcgcttccatgccgattgcatcagctatcactgatggacaatttcaactactccaaaaggataagctatatgctcaggggcttacgagctcaagcacaaggatcatacctttaagccggattgtgttctagatacaggcaacatgcactcgtagtcctgagattattttctatgttcgaagactggaccaatcattattccccgtaagcccgtaagggctatcaaccgaatacttgcgccagtcgggattcaatttttatatctattttggagtatcctataagggataatcactcagatcagaagctattcatatgagctatacttggtctatatcacccggaagatttattattcgggagcatgttacatgcgtcatcctttaaagggtgtcgaaggcatattttttggcctaagcctaatatgtctgcagcctatattttcaggtgtggcctgtcacgttcttttagggacttaggcactttttgcttaggccaaaatgcacgtgatcaagtgcccaataccttaaaatccttttataccgcagttactcaactttttaggagttggtacaatgcatcttaaaaggtgtcaaacagtaaagctttatatagctgtcccgctgacttttttatatagtcatggcgctgtttgggtttatcaagcaattgattgaatacaataccattgctttttgcaatgtaagtgtacacttttattgaccaatattatggtttaggctgattatatactgtggtcattttccaggcggttggtaaatcctttatgagtttatttactcggatgttacaccacatatgccatatattttcaggtgtggtgaaaccatgtgtcttttagggacttaagcacatctgttaaagtagtgtgcgcatggcgtatgcccaatactttaaaaaattctttattcacgtcatacaaggttctttatagctatttttgctatgtgaatttttaatgatgtagtcaactttatgttgtacacatcatgttttacaaagcagtcggtatatcacttggattatattattcggggattcacaatgcacatgctatatattaatatcaagtcgcttggttgactacaattatcgaaaccactttgttggttggattatttattccttaactgtatgcttggtttgttcaattaaccacattgtcgggggcgacacctattaggtgcatctggtcgatgcacctgactttatttttcagccctccacaatcttcagatttggtaaaagtactcgggagaccatggcaaagatgattgaagcactcggctttggagtaatctaattcgagagaagattatcttttcgactgtgaaggtctcaggggctactgtggagattatggataccccatacccacacggcaaggttatccgactagtcataggggatagcttatatctatggaatatgtaacagatcatgacttgggtattacgtttccttttatattatggagcggcctaaagtcctgatttgataatattgtaaaatagatttaggaaaccgataccgtcttggttaaggtttctatcttgtaatcctgccccccatcctatataaggtgggcaggaggccctctagggggcatgagcacaactagatcgtcagatctatactacactcggcggattcaaatccccaaacaggaatagggtattatctctcattgagagggcctgaacctgtctaaatccttgtctctgcatccatccacttttaggtctcgtgcgctaccccttttattattgccgaatttatgtttcgacaaatagtttattataaattggattttatttcatgaaaataatatcatccgattctcatttaaatttactttcatatgattttcattttgttgctataaacattgtagtatataaaaaattataagtcaaagaaagtcttaaagatcgtgccaagtttgaccgcgtcttagtgagtgggatgaagggagtaataaattagtaaataataattagtcaacttgaaaattttaaatttatagttgaaagtttcaaaatttgtaattgaaagttttgaattttagaattgaaagtttcaaaatttgagttgaaggtacaaaaatctatccacaaataacttcaaaataaaaattttaattaacatcaaattcgcaaaatggaaaaaatattttgaataaatagttgcctactaattggcccacaaagagctggcccaagaaagcaacaacgtgctgctgtgcctgtgctagcccacacgcacgcaatgttgacatagtgcgcggaataagtctattttgcctctctcatctattacccctgattgaagcgcatccttcaactacaaaatggctcccccatctttgaaaaccggtgcaaatcgactattaatttcagtggtttgggaagtggtttatgtaggcgaggcccacatatcaatgaggtatgacaaaagatatgtggttgcccttttatgtcaattccttttcttcttccccacctctccgtctttcttgtctctccttgaaagcagcagctgaggtgagaaaacgactacgtggaccatctcacgaagttctcaagcgctgagaagaccaccggaggcagcacagcaagaacccgtcgatagcggcacagccgtcggaatccagaaggagcgtatccctcgccactgcactagaagttggagcacctctattgccctatcctcccctccttctcatccccgctcctctcctcctcaaacaagacccatcctcatccatcttctcatgcctcaccaccgccagcctcgccacttcctagggatgagcccgtgcgttgtgctggcttaatatttagttttcgacgtttgtatcggagggtgccgtaccaatatttctgaaaatttgaaaaaattttggtcaaatttaaataaaatattacaaaattcacaaaaaagaaaaaaataaaaaaattgattgaaataatatcatatcgggaggggggggtctgatagaactgaaatttcattatgaaattttgaatcctagcgttgcctggagaggggtcaccgctcgctagagggatctagcctcatgcaccgtgccgtgccgacttgccaatatagttggccatgtgggccgcccggcacggcacggcccaggcccggccgtgcctgggccaaggcttgtcgggccggcacggcccgaccgacgcaccgggccgtgccgtgccagcccacgtgccgcactcacggcccaagcacggcccaacacgcctcgggccgtgccgggccggcccgaaggcacgatgggccgtcgtgcttttcctcagaataagtctaaatttcctccctcctattgggctgtgacatatgtacagctacaaaaagtctattttacctccctcttctttgggctgggtatataaatagctaaaataagtctatttaaggtccctattctttagacagttacatttatatgtctatttttagtccccatactttatgtaccgggcctggcctgccggcccatcgtgccgggccggcccgaccgtgccgggccagcccagcgtgccggtggggaggcccaggcacggcccgacggtcgggccgggccagcacgggcccgacccaagtcgggccgtgccgtgcttgggccgggccaaaaaggcgtgccgtgggccgggccttcgggcctcgggccttatggccaactatacttgccaaccaccactgacttgtccagctcgtccgcctacatgctgcctccaccagtctgctcccacgcggctccactttcgccgctgtctgtggtgccgatgcgcttggccaaaacgacaccgcccgagtagctgcagctccccacttgaaaccagcctgagcgaggtacctagcatcattggagaggcagctatggagctcgattaggccatccgggataagaccaccatggtcgccgtcaaccaccacgacaacacgaaaaacacaacacatccgaacaaccatcatctagctagctatatggagcttgaggaggccgtgcaggatgatacccatggcgatgcacattctcggcagcctcgtcacactagcaccacgtgacattaatggcgacaacctgatcatctcctagctctcactccacgtgacgctggcactcctcaactcggggggaggggggggggcggactccacacggccatgatactccctgttcttgtcggtgatatccccgcccactgcgacgagaggaccccgaggaggatctgtggtcattgtcagtggacgtgcttttcgacaacaccggaggcagagggagcagcttcggagggaatgcgacattaacgtcgctgccacattatttggaggacttcacggggagccggaagcctctgtcgaccctgaaggggttcggcatggcctcactcgcgtgcagcacgccgcactcacgcgccacgcaccgcctctgctagcgccggtgctagtgcatcctctgcagcggagaagaacacgagcagtaagagggagaggtaggaaatgagaaaagatactgacatgtaggacccacaatatatgttttgtcatatctgactgatatgtgtgcggcgcttacagaaaccgcatcccaaaccattatagaaatcgataaatcgatttgcaccggttttcaaagatgaggaaggcattatagcttgtaaggttgatggatgtgattcaatcaacaagagagaaggggcgtaaaattagacttattcctagatgcggtaactagtctgctgctttacaagtgtatccgaaatggggaatccttcagtttatgatgggcctaggaggccataacctagaaaaaaaaatcctcccaataggccatgagcaatcaagttcacccgccatccactcgtgtagtccacgccagccgtccgattgatccgtcaggacctaccattcccctacatgagcccattcataatagcccataatggttctaaatctgtagatgaacaaaactaacaaaaaaaaaagaaaaatagcaaacaacatttttcaatacattatatcttacatgtagcattttacatgcagtattctggacaattatgattatccaccctagcaaatttttgtaatgccaaagtgtcaattctagaaatcgggcctatggactttttgagcatgtccctcttcttctctctcaacgaccaacaccgtgcttaccacctgagtgtgttatttttttttagtgttggctggagcttaatcactattaccgaagggaacatctttaaattttttagaagtttccctttaatttgacactagtcaaattaattagatgcgactgaggtgtcctaattgatctcattcgaaaaacataataattgctatgagtttgccaaatcctccgtcaaatgggatgggtctttccgtgtccgcccgggcatgcatgtgcagttgacaacccaggaactacatgacccgtttggctgtgcgcgacccgtctagtcacaccgtgcttgggctgctaaatggcccagcgtgctaacacgagaagtgcatgtagcaagctagcacggcatggcccaggaatagcacaacacggcctggcccatgcaacacgatgacgaccgatgactggcgaacaaccccattcatgagcaaaaccattaagcacgtcggtcattgggggctcactagcttgagacaaaggaagtaggaagtgaagtgccacggtggtgcttagcgacgaggaagaggaatgtgctatcaggggcagaggacctcgctagagcttcgtcggagtttgtgcaacaggatgcaacaaactttgtttgtatttctttcttggtgtttatcatatttgggctaatcggcctccacatagcccacgtaccttaatcatgccaagccaacacaaaatgacccgacatattactaggccgtgcctaggctccgaccttagcatatgggccgatacgacctggcctgttcggtgactcctgcctaattggaccgtgcccaaatgtaactattatttatccaccatctcaaccttatctctactattataaaaattgaagatgtttttgccggtattttggtacgtcatccgtgtttgagttggttttatgttcgctcacttttgaaaatacagattcatgtatgagtccgattttaagttcgtttgcttttagaaaaaaacaaaatgagtcatataagaaatctctttaagaaaactcgcatactaacttgagataaaagtcggactcctgattgcagctcatgattttctaagaaaaatatgtccaagcgaaattccacggtgaattttatcctagctaaaccgtacaacaataataagattataataatcttcacccgttgcaatgtacgggcatttttttctagtgtataaaaaagataaaacaaaaatccaccgttccgaagatccaaccctaggagctccatttggaggatgagattatgactaatgaacattatcctgctttaaaaaaatacattatttccattttccggatttacaccctttgggtagggtggggatgggatgtgcaatcctggtggatctaatgctaggcgaaattacaaaactatcatcggcattttgaggtaggtatggtttggcctcagtcgtgcgtgagttatccgtcagtttgcccaccgcctccgcctccgccgatccccatccaaccgcgacagcgagcgagcaccgagcaggttgccgtcgttcgtcctgctccatccgcccgcatccatcctggtgagcacatcctctgccaccgccgcctacgccgatccctgtaacaccccgctcgccggcgtaagagatttggccgccgcgagccgccacccgccggatgtgtgaacacgcgagggaattgggggtagttcgtctcttttcttacttttgataatcgatgaggttacagccgtgttccagacataatttaaacccctcagcacgacccaccggtcaggcctaagcgcgcgcgcacacacacttattacataaatacgctttcttcacaggaagacgccttttcctcaatccgtcttccctgtatcgttgctgtgtaatgcctgcatcttcaggtgccacacccaccggtgtgacactgccgcccccatgagaaacaggatgtccccaaactgttgctaacggaaaatgagctcgcagcacagaatagtcctcccaagtagcacactctggtggcaaaacacccaaacgaacaagaacttgtgttagagccgcattccctttcttgaccaaacgacgatccaatatctcagtgggttctagagcagaaatatccaactggacagttgtcggcaactcagagaaaactggaacatgtgaaggaacaaaatgcttcagttgggagacatgaaagacagggtgaacctgactatccacaggcagtttgaggcgataagccacagaacccactttacttagaatttcaaaagggccaaaatacttgaatgccaatttaggatatggacgcgatgccactgatttctaaacgtgtggttgcagtttgagaaacactgaatcacccactgcaaactcacgaaaagaacgcttctcatcagcatattgtttcatgcggttatgtgccttagctaactgatgctgtagcatttaagagaaaagttgtctgtcctccagcaaagactgaacgccagtatcatccataggtgcagcatcaggaagcatgtcaggaaggaatgcataccttggatccatgccaaatagagctttataaggtgtgcaattcaaagatgaatggtaagttgtattataccaatactgggccaaaggaagccaagagcaccacttagttggagaaacagaagtagcacaacgaaggtacatctcgaggcactggtttactcgttctgtttggccgtccgtttggggatgataagttgtactgatgagtaaaggaaccttcattttggcgaacaacactttccaaaactggcttgtaaaaatggcaacgcggtcagaaaccattgtcttaggaagttcatagatagaagctactctgtccagaaaaactgaggccacatgttgagcagtataagggtgttttaagggaataaagtgtgcaaacttggtaaaacggtcaaccaccaccaaaatcacattcttactgtcagataatggtaagccgtcaatgaaatctaaagagatatcctgccacacaccttgaggtacaggcaaaggttgaagtagcccaggtgatttacataattcatgtttagcttgttgacatatgagacactattgcacaaattcctggactgagttgcgcaaattagaccaaacaaacaatttatgaattctttgaaatgtggcttgcacaccagaatgtcccccaattgctgaacaatgaaaggcagcaatgattttagtttgcaaggctgaattttcaccaatccaaactcgccctttatgtttaatcaaaccccccactaactcataaccttgatcattaggagaaataacagccagctcctgcagcaacttctgagcctgcatatcaacggcataagaattgactatctcctgtatccacggtggctgaaccaaagatacacttgaacaagcaaagaattgaccaactcttgaaagtgcatctgctgatttattgtccacacccttcttatactgaaagtgatactgagtccaattaacttagtcattgctttcttctgcatctctgaatccaggacatgagtatcaagatgacccagaaatttgtgatctgtcttaataacaaatgggcctcgcagtaaataaggtcgccacctgtctactgccatcataatagccataaactccttttcataaatagaaagtttttgattagcagtacccaaagccttgctataatatgcaatgggatgncccctcctgagacaaaacatccccaatgccagtgtcaaatgtatcagtctcaatgacaaaaggtttactaaaatcaggcagtgacaaaactggggtagtgatcatagcttgtttcaaagtctcaaaagcctgttgagtgacagaactccactggaatggtaaattcttcttcaacaattcaatcaagggcttagccaacaaaccataatacttgacaaattttctataatacccagtgaggccaaggaatcctctcaaatcatccactaaactagggacaggccaattttgcatcaccaaagttttagcagggtcagtagctactctagttttagaaataatatgtcccaaatactccaactgctgcaaagcaaaagaacacttactgggtttggcaaacaatttatgttgctgcaacaatgtaaataccaattccaaatgttcagatgatcctctagagaatggctataaatgagaatgtcatccataaagactagaacaaattttctcaaataaggaccaaagatagaattcatgaggcactgaaaagtggcaggtgcattagtcaatacaaatggcatgactttaaattggaattggccatggtgggttttaaaagctgtctttggttcatcacactcttgcattctaatctggtgataaccacttcttaaatctaatttagagaaatattgtgcccctgcaagttcatccagcaactcatcaataattgggaggggaaatttgttcttcatagtaatagaattcaacttcctatagtccacacagaatcgccatgaattgtctttctttttcactaaaagaactagagaagcaaatgggttgagactaggaaccaccatgccagactgaagcatctcagccacttggtgctcaatttcatccttctaagcaggagagtgttgacgaaaaaatcgaacacaccggcctaggagatctgcttagctccagtgcagatccaaatatgatgagatgcgggcgtgccagtcagtttgaccctgcaactaacaagatatgtaaacggtagatcaaatagccgatcggctgacaagccgatggagtagttctagccgatagccgataatagccgatgccgataccagccgatagtgatagggtttaagcaatcggctatatgtccaatatagataatgatataaaggtaatcagctgatgatgatgtaataaaataataatataatccagtataaaccaatcggcaaataatgatatgataaataagcatcgatccgaaggttaaagcacacatcggctggaggtccgatgtcatgaaatctacaagattagattgaacagtgaaacctttgttgtcatcggctaaatccaacttatatgtatatgcaatccttatgagccgatgcaacgtccagataactcaccggctgaaactccaataaaacccttattggcaatcaggaagtaggctagagattatggttctaagcatgacttagtagatcaaacttaactgatgcagcactaagaatgaaaagaaacataatatctagacaatcaagccgttgactgagttttcagggtggtagatgtctaagctaatctaatctagcaatgcgatttagctgataccggcagaaaccctaaaacgagaagcagccaatagagctaaattgatatgctaagactagattaacaaagacatatgataaaataggtaggcaaatatatcatccaaaccagagcaatccaagaggtcaaatgtactgatgcagccttgaacgacgccgacgtaaacgatacaattgcccgggccagcggaacattggacttaccccttagccggagatcgaacaccgatgcagccccgcgtcaggtgccaagtcccgccggacgataaaataaagtagaaaaggtaaaaggtggcgatgcgccgaattgtattgatcatgaggatagattataatgaccccgggtttacatatttatatccatgggtagatactagtccttgtaggacgagaaagaaactttcctaaaaaaaaggaaaacataaagtccttataggacactaaacacactttcctaaagataaaaagaaaactaacaaactattcctaattaatagatacaactgccttcttcggactcgatctgtacgtggcaatcacgtcaactcaatccgacaatgattccaatatcaccttgccggaatcggctacatcggcttgccttgttcgatttggtaactgccgatgcacactgtagccgatgcggttccgaagccgattcataccctgtttccattatcgatttcctcccaaatccgcttcggccataactccaaattcgatgtaaatttactaaatttggttgttaacagagagtacctatatggcctggtgttaacaggagctgcattagggagcagtgtaatagcatgatcaaaagtcctgtgtggaggtaactcagtaggggactgaaatattggttgaaacttctgaattaattgctggacagcaactagaaggatttgctgaggtacatgctgtacttgttgaatgacagccactgcccagatctcattgccttgatgccacatcaacaactgctcacctgaaattgcctgcaaggactgagaagtaggagcagtgggtttaacaccttgcaattgaatctgctgccctttatgatcaaatgcaatccacttatctacccaattacaagtcatagggctgtgttgtgttaaccaatccatacctaatattgcatcatatccccccaaatccagaattctcatatcatggcaaaaagtatggccctgtatccaccactcaaaatctggtaccatctgctgacaaatgacttgctaaccattagcaaatggggcatttgtaaatttgctaccagtttttttaatattgcaaggataccactcgaatgacggttctaatggcatttttgcaattttttagtggcagttttgcaataacgattcaatttgatgatatatgatgaaatcacaataaaataaatgataattacataattttttttaataaaacgaatggtcaaaacatatctaaaacgttaacagcgtcagatataaaaaaacgaagggagtatgaaatgagctttgtactataaaaatttacatattttgctacatggagattgactattgaggcaatttgctgtaatcgtgtaggtgaattttaggccatcacgtttcactctgtttctcttcacgagtgcgtgaatatattgcaccccaacgtctgcacctatgccatttaaatggtagctatgtcttaaaatatagtcctctatttcaaattgatcatcatataatatcatataatatttgtacatcaatatcaaggataatttaaaccacatcgattaagacgtcatgcataatatattaatatgtatacattctcctattctcctatgttgtgttaattatgctatgataaaatccgtgtttatataacatatggttatatgaggatcaatttgaaaaattttagtttttattatatgtcgatcaatttgtgaaggcacgagtaataagttttaaagttaggtgcgatattaatgcagtggctaggcgtataactgacctgacatagattaagctgaaccaagtgatccaattattattcactaattaagcaaaaaaggaaataaaaacaagtacaaaattgtttgacaaaaaaaaaatcgagcacgctagcacgaggacaatgtacgtgtcacactctcctagaccttaatgttgaccaggcgctccgacgccaacgacgcggcgtccaccgtcatggcgcggacggtggcgttcgttcccagggacgggtggctcactgtcaggttgtagtcgccgtgtgggaggtcgagctcgacggcgccgtcggcgccggtcgtcgccgccgtcttgtgcgtcttccactcggcgatcagcttgtcgacgagggtcccaacgggcaggttcttgaagctgttgtccgtcaggcacatcacgtagcaacccttggcgtgccacgccgcccacattatcatcccgttcaccgacgggtgcgcgtacccttccctcagcacctgctccaagaacttcacctgattccaccatgccaaacataatgttattaggtaatgtataacttaatttggtgtgtagatttttcactactaccagggttaaatcttttgttttcggtattcatatcgggagtgccgatatagcgatattttagaaattttcgaaatcatgaacaaaatttagtcaaatttggacaatattgccaaaattcacgaaaaattaaatcaggctgaaataatatcttatcgggggattgggttcatgatataaccgaaatttcgaaaatttcagtgcggaattttaaaccctgactactactattgcagaaaatgacatcagtgtcaggtttacctggttgggtcctttgacgacatcgacctcggtgagccacatgggaagcttgagctgcgccaacgtgtcgagggcgctcctcatgtaagggatgtttggggtggagaagtggctctcgaggccgacgccgagcttgagggcgctgttgccggggtagctctggatctgcttcatcttggcgacgtacttgctgggcaccgggttggggtcaccgggctgctccagcgtgttgaactcgttcatgaagaggatggcgttcttgtccagcgcgcccacctggttgtagatcatcggcgacgcgttcggccccagcttggtctcgaagaagttgaagtgcaggttctcgttcaccacgtcccagtggatcaccttcccggcgtaccgcgtcaccaccgacttgagccgcttctgcatcgccgccttcagctggtccaggttcagcggcgtcacccacttcatctgcgagttctggtcgtcccagaatacgttgtgtcccctaatcttcaatttgtaacaaccaacaaaaaaaaaattaatactccctctctttgtttcatattataagtcatttaacttttttcttaatcaaatttctttaaatttaactaagtttgtagaaaaatatactaacatttttaatacaaaacaaatatattataaaaatatattaatattaaatttaataaaactaatttgattttgtagatgttgctaatttttttcttaaaaacttgatcgagtctaaaaaaattttgactaaaaaaaatatcagacgagttataaacgaaggaagtagttagtaaggtacatgtgctggtataagaatgtcgtgagacagttgggtcaatatccgatgtcaagctgaccttgatgttgtacttttgggcgagcttgagcatggcgtcggcgacgcggtagtcctcgttgttctgggcccactcgttgctgtaccacttcatctcgttctcgaacgtggccaccgtgaagcgcgacgtgaaccacttctcgtacgccggcaggtccaggatctccttggtcagcgcgttgccgaacgggaagccggcccggaggagctcgacgatcaccgtggcgttcgccatgggcgcgccgtcggcgccgcggacgaccaccctgacggtgctcctccgcaccttggcggccgactgctgccggtgcgcgtcccactcgtcgaacgtgaacggctgcagcgacacgctgtccatccagatgtccaccggcgcgtcgctctgcgaacattatgtaaagttgagatcgatggaacggctggaacgtacgccggcgatgtgttcgacgaaattgcatcgagtggctgggtcacctcgaagaagatctgccctgggccggaggagtaggcggtcatgccgcccttgagcatgctccagcagccggactgggcggagacgctgccggcgacgacgcgctcgccgttgggcgtcttgacgaacgccttcacgtgcgcggcgccggccgacacctgcaaccacgctgcggcgccgcggcgcgccggcgaggcgcggctcgtcagacgacggggaccacgcacgcacgcacgcacgcatgcatatgtgctcgagtgctatctagttttgcacgtacgtaccggacagcgagtagtgggtgtcgccctgcagctggatcttctggtagacgctgcgcgacggcacggcggcgccggagagggagtcggcgcgctgcaccacggcgaacttgttgccggacggcgagctgctcaggccggccttgatgtcgcggtgcgtggaccagcccatgaggccgctgttgaactcgccgttctggatgatgccgccgttgtacagcggcttcatcggatcgcgaaggcactgcagatatgtggcatgcatgcaagctcgtttgaacattacaggaacatttcaatttttttaacggtacacataaatgccgtaaattttgctttttgttgacctattcactgattagagatgtttcagtttacaaaatagtcgagtgatttggattttgattgaaccaaattaactcagggtgttaatttcctgggaataataaaataattttgcgttttttaacagcccagctctaatcaatttttggcaaaccaaacaattttggcatcccagtcaatcttggcataaaacgatccagagccttacattttaaaactagaatacaactgattttaataaacaaattatcaagttttatagatagcagaagacgagaataccaactatcgatttgcaatttaaaatctgtgagacgagacggagataaaaacgtttaacaaagtcagagatttgcacattttgccaataatctcacatatggcatctgtttgagaaaagagcgatatatacaaagagaacaattaaacaaaatcacttgcctcaatacttgctgtatgatcatattctaaagattgcaccacccatcctacatcaagaatagatacattaatcttcaacgacatttcaagatgaaattatgtgatcaaaacaaatgcaaaaacgaacaagaaaaccatgcgcattttttttgaggaaaagaccatgcacattttgaaaacattaaatcaggaattcgactaaaaccaacataatttacaaaccagctgaccttggcagagtgaaatacatatcaaggagagcaccagtactttctccatgaaaaccttctatgtgtcgtctgtcactctcactgctaacgaagacgattcagctaattatgcagagaagcgaatatatataggcttgcaggattgacttagctagcactaattatgatttacgaaaaatggtgcgttgttttcgatattttgaattgaatcggtacacaatcggcgagagaaacggtacacagagaaacagttgctggatgagtggacgcatgcaggtgagtgatgttatttatagacatgtactgggcaattagttcacagagaaatagaatggtaagatccgtagatttctctgttgctgcgttcaatgaacaagggtttagttgcaaaataaatattgaagatttaattntgagttaaatttggatgtctattattcatatttgcagaaagttaggtggtcccagaataacattagtatagtgaggggataacatcgttggggtagccgtggcgttgggtacacagtatctagtttaaatcctagtgtacacacgcacatggaggatttgctttcagtaagaattttgtgaggtttgtcagtataccataagtcgcggctattaagagtgtgttaaaacgagatatattcttggcaagtttggtcttatgtttaggggtggatctatattgacaggctaacaattaacaattaacattggtgtcactcgatcccgatgacttatagtaaagaccactctaaaagtgctgcgataactttttgggtggaaatatattaaatataacgttatagtgcaaatatagtgtaattatattttaaactaaattttataacttatatgcaacttgcatgtaattattatgaaatctgggtaattttgctcccttggtaggcatggtcatgagtttaatcacccgcccccatgcgtgattttatttacgctcggtgtgcatctgatgacacagaaatagatagaatccaaacaaaaaaaacttttagcaattctatttggtaaaatcacaaaactacttaaacattgaaggtaatactgaattggggttttctttgtatggatggaaagctaagaagataacatatccaatgtgtatatatatatatatgtatatatatatatagatacccatatgggactctatggtgcccgggctctaaggtataaaacacacaaaatcactcaaattttttaaaaaatttaaattgtgagtatatacctaggtctataaatttgattcataccaatacctaacaacaaaataactcaaactcaactttatttcacaattcattattacatacctaacgaattatatgtttggatgttatatacctagaatcaaaatctaacaaaaaaaaaagttcaaactcagttcaaacttgttagtaaagaagttaatgttcatacctaaaacatttaaaaaaaattcatactcattcaaattggttatatactcaatttgaatcttggagccaatactccatgtagcacgagttaatttacctatatatatatatatatatatatatatatatatatatatatatatatatatattaaatttgtttggtgctccatggtgcccgggcaccattgttgaaattgagtatatacccaattcaaatgagtatgaaactttttcaattacttaggtattaacattaactactttactaactagttcaaagcaagtttgaactgaacttgaacttgtttttgttagatcttgattctaggtatatagcatccatacatataattagttaggtatgtaatcatggattgtgaaataaagttaaatttgagttgttttgttgataggtataggtatgaatcgaattattataactaggtatatactcacaatttgaaaattttaaaaaatttgagtgattttatgcattagataccatggtattcatatatatatatatatatatatatgaatatatttttaatgcatgaaaaatatatacatatacaaagtttatataggacgtacaaactttgtatacgatgaatataaactttatatacatacgtattaaaaaataaaaaactagaaaatacacaacgtatacaaaatttgcatacgcgtatacaaagtttatatacgtacaaatacaaacttggtatacatacgaatacaaactttgtattcctacaccttaaaaagagaaaccagaaaaaaaaggaaaaaccaaccaaacagaaaccaaaaaaagggaaaaaacaaaaaaagggaaaacttgctctctctctctctctcctcttagcgcggcgcgtccgccgtcccctctccgcgcgcgacacgtgtccagtcgcgcggggaggggcgcgcgcgactgatcgctaactagccttctcgcaagttgacgtctagaatctgtcctggcgttgcgtcaccgtatttgggcctttgggccgtgtatcgtgttggaacccattagggttgcgtcaatggttggttgcacgaccctaaactctatatatcagtacctgccgtcacccttagggtttgggttttgcttagattattctgtcaagaacattttcgccgctagatcggtttgtaagaacccaacttatgagcttaatcattcatctgcaattttggttgtattctaccttattcttgtttgtgttcttcgattcgcaaacagagattagccttctcggcgagatcatccgcgtttcgacacgggtgataactagaggagatgtggt

SEQ ID NO: 44472 - DNA, 11302 bp, Oryza sativa
aacaattattcaatttgacgataaacagtgctttgatatattattatgcaatagtgttttatttttctttaagctattcttccgtgggttaataatcttcatatacggctttgtttggatggactacggccagccggaattgaggcgcaacccatgtatatcattctacccaaggtcattttctctacgaagactgttgggacatttggatggagccaggttggcaaaagtcccagcacaatccgccctagcccacatagggaagaagtctctccacggtgatatgaaactcttttcttgcgtcacacttagggcatccacaatgtagtctaaaactagtccataagcaataaaatatttcattcagccacctaaccacattgtggaacagtccatagcaagaaaatagcaaaagccacccataagcatatgggttgcccatatagaataaaatatgttatttgtctctatttcctctctccttttaatactagttgctatctatatatattgtcaagatagcaatagttatagtctatatatgtgggtaccatctatatggactacttttgctatatacattgttgttgcccttacagcattacactcgacctttttctccttcatagacaaggtgaattccaccgcgtcatgtgagagacgatgtgccacctcctatacgtgcataggaaagagaggaagaaatttgggtgttgtctcctgagttggatgtgagtaccgttgtatgtttggatttcgatttggattttgaaaatttgcttaatggctgatctggatttgtgagaggggaaccgtggcctaaggattgtgtttcctagattattaagtttttgttttccaacatttctgatttttcactgtatttttttcagatggttaaaaactttatcttaatcttctgggtgttttctgaattctatatgttctgaattttgaataacaacaatcccatccattccacccactatacaaacaatgaaagggaaggggattggcagagatggatttggcgagaggatggggaaacccacccatgtgagcataacctctacaccaaatattcttcatctcaaatattctgttgtgacggactctagaataaaaagtactctctttctctccgtttgaaattataagtgttttgacttaaactgctccaagtttagtcatatctgtagaaaaaaagtagtaacaatatcaacccaacacgaatatattatggagatgtattcaattatagatttaatgaaactaatttggtgttataaataatactatatttatgtaaaaactaggaaggaagcccgcgcagatgcgcgggcaatttatttattgcctacaaaaagaatactaaaagaaaccatatccaccatattcactataagaaatagaccattgattttgatatggagtaaatgatcaaaatggttatcatatccaaccaaaactcactttatcccaattatatataaattcaacattcaccacaacttattaactttgttttgaagtatgaatattttcttaatcgatggaattgcagctgtatcgaaaaaaactcaatacataattaataccataagaaattaatctccacatcatacccaagtgcccatgtctcacagatccaaatctatatataaatatttaaaaatatcgcttctaccaattaataggataaaacaattatacttatatatgaatgctcctctcacgatcgggtgaagccgactatagccgctaaggatttttctctaatgccttgattcatgggtcccacattgatatagtcgtgctcctcaacggtaacataattttattggtaagtagcaggccagttaagcattattgtcaacggtaacatcttacttggaccaccttaaccgaataatgcatactcctatatagttactacaatgtagccagttgagatccatacttagcatcctttatggaatgagtgaaagaagatggaggtgataaaaaaagtttttttttgtcttgagttgatttattatatagagtagacataatttgtttaaggtgttaatcaatagtactaaattttagttgtatagatatattttttttaaaaaaaatagcagggttgatcattcaactatctaatagcttcagtgatgaggaccacgtaaaaaatatttgctcacgcagtgatcctttgctaacttacaagttaatataagttttgattttttttcttgtattatacatctaattcacctatgcatgtatgcgggggttaatatgcgttggaatttgagctaatttttaaaattgtttggatgaggatgacaaaaaaatagatataatgtagttatatgtacgttttttttctagcgaatagtagtctctcgtacatacattcctttttatgaacgaatatttttctaacatagggatatggtgcacgtatgtgtattcattgtgtgcatctgcacatatctatatgagctcatatgattgacttttacattcttagtaaaaaaatactttcaagaaaattgacgagatgagagtgaagcaatgggtggcgtgaggcagcgctgtggcatggctttttttaccacctcgctaggagtggttgctatgtttatatatcctcaatttgggaaaatcttagagcggtaaagaaaaagcaaactaccagatgggacgaatcatatacagactcttcttttttttctttttatctcttgtgtacgtaattatataggagttgtgtatatatgtagagacagattttcatagattatctctaatttattagagtattacgtgatatcttaggagcatttgtagaagtgtagtaatggtattacttatagttgtaatctacttgtagtcaactattgtttgtatcgtctacttactctatagtttgttgatggttgcgcactttgtatcgccatttattttcagtgttggatgacacacatgctcattgaatataagctaatttttaagtgcattgtgcatggataccttgtaaataatattatttagcgatcagtggatagtggcttatgaatagaacttagatacatggggatcactgaggacataggtttgatattttaggctatgattgaccaagtatacaaatttattgtatattatatattaatgttttagtacctaaataatacatttaaggctatgttctaaagtaattattggattggctactcccttatttatatcgagcatgtttcccaaactattaaatggtatattacgcggtgcgtgtattgcaagtacttttttatgtataatttttttaaaaaaataaaataaatttattttcattatttatatttaatactcaattgatcaaatgaagtccatagtgggagataaaggacaacggcacggtgtcaaaataatatatttgatatttaatatctaataatatataaataaataaaacacataatacattataggataattgattcggtttttatctcatgtgcgtgaaaaagagaaaaaagaaaagacgtacgttcatgcatgtatgtgggccttttaaggataaatctaattggctattttattatggatccaatggttaaaagtaatagctccaccagattaaatgaaaactgatgattagatttttttttaatttctctaaatttattagaacgccacatggcggcatagaagtatttggagagtaccatatggcgtagtatataatacattgatttagaagatagaacattgattggatatttattatagatcataatttaactaaatatatttatattagtgaagtaatatattttatgtttataatgtacaaaatcatattttaaacaccatcgatttttatggatctatgttttatttatgtctttttatgtagatgcgtatggttttttttttcttctggccaacattatgtaagcattattgttttcaatcgtgtatgtacatacgtacggaagaacaatagtagtagcgtttgtatagtataaagtcatacatatgggatatataatatgaggaagttattactttttaataatagttctaatctaatggtgtaaaataacggacccaccaatttaagttaaaatcaatggcgagattagatagtgccatgtggcggcttaggagcgtttgtaggagtgccacgtggcgatttaagagtgtttgtaggaaagttaatggacttttaatatataactaggaaggtagcccgcgcattcgcgcgggcatgcgtcgtacgctaagctagatacactataagagcaaaatattaaccaaagaacatctgccatgatttctccataaattatttttgtcggcattaattgcttttataattctctaacctatgagctttatcttatatcatattttagtaatatctacaagtgattatttataatcttcttcatcatttgaaaagaaggtagaatttttttctttagaaaacatgtcaacaaaagataaagtaaggtgtttttctctttttttaattgcatatatattatcatggtttaatagaggagaattgggtaggacatgaagatccactaaatgtatgggtttatatagcctaatatagctgatgtattttgagaggtgatctatctaaaaacatttcatttagagtaggtcaaagcctccacacagcttaacgtgaatactataatgacaaaatataattgtgcagtattagttttgaaatgttatagtattcatattactatagcatgaatacacgcttgttttctatataagatagatataatgataagaaatgatggttccacaggtttaaaaggcataggagtattccaaaattgtagcttaaaaattatgtttgttttaatactcaatattattgcaaagtgagtgtagctcaactggttaggttccttgtagtggaacatgccaccgggttcaagtcatagactttgacatgggtgctcgtatttatgactaattattttttcagtggtaggtgacgtatccatcgacagcgagacgtccatggtgatttcttaaatctcaaaatatgtcgtctaatcttttggacatactcaaatggggtaagctatgtgtttgtgagttcataggggtgagtgtgcgtccgttaagttgtgagcgcctacgtttgttgtgtgtttctaaaaaaaaattcataggggtaggctatgtgtttatgcattcataggggtaagtgtgcatgttttgtgagtgcctgtgtttgtaatatgttcctaaaaaatatccaacattgattgtttttcttttagtttgagagctaaacaatatgaaggggacgggctgtgttgtgcaaatgtgagggcgaggaggaggtggaagagattttatttttgtaatttttctaaacgatttaagtgataaccgatgatggggtgtttcattttttaaagaacttctaacatactttctttgttttaaaggatgtggcacatggcgatttaagattatgtttaagaaatagatttaatagttaaaaatattggaataatggatacatcaatttagttgaattttttttagaatcttaggatatgatagccagtgacttatgagcgctcaggagggagtttaattgatttttgttatatacaatgatttactataacatactatatattttcaattaatttttggttgttaggatattatttttctaatatagatattatgggtcctagttttgagttatatatttttataaatacatttaattttagatctattagaaaatactttgggtgttgtattttctaattaaaccacttagattgttttaaattgttctactggaagtacatgttattaatcagatcagaaggtttaaaaatctacttgatattttcttcaaaatgtatgaatcggtgaacaatagttagtccgtataatatatatgacacaaagtaatgaatttctttaataatatacttaacttggatcttcagttttaaattttatagtaaatattataatggtgtgcacaaaaaaaagtagatatatgatttagataatatagttgtttaaaattagttttcataaaacatttttccatctaactaaaagagaaaaatacgagagaaagaaaataggtggggaggcacgtacgtactgaatgtgaggggtggatatgcagtgcttgttttcttatcctctatttgataaacaaatctaatggtagaaaataatgggttataaaatattttttccatctaacaaatttaggaaaataggagaaaaataggagagaaggaaaattgctgggactggggaggtacatactggtcggggtaagtacgggagaggtttgagatatgcgggtcttttttttgtttttatccttatctatttggataaatatccattgtatattagtgaaaatcgacggatggatgttttatttattctcagattttttgtgatttttaaatttattaaaatgccacgttgtggcgtaggagtgttaaaaggagcgccacgtggcaatttgagagcatttatagcacatgtgcggaaaaagtctgaattacacccttaaactacaacaacagtacgaattgtcccgcttatatataaactcatctatcaccatcgttcctaaacatatgagttaatatattttttgttttgttttttcttttattatacatttgattcacttatgcatgttcatgggtatcataagatagaataatctatattgtcaaaattatttgtgctaattattaacattatatagatgagaatgacataactaaaaaaagatataatatggttccataagacactttcgattgaatgtgtatatgttttttctggcaaatactaagcacgtactttttcctcttttttttggagacaaatatttttttctcttagggtaggtgtgcgtatgtgtatttatatgatagatgtgcatacgtttatatatgcgctcgtgaatgccttttatatcattagtaaaaaaatactttcaagaacattggtgagatggagtgaagtggtgctgtagcggcgtggattctttgacaacctcgtcaggagtggtcgctactcatatgcacaatttgaggaaaatctatctcatagctgcaaagaaagaaagaaagagaaaactactcgatgcagctgatcgtatacacactcttcttgtttttttccttttatgacatctcttgtgtacgtatatagtgagggattacttgaatatatatatatatatatatataatggttgaaataatatatccacaggttatgtataaataaatagcttgattttacctttttaaattttttttcttagataagcacgggttatgtaatatataatacttaattaatcgctaatgatatactttgtttcgcgtgtcctagatatgctcttccaatgtagaccaaatgattactaaaagataaaaggacatccacatgctgtaaaaaaatatatgattgttaatttttttaaaaaaatatatgaataaagaaacatataatatatgaaaaatacattcatggcgattggatatatcagtattacacagtatggagtgagtaaatttttagagagctactcacaatttaaattgtttttattttgaaaatataagtccaatttaactatgctcttcagtgatatacaatgatataatccacaattttaatttattattattattattatttgtggatgatttgatgagatgcgctatttagaataaaacttaaaataacatataattttacaacttaaaacatatggttaacatggatttttttgagttttttctctaatatctactactataaaagttgaagatgtttttgctggtacttcggtacgtcatccgtgtacgagtcggttttttaggtttgttcgctttttaaaatacgtatttgagttgggttttaagtttcgttcgctttcgaaaatgcagaaggagtcgtataagaaatatttttaaaaaataactcgcatgctaacttcactcctaattgtagctcatgattttcaccttaactaaaccatataacaataataaaatcaaaatagccttcacccgttgtaacacacgagcattttttctagtctaagtatacatgcgagaaggaaaaaggaaaaaaagacatataggggatatgtacgtacacggacgtacggacgtacaggtccatggggacacgtacggccaggtaacgtgggtttttttagatagatttatttggtattttctttaaataaagatctaatggttaaaaataatgggtccaccagattaaatgaaaaccgatggttagatgtttttctttttaattagaatttctatgatttattaaaacaccacgtggcgatctaggagtatttgtaggaacgccacgtagcggcttaggagcgtttgtaggaagtttaatggacttttagtatataatagatagatagatagatagattagaatttctatgatttattaaaacgtcacgtggcgatctaggagtatttgtaggaacgccacgtagcggcttagaagcgtctgtaggaagtttaatggacttttagtatataatagaaatagatagatttaatcttaaagtagtttaattttgacgacttataatctgatatggaagagtacagatacttagcccctgatgatgtattctacttgtgattcgaggagcactaattcgcctcgtgaatattctacgggctggatccacttatactacaacactcctgttcctacaccctgatgtctatggcgttctccgacgaggatgacgatgcgtccacggtcagcgtacgcacggcggacgacacgagcgacgggtgggtcaccgtgacgttgtactcgccgtgcgcgaggtcgagctcgacgacaccgtcggcgtccgtcgtggcgacggccacggggtgcgtcctccactcggcgatgagcttgtcgacgacgtcgccgacggcgaggttcttgaactcgtcgtccgtcaggcacatcacgtagcacgccgtggcgtgccacgccgcccacatcaccatgccatccacgttcgggtgcccgtgcccttctctcaacacctcctccaaatgctgcgcctgcacgtagaacaatagattacgattttctcattttcataatgaaatcttgatgatgaaaaagatgtaattatacaatttgttacctggtttgttccattggcgacgtcgatctcggtgagccagatggggagcttgagctgcgcgagcgtgtccagcgtggcgcgcatgaaggggatgtttggggtggcaccgaagtggctctcgagcccgacggcgagcttcaggccgccgttgccggggaaggaccgtatctggttcatcttggcgacgtacttgctggccatcgccgccatgtccaccggctgctccacggtgttgaactcgttcatgaacagcggcgtctcgccgtcgatcttccccacctggtggtagatcgccggcgacgcgtccgggccgagcttgccgtcgtagaagctccagtggaggttctcgttcaccacgtcccagccgatcaccctgccgccgccgtaccgcgacacgacggacctgagccgcttgtccatggcggcccgcagctcgtccggccccagcgacctgacccacgccatctgcgtgctctggtcatcccagaacacgttgtggccgcgcaccctgacgccgtgccgctccgcgagcgccagcatggcgtccgggacgcggtagtcctcgtgcccctgcctcccctccgtggcgtaccacttcatctcgttctcgaacgtcgccaccgtgaaccgcgacgcgaaccactgctcgtacgccgggttgtccaggatctcccgggtcatcgcgttgccgaaggggaagccggggcggaggagctcggcggtcaccgtggcgttcggcaccggcgcgccgtcggtgccgcgggcgacgacgacaccgagggtgctccgccgcgccctgccggcggattgttgctggcggtgcgcgtcccactcgtcgaaggtgaacggctgcagcgacacgctgtccacccagatggccaccgctgcgtcggcctcgaagtagagctggccttgcccggaggagtaggacgtcatgccgcccttgatcatgctccagcagccggacttggcgacggtggcgccggcggcgacgaactggccgtcgggagtcctgaccaccgccatcacgttggccgtgccggcggacacctgcaaccacgctgcacggccacacacacaaacacaacaacaacaatggtattaaaacagcaaacacatgtgacacagaaaattaggaagcactagtgattgatgatgaagtaatgggtgcataactgtattcaccgaaatttaaattctagtgcttgtgaatattacacacatgtagataagatgtagataaggtttcaacaggattttagtcagatcagtgatatatttttagtttttgtctcttataacgtaggttagggacgcatatacgggacaacgagtgtagtgatttgtgcgcgtgtgtgtttacgctgtagtcgaaaaaaaaataggtagacatgtatctttttgtacctgagagggaatagtgggtgttgggctgtatctggaccgtctggtacacggtgcgcgacggctggccgtcggtccgcgcctcggcgaacttgttgccggacgacgagctgttcacggtggcctggacgcccaagggcacggtccagtccgtcaggcctacgttgaactcgctgttttttatgacgcctccgctgtacagaggtatcatcgggttgctcaggcactgcacaacacaaattgaaattccacaataaaacattgccttggttgagtggcggagccagaaaatcttcacacctaaaattaagctaataaaaacttagatatttctacaaattacattgtattttttaattaagattataatggggattatgaagttaggtatggggctcaggccatagttgccccatgcttgtttccgtccctggcttggttaatccgtctaattttggaatatgcttggttatatcttctctgtttcaagctataatgattttttacgcttttcaagatgtatctattcatatgatgtctaatatattttgtaaatcatatacaaattcttatattttagaatagagggagtatttagggcctgtttggtacagctctaactcctaaatttagctccaagagttgggtctggagtggagttg

SEQ ID NO: 44473 - DNA, 17466 bp, Oryza sativa
gcctaaacccagctccacaactctagttcattttgtgagagagctccacccagctccactcccagttttagtggagctgaaactgtttggctgagctccagctccaggaggggtagagctggagctggagctgtgccaaacaggcccttagagccgaacagtttgaatagctctggtgtaaaatcggtaaagtttatactatcaaagttaattaattagatagatctgatcgtgcagatcaactataggcaaatctgacatttaaaattgcacctggaataatagccccaaattaaatattgaacaattaaagtgattttttttctgaaatggcattcaatgcagtaatggaggcaaaagaaacagatgaaggatctcggagccaaagatattaaacgagaatgcatttttgtatttcgcaaactgctccacaaagttcggaaacgtaaatccatatctgattgagcagtgtgcctctagacttatcgatagcgatatctcttcctagtgcctaggccctctttgtttaggcttagacttattggcctagacttttaagtcagcttattggcttatatgatttataagccggtggatttaatgtcttaagtgtagtagttgagtcatacatctacctcacataagccaaaaaaagcttctccaacctagtttttggcttaatagtgttagagtggcttatggcttcaaaaaagccaaacggaaaaactacttgtttgtttagacttagactttttgacttataagttgtcttataagcgtaacaaagagggccatagtatactactcctggatcagttttgaccaattcaccatcgtaccattatttcgtggttttggagagactgaaatgaaagataaaattgatcatttttatccatttgatttgttcaaaatacacgaaaaggaaaaaatacatgaataaataactaacttagtcgtgtagtatatgcatgtcttgcaacagagctcaaattagaattatttgcgtcacatggttcgtactaaatattgaaataaaatttcttgtgttttttagatccagaagctactaagttcaatctttcaccgaagaatttatagaatggaaaaaaaatgttatgctagggtgatctgccatccaatgcttattactatttgtagaaagaaaccatgaaaaaaaaattcacaaaagagagaaaaaaaaagcttgcctcgatgcttgccgtatggtcataaggaaccgattggaccatctgacctacaaaaatcatggaggaaaatgatatgtatgtgcataaatatccataatcttttcgtaccattacaaaaaaaaacaaaatgaaatatgccaaatggtgtaactgaaaaaatgaacagagcaaaaggtaagtctgaagataacactacaagcagtgcacctctccatataaaaaaacgaatttcgtctgccccttttcatatgtgaaagtttcctccttccacatactgacatctcccaaaaaaaaatccgaggataaaaaaactaaaccaggaggggcggttggtccgtactctctctacatcatgttgcgaaaaaaactgacctctgaaggagagtagcaaaatgattccgagtttctccatgaaaaccttcatcgtgtgtcctgttaccactaatatttgtttctagctacaaatctggacagaaataaatttggatagaaatgaagtctttttggacagatggagtaagtatatacaactagctggatgccagctatttcctaacttatatgctaggatgtcagaaaaatgcccataaatagcaagacttaacttaatccagacaatcggtgtactgctaaattaccgtttcaaatcaaacggataagtatattattctacggctgtatcttcgacgagtattaattacaactactatctcgttgcctataaattcatttttctcctctggcaaaacggacctcaatcaatctatctattaaatattagtatagagatagtatatatcaatcaatcaatctatcttctatttatatactaaaagtccattaaacatcctataaacgcttccaagctgccacgtggtgctctaataaaatagagaaaatcctagaaattctagaaaaaagaaaaacattcgaccgttgattttcatttaaattggtggacctattattttgcaccattagatttatcttaggaagaaacactttccatcgttagattagattgatctaacaggactcatggtcaagcgcacctcgcccctttccgtgcgtgagacgcaccgtacacacacctcctctcctctcttttgctgcccctcccctcccctctccataattctcttttctatttgtaagaaatattttttatcaagaaatcaacagtttgatgagttcaaaataattactatagtttttaatatattttgaaagcaaacaatcagatcaagaaaatcctctcatgcacctacccactgctgtgtcaatataagcgatgcaagcaacttccatctctttgtttgatctctcacgccttaccgtgcttgtcactttgattccatgtaatagtaatagtacagaaaggctatctttgatttcacataaatttcttgaagcttatggaaaataaataaattaatttttaggcatttgggttatcaggtggttttcaagcaagggtgccctacctcttcctacgtatgtgcctcccttgcctttacacacttataagtcttaacttatacatttgatttctgatccgtttaaaacatcacattctttacgattaaatcaacaattaaaaactcagttttgaatatattttaaatcataaagatataattttgcatactaaaagtatattaaactccctacaaacgttctcaaactgccacatgacgttctacaaatgcttttaagacgtcatgtggcgctctaataagtttgaaaaaaaattataacaattctgataaaaaagaaaaaaatctaaccattaattattctttaaataggtggacccaataattttaaccattagatcttaaaaaaatcaggttcccccaccgtatgtgaccacacacgtgcgtattccttcacccttctactctcctctaggatcccaatctcctcacctatttaatttctagctaacttttcctattttctagctaatacaaaatatataaaaaataacaatagctaaatgatcatgactctcaagtcatgtgtacttttctcattttatttgattttctatgttattgataattaaatacatactccacgatccatagtgcccatatttactatataaaaattagataacttggttgttctgactacaaatatttgagcaaaatataactttgaaaatgatgaatgaatttaaatatgtgaatctaaagtccaggttcaatcactaccaaggagcttggaactgtgatacatactctgaactcaaaggaagaggagctacaagacattattagccatgtggacaccgatggcaacggtagcattgacttccacgagttcctaggcctaatagcgtgctagataattaggtgaaggaaaagtaatgagaggaggggaagagggagatgttccgcgtcttcgacaaggactagaaaatggcttcatctctaacgccgagccccgccacgtcacgtgcaatgcatcaggagaggctcactaatgaggaggtcgacgagatgattcacgagaccgatggtggcaggtggatcaactacaaggagttcgtaagaaaattcagaaaaaaaataaaacaagcaatttgattaaaatatacattaaaaaataaaaagaatcattaaaactataaaaaatacaacaatattccatgtagaatataaaatattaagagtccatataaaagtatgagttataaatagctaaaatttggaataataaaacaagtattacaagagaagtccaaacacaacacgcaatgagatcaacacgctatgagatcaagtacaatttaaaatccctaaaaagacaatttagagtaaaacaataatttgatttgaatacaaatttgaaattagaatcgaataactaaattcaagatacattaaatattttttaaagaatctttctatctttattgattcacatgtataacgaattgcatatatatgaagcaattaaagagagcgatagcagggtgggaaaaatacatttattacagtttatcgacatttcttgagaaaaaagatacaatgaacactcaattaaaaatagaaaaaaaatgttactttaatttaaatttattttgtttgaactattttcaaaataaaccaatacgcatgcccgcgcgaatgcgcaggctatcttcctagttattatatactaaaagtccattaaacttcctacaaacgctctcatgccgccatgtggcactctacaaacgcttctatgccgccacgtggctctctaataaatttagagaaattaaaagaaaactaacagtcagttttcatttaatctggtggacccattatttttaaccattggatttataataaaaataaccaattacatttatcctaaaaaggcccacgtacatgccccacatacgtgcatgaatgtacctacttcatgcaccaagccccacgttcctcttttttttctctttttcacgcacctgagataaaaaccgaattaattattctataatgtattatgtgttttatttattcatatattattagagatttaatatcaaatatattattttgacaccttgtcatttcatttatctcccactttagacttcgatcaatttcattgggtgagcttatccaatgcacgcagaatggtgcaagtcattagcacaggattaattgagtattaaatataaaaaatagaaataaattaattttatttttaaaaaacttttatataaaacatatttgcaatacatgcatcgcttaatataccatttagtagttcgggaaacatgctcgatataaataagggagtagccaattcgataagcactttaaaacatagccttaaatgtattatttaggtaggaaaacattaatatatacttcctccgtcccaaattataaggcctatatttttttacatggtcttcaactacatactttgaccattaatttattcaatgttatattcccaataaatatgaaattaacatcacatgaaagcactttaaaatataaatacagtgatataacatgcataataattagcatatactccctccgtcccaaaatgtaagcatttttagctatgaatgtggacaactgtgtgtccaaattcatagccaaaaattgctatattttgggacggggcagtatatgattagtatgattaatagtcaaaagttaccgagtttgatttttcttaaaatgaggacatcctatattttgggacggatggagtaatatacaatatatttgtatacttggtcaattatagtctaaaatatcaaacttatgtcctcaatgatccccatgtatataagttctatatataagccactgtccactgattgctaaataatattatttacgaggtatccatgcacaatgcacctaaaaattagctgatatccaatgagcatgtgtgtcatccaacaccgaagataaatggcgatactaagtgcacaaccatcaagaaactatagagtaagtagacgatgcaaacaatagttgactacaagtagattacaactacgagtaataccattcctacacttctacaaacgctcctaagatatcacgtgatactctaataaattagaaagaatctacgaaaagttatctaaaaaagtaaatatctatccatcaatttacacttaaatcgatgatccattattttcaaccattaaattaaattagatatatgaaagtaatccctctgtcctaaaaaccatataatctgtctctatatacgtacacaactcctatataattacgtacacaatagatataaaaagaaaaaaaaaggaatagtgtgtttatgtgattcgtcgtagctggtagttttctctttcttctcatttcttctcagctctaagattttcccaaattgaggatatatatacatagcaaccactcctagcgaggtggtaaaacaaaccatgtcgcggcgctgcctcacgccacctattgcttcactctcatcccgtcaattttttcgaaagtatttttttactaacaatgtaaaagtcaatcatatgagctcatatatatatatatatatatatgtgcagatgcacattatgaatacacatgcgtgcaccatatcctatgttagaaaaatattcattcaaaaaaatgaaaaaaaacaaacgtatgtacgagagactactattcactataaaaaaacatacatataactacattatatctatttttatgtcaccctcatccaaatagttttaacaaattagctcaaattccaacgcatattaactcccgtgtacatgcataggtgaattagatgtataatacatggaaaaaaaatcaatacttatactaacttgtaagttagcaaaggataactgtgtgagcacatattttttacgtggtcctcatcactaaagctattagatagtcgaatgatcaaccctgctatttttttaaaaaaatatctatactgctaaaatttagtactattgattaaccccttaaacaaattttgtctactctatacaataaatcaactcaagacacaaaaaaaactttttttatcacctccatcttctttcactcattccataaaggatgccaagtatggatctcaactggctacattgcagtaattatataggagtatgcattattcggttaaagtggtccgagtaagatgttaccgttgacaataatgcttaactggcctgctacttaccgataaaattatgttaccgttgaggagcacgactatatcaatgcagaaaccatgaatcaaggcattagagaaaaatccttagcggctatagtcggcttcacccgatcgtcagaggagcattcatatataagtttaattgttttatcctattagttggtagaagcggtattcttaaatacttatatatgggcacttgtatataatgtcgagattaactttttatggtattaatgatgtattggggtttctttttatacagctgcaattccatcgattaaaaagacacacatacttcaaaacaatgataataagttatgatgaattgtgaatttacatataattgggataaagtgatttttggttggacctgatagccattttgatcatttactacataacaaaatcaatggtctatttcttatattgaatatggcgagatatggtttcttttagtattctttttataggcaataaataaatttcccgcgcatctgcgcgggctttcttcctagttatataaaagacgagcattacgtaccgagctagctgtgaaaatccatcctaatggattaatggctgttagagacaaagttacgttcggatgtcgcaaccctcgtgggattgttgctgatgcgcctccctctacattatcaacatgatcctccgatcaaaaaccctgtctaggtctccttggcaagctacgatattttcaatgtcgtaaccttattggaggcatcgttttagatgtgatgtttgtttttgtagcttttcagatcatgggcatatgggcaatctgttaagcatagcagcgtacggcttgatgctaggctttttcctcgttggtgtgcgggtttttttttggcacatggcgaggactataaccttatgatatttttcatgctatatcaatattaaactttatattgtttcgtgtgatgtgtttaaaagaatatattgtgtgaagcattaaacgcaggccagcatttatgaattttcgggtaatgtcagttacaatataaccaagtatgaaatgtgctgtatatctcataactaagtaaaacttgtacccatcacgcattttgttggtgggttcaactgtaagcgagtaaattttcaccgtctagtgctagctagtgaaaaatatacattcctgaaaaatgatttttgacggctaagcctctttcactatgtaggtggaatgtattttcagctccgaaggcccacctagtgctcttcctccgctcggccgcgcccccgttacaccggcactgccgccgccaggccacgccccgctacacgggtgcgccgctgccgctcgcgacacccctccggccgaccactgtttcgtcgtcaccattctaatggagaaattttttttgtgtgtgtggtgatgcgcgggggcattctaggcatttcgaaaaaaaattcaccactttcagccaggaaatgataatgcatccggtgtactaaggaaaatttcacagtttttaagtgtcctagagcagtgtcacgttttcgcggtgtccctcagctaattatacaattttactttttttatttttttattttaaaaataaactcttttaaaactttttttttgaccgggaaacagtgggggaagcccccacggttaattttcatttatatagaggaaaaaagaaactgtacagaagaagatacgaaccttttggccactagcgtagcaaaacaatactgtcacacatgtcttgctggtataatagtgttattcggccacgtcggtctcgctggcgtggcagagttatttggctacgccactttgactgacgtatcaaggcaaaactgtcacgcccgctacaggtgatgtgtcagtgttatttcgtcgtgtcaggaagggctggcatgttcaaaaggtttagattttagaaatatatttttgtaagggtttattttgaaaatttaaaattaaaaacgttcaagaaaataaaaaaaatctggttgaacgtggttagcatctgaattaggcaaggtacattggttaatgcagagctatgaccggaagaaagaggaagaaagcaagtgtgacatgggaagtggagggggtacacggagctacggagaggcgatttgagcgaggaagctccactaccacgtacggcggcaagccggcaatggagccggccaatccggcgagcgccataccaggcgagagatgctcctatcgacgaggcgccgttgcatctgagccgagaccgcacaggagacaggaccgtcgcaccgagtcaacgggctgagcagaccgagcaacgtgaaggagaacagagcaggtgaaaggaagggccgggccggcacagttaggaaagcccaactagaatgctaggaggccttcaaaccaacggacgggatttggctgtgtgtccatgtgaacaggctgccatgttagaaacccgagtggtaaaagagccgtggaggaaaaggacctcaagtagatataagttgggaaatgccaggcgccggtgcatcgggcgcgcctaccgcgcggggggccccacgcctgtgctgcccatgtgcgtctgtgctgcttctccacgtgtcttcaccatataatcaattacaacaaatcacccacatattttgaaaacactctattaaggtaatttggtttattttttgttccacaaaaaatgtttcatctagcgtactcacaatgtttcactatgtatggataatgctacagtgaactgaaacattctttcgctatttgctgaaacattgtttttatataaagtgaaacaacgttcgatttaaacgattgaaacatttttgatctacttagtgaaacaattccgaaaaacctggtggaacatcgtgcaacatttaaaaaaaattcaataataagctacaaaaatttcgtcagaatatatccatgtgtggttttttttaaaagatttaattgcaacgaatttaatggttcaatcggatcatgatttggataaataatttttaagaaaaatttgttcatgctgacgtcagcgttcgatttttggagatttggatcgggcgaccgatccctagtcacctccatataaagtttgtcatgttattgttgaaactagaaagcattatacttgcatgttagaaaccagtcgcgctttgttcagtacggagcgctaggaaggattcagagcaagtataagagcaggtacaatagaaggccataagccagctataaacatattttaaagaaaaaaagaggagagagaatggcagcaactgtagcacggatatcaaggtgcatgtgtgtatgataggtgggaccagatattaattatataatatatgtttataggtaactattgtaagaattggctatgaagttgactatagatgatttagagccaacagttggctacactattaaacttgctctaatagtgagctataagcttacgtggagtataaaggtagcaaaaaattaagagtgttggctctcatgcaagagctagtttatcacaagttctaagacaaatacattaaatgtataagtgagagatagagaaatgagaagaaaattatagccaaccttacatgctaatagtagaaagtgagctctattattatccttgctctcaggaattttgatggctctcaatggtttctcaagagatgatgaacacaagcctatcagaatatggcatccatattttattttcttgccatttgtcttctaagaaagtgctgtggttttctgcatactaatatggaaaaggcgcatggtgataaaccttaaatgtgcaatatttttttatttaagttcatgcaattgttcatggtttcttttcatcctttgatagagaaatgcaccaatggatttgtgtgcagactatcatgtgccactgtcactgtggtctgcagcacaatttccctgcagaccttgcttgaaatttgggttaacaatggcacagcttccctgaagctggtctagagaaataacctgtgtactgataattgtgcatggctgtcctatgcccttaacctttctgatgaatacttgaagtgactgtccttcttgtttgtaaagtttgcagcagctgccttctccaagaaatatttgcaacacagacccaattcaccaattcagagggaagatattggaaaccataaagatggaagagtatcacggtaagtacatcggagcttgttgcgctccacagagcaagtcgcaattccctgcactcaagattatactgtacgcttctgtattgaggaagcttgcagcaaatacatggaactcatacaagccaacaaaacgttggcacaagaacattacacagcagtatttgtacagtagacaggctaattttgacaattttgaatgttttacaggctttcactgggacggtgaaacttgctcggtccgaaccttaaacacgggcatcatcctcttccattcaaggtgaatgaagatggagatggcggtgtgcagttcaggcagcagctagcttgatctccgttcaaggaagatggtgatgcagcgtctccggcgacatggagatcatctgcagcaggctggagctcgagaacgtctcctcgagggatatctcgatcttgctgctgctcccgatgttgttcctcacgatctgcatcagctccttggcgacgccgagcatgcagagcccgttctcggcgctcagcaggcacgcgacggcgagctcgaacaccttcctcacgtcctcgttcggcgccggcagctgcttccccgccaggagcgtcacgtcgatgacctcgtgcagcctcccttccctcaccttgggcgccaccgagtcgaacgggtgctggtgcctcatccccgtcagtagctcgatcaggaggtggccgaagttgcgcacgacgtcgtggtcgtacgacggcgcgtagtagtagtaggcgaccggcctcgcgagcttgtagccggcgatcttggcggtgaggttgtcgtcgaggaagacgtcgctggacttgaggtcgtggaggaaggtcggggccgtgtcgtgcgcctgcaggtacgtgagcgcgctggcgagctcgatggcgatgttgacgcggtggtaccagctgaggagccggcccttcacctgccgcaggtggtcctccagcgtgccgccggcgaagtgctcgtgcaccaggagcagcgcgttgccggtgccggagtcggcggcggcggtgcagcagaagccgacgacgcgggcgatgttccggtgcgagacctcggagaggagctccaccctgtccaggaccagcctgagcttctctgccgtgtcgtacccgatcctctgcaccgcgaccacggtgccgtcgtcgaggacgccggcgtggaccgtgccgccgccgtccacctgcacgttgacggcggccttctcgctgtcgtcgaacctcttggtcgcctcgtccagctgctcgtacgtgaactgcctcgcgttgcacacgccaccgaggatcttggggatgcacgccgggtcgatgtcccacagggtgtccttggaaggctgccttaggaacaaccaaaacgagacggccgccgcgaggaagaagagcgaaacgaagaaacctgtttttcgtgcaatgtggatcatcagctagtggagattgatgtgcaaatgtgatgcaaccaatcgatgaacacacgggagtgtatgatttaccggcaagagcaactgacttcttggagcaaaaccttccctggcaacactccctgccgtcacttgcctgcccagaattgctgcacgctaaaacatgcatacatacaagcaagagcatcatgtatttgggctggaaatttgtcgagctcgcagtcatggagtacttacatgtgccttttgagcagccggtgccatgtgcgaagccgtcgccgacgagccccgcggcgcacgcgcaccgcacgccgcctcgcaccgccgtggcattgacggcgaccgcaccgtcggcgcacgccgccatctcgctgcccttgggcaccgcccactccacctcgatccccctcacgacacccggtgcggcggccgaccggttcttgacccagctcgagaacccccggcatccgaactccgcgaaggcgccaagcccatcgccgggcttccacacgctgccgtcggacagcggatagcagcaccccgacttagcgcccgcggcggcgccaccgcggccgcaggtggcaacgtcttcgcagccagcgcggcagagggaggagtcctcgcaggcgtagaggcggagaacgttggccggcgtgacggcgaggaatgccgcggcggcatcgagagcggccgccggggaggacgggcgggagaacgcggcgtacgcggggtcgcacggggacgacggcgacggcgacgcggcgggggcgtagtcgaggaggatcgatcccgacgggaggaagccgaggacgcggaacgtcgccgagccgagcggcagggtgagcgtggcgttggtggtgtcgcaggagaggcgaaagcgtgaggaagagttggtggtgctggagacgcaggaggagttgaggtggaacgggaatgggaggaggagatcgccgcagcgttcgccaccgccacagctgctgctgctgctgctccgatcggcggcagcctgggcggcggacgtcgcaaagaggacgagaagtacagtgaggtgtggcagcggcatagggggggacatgggtggcggcgagccggcgacgccgacgcggatgccgcgagcgactcgcgctgtcacggattgagtctcagtgtcagtcacatctgcgtgcttctgatggttgagcaacgagcttaattagcaggcacctagctagcaggacgcgcgtgcaactaggcagtagcacatgatatgagcacgtcacacgcatggttcatagtgcagtacgtggtagctagcttaattgggtgcttggctacttaattaggcaggcaaaagcaaatggtgtactagcaggagccgagtactaagacaagcaggacgtaagagatgaatcttaatgaagtgatttgcattggagttggatcttcccagcttatttgccccgctcttttctgattaacatacatattttatctcgattttcgttagcacatttttcaaccttctacacaaaagttgatttatgatatggataaatctatttttctttcaagtttgtaataattaaaacttaattagtaatgcgctaacggctttttaattttctgtgctctaacttcagctgtatttttggaagaaccgaacaacactatctagctagctcttgctaaaatttcaagaagtccatgcatcaatagacttacccaggcttggaaaattttatggctctgacagtggatgccgctacagcttgctgagtgtcaccaccaagatcttcctggcggcaaagtgtgtcactaaaccaggaacaagcctcagtggaagtgagtcaactgtggtattatcagccgtgctttgttcagttcgcagagggaggagatgatgaaagcttgaacctatatatcagaatatggcatccatccttttgttttctctgccattttatcttctgagaaagtgctgtgattttcttcctactaatttagaaaggcaaaaggtggtaaaccttacatgcgggatttgaaatttcggtaatttcagcacccaccggaaaggtcaaaatctccctgaaattttcggtttttgccaaacatttgtaaatttggtcaaaatttgttcaaattcagtcaaaatatgttataaattcaaaaaaaattggacaaaaaattctaaaattactgaaatttcggtgatttcggttgtttcggtccctagcggcaaaaacacaatttcggaaacaaaccctgcttacatgtgcaatatttttgtacttaagttcatgcaattgttagtggtctctttccatcctttctttttcaatatttgatggaaaaatgcaccaatggatttgtgtgcagattatcacgtggcacttcggtttgcagcacaagttccctgcagaccttgcttgaaatttgggttaacaatggcacagctttcctgaagctggtctagaaaaatagcccgtgttctggtaattgtgcatggctgtccaatgcccttaacatttctgatgaatactgcaagcgtctgtacttcttgtttgtaaagtttgcagcagctgccttctccgagaaataagttgcgatggcctattcaccaattcagagggaagatcttgggaagcagaaagatggaagagttaccacggtataagtacatcggagcgcttgttgcgctccacagagtaagtcgcaattccatgcactcaaagattacactgtacgcctctttattgcagcaaatatatggcagttatactagccaacaaaacattggcaccagaacatacacagtagtattgtacagtagactggcttttgacagtttgaatgtttcgcagggtagaggcttgactgggaaactgaaacttgctccgtaccttaacacgggcgtcatcctctcctttcaaggaagatggtggtgtagctccatcagcagctctcccttcaaggaagatggtggtgcagcatctccagcgacatggagatcatctcgtaggattgaaaatcacaagaagtaagcctactagagaggggtgaattatagaaattaaatacctaaaaaccgaaagcttttagcggaactaaaagttatcctcaaacttgatggtgattcgatctaaccgacatgtgagcacaggtttgaccgtgtgccgatgccgccggtctggctagtatggatgcttctgtctaaccacccttcgagccgaaatcgtctgtcgtagttgccagtctaatcaccaaaccatcagtttgactgtcgtcaaactattggtctgaccgccatgcactcgctagtgtgactgccaaacccgaggtaaaacacaaatcgaagaactcttgaaaatatatcaactttattgcttctaattgtatttacaaagtgcaacaacagcactcttactcttctttcagcttttgactaaagtaaaaatatagactaagccctaatttttctctcaactatactctcacaaaaatcgataccgagatacctgaactcctcttctacacacaatataacttaactattgacaattttctccaagaaaatttatacacatgttttttctttctttttataacgtgcgttgcacatgataatataaaaagtagtggttcactttttcactagatgcacccagcaaaacaatatataaaacaccattatcccttttcttagccatccgatgtattcatcagatggcaccaaactatgtaggcatcaatttcttaggatgctacattgaatttatcgattgccccaacgagtggaatgcacaacgtactcctcccgctgacaccgccgcggtgctactccatcgtgttctcctcaccgccgagctcgccccacccccgtcgctcccaatgcatcatttgcaaggaagaattgaataagatagggaaggaaagaggaggagctaaatatgtagcagacctagagcagcgcctcacgcaggcgtggtgcggccttgccaggaacaacgaggccgtcgcgggtaggagcatagcaacaaagaaatcggggttggtgtctgcagcatagctcggccaccaacaacatcgatgctccggtagtcaagctacctgcctccgcggtggcggcggcaacctctagccttaaccggcaagcatggcctaggggacgacgcccttcgagtttggagttgggaagcaaaccaatggagagagtagatcaggtggtgagactggaggctagaggtgatggcgttctagaggagggtgttggtatttcttaatgatattactaaaaatataattcccagcaatggcgcagaaatagtcttgatatatttatggttacggaagtgatccgcaagcgcatggatataccattgtagcatttcacccggaagtattccaaggtattatatttatttaatcccaagggaagattaataagagaagactatgctaataatttacatggtacttgtataagttagagtctaagcagtggttaataattcaaaggtagagtgacacgaacaagaagaactaagtactctcattaaataaatccttggctaagtggagaaagaataaaaaaagaattcatcataatacttctaatatacatgtatctttaatttacactctttagtatacaatcatgtagccaataccccctaactatgctctcttagtgtttcgagagaccgcgcctgactgccgagttccttacgacaacccgtcatggtcatctaaccggaaatgaatacggaggagtacctataccaggaaattaacttatgactatatactaaatacccgtactgagctatcaccatcagcggcccacctctattgtcccgcatcatatacccccaaataatgatatttaataatctaagcaccatgcttacattatcaaatactactctatatccgctagcatgacataaatcaatcatttgcatgaacattatacccacaccattgcatat

SEQ ID NO: 44474 - DNA, 4999 bp, Oryza sativa
  unsure (1)..(4999): unsure at all n locations
tctcattgagatacatggatatgtgcttgttgttgtatgtaggtggatgcataggtttccaaaaatcagtttgtcctggagtgcgtgtgcgtaggtaggttcctttgtgctagacatgtgcggagcaagaagggcggcatcaacgctggcagtggtaccatgccgttaattccactggctgttagcatttgcggatggcatggacacggtgccgatgttgattttcatgattgattaggagacatgatcagtaaaagttgttatgcacgcgtgcatgaagaggcaatctatatgtaagatacgatgggtgttacagcgactatgcatgatttaaccaaagcacaaagagtaaaatggataaaatactgacgttacacactttttagagaagttaatattaaggagtaacaacactactctgtctcatgcatatcatgtattaggagatgtattaggaggttttggtttgtaatcatccaagtatccctgtctcacgccgacaagctctcaaaactcctctctctctctctctctctctctctctccctccctccctccctctacctccctctacctcctattaggcgatatcttccaagcaccatcttcgccgatgaacttgcatatgcagcttcaaattgcctcatcgagtgcggtcccaaaggtaacaacccctgccgcttttatttcccaccgttttctgctgcattatgtagattgaatctagctttcatccttttttttcttatgtgttcttcatgttcacctttactattcctttttttcactgtagaatctgccaaaccatatcatgtttccagacttaaaccgtccgaccttttattatatgggtccaatgggtgacaaagatcccatagatttgattaatgccgaaaccaataggatcccattcaaacaatctagcatggccactatagattgttataatagctttagatctggccatcaaagttgataggatggagaacttggtatagacggaatcttgccaccaaacatgatctgtgaaccgatctaggcatcgttcaatgcattggcctctcctgagctgagatggataaagatgaatctttcattgtaccggcttgctacttccggcccgatacattgaacgccttcctcttcagtcatgggcaagggcgccaaacctgatggaggtcactatgatcagcggccttggtactaaaaatgccgacggttgggccaactacattactaggcatgcaaaaacttttggaacattttccaaccgagagcaagttgccttccataacttatggcttgaaagatttgtcttctgcggatcaaccttaggttcgatagcaaatatgcaacacctagcataagcctcgctaatggaaggactatgcccttgggcaaatatttcgtaggggccacttatcatctgctgcatcaagtcgaaacaaagctattggttagccagcccatctgccatatatgcggtccatggtagtttatctagttatggctaaagctttacaccgttgaagttgttatgaaaatagatgcacaacagagacacgaatttttacgtggaaaacccttgcgggaaaaaaccacgggcgccgaccggcaatgatcactatagaggagatgattacaaacgtaggggaataacaatgggaacgtcaccccttcccgtacggcttacaagagtatatataggggataatagaaagacacctaataggaaacctaataggaactcctactaggaaactaatcctactaggaaactaatccgaatatattgtgggcctaaaattcggattacatatttaacaatctccaccttgagacgaatttcctcttgtagcataaaaacatcaatcaccaaaaaatacctcatgtaggtaaaatcaccgcgcgccaaatagtctctaggactatactgtaacaccaaccaagcttgagcaaagctcaaacttagtagcaggaactggctttgtcatcatatcagctgggttttcatgagtacttatcttgcataccttgacatcaccttcagcaatcacacctcgaataaagtgatatctcacatcaatgtactttgttctctcatggaacatctgatcctttgtaaggcatattgcactttgactatcacaaaatatattatgcaagacgtaactccacaaagctcagtgtacaaacctctaagccaaatagcttctttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaccccctgtggaaggcagctacgtctgagctaaacttggatatggaagtcttctttcgtttagggtgaagtaagaccaagctcatgagcttattatcctaggtcggaacaaattagttgatagtgataggatcccctttttgacgtccccatgcccccccccccccccgtgtggtgtggcggcatggggatgtcaaaaggaaagggatggagtttttctcgcttttggcgtagcaggcctccctttgggaggcccgtgcgacgggctattagctcagtggtagagcgcgcccctgataattgcgtcgttgtgcctgggctgtgagggctctcagccacatggatagttcaatgtgctcatcagcgcctgacccgaagatgtggatcatccaaggcacattagcatggcgtactcctcctgtttgaatcggagtttgaaaccaaacaaacttctcctcaggaggatagatggggcgattcaggtgagatcccatgtagatctaactttctattcactcgtgggatccgggcagtccggggggggcactacggctcctctcttctcaagaatccatacatcccttatcagtgtatggagagctatctctcgagcacaggttgaggttcatcctcaatgggaaaatggagcacctaacaacgcatcttcacagaccaagaactacgagatcaccctttcattctggggtgacggagggatcgtaccattcgagcctttttttcatgcttttcccggcggtctggagaaagcagcaatcaataggacttccctaatcctcccttcctgaaaggaagaacgtgaaattctttttcctttccgcagggaccaggaggttggatctagccataagaggaatgcttggtataaataagccacttcttggtcttcgactccctaagtcactacgagcgccctcgatcagtgcaatgggatgtggctatttatctatctcttgactcgaaatgggagcagagcaggtttgaaaaaggatcttagagtgtctagggttgggccaggagggtctcttaacgccttcctttttctgcccatcggagttatttcccaaggacttgccatggtaagggggagaaggggaagaagcacacttgaagagcgcagtacaacggagagttgtatgctgcgttcggaaggatgaatcgctcccgaaaaggagtctattgattctctcccaattggttggatcgtaggggcgatgatttacttcacgggcgaggtctctggttcaagtccaggatggcccagctgcgccagggaaaagaatagaagaaacatctgactctttcatgcatactccacttggctcggggggatatagctcagttggtagaactccgctcttgcaattgggtcgttgcgattacgggttggctgtctaattgtccaggcggtaatggtagtatcttgtacctgaaccggtggctcactttttctaagtaatggggaagaggactgaaacatgccactgaaagactctactgagacaaaaagatgggctgtcaaaaaggtagaggaggtaggatgggcagttggtcagatctagtatggatcgtacatggacgatagttggagtcggcggctctcctaggcttccctcatctgggatccctggggaagaggatcaagttggcccttgcgaatagcttgatgcactatctcccttcaaccctttgagcgaaatgtggcaaaaggaaggaaaatccatggaccgaccccattatctccaccccgtaggaactacgagatcaccccaaggacgccttcggcgtccaggggtcacggaccgaccatagaccctgttcaataagtggaacacattagccatccgctctccggttgggcagtaagggtcggagaagggcaatcactcgttcttaaaaccagcattcttaagtttaagatcaaagagtcgggcggaaaaaggggagagctccccattcctggttctcctgtagctggattccccggaactacaagaatccttagaatgggattccaactcagcaccttttgttttgagattttgagaagagttgctctttggagagcacagtacgatgaaagttgtaagctgtgttcgggggggagttattgtctatcgttggcctctatggtagaacccgtcggggaggcctgagaggcggtggtttaccctgtggcggatgtcagcggttcgagtccgcttatctccagcccgtgaacttagcggatactatgatagcaccgaattttgccaattcggcagttcgatctatgatttcgcattcatggacgttgataagatccttccatttagtagcaccttaggatggcatagccttaacgttaatgg

SEQ ID NO: 44475 - DNA, 7244 bp, Oryza sativa
  unsure (1)..(7244): unsure at all n locations
nnnnnnnnnnnnnnnnnnnnnnnnnnnnnnnnnnnnnnnnnnnnnnnnnnnnnnnnnnnnnnnnnnnnnnnntcgatatactgtagtgaattgggcattatatgttttgttaatatttaaagtagtgaatgaagcctcgactatatattattcactgtattggaacattataacgtattcatgtaactatagtgcatctatgtgatactttaaaggatctagaaatctcttcagaatgtaccatgttacattcttgatgtatgtgttgcttgttatactggtacaatcagtgtcagtcaacctcgacaatttttgacaaaacttagtactgaactacttaaacgataaaataacactataaatttaagcataatcaccttattatgacaccgacattgaatccaccactacaggaagagaacaggaaatagaagagagtgccgagttctgtactaaaaataaatgataatgtattcttatcctacaagttgtatgggtcccaaagcacttgaatagaactagagaggaaagtatgtatgggtaatgcttgaaacttggtgcaaattgttttggtagaatccatgaaccatatattaacgaaagggcatatagtctagtggttacagtgacctgagtagtaccccaaggtcctgagttcaaatctcctatggagcgaatttcagattgggttgtttgcggggctaagttccctatttcaatggccgtatatatccggttggatatagaggccgggtaaaaaaaatacccttctctaaaaaaaatgaacatatattatggtactaacacattatattggaccaaagacaaacttggcactagtatagacatacttgtaatctagcttaaatatacctaacttcccttcctctcctaaagagaactggcctggccatgccataacattattggcttcattaatcaaatcatacaaaaacaatttacaaccatttagaacaaacgtgtttggcatttggcatgtctaagtccagctatttcttccaaacgcaggaataacaaaccatacaaaattataaagcacgagtacacatgaaacttgcataaaatggaattgcatcaacggttgaaactacaagaacaaactttaccattccttatgaaaactgtggcaccttcatttaaatttaacaaagagggagtactttctacaaatccaatacaatgcatttgtttatcctctacaaacaacatgtaaatttacagatgaattatacacttggaataatggcttccaatatgaacctataccagcttaaatacgtcgttctacacaaactatctgcacaagatatgacaacagtacacaaatgtatcctggaacaaaattgagtggtctctgaaaatttacagaaatgcttgcaccttctgaacctcaaactcagctatgttcagcctcagtcacagtgcccagttgagatccatggatgctccgctccactggcgaaccaggcacgaaaggaacgaagcctcggcccccgaacatcgggcgcatgaatctatcatcaaacttgcgccacacgcgatgaacggagcgagtctgaatggtgagaagaagctgaaggttgttctgaggggagggctggcctacatcgaagtcagaccccagcaggcttccaagaagtgggtctatgattgactggcttgagagatcagctgctatgtcaggccttggtgggatgaggagattgaggagaggcttggtaaaaaaaccaaaaacctgaaacaaatattgatggtgtatacattagcaaagtgataataattggactactttctttgtacacgatggaaacggaaatgtatgatatcacttcttttctagattaaacaggatcatatacattgataatccccgtatggctgcattgttcatgggtatttcacttaatctgtaagcgtcatataaagaaatgataaatactgcattagatttgtttacgctcatataatcacatgtcccctattgacttggctgaaccaaatatagcacacacaaacaaaagtgcacaaatctatcaacagattgctagaaatacacctgctgagcagaaaataaccatccaagataataacagagagaaagcattacatccttaccattgtgctgaacagaacaacaatgactgtgctggtgatcatgatagcattgattcgcaattcagtatgaccagatgcggtgaactgcaaagttttacgagaacgttacatatcagactaggttttagtaaattaatgtggtagtggttccaaatcactttcagagaggcaggttaaccatcaaacatcaccttgtgataggcaagtgctattgatactgctcctctcatgagacctgcccaccatatgattacctagagaataaacccatcacagttagctgcttagctccctctgttttcaggagggaaagaaagtgatacaactacataagaataaaaaaggtcaatactaacttgctgcttgaaggagatctttgggcgtgtctcttttttacttagattggataagaaagacaaagggaatacaaatgctgctcttccaaccataaccaagcccaatatagttgcacttaaagcaattggttttttaggactgcatcataaggaaaactgatataaattagttattatgttcagaaaaaaaaaacatgggcaagacatgcaaggtagttgctgttgtgtgagcctgtgtttaacagtgtgcaccatgccaaacaacaattaatagaatcatagaagcttgaagatgttctttgcagacttctccaaactgaaaaggaagggttccgactttctctcatcaacaacatatcacctcacatagaatatacttttgtcagctgacaggaccatcagtctaagaaggagctaagcaaattacagcatccctagtgatggaaaaattgaaccatagaggcaattgttcaaggcattaccaccggggacttgaaccaggaggcagacaaaaaagcaaaactagttcttttgtttgaaccaaaccgaaaaaaagatacttgctcgtggtttccaacatatgaaaggagcaggtgcggtcctttggcagacaggagagaatggatgaaagaacacgatcatttgtttttattctggccatggatcccaccaatgaataacacgctacaccagtggatgcaaaccaaaccatcggataatgaaaatatcagaagaaactttatgaattggtcgtggacaaaaacacacctgctgctagctaatttccatttttcaatgtccagtgcatccatcccaacatagagaaatagaaaaatttcagcaatgaaagataaagtagcaaaagtgtgcctgtaaaatgaatgaagaatatcaggaagccatatacataaatattttcatctaaaagaaaccacaagggttgccagtaaaactgattatcagacagtacatacttggtagtaatcctagagctttctgtcacattatgccaagtgtaatgtgacattactattccagagaagaacacagtgagaatgccactcagatctagcagctgaaatatatatatatgaaagggtcaaaaaaaatatcaatatcatgtactttggaagatgctggtgcaaagtgagattaaagaaattacagactgccaaaagaagtacaagagtaaaacatcaacaaatttacacttagtattacatggatataacatgatactccctccatcgcaaaatataagcatttttggatttcgacacagtctttgatatgctactttgaccaaaaatatctatataaaagtaaaatgttttaaataaagagagttgtatattatgatagcttgtttaatgataaatctagtaacatcaattttacgggattgatcttttttttttgctattaatagtcaaagttaaaaatatttgacttagcactaaaaatgcttatattttgggacggaggaagtaattgataaatgtccgaaataatttgacttaagagagttgcttattttgaagttcttatagtttgtaggcactcaccatcgacagcatatatgaaaggtacgccatgagtatcatgatagcaacttctctgtcagttgagtgtctgcataacatcacaagcttgccacaatgattttcatatctacataaaaaacaaactactctgtggcatgactaaatcacataggagcagacctggcaaaacatagtttcttaataatataggcactaagcaacccagcctgccaaagtgagtaccagtaattagtccaaaaaggcatggtcaaatgaatcatcagaaaggaaggtagtaaatggaaaagaaaaggaaagatcagtggaggttgtcaaaaacaaagagacttacaactactccaagaagggtactggtgaagaataggtagagaaaatttcctatgaacgctagtagaacaaggctatcaaaattagcaatatcaatgtcttcaattgcattaaagagcacaacagatgtagcatcattgacaaccccttcaccaaaaaccagactatagagtaggggtgtttcgtcttggttaagcacctgcaagtaacaaaattgcatatttaatggtgtgctgtttcattttacaagacattaacaacaggtcattaaatggaaaaacctgtaaggtgcaaacagaatctgttgctgagaagatagccccaattgctgcatatatggattaaacaaaaagataaacagcgagcagaatgatgatgtattcaatggtaccaaagtccaaccagtcgcttcaataattttgaagtgtagaaaggccaagaataaagtatctaaccaagatagtccccaagctggagtggaccaacatcaagttttttgaacaatgtcatggcacctgatatgtccattagaaaaaaggaaaatcttagcggccagagcaacatatcaaagtttgaggatgcaaggtttgagactttgaacaaatcatgtttgtaccattgagtaatgaatacaataaggcaaacaaccgtgcatctaacatacatacttttacatccagctccacaactgaaaaaaactatccagctggcttctccgtactgaattatggattttcatgcatcatgtagccacttcatatagaagcgattggctcattactgattcttttactctcttaaaccagtgtttaatttatcttaatctcaaagaaatcagtcacacatacttgaaagttgaaatgatgatatttggtttcaggtgttaaacaccaagattttgtattttggtgtaggtgttcatatagttggttatcttgtgatcattaatatggaaccaaaataagatgatgtaagctgagcaaagaattcagcaacttacctagagagattatcacaaaggatatcaatgtccccacagcaccaaataaaataattgtcataaaattgcggaagaattgttttttctttacttgaaacctgatgattataaacaaagatgcatttcagttaaaagcttcacttatataaaatgtaagtaacttcaggctatcactttgatgttagggtcaaatgttttagcgagaactgaaaatacatgtatttctgcacaaaaatataatgctggagcttaaaatgttattagctaatccaaagaaatacacaggaaattcatattaatcaattcagttactgcaggaatgcatgcaatttcctaggttcgaaacagggcagagtaaggatgctgattctctataaagactatatatatacttgcacagtcaggaaaaataatctaaatgactcacaagcttactcacgttcagtaagaatgtaagaatgattagacatacttggatccaatcatcaccaagtcctctaattgtaaaagggcttcatgtactactgtgatacaatcctttttaagtctgtatttcagggggggaaataattgtttgggacagacgtgatagtttaattcatttttcagtataatttcatgggaatgggtgggcagttgactattttatacatccagctcaataagtgtaccttagcattcacaaatcacataggttttgaggaagtcttagaaacatgggtttgatacatccagaggaatctaagtaatattttatacagaatggcaataataatatcatcatatgcatacttcagaaatacatgaatttctcaagtgagtcctattgcggtgcattttgctctcaagattaaattagccaaaaccaaattaaactaagacaaggcaccttcttttcttgtacagaagaacaacaaaataaattccgctttggttgggagctcactagaagagctataggtacacagaaagctcacccagcattaaagatgatcggtggaagcaaataaatgaagaagaggtcctcactgaacacaagaatgtgcgagttcttcccaccactgacgagcagaatcacacctccagtgatcagcccctgcaagcgccaacccacagaacaaaactcaaaaccactcccctgtaaggcaaaaccacaaacacctggggtgcaaggccagagagccctctcatctcaccatgacaagcgcggtgatggattcattgacccaccggttcccttccagcaggtgcccgatcacaatgcagctgcacagcagcgccacgaagatgttgatcgcgacgatcgagtcgtagtccgacaccaacagcccgccggatttgagaacgagagctcccaaatccagccccatctcgaccgccgccacctcagtggatcctcctcagctcaccctggcagaatggaaacgaacaattctcaatgttaaaaattggatcatttgctcggtgcaagcaagcagatcgatctccatgattgcctgaacactgtagccgtcaacaaattcagagaaaccgcaaagcaacagcaaatcactcccggcttaatcattccacaacccaaatcaacaaaccagtgaccagtaggatgaaagatgatccgagctacatattctcactgaattcctcaattccgactccaaatccaaatccgacccaagaagccaccatgccgccacctctcctctcaagaaaaggatgtgcacaaaataaaagtaaaaacaaaaatcgaaattccgcacgcacctgcagattcaagcgagatggccaccctgatctgaagcaggagagaggatggaaccaacaaaaaaaaatctggattcagagagagagacgtgagaagaa

SEQ ID NO: 44476 - DNA, 3034 bp, Oryza sativa
tggactggtggtcgtgtccatctggccatgaggccgtgagaaacggaggggaattaattaacgaaaatcgcgccacctgtcaaacggtcaaacgggccccaccaggcagaggaagggagagacccatgtggatgacgggtggggccctgaaccgggttggccccgcctgtcagtggctgtggctgggttgccgtcctgtggttttggttttggttttggtttaacctgaggggtgtgaggccgacgtggcacggggtgtgtgtggggcccacccggggatggagaccaataatattttttcttagataatggaatgaatggagaccaatatggggtattgggaagcaatgatggcgaatggatgggtgattagaggaaggataataatagagtccactttctactattattttattttaaagccaacatatataatagattggctataaggttggctgcaattttcttctcctctctctatctcttacttatgcatttaatggatttgtcttggagcttgtgataagctagctcttgcataagagccaacatacttaattttccactacctcttttcttcacctaagtatagtaagcttatagttcactattatacttgctcttagatcgttcggatgatgattcatgagtgtcgccctgtcgaagaggcaagatgaaatgaaaggagagaagggtatcgtgtatcatgtgtggtcgtcgtccactgctattaaagacaagaacagaatataacggtaaagttatacttccttcatcccctaatataaaaaatattccctatttttaaacgtttgaccacttattttattttaaaaaatttatacaatataaaaaataaaagttatacttcaagtactttgaataataaagtaaatcacaaataaaataaataataattctattttttttaataagacgaatagtcaaacagtgcaagtaaaatgtcaaaattacttatattaggggacggagggagtagagtagtacagacataggtggtgttcttttctccggaagatgaagatgaggttttttacgcaaaacgaggtggtattaacgtatgattgattgagttttaattattacaaacttaaaaaatagattaatatgatattttagagtaatttttatatagaaagttttcgcacaaaacacaccgtttagcagtttgaaaaagtgacacgaaagtcttaatattctttcaacttttattggagaaaagaacgggactataggactcccttcattctaaaattcgaacagggctgactgagttcgtttattcatgttccctatttccctctcttgtttgtcgcgtgtaatctctatagaaaaattatttttaaaaatcatattaatcctttaaaaagttttttaagctatcttaattaattatgtgctatgttgctccatttttcgtgattagggggtcaattcccaactccatgagacagacacagtcttagcatgattgaaacaaaggaaaaaccatatgaattatagaggattttatcctatgaaaaataatcctatagagttatttgaaataaaaaatgtttcctatcaatttcttaggaattcatgtggaatgaaccttacaagattaattttagaggaaaataagcatgatatcttacttcatgataatcaaacaacttttcgaaatcccataagaactccctaagtataacattctattcctacatttgttcctattgctgtgttttctcatccccacatttcaaaggagccataaactcttaaataatgttttgagttaatggtttgcttgtttgatctatcttaaatccatttttagggcccctttgaatcgtaggattgaaaaaacggaggaatgggaaaaacataggattctgataggaatgcaagtgtaaaacaaaggattgcaaaacacaagaaaaacacaggaatggccgtttgattggaccgcaggaaaaacgcaggattcaaacgagagagatagactcaagggaagttttccaagaggtcggagtggatgttaaatttcctacatttttcctctagaatcgtaggaaaggaaagtttcctacgtttttccttttatcattcctacaaatcaaaggcatgaatagtgtaggatttcaattcatttgtttttcctccatttatcctccaattcaaagggggccttaatagcattaactttcttttccaaaataagtatataaatccaaaaccatgaaaagaagtatatatttttttcaaattttattccaaaactacgttccaacaagcatgctccatacggctaggctatagagttgatagagagatgtggagggcccacgtgtcagggacacccaacgggattgtgtttttttttttttgagatagtgttgacagcgaaagagtgtggaatgaaattcttggctgtagatgagcctgtaggccccgccacggatgcgaggccaccagcggatgagcgccacgtgtccgctacaggcatgggcagcgcgaccagagaagtggacaggacaaggccgcatccgccatcctccattgattcatctcccttcctttgcttgagattcctcaacctctacatctctctcctccaatcccctcctctctctctatctctcttcccggcctgtgcagagacggaggcaggataggccggcgagcaaaggttcgagttctttcccctcggattccacaaagtaggtgtcttttttgtttaagaaaaatagaatcaccaagttgttgttctcgttgagttttggttgtattttgtcactcgagagcctctgcatgttccaaaagatggtgttttattggtggtgttttgatcatgctagatgtggaggatggacggatcagatattctgttgtttactcgctttgaaatttatgcttgttttagtattatgcatctttgggcaattatcgcatggatggatcatacatgccatttctttcggttcgaatgtcttcctgtttactactttggaattatcgtttttagagtttc

SEQ ID NO: 44477 - DNA, 10375 bp, Oryza sativa
gagcctcccaattttcagataatcaagttgcagcaaagaaaaaatcagtcaaatctagtcaagggttggctgaagcttgcaaatttgtttacaacgatgcaaaatttgtgaatgaaagagctcaaaatgatattctcttgctttcacggtattcctttcataataatctttaaaaaatatatcccttggtaaaaacaagagatttgtacataacaaaattatgtgtctcatttctaatcctagtggcataacaaggctgaacaaacgtgcgtgccaggatgttgctgttttagggtcaggatttctcaagcttgatggtacatgatttcccttttagctgacaagctcttagtttctttggtatgatttaactatccatctaaagctattatttactgaaagctcgtgcaaggaaggacactaaaaaaattgaccacagtgtgaaggaaagggcagcgcggcttacccattttgcgagagtatgatttttcaatatgtttagataattgaaccatccatgtgctttactttttgttcctttctacctctatgtactttagcctgttacctctgtatgcatattcagatattaaaggaacaggctcagtcagacttgaagaaagcagcagatcagcattggagcgatggtgctttggaggtctgtgctagttctctgtccttcacttcattttgctggaactagttgaaaatactgagcgatatatagctgccaaatgtttctggagtaccgatgttgttttattaccggtgttaaccttctttgtgtgtgttactatcaaattcatgggattatgcttatataatacactatttatttgcaatgcaggcagatctgcgacgagctgactcggttgttagacgacgtgccatggaagatgctttcatggctttaaaggtagcccaacttgttcttttccatctctactgtctttaaatgcagcaagttggtttagttttcattacaatttacaagctaagatatgcaagattttaggatgaaaacataatcagttattttgatttatgaaagcaagatttataactcaaactcgtaacaattcttgattatttatttgcttaacatcatgccccatacatcatatttccaacaaattttgtttgttttatgagcctgctgtcatgaccggtttgctgttatgcattacattaatagctaaggtttagtttgattggcttagcagaaaataaataatcatatatctagacatgaataactagcctcagacttaatcatactctatctacaccttgccatatcgacatttttttggtatttgttgctgcacaaaaggaaaagtttatggatcacatactagatgttttgatcaatttgacccttcccaattcttggtatttctcatacagcatcttgattattaaatattacacttgtatgtaattctgtaatatttagtgcagtttgttcgggatatccatgacatgatggcaaacagattacaagagcagtaagttcatttcaaatgctcatttcttagagaaattcaatgtttaattaaggagggtatgattttacttcgctggttcatattcattgttagaacaatctgatttgtactaaaataaatatactttagattcgcaaaggatggttcctcttctcctgctaattcaagaagtttcatcacccttgagaaaaatggaaataccttcgagctgtttcctcatgaagtttcaacggaccagattaccgccatagaggttatatctagattaacttatttagcagaaaactcccatcatatggctaattttggttaaatttgttatccatagcaagcatactggagtatggcatctgcgttgtctgaggctgatggtatcgactacacagatcctgaggaggtgaaacattttttacccacattataaagatgaaccttcctatgtccatctttctaaccttctcttttctgtttctgaagcttgagttgttagtagcaactctcattgacctggacgccatggatgggaaaaagagtgtttccttacttgctgaatgttcaagctctccagatgttaataccaggtatatcacagcattattgagtacagttacctgcaatgtatgttgcttctgcgttgttagcaagatcgaatccatcttcaagtacagaaaatgagaatatacagaaaatgagagaatgttaatataaagaatgcagatttgatatgtcctgtctctatacatcatggctatgtgccaaaatagctaattagcgacaaaaaataatttatggataaaactattatgtatatgtccttagtgacttaaaagccaattcaaaaaaggaactatgttgaaaataccgtagaattaactcaaaaattaagtcttaaataaattttggcggtggctgattcgttgtagggcaaacgatgaggctctatgttatatttctgaattacatcgcattcgtattgaccattattatgtatgtataccccttgtaggaaagctttagctaatgcactggctgcagctccatccatgtggattcttggaaatgctgggatgggtgcattacaggtgaacataaatctctcctatagctcctcctattgacaatttctgattaccttcatatcagaattttttgtatgagaaatttctaagcctctcagagccaggaatcatgcttgccccacagttcaaatttgatcttcatattcatttgtaaccatgatttccaagctgtacaaactgaagctcatttctcccttgtgatcaattatctaaaaaaggttaaaatccatagtacaacgcagcctgtttctgcataataatcagttattgttgaatgaacttgctagttgctacttgctacatgaactagtttctttgaagttacttgggtaactattgatgtttcatcaatctttgcttgctctttcaattgcagagattggctcaagattccaattatgctgtagccagggctgcaacaagagccatcaatgaactcacaaagcaatgggagcttgaagaaggtgacagcctgaggtttgtactgaatcaaaatatggtttctaaagagacagccgatgacagtgcagcagcagatgacaccaggtgatcatgtgcaaataagaggaaaaaattacactaggattaacagaaacttatacaaacatcacgtttcagagcatatatatggataaggtgaatgtctatctctgtcacagtttcagagcataatgtgctgcttggtatcaaaccagatcaccagaatcatcagaatgacagaatgcatgtaactgacacatcttttcagtgccaaactgccaaagaaattaggaactggtgtaaagataaatgtattccttcagtaagacatagtcaatagtgttagaataattgggctaggcccaacttatcctattaaatctcaaaggcccataataagtgttaaggataataataccacatcaggatttaagcgaggaatatcttaacctaaatagggagttattggaggccccctgttgactggttgaggtggggttcggaatgccacgcgcgcgcgcgcgccgggccgaggccgtgggcgtgggcgaggctggctggcggcgtgcgtgcgtcacgtcgctattcttttgcagccactaaccacgttccaacaactgcctctctctcctgatagataaggaggccgcgagtccgatctgtaacggacgcttgcttctttcccggtgttagttcctcctccgcaccagtgctgttctcgcttcctcgcttctgatctcttgcgcgcacgagagattggaaggagcagtgcctccaaaaccacatcttcgcctgagatctgcaccgggtaggcgggtgatcaggtttttgggtagtgcctctcgcacgattgctcgccatgtctggagatgccgccgccgctactggaggagatggcagaggtggtgcgccaggagctggagccggtgccgcgaacgacaacatcaacggaggcaattctgcctcataatccaacggagggccattctcgaggtatatccttctcctgttccctttgttagcgctatcgctttactgttatgtgcgctgtgttcctgttcctgacattcatgatgcctctagcatgttattgcgttactgtaatgtttctgttcctgacattcatgatgcgcatagtatgctactggttatgttaagatcactctacactgtttatgccatggttattgctttaacattttggattaaaatatgccgattcatgactatatttccaacaaatagatgaagcaaaagagcatggttgaagaaattatgttcctcagatgttttttgctattcgattgggaaatggataatagtgccacctcctgagtatttctttgagaaaaaaagtctattttacaaccctaaaaactttcactcgcaccgagttgttaaatcctgaactttagccaagtggcatactccccttttttttacatggcatactaaaatttgatacaaatatgcaaaattattagtcgtgcttaaagcacctaatgataaaacaagtcatgtcgaaataaatgatactccctccgtttcaagttataagacgttttgattttggtcaaagtcaaactattttaagtttgactaattttatggaaaaaaattgtaatatttttaatccaagactaatatattatgaaagtttattcaattatatatttaatgaaactatgctgatgttgtaaatattactatatttttctatagagttagtcaaatttagagtaacctaaaacggagcgagtatttacatagttcttttaataaaataaatgaccaaatgtgaggtttaaaagtcaacaactttatatttttcaaaaccgagctagtaagtagcccaacaatgtcacacaatccgtgtacagtacaatggcacttgtttagaaggtaatccaacaatcggaaacgatttagtaccatgaggtactggtaccttgaggtacttcttgttggaccggagcaaatctcgttgcataaaccaccctaattgtcactctagttttgatattctaccctataacctatttcgttgcaaaagcccacccaccgtacacacgtgagtagcttatttgctccatttcttctgacatggattcgcagtgaactgtataagccatgttgtgttcatctaatatggctatgaggtgagtttgacttgagctcgttcttaggtcctgtttgggagagcttaagattctgagaatctactggttgatagacagcttatgagaatatggagaagctactaaacatagcttctgaattttagtttattttttaagtagaataatagattctcaaaatctatgtgacaatctcgattgtttggggagagtttttgattctgggagaaactgcacctactagaaactccccaaaacagatccttatactagttcgaagtggcaagaagggtggaatgacaatcaatggcgttgatcggcagcgaatccatattgaaagaaatgggccaaatcaactaataatgtgtatggagggagtaattttggcctttggttgcctgagcttttgcaacaaaatgggttacggagtagaatgtttaaaacgagagtgacaacggaggaggtggtttatacgatttggtcagtttaaaaaggacccaagacatgttttgcacgaggacaaaaacatccatataactaacttatcatcgaagagattagtacaaggtaatactataccatttctagtttgaaatcggcagagatggttaagctagctttcgtgagcaggagtgtacatcaccattcaccacaccaagccgtttcactgaagcttccgccttctcgccgataaattaaacggaagcagagctgctgctgcaagaaggctttcagctcacacgggagagaagagagatgggagtgagggtgaccgggccggcgggatcgccgctcgtggcggcggtgctggcgagcctggaggaggccgccgccggcggcgggtacgagctcgtcggcacggcggcggcgcgcgaacagagtacccggccgcaccttgcccggaacgtaagccgcccaccctttctgagaatttcttttaaaaacctttttaattttaaaaataaatctacaaaacttatttttaacatatgaacaattttgccacgctaacttgcatggcaaaaatatattgtcacgctaatctaactgacgtagctgttatttactcataccatcctcgctgatatgataggataaaaccgtcacacctattgcaggtgatgtgtcaatgtttttttttcctaatgctagatgtggtcaaagagttaagattttggaaataagttttgaaatgattcattcttaaaattaaaaattttaaaagtattttgaaaaaaatccctttctaacgcagatttgcatctcttaatgtgtttgaaacttttttaatcactcgagtggacatctagtcgtgtagtatcatagatttgcatacgttgttctgttcttgcagccgtttggtaagatcgccgcctttgctgaggacggcgagctcgcgctcgtcgacgccgtcggtggccatgttgatggtagccgctctcatgcccgcgtgacgtcttgagccatcggcttggagaaggccccactgtacaggctacgtactgacagttgggccccaccgtgctgttatactacttaggagttgattattatggtgggggccatgtgtcagtctcgatttgatagcaatgtgtcatgcggtgaagatagaaatgtttgtgtgcgagcgccagtaattaagaacaacacagaggaggtaggggggcaaaggagttcttttgtgtcgattcctattgcatcaagataagactatttctttactattgattttacaaagaaaattactatccatacgactagtgtgtacgacttgcgtatgactagtacttagctactgcttgccgtgacttacatggaaaaaaactgacttgtatgaagtgaattgattggctgatgaggcagggtcgaataggggtcggatgtatagcggtactcctttacaaataaagttcatcgtaaaacatctcgagaaggtacgtatatgtgatcactaatgttgttgatgggatgtttttcgtaccgtgcttaaaatctgatgtacaagttgtttttggcttgttgcatcacttgtgcattactcctctaaaagaacttgtctaatgtggcgtcaagaactaacaattaagttacagttgagtcaatcaggaatatgaggccgcgccatctgtaaggtctccttctatgtccacgtcagtgtaatttgtttctatcgttcgatatatcatatacggttcggatgcattttgccagattatgcatgcactagaatgcacaggtactagtgcttgacaatgacctatcatattacaagtgtacataatgcaaaatgtatgaggctataatcctgcactgatttttatctgagggtgcatgcatggataagaatggatgctattggccatccatgtaacaagtttgcagggtgcacgaatgcacgatggcctcactccctcgtgtgttattgtgttaggtctgctattttcttttttaaaaaaatatagtccaaaagagagacgaggtggggaagacttgattatattgttctcttttttttttcagaacacgcaatacgattacgcatcttttcaccgaaagacggggaaaagaaaagaaaaactcaaatcacccatacaaactgattgattgaaataggatcacatcaaggtggaagggaaaaaaattaaaacaacatatatctattatatgaactctagatgacaacaacattaacagtcagatttaggataagtgtgtacattaacatctactccctccgtcctaaaaaaaaagaagacaaaccctggtttccgtgtctaacgtttgaccatccgtcttatttgaaaaaaatatgaaaaaaattaaaaagacaagtcacgcataaaatattaatcatgttttatcatttaacaacaatgaaaatacgaattataaaaaaattttatataagacggacagtcaaagttggacacggaaacctggggtttgtctttttttttttggacggagggagtatctgtattgtaatgtgtttttttttaaaaaaagaaaaagcttgcatgcatgatttctatgctagtttaaaaagagcagtgatggtgatgaggggttaatctgtcatcaccaactacttactcttttgtaataaagaaataatatgtggggtcaaaaggttcacatgttaaccaccccatcgtctctaattttactgggaaagacaaatgatattataacgtcatatggatcatatattaattacaaatatatatagaatttaagagatgatatatacagaaaataatgataatagcaagttaatcattatttttcgtcaattaaaattctgttgccacaaaatgtttcatccgattctaatttcttatattttttactcagcagcagtagtaataccattatcatcaagcctatggtcacatcattcacgccaagtgtccaagcacctactccgaagcttcttgctgattaaattagacggaaatggagctgctaactgatgcctaaattataaatgtcagcatgtgtagaacgaggaagaactcacatcaagctttctcaagagagatagagacagagacagagtttagagagagacatcggagatggtcgcgaaggtgtacggagtggcggcgtcgccgtacgtggcgacggtgctggtgtgcctggaggaggccggcgccagctacgagctcgtcgccgtcgacatggccgccggcgagaacaggtcccgccaccacctcgcccggagcgtacgcccctctttgccctctccaactctaagattcgcttcactttcatacatgatgcatctcgatctcttcttgcacaaaatcaattaattgctcgctagaaaccttttcatctctgaattaattaaccaatcaatcaaatcaaattcggctatatcgttcaaaaaaaaatcaaattcggctatatttcgttcaaatttgcacgtgtttctcgcagccctttggcaagatccctgcctttgaggacggagaagtcactctctttggtatgaggaacaccacacctcacccgaattactgtgatatgctccatctcaattacttatatattggaaatgaataatgagtattcactttttttgaaaggaatattcacatattattattattattattattattattattattattattattattattattattattattattattattattattattaccagagtcgcgtgcaattcaacgctacgtgcttggcaattacaacaaaccggatctcttaagagaaggcaaccttgaggagtcggcaatggtggacatgtggatggaggtggaggcgcaccactacgaccctgccatcttccacattatccgggagtgcgtcatcaagccgatgatcggcggcggcgcccgtgaccaggccatcgtcgacgagaacgtcgagaagctgaggaaggtgctggaggtgtacgagcggaggttgtcggagtcggagtacctcgccggagatttcgtcagcgtcgccgacctgaaccacttcccctacacctactacctcatgaccaccgagtacgccacgctggtggagtcgtgcacgaacgtcaaagctgttgagattatgggcatataaggatttaatttattccataaataaatcatgacattacagatgaaaactagcatgaacgcatcattagatctacacatgtaaactacgcagaataacatgaacagatcaaatatgcgcaacatattgaacacgtaccgaggtgacgaaaagaccggctgcttggtcgaaatttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcaggacgtcaaaggcagaggttccggagacctgctctcccgatcgcaggtgcacgccggcgagcgggatggagtagtctacgagcgacggcgcagtacagagtaggaggcaaaccctagattgattttcgcatgtattgcgtgaagacggcgggtcggtttatatagagaagggtcgcttgatcagggcgcccgcacgatctctactgcgcgtaaccgaaccggataagtcgcgcgtaacttatccggactccacgccgtttgcacgcaccggatttttcggaacg

SEQ ID NO: 44478 - DNA, 1915 bp, Oryza sativa
cgcgtacgtcgtgcacgcgctgccctgccctgccctgccaggccaggccaggccaggccaggcgaggcgaggcgagcgagcgcgcgcgtgtgtttcccctcttctctccaccacacatgcttcaagtggctaggagggcatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacaatcccccaccaaatctcaaaatcccactgagatttgccttttccaatgtactgtttatataccagtggttcgatggagaccaattaaggttgaacatccacctagaactccaagctacacttactcacaacttgaacaatggactacgccttgaattgcaagtcttgtgcaagcaagtttcactcaaagtcttatctggtactagaccgtctgtagactacccctcgggtggagcgtataagtcatactcctaggtctttggtaagcttcctagaagattcacccaaaatcttcatagactgcgaccaacagtcaagctcacaaaggtgagttccttcaagaatgctctgcaggacaacatctttgctaattaaagccaacagaactcattaaggcatagccaacctgccttgcagctcacgagagtatatgcatcttcacttggatagggtatatatattggtactctcctctagtttattaatggtttgttcttcccaggatctaattcacgggatctccgatcacatagactgggttaccaccatagtataactcacatgggtctcaaacccatctccttcgatgcattgtctatcacatttcgtgatagtccctttgtgaagggatctgccaggtttctcgctgtttggatgtaatccaacgttataactccggagtttcttaatttcctgacagacttcaatcgtcttttcacatgtctagacgatttcatattatccttagaactattcactttgacaattaccgtttgattgtcacagttcataaggatagccggcaccggtttttcaacaacaggcagatccattaatagatcacgcagccattctgcctcaacagtagcagtatccagtgccgttagttctgcttccatggttgacctcgtcaaaattgtctgtttgcaagacctccatgaaacagcaccaccacccagtgtgaaaacatatccactagtggctttgatctcatccacatcagagatccagttagaatcactataaccctccagtaccgcaggatacccagtatagtgaagtcccaattccacagtacctttcagatagcgcattactcgctcaagcgcacgccagtgatcatctcccggattagaagtaaatcggctcaacttgctcacagcaaaggagatatcaggcctagttgcactagccaggtacatcaacgagccaatgatttgggagtattccagttgattcctagcaattctcttgttcttgcgaagcaacaagctaggatcataaggtgttggagaaggcttactatcaatgtagccaaagcgattcaagatcttctccacataatgggactgcaagagagtaatcccattctcacctctaattagcttaatgtttaagataacatcagctactcccaaatctttcatatcaaaattttgagacaagaatgatttaacctcatttatcacctcaaggtttgtcccaaatatcagtatgtcgtcaacatacaagcacaaaataactccctcacccccaccatggcgatagtacacacatttatctgcctcattgactgcaaagcctgcagatgtcaatgttttgtcaaatttctcatgccattgcttaggag

SEQ ID NO: 44479 - DNA, 8781 bp, Oryza sativa
caagccgagccttgtacttttcaatagtaccgtcaggcctaagcttcttcttgaacacccacttgcaccccacaggtttacacccatagggtcgctctgtcacctcccaagtcccgttagcgataatggaatccatttcactacggacagcctccttccagtagtctgcatcaggagatgcatatgcttctgaaattgacttaggagtgtcatccacgaggtacacagtgaaatcatcaccaaaagacttagccgtcctttgtctcttactccttcgaggagcttcactgacatcctcctcagagacaagttcatgtgtatgttcagtttgttctggtggtgtgattgaactgggaattatttcagagggttggttcgaaccactatgtgtatccttcattggaaaaaagctctcaaagaaggtagcatcacgagactccataattgtaccaacatgcatgtccggtacctcggatttaactattaaaaatctataggcaatgctatgatgagcatatcccagaaaaacacagtccacagtcttaggtccaagtttgcgcttcttcgttattggtacattgactttcgccaagcacccccatgtgcgcaaataagaaagtgatggttttctaccaatccatatctcatatggtgttttgtccttatttctgttaggaattctgtttaacacatgatttgaggtcaacaatgcctccccccaccatgccttaggcagtcccgcggtgtccaacatggcattcaccaagtcagtcagtgtgcggttcttcctttcagcaatcccattagactcgggagaatagggaggcgtcctctcatgtatgatgccatgttcttcacagaataagtcaaactcgttcgagaaaaactctccaccacgatcagacctaagcctttttatctttctgtcaagttgattttcaacttctgccttataaattttaaaatagtctagagcctcgtctttcgttttcaacaagtacacatagcaaaatctagtagcatcatcaatcaatgtcatgaaatatcgttttccacccttcgtcaacaccccattcatttcacaaagatctgaatgtaggagttctagtggtgccaagtttctctcctcggcagccttgtgaggcttgcgaggttgcttcgattgcacacaactatggcacttagaacctttgacaatggaaaacttaggaattaaacacatgctggaaagccgagacatcaagccaaaattaatatgacataaacgtgaatgccaaacattagcttcatcatccacactgccacaaatatggttcacagacttattgcagaaatcagaaagggaaaagcggaacaggcctccgcactcataacctttaccaataaaatatccatgtttagacacgactactttattagactcaaaaaccaacttaaatccgtctctagtcagacgggagccactaacaagattcctgtcgatagaagggacatgctgcacgttcttcagctgcacgatctttcccgaagtaaacttcagatctaccgtgccaacaccatgaacagaagcatgtgacccattccccattaggacggtggaaccccgtgcgacctgataagaagaaaacaatgagatgtcagcacaaacatgtacattggccccagtatcaacccaccaattagtagattgattaactgaaaaaacagtaggtaaattaccatacccgcttccatctccagtgttgccaatggtcacattagcagacttagaagtctgccctgcaggtgccttcatccccttgcgttgtggacacttcctagccagatgaccaacttggccacacacaaagcaagtcctctcatcctgattaggattggtggtgttcttcttctgcttcttgaagttggtggtctgctgagctttgtatttccccttgctcttgttctgggccttgtgcacaacattggcactggactgcccaccatcgcccttagacgcggcatctttttcccgagctttctcctcaacatcaagagacgcaatcaacccctcaacggagtattcctgtctcttgtgtttgagtgcagtaccgaaactcctccaagatggaggaagttttgcaataatgcacccggccacaaatttgtcgggtaagacacacttaaggagttcgagttccttagccatggtttgtatctcatgagcctgttcgactacagaacggttgtcagccattttgtagtcatgaaactgctccatgatatacagatcattgctagcatcagtagcaccgaatttagtattcagtgcatcccacaactccttagcgtcggtcatatgcatatacacctcgaccagacgatcgccaagaacgcatcccacaaagagagtagtggcttcctcgaattgcttctgctgttcagcagtaagaactccttcaggtttgccagtactcacccagaagcatttcatagctgtcagccacagagtgaccctgatctgccatctcttaaaatgcacaccggtgaatttatccggcctcagtgcatcggcaaaaccagccatagtaaaatcacagtgcctataataaggtttttggattgttgagattatgggcatataaggatttaatttattccataaataaatcatgacattacagatgaaaactagcatgaacgcatcattagatctacacatgtaaactacgcagaataacatgaacagatcaaatatgcgcaacatattgaacacgtaccaaggtgacgaaaagaccggctgcttggtcgaaatttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcaggacgtcaaaggcagaggttccggagacctgctctcccgatcgcaggtgcacgccggcgagcgggatggagtagtctacgagcgacggcgcagtacagagtaggaggcaaaccctagactgcatctgcgcaagggtgaggagccaatttttcggaccattcgacgcgtacgtcgtgcacgcgcgccgcctgccctgccctgccctgccctgccaggccaggccaggcgaggcgaggcgagcgagcgcgcgcgcgtgtttcccctcttctctccaccacacatgcttcaagtggctaggagggcatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacaaaagcatggtgggagcggctgctcgcgaggccggcggtgaggaaggtggccgctctttccccccctgtgacatcaacctgaagaagctccacctcttggcgttaatgacaatgacagttgggccccattgtattgttaacttaggttatggttgggacccacttgtcagtgtcagttcgctagcatatagaattactatatgaagtactatgcattattgtgcgtctatcaatagaagaataaaacagaggagataccactatacagtgtacacggcattggcaatgtgtcaatgtacatgacacctattatttttttatcacaaagcagtataactaccattgttcatgtcattattgaaattcgttgtgaacaggctaggatcatatgtcctaattactggatgttgtggaggaaactagaaacagaggcagtgcgaggtacaagcacaaagtagaacaactgtttgctgagccgcacacttgtttggaccctaccactttcatgcaaaattcatgcatatatataaatatatttacacctgatgcattttagcttaattaaattcatttccaaagaagtagtagcaaatcaagcgaaacaaaagcaataaagatgaaggcttcctcgttggccgccgtcgccgccgcggtgctcgtcgccgcggcgtgctccgggcgcgcgccggtggcggaggcgacgatcgagagcacgtgcggggcggcggcgaagggcgaccggcgcgtggacgtcggcttctgcgcgcggcagttcgcgtcgtaccacggcgcggcggaggcggacgcgtgggggctcgccaagatcgcggcgctcatcggcgtcaacctcgccgacgacgccgtgttcgacatcggcgccggcaagatccgcccctcccccggcggcggcgccaagggggacaaggccatggacgcgtgcgccaaggcgtacgacgccgtcggggtcgccttcgcggaggctgccgacgagctgggctcgcgccggtacgccgcggcgaggcaggagctggcgcgcgtggcggcgctcgtgcagcggtgcgacggcggcctctcccgggccggcgccaggtcgccgctgcccaggtacagcgccgactgccagcaggtggccatcatgggcatcgccattactaacctcctcaagtgacacgtcgccgcgtcgaacacctttggtggtgtggcttggttcttggctgcttacctacaaagtgaataaattttgtatctgtagtttataaaatccaataaattaagacaattcattgggtgtttgtttggtttaggaggttgattttcattgtgttagattatatttggtcgagtgatataaatattttgggactatctatatttatggcgccatatttttcaacaaaaaatagtcggcatgtatttatgttgtagcttcctaaattacatatgtaattttagtgtatttacaatgtaaatcccaaaaatacatatataagtcctaaaattacatatgtaaatcccaaatttacatattaattacatatataagtgatgtgtaagtgaggtgtaactactgtgtaaattcgtataaatatataaataattattaattttataacggaggtgaagtgctaatgagcttagagcttgattaggtgcagctggttctttcacaaaaggtgtaagatgggtgcatgtgcttgaaacgaatcttatcggaggatctcacggttaaaacatccgactgtaaattatcctaaaatatgtcgacacaaatttagcaatatcgaatatttttgtgtaatgtgaccaaagttctagatcaatgggttgagaaacaacatcgagaaacgtgggatgctatttctgaatggttttaaattttaacaaggaaaagatgagattgtacctatgttattaggatgggaacaatggttcagaacgagggatgcggcatgattccacgttcttggtgacttagattttgtaatgttggatttgaaaattcatgttatttgcccacttccttttaccaaattttggccaagaccatagataccatgttactgccaaataacaaaccttttgtgtattcaaaatttaaaaacctgtttcaaaaaaaaatcgcataactgtcagtgggaagttccatgcgttgtaatccaaatgaacaactcatatttcgttttcaccatgtaactgaattctagtccaatatgagtttggtccaacaaattgtaggatcaagctgatggcaaatgaacaagggggaattcagatcaaccctcgataaattaaatcaataaatacgaataaaagttactcaggtttatgtcaaaccgtatggttcaacatatggataaagttaagcgataaattcaaggcgagatcatagcatttcatatccttatcggactaaaacaaacaaacaaattgataatagtagtcattttgacatagatctttgttccaaattcatatgtgcaaattagaaagggataaaaacttccatgatatattcatgtcactgccaaacagtgcaatgcccattgtgacacctgattattattaattacatcaagagtcgtgcagcacgtacggatggatcagcagctcatgccggcgtccaagggcgtgtccatctcgccgtcggcgagcatgtcggcgagcaccatccctgcgaccgcgccgccgacgacccccatgccgagccccgcccccatccccatccctcctccaccgccgtgactcgccgcgccatggccgtacggcgctgggccatagccgtacccgtaatggtggtggtggtgatggtggtgctgcgcgtgcgcgccgccgccgccgccgccgtagggcgagccgtggtggtacgccagcgttggcgactgcgccgcgccgcggcggccgccgctgtggcgcccggccgacgggtacgcggtgatcgcgctgagctggaggcccttcccgctgacatgccgcgtcgacgacgcgccgcgggcgccggcggcggacgccggctcggcggcttcgtcggtgatctggtacgatatgtggagcacgccgcacttccggccgctgacggggcggcgcacgtggtagctgaggtgcctgtgctcgccgccctcgggcgccgcggcgacgaggtccttgaccgggacgaacacctccccgacgtcgctgtcgccgaagacgcgctcggcgcggagcagcacgtgcagcgcgatggcgcgcatgtcggcgccggcgtcggggatggggaagcggagcggcgcgtgccacatggggctccggccgccctcccggtcggcgtgcgtccggtgcgtcggcacccgcgggtcgccgccggagatggacgccacggcgtacacgcgcatcttggagaacatcgtcaccttcttgaggttcttggccgagaccagcgtcacctccagcacccggcgcgccatcgccgccgcggcgaacagccggccggtcactgacggcgaccgatcaaatgaagccgcaaatgattttttctctcgcaagtgttcacgttcttggattaaggaaggacgatgcacgcagggtggttaattgcaaacaaggttaattaagatttgagggcttaatttgtgtttacgaggtgtaattaatttgtgcggcgagccgttcatgtcggtggcatatagtgtcatgggtatttttagtagtagaggtttggagagcacaaaggtcatttctctgttggtttcacctccattgctgtggcaatgtgactggatttgaattctacttgaggatatgtgttcaatctttttaaaacataggcagaatttttgcctcattttgtttgatagagaagagatacacaacaccaacaaagaaagggctccctctcaaacactaatctatttaaaactcaaaagcacctcaagcacaccacataaactacaatgatatatgatatatgttcatgtttcacttttaggtcatgtttggaacagaggaatggaaaacacataaataggaaaaaagaacataggaaaacaatggaattcaaaacacaggaagatacattttggactgtttggatcacatgaaaaaattgacagagaaacacagatgcaagcatgaagcaaaggaaattttcctttagatcaaagtagatgttttttatttcctatgaaaatggaggaattactacctttccaaaggaaaccaacaaccccattcatttgttccaactaacttcataggaaaaatttccaaagtattataaacgtaaaaaaaaatccttcaaaaatcgttcctaacatggacttagaggttgcgattatttagaatttttttcctattttgagcctaacgcacgctcccagtttaccccatgggccccctttatcggcaagtgaccgacaggtgggtccgtagacaattgggatgaaaatttcggttgtaatgctccacatgtcggctgacaggtgagcccgttacatccggttgatgagttgatctgtttggagggacaacgacaagatcaagcatatcaacccatatgggttgggccccactttcgtatacatacatgtgtactgttgacggagcgcggcgctcctcaccgggagaccgcacaggcccccctttgccggttcggccgggggctcagggtgagatctcaagctctctctgtagatgacggaaagatcgcgacctctcaagagaacatgaaacacaagcgatgtatacaggttcgggccgctgagaagcataataccctactcctgtgttttggtggatctgtgtatgaaggagctataaagtgtgagccgacctctccctcgttctaggctctgaatctggaaagaatcaacccctttctctatgggcaaggtcctccttttatacttcaaggggataccacatgcacccctccctttccaaactggacttttcttcttttcataaatggacggagatttgcatggtcgtcctccgaacatcctcctgacgggacggcacatacctacctccacttctgcctgaggcgggcacgtcgtgggaaggtggctgtgtgctgacgacatgagcagtgtcagaccggtcacaaatcggtcattcttgtccaccacacgtcggctcagcaacgtgcatgtttgcccttcttcaaacaacatcttgcttgtaatggttaggatgaagcctggcatatatcgatcggggctaacgtgtcatctctgggatgtaacacgctagctccagccggggacgagtgcctagaagctctcgtctagacaggatggggcgaagcatgcgtctgaccgcctgtcgccacctaacccgcgatttgaccggtctgtgactggtcacagaccggataatcgagtgcactgcactgcacttcgtgcggcgtgacacgcttagccgaggcgcaataaatgc

SEQ ID NO: 44480 - DNA, 7542 bp, Oryza sativa
gaggggtcggggcgcctcggccctcgggggcgaggctggagtggtccgacccccccctcggggagaccaagaggtgggcgcacacattaccctcgggcccgacgtcccccgagggtgccaggccacgtgggcgattgtgtctgcctcaagcctctagtcatgatactcccggtcccatgtcaccgacaactgtgaaagtgtgaactccccttaacgtacaaaatgaggaactatgtcacaaagaaggaggttcgactagctaaaataggctaagttagattcacatctcagactcaacaaaggagggttcatcatgtccctgcaagaaaaaggattcatcctctctcacttagatcatcccaacatcatctgccataaacttgatcatcatcacttagagtgagtttgaggagaagtggattaagaagattggaaagatacgtaaaacgaggtgagctattagcgcataattagttacgtattaactattttaaatttcaaaaatggactaatatgattttttaaagcaactttcctatagaattttttttacaaaaaacacatcgtttagtagtttgggaagcatgcgcgggaatacgatgtcctttctcaccctatgtcacctaaacaaacgctcccttagtgcaagaacgtaggagtagggcattatgatttcgagcaatctaaacctgtataaaccatctgtcttcattctctaatatcccctcgttctcatgcacgacctaagcacgagctcgaacctgcaccatgaccgaactatcaaacgagggtactttgccttcctgcttggggagttccttgctctaatagtattgaacacttggcacattaaacatgaaaaaaaatatactatcatggacaccatatcaacaagaaacacacgtcgttgatatatattttgttctttttatacttaaattgcactgatgagttttaggataaactcaaacaatcaatttctaccaaaataataggtgactaattgataaataagtaacaaatgacatatatgtatataaaacggatatatcaggcccacattaacatcacgcggataaccatctatgctacgcgcccactgtttcgacgaaaccgctcctgcgtctattcgtaaaataccccgatacaccattacaattatgcgcaaatgccacactactttgtctcactttataaaaactttgctacccctatatgtcatttcgcattatcgttcgactatataacataggtcccgcatctggcttgcctgacatagaaaccatttctctcatttcttttttctcctctcttcccaatttcccatcatgcccccgatcccctcccgttcggggcccaagctcccgaaatcccccatccccaaaagtcccaaacccaagcccaaatcgagagaccccgcaaccaaatctagggtttcgcctcctctccgcaggatgtccgatcccgcccccgccgccgccgcctccaccgccacggccacggccgccgccggctccggcgccgcggcgtccggctccggcgccatcgtgcaccccggaggcggcggcgcgtggccgcgcggcgtccggttcggcgacatggtctggggcaaggtcaagtcccacccgtggtggcccggccacgtctacagcatcaccctcaccagcgacggggaggttcgccggggctaccgcgacggcctcgtcctcgtcgccttcttcggcgactcgagctacggctggttcgagccgcacgagctcctccccttcgaggagcacttccgggagaagttcgcccagccgggtggccgcaacttccccaccgccatcgacgaggccgccgacgaggtcgcccgccgcgccgccctcgcgttcctctgcccctgccaccgccccaacgccgctcgcccccacgagctcgacccgaggtacctcctcgtcgacgtgcctggattcgacaccgacgccgagtaccaccccgagcaggttgccgcggagcgggagaagatcgatccgcgggcgctgctggactacctgaagggtgccgccgtggagcagctggacgccgccgagctgatcggcaagcccaagcggcacatcccggcggtccagatgagctccatgcttgaggcctaccgcctatccagatacgcgctgaaggatcccacctacgcccaagctttcgggatggactacgacgaggcgcaagcggcgaaaacagcgttggagaagaaagctcgagaaggtatactcactcgcatgcccaatcctattaatccttttagctgcgctgtatgctactatgctattgtttctgctgctatgtactcaaacatgctcgttaagctaaccgtaataccattgctgagatatagattgaagtttgattcctttgttctgaatagaagtgtagatctggttcaattagttttctgtttcatatttttgttgatctgtctgttgcatgattgttgtttcattggggttgatgtggtttgtcacacgattattatagaattgattcaaaatgaagtaaaatttgacagatgcattgcagcaaccaatcttgagttgtcgtagattcatgggtattgccatgatctccaatttgatatcttattttttccaaacaattactaagggtacaatgagaacttatttccccactaccttgtaggaatatttttttataaaaaagattagggcctgttattattcgattgtgattttgttttgtcatgcttttattcatatatctcaattagagatttacgtgctacttagtacttgctgcagtttataggccaggcctcagttcctaacttgctatatgtttggaaatcgtgaggtcctctcttttcctaacatttatgcatcatttttctgttcattgcccatgcacttcagattgtatgcttgctgtttgttttttttttcatccctatagtttggcatttagacatgtgcaagcagtgcacaacacaacatttgttggttaagcgtaactaaagtcatgcatcataaaggactactataaatattggttaatgtacctgataaaacagagttatgagaagtgaatgtgattgggtttctcatctgcataacatgttttgttctggatgcactattccttgttcattgatgaagcaggctctgaggtaaggtggttgagttcacctttacattgtgaaggaaggcaccaagttaagatacgtatgactacaacatttgttagccgtgcttgttggttattatatttattaaacatgtataaaatgtatgaacattaactacgtataagtttctttgctgttattttagatgcatctagctgaaccattcggaagcggtaaatatgattaggatttctgttctttatgaaaaagggtaattctcaagatttgcgcataacataacaatcacaagaaaggaaatcatataattatgtatcgtcaacctaaaaaatatataaacgaagcattctttgcagactccaagtttataagtctgagagatccatgcctggagtaaagcaaggtgcatctagcttgcactaggatcagaggttccaacaccatcaaatagtgagggtactgaaagggggatcaatcttttgcctctcctgtccatgttcttgaccaccactagtgtgtttaagttgctccttcggttagaagcccccctccattcttcccgtgatcacaaatccttcatattggaattgtctcttcatattaccttctgctgctgctgtcctgttccagtgatttacttcccttctcgtccttttcttaactcgactagttcctttcttaagatgatgccttcagctattgctgctgctgctgctgctgctgctgctgtccaattcctggaattaacttctcttctcgttcttttgttaacaaaacttgttcctagaatcaatgctagttcctttctgaaaatgatgcctccagcaactttgctttgccttcagagttcgtagcggttatcataggttccttttgcacagaacagaatgattagggaaacactagagccttcagttcagtttagtttagtttattactctttccatccgaaaatataagatgttaggactggatgggagacatcctattactatgaatttgaacatgatgtttagattcacagtgctatgatgtgctccatctgatcctagtaccttatattttgggacgggggagtactacactagagccttttagtttagtttatttttgaaaagctaatcacagtgcacaaaaaaactgaacctctccggttgccaccaagaaatagctccccgcggttttgcttgttctaggcgatgcttcttcctgcccggacaaattctcctctttcctaggaaaaagcaaagattccatgaattgaatatatagacaccccttaggttgaaattcatccgaaattcgaaacgaatccacataagattatttcagtaaatggacatgaataacattaaattacaaattccacctgaattctccatcactctcttttggcgagatggtgataccgagtcacatggaagcttggaaagacgtggagagccaatgggggttggagaggcatcacagaatatgctcctcctccgttagatatttggtggccgatgagcgagacagacgccagcatttgtgccgtccaggagcaaagcactggtgaattttgtcctgccgtgtcagtcggactgtcaccctgtcttggcttaaataaaaaagctcttgaagcattaaacccccaaaatggatcaaccaatccttgcctctctactctttagcctttccaattttctgcgttagataatgatcaattgacaaagaagaaagttaaaggagctcattggctctctctggagctatttttcaactagacataataattcatggaagggaatgaagggatttcccttcaagaagaagatctcactttgcatggcaaatgagaccaaaggcgaatctcttcctgccacaaacaaatcccaagaccaagaatataggtgacggtcacgtagtagtagcagcattggtagtggtcgtacgtcattacttgcaatttgcatgtgcgtccacgtatgtaggcacattttcttttttttaaaaaaaaaattctgatacattgtgttcgctcgagagagaaagagaagccactacatactcaattcgtttcaaaataagttaacctagcacattatgtgactatcctatttaaattttaaaataaattaacctaatacagtatgtgacatattctatttaaatttatagtattaggatatgtcacattctgtattattgttttgggatagagggagtataatatttttcttttcgccatagaaaaaaaatcactgtttctttggttggatattaacctggcccaaagagagaatcccaggagaagcagagtcgccagcactcaccttttgcatccaccgacacggatggacggctaggatggatctaccgacggtctggattgcgcgctggaagagtcacccatctatcctcgccagtcgctgattctttttttaatttttggcattgctacactttctttctttctttctttctttttgcaaggtcttttttgtgtgtcatacacattgatttgtcaaggagatgagtaacaaataaatataaataaaaagaaaaaaaatcaggatgcatttccctttactactctccagctcgtgctttctcatcattcttcttttttcccccaagagtgaattgcacttgcacgtgttctgttacacagtatcagtgaaaggcttaatttttttttctttttgttgagacatgtggcagtcaaagccttcataaacgaacgaaatgtcatgatgtttttttaaatctctctaggcaagagacgtgtttggtgggaccggaaaacacaggaggaaccccaggatgatcagggcgagtcttcaaatacaactcctgcaggtattgtactgtacagtatatatacgactgtacatattcttctcatttttattatacttgtattattttgtattttacatttttcttccttccaaaaatccaatttctttcaaaacaaaaaaaaaccccgactattttaactcaatcacaatatcattagttaaattagtttattgttgttttatatatttcaaatacaacttctgcaggattgtaatgtacagtatatacgagtacatatattcttttcatttttattatactagtatagtactttgcattttcttccaaaaatcctatttctttcaaatccaaaaacactcgtctattttaatgttgatataatttccactagctcaatcacaatatttaaattagtttattgttgttttatatttcatatatataaaaatggaaaaccatttgcgttgacttggtcttgatgtgtggctacgatgcgtttgcaggtcgtccggcgaagggccgcaagaaggcggcggagaatcccggcggccgccgccggaagggcagcgcggccagcacggcggcgaggctcatggagaagatcatgcccagcgcggcggcgatgaagcccagggccaagaagaaggaccagtacctgctcaagcgccgcgacgacgcgcgcgccccgccgccgccgtccatgccggacgccttcccggcggcgcccatggcccccgctctcgacgacgtcccgccggggttcccttccgatcccccgacgccgccgctccccagcagcaccctcgccgccgacgaggagttcttgctgcagaggcgcactccaccgccgctgctgtccgcgccacccaccccgctcgcgcttcctcccgccgccgccgggcaggtcggcgacggcggcgcgcccacggacgccgccaccgccgccgcggcgccgaagaaggcgaccaagccgaagaaggcagccgcccgcaagcgcgagcgcgaggaacccgctgacgccgccgccgctgccgccgcaggcggcgttgccggcgagcctaagaagaagaaaaagaagaagctcgccgagctcaacggcgtggcggtcgccgccgccggcaagccggggttattgcctgctaaggtagaccatgatctgaagcaggtaatatccgagcttcaaagccttcctctcgttgcctcctatgtcgccggccgccgcagcatctctgacgaagctcgctccttcctcctcgccttccgctccaagtctttcaagaagagccatgagaacgatccacccgaggacaacaaggcctctaagcccaatgccgccaccgccgccgacggccagaagccgccggcgaagaagaagccggccgcgaggcccggcgacaccaccgccgcctccgccaaggttgccggcgtcaagcgcgccccgtctgatcgccaggaggagcttgccaccaagaagaaagccaagctcaacaagatcaagacgctcgccactgacaagaaggccgccggtctggagctcgccgccgcggcgcctgcggcggcgaggaagaatgatgcgatcgctgccaggaagaaggagaagg

SEQ ID NO: 44481 - DNA, 5550 bp, Oryza sativa
ttcgcctcatggagacggccccgttcaggcccgggacctccggcggcaactgcgcgccgctgccgctgtcagggccgtgccggcgcgcgcggtggttgggcagcagcccaagtcgatcctcaagaagacggtcaccgacgacggcgcgccgtcggcggcggcgctccgtgatgccccgcgggtgaagttcatgctcgacgccggggacagcaagctcgagccgccgccacctgcagcgccggcgagcggcggcggagacgccgccgcgccgctcgccaagagcgccaccaagtcggtcgggttcagcgccaccgcctctccagccgccggcgcgcccggcacagcacccccacctgcagccgccggcgcgtccagcgcagcagcctcctcgcccgccggtgacccagccactccctccgccgccgcctctccatcagcaccagccataccaacctcgccacaccgacgcgctgccgctgccgctgccgctgccgccgccaccgccgccgccattctccgtgcagcagcagcagctccctccaccgccaccataccacctccgccacagcatcgacggaatgcaccaccagctccccggaccaccgctgccgccgtcgtaccagcatcgcgccgccggcggcgtcgtcttccccggacagcatcagcagcagccataccgccccaacaacgacacccagctcggcctccccggcgccggcgccgccgccggtgacgtcacgccggcgtggaagagaggagggagagagttcgacgaggagttgatgagggtgatgcggggaatcgccaagatggtggagccattgacggacaagaacggcaacttcccctaccacctcttcacctcagcttgagagagagtgagcagcgtctctcacagacatatgggccccactgtcagtggcagtagctgggctaccataacctcttcacctcggctcgagtgagagagagctgtctctctgacagacagatgggccccactgtcagtggcagtagctgggctggtagtactagtagttggactagtagcttggtgacttaattttgccaagaagaaaaaggattttaaaaacaaggtgtgtgtgcctgtcatgtgatgtactcttgttgtagcggtactgggattaagtttggtttggtatgggtgcatcgaccatactattattagtacctttatttctgggattgactcatggtcaagtgaagaaacagttgcagacttgcaatatgttatttctgactatgatgttgcagggataacataggaaaatcaaaatccacaaaccgtcaagtagctcttcacgaggcacgacttatctccattttaagctccccggctgcgttaaatagtcttgattctcgctctggattattaggttcagtaggtttagaattcaaaactgtaatagtagttctagatttttttaaaattatcggtgagaaactgagagtacgaaaaaaattctttagctcttccaaacaacaccttagctttgtattcttagttgttgctctttgtcaactagctattgggtcatgagattcccgtatataacgtgccatattggtgaggaactttatcatccttcatatatgactttcgccttttactctgttatagttcctagctacgcctctctctctctctctctctctctcacacacacacacacacattgagatggcctccttttttatttttcttttaagaagaatttgagatggcttcctagcgatgttctcttgtcaagaagcacatgcatgtctccctcgtcttatgagaaatggattaatgaaccagttattattctattatacctctaaagaacctctgtaaaatcctatattccacgatgccgggggtagagccaggattatatcaagaatatggcttaatcactagagtatgtacttcttgaacaagttttaataagaaaattagcaaattccttggtattttttccgtcaggtgtggggccctgcatgatgcccaaacattctggacatagagaggccagtttacacgatttagttttcttataacattacttcatttcaaagtataagttcacacgaataagatagtgttcctttctagtgaagataaaaataaagttagcaaacgtaaaataaaaacgccgaaggaagacctgaaggatggaacactgtcctccttagcaggggcggattcacaatgggggcgaaggggtcttgagaccccactaccgcccccgggacagtggagacccccctaagcccccactaattcttttttccatagatccataggatgtggggactggaggttcgatttatactgatgtagtttattcagtccccactattattttttttctagatccgctcctgctccttggctaaacaatgttaatttacatgccttgcgactgtcacatttgaaatgaagcacaaaccaaaccaggtaatttctattaacaaatcgatcaattctcattccaataatattggcacggctaacaatcccacatgacaaactcttacaacctctagtcctagttgaaaatacctacagcccgattaaaatttacaattactttatttcataatcatagaaaatatattaaaattaacatagttccacttaatccataaataattgaaaatttttaattcaattttactctattatattgcccattaattaattatagtaattaatttaagcagattttggcgccttgactgcctcgaagcgtggctccttcgcatcgaacttttgcttggcgtacacatccatgtactccccgaacacgtactccgggtactcgccgccggcgccggcgccgccctccaccgtcggcgagatggtcgcctcgaaggccgggttgtagaaggacgcgacggagcgccggttgccgtcgcgcatggggaggacgcggtgccacgcgctgcgttagcggccgttgctgagcacctccacctggttgccggtgttgacgacgatggcgtcggcgagcggctgcacgtcgacccactcgccgcccctgagcacctggaggccgccgacgcggtcgtcctggaacagcaggatgacgccgccggcgtcggtgtgggcgcggaggccggtgatgaggtcggggcgcgggcacggcgggtagtggctgaccttggtgccgaagaacggcgcgtggcggccgtcgccggtgaaggcgcgcctcatgcgccccttgtcgaggccgaggttctcgtccatggcctccatcaccctctcggcgagcccccgcagcgccgcgcggtactcccgcatcgtctccttgaactccggcggtttcgacggccactggttgtcgtcgtggaggtagaagatgtcctcccagtccatgtcgtccaccggcgccgccgcctcgccgcgccgctccgccgccatgagcccctccagcgtcctcaccggctcgactccatgaacgccgcctcccggagtcggtagctctccgagcacaccttcttcacccgatcaagaagctccttcgggacgccatggttcaccagctgcagtgatcccaagagattattaaccatcttaatcaaacatgatcgatattgctgtcatgatcagctaatcaccaatcatcacatgatgatctggttaactcgataatgaaaatgaattacatttccggcttctgttataagtcaccagctaccgttaacttgcattataatataatttttggtcgctgtaacaatttcagctccaactaaaatactccctccgtctcacaatataagggattttaagtttttactcatagtgtttgaccactcgtcttattaaaaaaattatgcaaatataaaaaaataaaaaattgtgcttaaagtactttggataataaagtaagtcaaaaaaaatagataataatttcaaaaaattttgaataagacgagtggtcaaacagtgcaagctaaactcaaaatccctcatattataggacggagggagtaggagtgaagctgggtgcgttggagatgaacaagagagttggagatgcgttttgactagtccacaacttcactccagactcaacacctggagctaaatttaggagttggatctctaccaaacagaccctaaaaatgcacgcagatctgattaattagctacctggaagaatccccactcctcgcagccattgtcgatctgcgccatcgtctcggccctctccgcggcggtgccgtcgagcttggagaagttgatcaccggaaccaccatggctgaaaccttgaagaagatggtggtttagaagttccttgtaaagaatatcaactttggtgttttcagtaattgagctgctaatgctgctgcttaattaagttgtgatggcttgagttaagctggagatggagatggagcatggatgaacgcatatttatagggtagaattgcactgatcaaggatggacataatagtttattttgcaataatgaacaaatagtttgcttctaagaaataaacaggataatttggtcaaagcacaggaaaatgttggagctgacctggcatctgccaggttatctgggatgaagcttctgggcagcgacagccgttggatgcttctggcaaattggtactatttgcatctccatgtaattatgcaccaattggagcaagctgatgatgatcatgtccttgtcatacgtgacctttgaactaaccctcattacactggcagaggattgccatgttgacaggacaaatccttgtaccatgatttcatattattgttcacatgaatgatgattcataattcatggagttgatttgatctcgtttatcatgatggtagaagtttagtttatcgaaaataataaaaagaactcgatccttgaaactagtagaatgatctttattaaattaagaaaaaaaaactatacaacacgacactaataggattctcataaaccacttaataccttctgccggcccggcgaaaaataaaccactgaacatagcctatcttgtttggtatcttgtttggtgggaggtacggatgtaaactcttagaaatagagtctgtcgtcaactcctattattttttactaaaaaatattcgcgtatggcggtatctgtaccaacaagcactcctcaattcttggaattctctcgtggaaaatatgtgagactatgacaaatttctatcaacacggtaaattttcctgaaaattggcatctgagatagtcggtgctactctctgaagattcacacaccaaagagtccaatgatcgatggcaccgtattccctgaggaaaaagagaagaaaatgaaaaagcttgctgcatcttgccaaagaacaaattgttctgagagtgttattgatgtttcctggatttttttttctctccaggaaagtgtgaggaaaatggctggaattcgtaggggccagaattgtgtcctctctctatctgtgtctgaaactctatctctgtttctgcttgtgaattcagagttgccatctcctttaatttttaatttggtcactagctcatc

SEQ ID NO: 44482 - DNA, 2822 bp, Oryza sativa
attcattccggaaccctactagttttggccttgttttagatatattgttgagcaggttattttcacgaattatcgatttaataatatgataaattattttttaaaaaagttaacaaatgacttaaaacatgtgatttaaacaatacagtagaaaaaagtatttttatggagaaacatgtttttaagcttagatcaaataatttgttttaataatccagtgaataagcttaaaagaacgtagagttagtggttgatttagggctaatttttttattggaaatatgactatcaaaaatagatggagagagagtggatttatgaaatcagtttacagctacgtatggaagaaagtttaggtcaattttttcgttaaagaaagtttagacccaattatattgcatattgtcagtgctatcaattctgtaattaattttcacgttgaaatcggaatctggccgtcgcatcacgtcagtgtaaaaaagataatagacggccaaatgagaccaagaaaaacatttggcaggcaaatgtcgccatcacctttacctgcataggagggtcatgtagaattaggcatggttaggtgaagtaattaattaattacataatgccttgttgagttaattattcagttagttgccattcgttccagatcaagaattcaaagattgaggatgatatatttaatttgcatgttgcaacatgtatatgtaagaaaagataagagtatatatcaccattgcatcagggggtttgcaatttgcatccaagataacaaaatatatttttcttgaggaacatttgaattcttctccttctcccatgccactggtgatgtatgcattcatgcatgtgcattttgaataagtcatttgtgataactaatatacctaatagcccatgaagtaatcatgcatgaatcaattagttggaaccgtatctatatgtccatgaaaataaacgcattatatgtacgatggaccacatggcacgtcgacgaagaacacatgatgaaaaagaaagacattccaatttgccagtcctagctatgttgcattagggatgatgtgaaagacaaaaacttttaatcaacacaatattgaattgaattgaaatctttctcgtgaactcgagaaatctccaaattaaacatcatatattatcagttccctcacattgttcttgagcaaaacatgcatgcatatgaaacggtcagcagccacacaattgtcaaacatggatgatcaaccgtgtgcatctatatattggaacttttttaaaagtttttcataaatatgttactagaactactatagcgcgcgtagctgcaaagttgattttctcactgctcgatcttcaaatatcactcattttttttacggtgatcgttgaaggttactacttactagtcaatgtacacgtgttgcgtgtgttttgtggtcgaagttgtatcctttcattctctttaaacattatttttcttcttatttttaaagaaaaagtagcaaccaagcgttaaaaaagacgacaacaaataagagtacataaatttgctaattcctgaaaattcatatttttggctctagtagatggggataacagtcctaaagggcgtttgcctacatctggttatttggtgatgaaaccaggatttcttaattttatttggtgcaagggctattaggccaaattttatttaaattccgataagtacaataactactattgaaatctcaaactatgggagatgcctacctacggcccctaccatgccctataggttatttttcatgaacattgggaaattataatatattcttttttaaaaaaaagtgcccccaatttcatttgagaacacaaaaagctgagtgaaaataatcagaaaacagttccaattttgtccgatgcagaacaacatatcatgagtcgatatcctctctctgcatcaacttgttcggagatatatcaatcatcctttatgacttgatttgctttcttcatgttgcatcgaccggtagactagactctttgagtccgtttatcaatctactctttagaagagaagtcatacaaatggacaacacaatgactacgttgtttgggttgatgagaaaaaaattaaagtcattgataatgacaagtaatcaatcaaacaatggtatatatgccaaatctaattaagcatggcacatatccaaccaaatacttggcaatctatccaagcatcctggggtgcgctacatcccagaaacttctaatttttgccacatgcagaaaattatttattatttacagcagccaaccagctgattaattggcctataaaaccctcattccctagctccatttgaagccatcaactgcaagcttacatcacactagctaattagctacttactcttcttcttgctagcttgctagcttctgcatttagacattgcaaaatctgaaaaaacttgagaaattaactaaacaaaatggttgttccggtgatcgacttctccaagctcgacggcaccgccgcagagagggctgagacgatggcgcagatcgacaatggctgcgaggagtggggattcttccaggtagctatacataatcagatcatgtgtcttcttagttgttgcagagatcgaaagttataaatcctcaattatatataagaatagttggtgcagtgatcgaaagttattctcgatgaatttaaacatatcaacatattgtgaccaaaattatccttacatttttaagaatagttaatcaaatgaacatgtgatgattggtgattagatgatcatgacagcatccatcatgttgattaa

SEQ ID NO: 44483 - DNA, 2718 bp, Oryza sativa
acacccagtggccgtcgaacccgccggagttcaaggagacgatgcgcgagtaccgcgcggcgctgcgggggctcgccgagagggtgatggaggccatggacgagaacctcggcctcgacaaggggcgcatgaggcgcgccttcaccggcgacggccgccacgcgccgttcttcggcaccaaggtcagccactacccgccgtgcccgcgccccgacctcatcaccggcctccgcgcccacaccgacgccggcggcgtcatcctgctgttccaggacgaccggtcggcggcctccaggtgctcaggggcggcgagtgggtcgacgtgcagccgctcgccgacgccatcgtcgtcaacaccggcgaccaggtggaggtgctcagcaacggccgctaccgcagcgcgtggcaccgcgtcctccccatgcgcgacggaaaccggcgctccgtcgcgtcgttctacaacccggcgttcgaggccaccatctcgccggcggtgggcgccggcggcgagtacccggagtacgtgttcggcgagtacatggatgtgtacgccaagcagaagttcgatgcgaaggagccacgcttcgaggccgtcaaggcgccaaaatctgcttaaagttaaaaatagacttttatttgtgaattaattaattgattagttgcataaactatacataaccgcttttgctattcaagataaaaaaataggtgaccttacaaaatttaagtggttattattgtcatgagaatacaactattgttatgttacagtatatagtttggtattttagtgtgtcacggtttgtcagtaggaatatataataatgtaatagatcgtgttgttatatatacatgaataaactatatagatttttttaattaagttttgtcctatttattcgtacgacatgtagtttccgtatcattaatgatgcgatgccttgctggttggacaaaacaaaattgttatcccaattcctcagtaatattattaacgactctcatgcagggtacattttgacttttcttaatgattcttctaatttgtgacgtttaagatatcataccatatagtactactaacgattgttttacatacaggccatacattaaaaattaaaaagtactcctatgttgacctaatgagtaggatgttattaatggatgagccttcagtggcttgtgtaatttacagctgtgtcactgacacgtgaatcataatagagtgggactcatatttcagtgatgctagtacccatgatacgcactattctaataaaagctcctttcccattttttaattaatgctatgagagaaaatataaaccaaattagtcatacaatcgtaccctaggcgggtgtgccgacctatgcatcatatcccatattttcctccaaattcagatcctgatactgatagtgtcggataacatatcactcatactatatcatgttccatattattttatttgaattagattcaagaacgaataaactatttgtatctctagtatataaatattaaatataagaaggcaattaaagtaccaaaagagatatatcaaggaaaatcttttaaaatattacatgtgagctcgtaaaatagtgattaaccaatcgtttatcatcatatttgtaggtggatttataatagatgttcatatatgttttataacatacgggcggatacaagtcttcacatatcctaacccataattttttatggatttggattcgaaaagtatctgggattccattttctctctcatattcttcccgcgagtctcgggtcaggtgggtggtcgggtaatacccatcccattttcacccctagtaggaagtgaccaagcatagatcaggtgataaaatttaccaaaaaaattggcaaattttgtatgagaaccatatgggtctctcgaagtaattagtaattgcttttagaatgttgtgtgcttaattgctcaaagagtgtagctgatccttaaacttgtataattgtatcatctagatctttaaacttttagaatgccgcaattataggtccaaggacttgttaaattgtgttatttcgatctcaaactgcaatgacctcatagggatcctatatagtttgccacatagacgctgacatgctataatcaactatcctacctcgagtgacaagtgggtccactaagagttcttttttctttcttttccgtttttcttttgtttccttctttttttttctctttcttttcttttcttttctcttcttctgctcatggtcatcgtggaagccatctaggggacaccaccagacgagggtggatggatagcggaggccggaggggacaccactatggtggcgaagcaagaagggtgggagaacagcggagcctggaggctaggatggacaaacgaattgtagaggcgcttcgtcaccgctgcctaggaagcaagagcaaacggtggggagcgacatggggacaagggttggtgggatggctatagcaaattctggagcaagctcttgctgtctagtgctagcgaaaagacggaaggagggacagcgccacccgttactatcaggtgccggaagaacaagtcacggctgctcgtgagattgtcttagtgggagggggatatgtgactatcagttggtgtagaattagtgataataccacattagcatccatgtggcatgccacgtgagcaccacatagatcttggaggggt

SEQ ID NO: 44484 - DNA, 2397 bp, Oryza sativa
ttcctgcagcccgtcgtggtggtttgcgacacaaaagggcacaatttaataggttttgggacttagatctgtgttttgagagtttaaggacatatatgacacggccacgtaaagttttaaggactagctgtgcactttactattgttcaaaagaatatagtaatagtagtaggagtttagtacactcatcacaagtgcgttaggtcatatatggcatgacacaactccacgttccacgttggatttagagtttaaaagttaaattagagttatttccatgttggatttagagttatttcaatttgtatatttcatctaaaataaaaacaaaataatttatctaaatattacttatcaatataatcacagctacggttcaccgatttctgaagctgaacacccagctgtcagtcataagaaatcttgatctggagtaccacgggacggtttagtgtgcaaccgtagatccctagatgccaactttctggaccaccatcagtgcgcgtccaaatcagtgctccagcctccatgtggtagcgactctgccattggcgacaacaagggaacaggatgctattgcacagtgcacacaaatggattgaaagaaaaatggccacaaaggctctagctacctctatgatggaatggtctttttttttttttctctcctttccttttgcgtttttttggatgattggtccatagtggagcaagatgccttagctggaggctatccatatccctggtatagcataaatgtcttctgtggcgtaggttatgccaacttacatagtagaaatttaggccctgtttaattctatgggtgaaaagttttggcgtgtcacatcggatattcagatatacatttaaagttttaaacgtagtctaataacaaaataaattacggattccatctgtaaactgtgagatgaattttttaagcctaattaattcatcattagcaaatatttactgtagcaccacattatcaaatcatgatgcaattaggcttaaaaggttcgtcttgcaatttacacgcaatctgtgtaattagatcttttgtctatatttaatacttcatgtatgtgtctaaacattcgatgtgacagggtgaaaagtttttgtgtgagaactaaacaaaaccttaatagaaaaaagggcatgtaactagactcaaggttgtctacgaaattgttttgagatattttgcgttttgaatgaattttggttacttgttggagggaattggtacacgaatcccctaagaaatgcatataaataattgtttgaaacaaatatggttttaaagcgtattttatcgtcctcggcataatttccctcaaggattggtaccaagtcatccaaaatagtgatggtttttggttaggtttggtatcaccgaaattttataactacacctaaaaatatttaagcaccgacttgtaagacaaaactatttttgaattttagaactaaaatttagggttaatttagaggtattcactcgctgttttcatcacttaatgttacattttaaaaccataaagaataaaacgtactacctccttgcacaaatatatgacgttggttagttcaattttgagctaaccaatgtcaaataaaaaaaatttggagggagtaagattcttacaacctaattattttcactgcatccatcacatgtctgcggtttataagctgcaaccaaaacaatcctttcaaacaagtgcttggttaaaaaaacaaaatggataaaaacaaaatcatatatatgccgtacccgttggtacacgtaccagtccaagacatgtgcaagagtacaaacaccaaataaaacacccattgttcgattcgaatttcgaaaagcccgcacgaatctctaggcacaattgacggacagatccaacaaaaaaataataatgacgacgttaattagtaattactcaaccattaccatgtgctaagctaggaggaccgggtaaaaacttaaaaaccgctgttataactaacagcgagagaacactggcaaagcatgcacaaattcggggagccaagaatggcattactggatcacatcacccaccacactagtagtcgtcgtgacgccttcccttccactctcgccgccgccgacgccgacgacgacgccgccgacgaggaggagccaagaattgcatggcgggatacgcggcggaggcgggcgcagctgctggcgcggggcgtgggcgcgcagcacggcatccccgctgacgtcgctggtggtgtccaccatcgccgccttctccgccgtcgtcgtcttcgccatcctccgctcggtgcgtgcggcgtctcgtctcttcgatctcactcttgtagtcttgttcttggcgtgttcgatcggatcgatcacctgggctg

SEQ ID NO: 44485 - DNA, 18910 bp, Oryza sativa
ccgccgccgctgttccgctactgcaccacccggaaccacttcgacatccctttccctgattggtccttctggggctggtaagaattaaaaaatactccctccgttttagattataagacgatttaactttagttaaagttaaactatttcgagtttaacttaaatttataagcaaatataataatatttataatactaaattagttttatcaaattaataattgaatacattttcataataaatttgtcttcggttgaaaatgttacgttttttctacaaacttgatcaaacctgaagcagttagattttgatcaaagttaaaaacgccttataacctgaaacggagggacggagggagtacttactttgtcttattgcttgtcttcttcccagtagtacgacagtagtactattaaaatatttgagtttagaacatgatttagttagaattttagaacttttaacatctacaatttcccaaaaaaaacttagttcatgaatagaaaatatggtatgtttaaattgacctcaaaatgcactttccattatatcataaatttgttacattttatagacatattctaccaatgttatgattagtggccaaaattttaatggtttactaaacatcgagtatttcccaccagagagagtagtattatccgttgggttctacaaaatatcaaatatggtgtggaaaatcacaaattagagagaaaggattatgcattgatgtttttttaagtagtgattcgctcgggttccgattctatgaccgatttgggtaaagtctctgtttttcagcaaatgtgagttgaggttttatgtatttttacataatatataggcctgaaacgaacatcgagccgtggagcaaggagttcagggacatcaaggaaggggccaaggcaatcaaatggcaagacagagtggcaacggcgtactggaagggcaaccctgacgtggcgtcgccattgagggtcgcattgcttaactgcaacgacaccaacatgtggcacgccgagatcatgcgccaagtatatattccactcacataaataaacacgtgatcaatcattacattatactctctccatcctaaaatatcgtaacttttagctattaatcataaccgaaagtattacattgtactacctatgccataaagtatcgtaacttttacctattaattagaacataaagtattttagaactaagatagtaataaaggttaataaaactgactaacattatgatgaatgcagaattgggatgaggaggtcaagtccgggtaccataactccaagctctccagccaatgcacccataggtaacgcaacggtgtcgtggcgttaaaaaaaccctatgatttagttttatgcaccgatcaattcaacccaaacctttgtttcaggtataaaatatacgcggaggggttcgcgtggtcggtgagcctaaagtacatactgtcatgtgggtccatggcgctagtgattgacccgcagtacgaggacttcttcagccgtgggctgcggccggaggtgaacttctggccggtgcacatcgacgtcgccgccggcggcatgtgcgagtcgatcagggacgccgtggagtggggggaggcgcacccggcggaggcggaggcggtggggcggcgcggccagcggctgatggaggagctcgacatggacgccgtctacgactacatgctccacctgctcaccgagtacgcgcggctcatgcggttccggccggcggaggcgccgccgccgcggccgccggcgcaggaggtgtgcgaggcgtcggtgctgtgcctcgccggcgagaagcagaggcggttcctggaggcatcggcggcgagccccgccgtgtcggagccttgcgtgatgccgcccgatgccggcgagtgataaaatgtgttacattatgttttttttagagcaacacggtaggatacgtaggcagaaaatttgagcagttcaacttgggattttaggatttgctttcagccttaaacttattttattttcagccgagcgcaaaacaattcgaaaattttgagcaaggcgtgcatttgaacctccacatgttgagttctcaactagcaaaagtgcttcaattacaagatcgaactttcaattacaagatcgctttcgtttaaaatccaaaccatacccaacatcttcatccgaattgaccgaaactagtcagcacttctcaacctctagaaacacaccaggagaaaaaaaacaagtgtgcttttaagaaaacgattccatacaccagaaccaacagcgctggtattttttttaaaaaaaaaaaacaaaagccatcctggtgattaaaatgaagatcaagagcaaacccaatatcgcatcgacgcggcgcgaccggttaaattaagacatactcatacattcgcataggaaattcgtaactaaaaccgcatttttttcttttttctggcacagggcaaatgaaacgagaacaaataatgtaagattcacttaatactactatttcatagagcaaataaatacccatttagcatccaggttaactcaggagtgccaaggacatacataaaagcatactgatgatatgcataataacggcatggttagcacctgcgcttaacagtgaccaagtgcctcacttatccagccgatatgccctgctaccgttttatctttgagattatcatcattctcctatccgatgacgcatgtacaaaatgagaccagaccagccagtgctgcagccagggaagaccgcggtacatcgtaacatagaaatgcccaaaaaaacaccgcatgaccacgaaatcgttgatgaagcatcatgacaccgctgcagcgaagctcgcgagtcagcaaagcttagctgtttcttgacttagcatcaaccaccaatcaagccaggtatctgtacacattagcgttgtccttctcgcgttccaggtaatcccttgtgatgaggtcctcgattcgcttcttgatggctttgaagtcaggctgcagtggacaaaaaaccaaagtaagggaatgcagtgtactgtagtcatataactaatttaaaagaaataacttcttccttatgataagaacaacttctcgagatgaaagaaaaacagctaattcaaaatgattgacatgtgagctcagaacacattagcacatcagctaattcaagatgcattgaagacaaaaatatgccgcatgagttgtactcatatgcaactatacaagatgtgataaggattaaaatatgtgggatttcctagaagtaatatgtagtcggtaccttgaacatgcggctgagctgctccacacattccgcaactagctgctgatggcccataactttgcgactcttcataatgcgcacaatcgatgcatcaattgcataccgcctgtccttgtcaacatcttcgacaacctttttcttttcatcaacaggaggtaggggtatctgcacataatatgaagaatacaaccattaacatcatagcattcatactccagaaagaaggcccaccaacacgcaaaacacaaaaacacgaaataccttaattcttctcatcctgtcagtgaattttgaattgaactcaaaaacatcgttgggagaaatagatctattagctggttccttgttaagaatcttgtattttgcacaggagagagaatggagcaaacgcactacatcatcatctgataagtttagctgtgttacaatctcagaataagtaagcctgtcagatccgttgaatagcagcagcaacgcagcctgcaaaaggagaggcatgtcaaaaaagtatcataaaggtttttagtgcaacagatctgttgacagtcatataatttaaatttacctgatatgttgtgacaatgagctcaatagtttttgcctcaaactttgcattgatattgcaggttcccaaggaatatatccaggtaagctttctgtgttttgttcttgtttggtaaaactccttgaaaacctccacgcatttcacctaaaaatgataaatgcaaatgttcatgtaaaaaggatcacatggcaataaatgtttcatggaaaagaagataaatatggatcatgtttcagcttaacattatcaaggacaattgacaagcatgtaatgatgaaccctaaagatctgcaagaaaaagtcacttaccatctcagcaggaaggttaatatcgaaagtcttgtaacttggccagaatcctgttgtcaaaacagtgacagccaagtctatcccaggattcaactcctgatgtgcagccacaaactcttcaaacttagtttgatggtcccttgcaacagtaagatcagtaaccattccctccattttagaagtaaattgtccaccacactctgcttgagtttggtaagtatgcttctttcatgttcatcattggcactcttatcaaaaagcaatctccttgcaagttttttcctgcaaatagctccacacatgaagcaatatgaatacaaagtccaaaaagtaatgtttcttaaattcaggaggtatataggcttaaaacaagataacacaacattacctgtaaaactcagcaaagaggtctttatcgctgatgtatgcaagcaatcgcaccacctgaatcatatttcattttcagcttagatttccttctacaaaaatttaataatggtagcaaaagagaagggagaacatgcaccttctcaagagcatcttcgatggcttcatcactgagcttttcactgcaacctttcttcagaatattgtcacagaaggtggcaagcagttcagcacttgaactgccagagacacccttgttacagaagacctcgaatgcttctttaagggcctgtagaatgagaagtttaagaatgaggcatcacatttgacttaatgaaccaatggtaacaacaaggaataggaatgtgtcgattggcagaccttatgaaagagggtgtgaccctggaaacattctgtgacataagctacatacttgtcatggagctcaatgattttccagacaaaaacctaaaaagaaaatcacatgttaggtggaaaacatttcatcaccaacgaagtgcaagaagttcaagttgtgtacctgttcctgcataccaaccatgtcctttttctcgggctgtacaaatagttgatattagaatattagctaaataccagtttgttgcaacgaatttgaaataatcaaaagttctgaacttcaaaagatctatatatttctcagggaaacatataattgtaatcaaatataaacccacaaataatctaactacaactctacaagctacatgcaaaaacaatcttaaagatataatgtttctcagggaaacatataattgtaatcaaatataaacccataaataatctaactgcaactctacaagcaacatgcaaaaacaatcttaaagaatcacatagcatcccaccaaccgtcaccagtaggttctttatacagtagagcacaaaaaactaaatcaaataacatgaatttgaatcactaataataaatgcaagggaatcaagcatttgagtgtaaccagaaacagcatataccgtgtcaggaattgtgcacactaggaaaactatagaataaaggacaattttacaggattaaatagaaagagacagtcagcgacctctgtttgatcaactgaaaccagtttaaagggagctaatttaaagcactaatctggcatgcacaaatcacaatcctaataaccatactttgatggaacacaagtaagaaaaatgctaaaataaataccgcaccttcttattactagcagaatcttctgcttgcttgaccaaggctgtgccctcatttgtaacatgctgcagagaagtaataatttaatcagaatgcacaaaaaggttatagggaataagcagaccaattttgaggcaatgaggcaataccgttttaaacatgttagcaataggttctagaccgcggttaattttggagaagagcctgtacatcctagaaaggtcttcctcctggagaagataatgggtattcaatattatttgttttcatgatatacggttaagaaatgaatcatgttgtccaacaaaccttgtcatcacgaagcaatgcaaaacacccagaatgctccttctccaacaggggagttgcatattgtgcaagcaattcattttgcactttctgtgacaatccaggaaggataataatatgagatgatattccaaaccatacagggaaagtgcccaaacattatttaagaaacatcgatatggcagtccaaatacaaatctgtaagaacatatctcaaatgcaagtataagcactcatcaacatgaagtgattggaaactggaaaagggaattctcaaacaaacctccagtaacttctgttcactactaatatgcaagtagtgaccaactcgctccttctctttcttcaagcactcctcagcctaacaaaaacagcacccatttattacaccagagatgtcatttacaaatacagacagaaccagtcagaagatcctcctcaaatgtacctttatcatgtaatcaggacaagagtcctcgagaatccagctttgagccttgagagagtagtaatctgtagtatccttaagcaagaaatcttcaaagtcattctcataacattccatactgcctagtccaatttcaacaaatatgcccaggacattcttcagcagggccctgtctatctgttcgccttcacgctctttgtcaatctgtcaaagaaaggtattgcaactatttaagtatacgcgcaaaatcattttcccaattcaatgtaggaatgctgactcaccagagctatcactgcacctttaacttgtcctttgatttcttggtatatctgttatgagttggtcagattaggacacagaaagtttgcaacacagagattgaacaagagcaaaagctattttaccaaatctcggaagcaagtaagcccaacttgttcaagtggtataagcgacctccgtgagatgaagtatcgatcaagataaaagaagaaacgtgacagccaccgaaccatgattttatggtttgaccacctctttactagttccctcagcataaactcgtcatgtttatctcttaatgaaggtaagacctgaaatatattaaaattaagtgatataaagctcagagtgtacatacaaatataacaaaggagcatagcatacaaaaagagcatgtaatacatgttagaatatcagatcaatatgcacaagtaggaaaaatagtttttgtttcaagcaaaatgtgtcagtttgcttagcgcaatcctaaaaaattatgtacatgatttctaccatgtttagacaaaaccaggagagcaatgctaggatgcaaagcatgatgttcgtcaaagaaccagtatcagccagacatttaaggatatctcctgacctcaaagtcatggaaacaatcagcacactggcatgaacctaaaaggatgccttttatagttttatgtttctaggctatagtcacttttacagcagccttggccaaaacagtgggggcggaaatgcaacgttcacctagtcactagtcgttagttgatcaatgacccactgactagtcggaggctccaagcctccaaaataaccaccatttaaggatatcggcacaattttttacatgtttcgtggtatatgttgagaccacagggtccacactgcatacactagtgtgggtgtgcctgggactggcagaagggaagaccggtatgcgtgcggcaaatgcatgggcccactgtgagcaggggcatggcagtgtgtaggataaaaaagaagcaacaaaggagccagggggaatttggggaatttaggctaaccgtagacccctttaccccccttttaacccacacttttgggcctaaatatttcagctcataccatattctgtctcctagttggtctgcctgattgattagtcaccaactaaaaccaactgactaggaccgactagtcggtcgaactgactagcccactgtttactccctaatcgagacggtgactaggaccgactagtcggtcgaactgactagcccatgtttaccccctaatcgagacggtgactagtcaggctggtcggccaactaggtgaagtattacaacccgccgcacattggtagagcgatcagctgttgactgactagtcatagattcgtatcctacttgcagagttttgattcacaaggaaaatcatcatcgtttcagttaagttaactaataaaaggaaacaaattatgacctattcaactgagatagacttactacacaatcgaatcaaatagatcacctctatcaacaataatcaggtaaccgaatcagacaaaactaagatccccaagtacactaaccccattctcctcctaaccaaggaggaattataacccatcggtgcccggccaccacaaccaaaatcgcctggatcaaccccaaatcacctactatcgaatccaaccggaaatgacagacatgcacaatcatatcaaacatttacaagaactgcagaaaaaaaaagatcgtctcaccatggaggtgatgtactcctcgaatgactcccggtacttgtcgtagagctgctgcgagtagtcgtgcggcggcttctgcgtgcacatgttgtatatcgtcctgcagacaacaacagacacggagtggggggaaaccctagatcagcaccagatcgaagcgaatcggaggggaaaccctagcgggcgggaggaggaggaggaggaaacccaggaggaggcggcggcggcggcgggggacgtacgtgtagagcatcatgtagtcctcggagctgaactgtggctcgggcttgccctcgaggatgttcttcagcttggtgatgcccttctgcatgaacgcccatccctcctccagatcgatcgtcctccgctcctgccccgccatcgccgcagccgccgccgccgccgccggtgaacggaggccgcgcggaccaaaccctaggggagagacgccgccgcgtgggtttgggttgggttccgcgcgagaaaaatggggaggaagcgggcgagagagatagagagagagagagagagagaggaagagggagcggcagactgatgacaagttgaggcggtgacgcggttgggggtaagtataccgcttatatcggtgtagtaagcgtgtcacactgtcacacaaatccgcaagtgaaattgggctgcgaattgcatgggtgatcgggtcgaggctatcctctggatatactctatttcaaaatataataacttagatttatttattcaaatttgtactattaaaaaataactcatccgattctaaattgacaatgagagtattttacagcgaattattttgtatgaatttctttatctctatccattctataatcagagtcgtcatccttccgttccaccaaattctatgttttctctaagttaccctcatggcacatctctaattatatgggtttggcatgttataacatattaacatgttacctctactctcttaaaatcaccggatccactgctttattctcttaaaaacaccttcctgacacatctctaattatatgggattggcccattacaacgtatcagtatgttattggtgggagtatgagagattttttttttgcgtgcttcggtaataaaaccatatataaatcgtaactttgctatttgttgagcgattaaataaatcccaaatcacagataattgataattttgttggtttgatattcaatatttttcgaattttttcaatcttgagagttgagacaccgtacgtctctaaaagcaactgcttcttcttcggcaaccacacctctcctcggataactattcgagtgcactgacttaaattttgaggagtggctaagcatactgctttaatcgtgtcacatgagagcattgtaccaactgcatttcgcaatgaagtgtttttaaggatagtgggagacaaattcctcgcatgaatcggtaatagaggggtgctttgttgatttggtagttaaaaacatattacatagattacaattttagtatacttgttagctaattaaaaaatctcgaatctcacaaatgatctcaccattagtttgattcccaatagctctgttatatctttaaagggagacattgtctccctatcatcggcaattgcttcccaggcaaccacgtgctcctccgattctttggcaacaacccttttagggtgactatgacgttcctttagcgaacacgacttattgtattagatcaccacgctgactctatttcatgatggtttttcctatgcagcggtgggagagaagtttctcacgtgctttgttagtagagaaattttttacttcggtaatagaatcgtatataaaattctaacttttctacttgttatcaactaaaattttccaaatctcaatcaatttaatctcactgctagtttgatattcgatgaatctttgagtgtcttcagcctatagacatcatctatccgccaacaactgatccttctctagcaaccaaaccactcctccggcaactaccctcttatagtgagcacacccacaactcatcgtggatcaccatgtaaactcccttttgcaatggacttttgtcgacgtttgatatcacaactacggtattttgcatactatagggatcgttggtaccagggtatatgcgagattgaagtagaaaagatggagacaatgatttttatacatgttcggccccttatctgtcaggtaatagccctactcctgttggccgaagccggtgttgcttctttattcatctgaatcacacaggtacaataattggaataactcatctgactgtcgtcgacttggcggtatggataaccaactcgtagttgacgacagggtagtcttcctcctcgaatccgcactcggcgagatcagagatagcagctatatctctcttgttgacctccgcagacaccatattaggtttgtctaggcttatctctgatgtcgatatctggcggcgtgtgttggcttgtattgatctatattgatcttgctgtggctttgtgtcattgtggcattgtggcgtgtcccctcttctcttagggggccttgtatttatacccatagatgtccccttgttcaagtagaactagggagaccaatatggatacaatatgttgtttccatatataactctactcgtcattccttatccgcaactctttctatatacgaggtttgtttccgtataagacatagtatgtggtgggctctaccgtgcttaggtatatggtatccataaccctgacaactttcttgtgcggtggtggaagataaatttatcatgtgtttcagtgtagaggatttggtaataaaccatatataaattgcaactttgctacttgttatgcgattaaaaaatatccccaatctaggtaaatgatatccctgtgggttcaatatccaacagcttttgcatgtgctcaacctctatacatcatctatagatattttataaaatgttacgtaagatccatctatctttctaataaatagatagatgctttttttttgacaagttttaaacattgtttcacctgattaaccacattgccaattgtaatctaatttcaaacaacatgcaactaagtttgcgtggtgatttctatattgttgaaacatgtaggatatatctcaataaatatagtaagttgaagtatggtcgtgataaaaaagaagtattaatgctatgtttatcttacgatgcctcatatattacataggcactagaataagtcagttgttgcatttagtgaatctgccaaaccccaccaatctaatgatgaacttatcggtaagaccataggctcccaagagtcctattcatgtttgttaatcaccttggtgttcgggattgacatcaccctggatgcccgtgactaacaacataggcggtaaagcatgccctggaggaaccgaatggagctagaccaagatcaagggtgaccaatagaggtcaacactatcaaaatgacactggcattgataaattaacaatggaggatgatggattttggtttatattgcccaaatggctttcaggctcactgtccttgtttactactgcaaaaagggtgtggtagtagctaaagagaatgagagagaatgagagaagggagaaattgaggtacggtggtggctgggtagggagggaagaggagacttgggatattgacagctaaaacgagcgccatgttgtcatattataaaaatatattatttgataagcctcttatagcaattttttattttacatgtgaatgtacatgaactagctaataccaactagcattgcttttccattgttatgttgctcttacaatggcaaatttcgcctattaaattctcatacaaacgaacagttcattttattttatttgacagtgatacgatccatttataacctactgattttttggtatgtgtttaaacaatgtatcgcccttattatattaaccgtacctagtttttgatatcttgtaggtaaattagcacgaaaaaattgctgttctcttctaaatttgagacctacttcaacatatttcaatgtctctgaagactggttatgatgtgaaataaatattattcactatgatattttctatcgtagttagatagtacataaacctacacagtgatatcatatacggagtaattaaattgtgcttgattaccagcacactatgccacaatttaccatgtacaaatatttggctagagccattaggggtgggcatcggtccgatcgaaaattttggtctcggtcttcggcctttcggttagtttggtcattgaaaagtgaagaccgaattttaacgtaaaaatgtcaagaccgaaaaattcattattggtctcggtccagaccaaaattcaacaatagtttcatatatgcgatcatagaaattttcaacacaaaaatcacaaaaataatactttcttcgtttcacaatgtaagtcattctagcatttcctacattcatattgttgttaatgaatctagacattaacaacaatatgaatatgggaaatgctaaaataacttacattgtgaaacggagggagtagtacgtatgagtaaagactttttttttcatgtctagaaggaatagagatgtgaaaaattagaatttaaccctattgaactcagtggatcgtaagttgcatttggacatttttttttgttaatttggtcttttcggttgaccaatgagactagccgaattgaccaaactaaattcggcatttcactacttaggaccgaattgctcggtcttgatcttgtcttttcggtccggtctttttctgcccacccataagagctacagttgtagcaaggttcttttggaataaattagatccacaccaattttacattgctccattaacttgacaacaccatcaattttacattgctccgcatgacttaaccatctataagtctaacaccatcattgttataaccgtatacacatgacgatcacttaccctacactggctatgcttcgggagagggttgggaagcctaactccctagcgcgcaaaacaaagcatcgtttagtgcataattaattaagtattagctaaaatattaaaaatagattaatattattttctaaagtaatgtccatatagaaaatttttgtaaaatatgcacgtttaacaatttgaaaagtgtgcgtgcgaaaaatgagaaatgtgagttaggaatgtagagataagagctcaaccacctttaagggaaaaaatgaattttatatttttgcaaatagaaaagaaacatcgaatgaaatctgcagtatttcgaattcgaaagatttcatttcatacgcattttgtcttttttcttcacccccaacaacacgcatccggctggctcgatctcgacacaccaaccaaaaatcgaatcgcgttcgagccatcgagccgacaaggcgacaacagccacaacgcctcactccccccaccccacgcgctccgacgagctccgatccgccgcccacctcgccgcccgccggcgatgagcaccgcctccggcgacggcggggacggcggcggcggcggggatggcgcctcgtcggccgcggggggcggcgggaggcggatcccggccgcctcgtgcatgccgtgggtccgcaacctccgccgcttcgtcggcacgggcgccggcctcggatccgaggccttgatgggtcagtgccgttcgccgccgccccatcccttctcctttcctgtggtgtttggccgggccgggattccgttcctcatcgtggagatggcggtgcggttagggtttacgcgtctcttccatgaaaatgatgatgtgattggggaggagaaattatgggcccccctctagtgggaaggattactataatgtgttcctcaggtttgagattgcataacgcagcgtgtggatgcgtggaatgggctcgctcttgcttgatttgcagcgggtgatttgggtggagcggcatagtttcttgacatttgacgaaggtcacaactcacaagatgttcaggctcctgggagtcctctgcacagaggaaggcttgccggctgtggacgcagtcagtattggcaatgtagggtgatgggctgggattttgagtcttcgtcgtggagatggcgataaggttagggtttacgcgtctcttccacgaaatggtgatgctattggggagtagaagttagggtgctctagtgggaagggttactggatgagttatagtgcctcaggtttgaaattgcataatgcagccggtggatgttgaaatgaactcactcttgcttgatttccactgggtgatttgggtggagaggcatatgcttttcacctttgaggctttcacaaaagtcacaagatgaaatcttctgggagtccttttcacatactccctccatcccccaccccccccaaaaaaaaacccaatcctggggtgcatcgctaggattgggttttttttggtacatagggagtagtaactagtaaggcactgtaggcttgtcggccacagacgagtaagtagtggtaggagtagtaaggcactgtaggcttatcggccacagacgagtgagtagtggcattgtaggaagacaaacatcagattttagtcatgtgcgttttacttgttgatacgtaagctgaggctattggtaatgtggcttgaggatatctcccagctagttcaggaaaactttgatccatatagtgcatatagttgaggcttagttgtccttttctgttttaatcgcatttgtggaattagggactataagataagatgtctcattggcatgcaatttttgggtgcatttgctacaataacatggttgctttgttgatcaatattcgcatgtttttcatgtgcctgcttgtaaactatttgttttaaacctttgatcgcagaactggaaacaaaaaggatactgcttgagattttcaaggagcgccaacggaagagtatggaagctggtgccattccaagtttttataagaaggtgcacagcttggttcagtttattggataccgagatttcataatcttttacgttattatcaaattcgcagcgtaagcaaaataaagatcttgacaacagtagctgctttgacaaacgatgataaaaaagatattggtttcctaagtatcatagtttagttctgattcaagaatgcattgccttctcgtcaactcatgaaattaatatctcctttatggacagaaacctgaagatggatccattagcaatagagttcagaaattggcaaagtacaggtttctaaaggtaatgtttgatttcttcttattgctattgagatattcgtgtttggttggcagcttacttgcattgccatttaaccttctcatggtttgggccttacaatagttattttaaacaaatggcagaaacaatctgaacttctgcttaatgctgatgatcttgatgccatgtgggtttgtctcagagaaaattgcgttattgatgatgctacaggtgctgaaaaggtaggttgttttatgtacctttatttcagaccagcaatctgccagtttttaatctaaaaagttcagatccttggatgacaatatgcatcatatgtctacaatatgcacgcaaaaaactcatccaaaatgaaaaaaatcttttggtgtgatatgcttaatctcttttaggggatttttttagttcattgctacttgcttgaatttggtgtacatactgccctgtaaatctaacgatgatccttgtatctgtatttgtgtttggtgtagttgttcatgtagcagttttggttcgattaccttgctcatctatttttctggagtcttgcagatgaattatgaagacttttgccatattgcaacagtatgcacagagcagatcggccagaagtgcaagcgtttcttcagcccttcaaattttatgaagtttgagaaggatgattctgggagaattgcaatcctaccattttatctttatgttatgcggacagtaagttattttcaaacaaatattattaggattaccaaatttgttttgtgtaatatttgatgtcttccatttgcatctctgataaactggtaattctagcccacaccatgcttcttttccaatttcccattggatgtactcctagttctttttactaaatgacaaagtaggctagttatatgttatcatcagttgctccattattattgttagttagcttttattagaaaagccattcaaagcaataacaccaaatcgctattacaatacaagaacatgagtcatgtcattcaccaaaataaacttgatgggtgtaacaatgcccaaggaagctaaaatcgtttcctcctattacatcagaatgggtcacatttaagtctgaaacatcacataaactctgaattcccatccagcaaattttttgctgaatccatatttatagctgtaacttatttcaaatcattatcatgcatgctactgtttctttttccttgcgtatacaattgtatgacattcttttaactaatttcttcaggtatctctcacacaagcgagaattgatatgagtgagcttgatgaggattctgatggtttccttcaacctcatgtaaggacatcctaacacacgttaacgccattgcacaccttagtaatgtttgacatgacttaattctattaacaggaaatggaagcatacataagagggcttatccccaatttggcacaactgcgtgatatgccatcagcatttgttcaaatgtactgccgcatagctgcacgcaagttctttttcttctgcgatccacacagacgaggtttagaaccaacctttaagtgcagttgtattaatatgcaaattactttaatcgatacatttattctttgtaagagtagctaactgtttgtaatcgatacatttttttttcagggaaagcatgcataaagaaagtattgctgagcaattgtcttcaggaacttatggaactacatcaggtaatagaagaaacatatttcatggtttgctggtagaaactctgtaaattttatacccttataggcttacaacataatattgctgtatcctatattctgtttctttgtggttacgattcttatcaactatattttcaggagagtgaggaagaggttactgatactgagcaggctgaaaattggttttccctgacgtcagctcagcgcatttgtggtatgccagccaccctcatgtctggttttctgatttttcttttgggtagcagtagcacacaatcagtgctctccaaaaagttaccttttgccattctattgcagtatagttgatgatctacctaatgcgcatggtcccatgcagatatgtttcttgcacttgacaaagatacaaatggaacattgagcaaacaggagctcaaggaatatgcagatggcacattgactgatatcttcattgaaagaggttaaaatccattatctgctctcatgatactttatgtttgtctttctagacgtcctaaccaaaaagaaacatgcaattgcagtatgtgaagtttttttatgcattatacacatagatcatggtgtatttcataaatctttagtcgtgaatagataaacaatattataacttcttttctttttccagtttttgatgagcatgtacgccggagcaaagttggaggtggcaacagtcgtgaaatggactttgaaagctttcttgactttgttttggctctagaaaacaaagatactcctgaaggattgacatacctatttagatgccttgatcttaatggaaggggattcctgacaactgctgatatccatacattatttaggtatgtacggggaatctgtattgtatattttttgggcagtgacggaaacatctgcttcggaaaagtggcttaagcaggagaaagttgattgttgttcattagaatagcttttccatggcatataaaagttgagctagcattgtttttgtcaaaattgggaacagcctctgcaatcacatgctgaataatttactgctattctattcctctgttaacttttatctcggaagaaaagaaaggaggatgtgagagttagcattcctgcctgatacaatcttcctagatttaatctgccattttgtttgcttgctgaactattagacagttttgctggccttagtgggcaggacatcaccatgacattggttcaatcgcacataggtgtcgctgtttcttacatactcacaagtgcaacatcttcatttgcacgtgtacatatttttatatacttcagtattttctcagtttcttatgagaactaattagtaaataattagga

SEQ ID NO: 44486 - DNA, 2210 bp, Oryza sativa
gttctccagctgccgtgcaaccaacctggtaaactctcaaccgcaaggcactggcaattgctggtatccgcaaccgcaaggcacgggcaattgcttgtaccactgtatgtgtgccattgtagcttacatagtgtattagaatcaagttcaacctgttcgctgggagacttgttgtaacctgtaagtgttccatttgtgtaaccggagtgaaatctgacatattttgagttgaacatggttttgtcgtgtcgaccagatgtattaccgcagggcttggttggatgcagaaaggaaagcctcagcctgtggaatttgtacgtctatgcgacaccacgcatgtaattcggtttgcaactgcaagtctatatacgcaaaaatacattgtatgccctttgatgcagtggttatttgtgcccttctccgtgccaatcactagtttgctttcatttggacgtgctctactttctgcatttggaagattgcacagatttcattgactgctccctctacgttttctagcagtgtttaaggttgagatgaaattcgtttgatgccttacacaactttaggacccctttgaatcgtaggaatgaaaaaacaaaggaatagaaaaaacataggattctggcaggaatacaattgtaaaacagaggattgcaaaacacagggaaaacacaggaatggccgtttgattgggccacaggaaaaacacatgaatcaaatgagagagatttgagagatagacttagagaaaatgttccaagaggttagaactcttgctaactttcctctaaaatatatataggattactcattccatgggaattttaaaagcttggatatgattcaatcctttgtttcaaaggacttcataggattttttctataggattgaaatcctctaaaattcctacatttttcctacaaatcaaaggggccttacttgtttggaaaagacgatgcaaaattgcaaatgccctatatttatagatggtgggagtaaatattttgaaaaactttcaacaacatatgcttatttttgttgggtccccttatttactggttggttaaatacagtggtgatgccggttcggcccttttggacactactagaggttgtgttcggcagcccctcttccaacccatctctctcgttttccacacacacgttttttaaactgctaaacggtgcgttttttttaaaaaaattctatacgaaagttgcttaaaaaaatcaaattaatctatttttgaaaaattttttagcaaataattaattaatcacccgctaatcgctactccgttttccgtgcgggcacttagtgttgggaacccctggttggaacacaccctctgtctggaaaaaaaactaatttcatataaaaacgtgacacatctaataaaataaatattgacataaccaatttatctgaacatagagttgttgtcgtatcttagtataaagttggtctattaggatggagtacacactaataactcttaatttgacttgattttttttcttaatttgaccttttaatttcaaaaaacaactttgaaacgggccaaaatgtgccgccaaacagcgcaaaccccatccattttgaaacgaaagctgacaagtgaagccagcggagtggagtggacaaatctccgaaccacaaattccaattcaaaaactttttccccgagtagcctcgccgtcgccgtcgccggagatggaggcggcgcgggagtcaatggcggcgctcgtcgacgccggcctctacgactgcgcccagacgctcgtccgtaaccccccatcctcccttccctcccctccccctccccctccctcccgccccagttcccctctccgaatcactagggtttcgcttttgcccccacgaatcagtcgctgcacctgcgcgcgcgtggatcgggctcgcttgggtctcgtctctcgtcttgggacctgtggttggttcatcgcctgtgccgcgcgaggttgggcgggtggttgggtgattgtgcgatcgggctggctgggcgcgagatatttttttttttgtctttgttatctgtttcataatgtatcgagattgatttcgggtggagataatgctagtttgttacttgcaggggtgctttcttgtgtcttcatcacctgcgagcagcgaggctggtatgtccatgaaggtggaaagcttggtaagctccattgagtagct

SEQ ID NO: 44487 - DNA, 8258 bp, Oryza sativa
taactgaggattcttcatctagaagaacttacattgtcgatttctgttgtctagaaggtccaatattgatcttcttggagcttaaggtgtcagtgtattgcaggtactgcatggtgatgctttgcatggagagaaagaatttcgcagggcactggtaatattgccgataaatctatgttgatagaaaaacgataatgcattttgggatttcattgtattcggaaatgtaacacatgattcagaccccagttctgaaatcttagtctcttatttcctgtttcaccatggtagagtgcctacaaacaagctatgcaatacagcaaaaacattcctaggcaagcaacaagtaatactagaagctcagtaactgccactggccggtctccttctccaaattcttcaagtcttgcaccactcaatgaaaatgaggtgaaaacagctcggcaggccattagatattccgttcgttgttatttatttgtcatatctagcaagcaactcattctttttctactgttgcaggtgaaatttaaaattgcactttgctattctgctctacgtgagcatcgtgaagcacttcaagaggtttccatttttcattcacctttgtttagttctctattatattcctgaatgttactccatcctgggaagtggaaaggcaggatcatctgaatatatgtaggatgactcggactcacttgtggtagcttcttctgtatgatggaagacatatgatgcaaaacatggcctctatgttgcctgcagatggaagggattccttctaaagcgaggactctaaaaatgaatctgatgttagggaagctatatcggatatccagaaataatcgtgcagctgctgtatgttataaagagtgcctgaggtatgcaatgccaaattattttgcttcctagctcctcaattctgcaacagtgcaaacgatcacataactaccattttcttttgcatatcacgtttccccctaaacattgatacagaaaccaacattttttttcaccattaaaaatattgcccctcacttggccatttcatgaagatttagtttgacaaatttctttctacatctatatgctcttatgacaggcaatgcccttatgtttttgaggctattacagctttggctgaaatggggctttcttcaaaggagttctctttgatattctcacaagtaagtgttttgctccataggcagcttgtattttcaaactgaatatagtgcagttttagtgaggtcagataaatactagttatgctagatcctaagactcttgagtgcttgattgcctgccattttttctggttgcctattatgcttgccatgtatataggctgtctaatcccattgatgccatgccttggccagtattgctacacaactacataggtcattgtttgttttgctttacatcaaaggaccatttctcagcatcatataaacaatgatattttattgatggaagatgcatactgcaacagagaaaaagaagtaaattacatgctgttaatagttctatataatatatccctttattttattgatgatctctttatttcatatacaatatttaccttcgcacaattcaatgttattacagaaccatcatcccaccaattttttatcctttctatatttcctttggcgccgtgagcactgcaaaaaggaaataatgagcgcacatcagtttatcatgcaattgaagatgtggtattctctgtaggcaccaaatcgaggaggcaaggctccaggtgactctttagatgcacagcgttggtggaacgtaagtgaactacttgcacccttgtgtagatagaacatgcgaaccccaaaaatatttgacatttcttatgtttgatacaagtaaacttctatgctggattttcttagtatattttatttacattgattattgaacctcaaaaccacttttactttcgaaacttattaaattggaagagtgggaatgaagtcctttccttttcagctctatgttaccattgtatgaactgagcccacttgtggaacagttctatcatgcacagcttttaactcatggagttcttttccctgaccacaaataatttgtcaccactgcgtcaacaaatgcacacctgcacttctattgttttcttgtagtggggatactgtgatcaatactagaacattaggaagcaccatgatattgtacctactgatcacatgcagttgtatttttttttatgttgtggatttatcagaagaacccattttgttccgctcacagctacagtgctgctttagatttgggctcaattatgtataagagtttccttgcaaactctacttaactcatgcagcatacagttgatcatacttattgttcttgttattggttgactcaaacaattattgacttaaatcattgttttcttaacagcgctatgttgaggcccaatgttgcattgcttcacatgattataaaggtgataaaatagcattaatccaaattcatttgacagttctaaacgtaagatgcacttattttatttttgtcattgtcaaaaaatcgtgttgcatgattacagaggatttccactactaaacaaatgatatgtagtgttaatgtgttatatcaccctgtattgtcatctatgtcttaattttctgttggcccttgttcctttggtgttggtccttgtgccactgggtaaagcttgatagtcaacatttcttaacttcgatttgtttgcttgtatcctctcatctgttaagcataaacttgaagaagtaatactgatatgccaaattcatttatagtggtcgcaaaatataatcatgttatttttttgtttaggtggccttgacatatatctagacttaatgcagcgattcccgaacaatgtgcacatcttgctggaaattgctaaggtttgtttttcttcaagcattctgtttatgttttatgtgctctctgtaacatgtggattcttgatgcattgagcaccatggctatgtcatacttcttattgtttatgtacttcatgtttggttctgctgtgctcctctgtcctgtctataaaatttccttttgttatgtgttgaaattttggagttcctcttaaaattttcatttggtggatttaattcccctccattatgaattgatcctgaatttggagcttattatttgaaggttgaagccatcataggtaggaatgatgaagctatcatgaactttgaaaaggtaaaattaacaagtatagacttggaaccccttaaaacgtaagtatgtggtaaaattatttgcttccttgcaggctcggttaattgatccaaacatcatgacatatatggatgagtatgcaattctccttaagtcaaaatctgactacacaaagcttaacaagttggtacatgatatgctgcatattgaccctgcaagaccagaaacatgtcttgctcttgcagcattgtgggaaagaaaagatgaaagaaaagctttgacatatgctgaaaaggtttgtatcgttacataatcttttattgaaagctaatcttgatcctaatgttccttgattttccttcaacagagtctccgagttgatgatagacatataactggatatatcatgaaggtaataatgcaaaagattgtccgaacgactggattttgcactgttgtagacatgcagtggcattttcttgctttgcaaagtattatagagaaatctctgcaatgaattgcgtgggattaaaaccaaaatgttattttatcaaagttaaaaccaaaatgttgtgatggtttttcttggtatttactctgggaagttgtatacttgtaactttgctacctttgtttttgtttatccacacgtcaggcttattgtttgcttattgcttttcaagggaaatcttcatcttttgttgaatcgacctgatttggcagtcacagacttcaggggagctcaagaacttagggccgatcttcgctcttatcaaggtattttggtgatgctcctgattttgaagatcaaatcataccatcagtctaatacatatactatatcaggattggtacgtgcttatctagcgctctctaaatgcaaagatgcattattcactgcacgtgaagcaatgaaggttatgcatcagtctgcaaaagctctcaaattagttggtgatgtgcatgctatcagttccagtgggagagagaaggtaatatttattttccttggtcatttatacctcaattatattttggtaatggtcagttagtcacttggtcacaattatagtttgcatacttcccctcaataatagtaccctttgacaaattcattgcacaatttccaggctaggaagttctatgaatccgccattcgtcttgaacctggatttctgggagctgcattggctttggctgatctgcatgtcgctgaaggacgaaataaggatgcagtattgctgcttgaaagatatctaagacagtggacagatgattctctacacatcaagttggctcaagtttttgcagcaacgaatatgctttctgatgcactttcccactaccaatctgctctaaggtgcgacttttctcttggagttgaactgtcaaatagcatcattgttgcaatagcgtgtttcctcttttgttattgacctgaaacccaaagagtacttgagacactcaacacacaagtagtcaatatataatgcattgatatactggatataactaaagtatgtgggtaagattgtaatgctggttcctggactatgtagcagttaagttttgtgctgaatccgataactgggttggacggggtgaactgaattatctgtatgatacaaatttttttggagacactactgtttcagctggtggaattcgtttttttataacctttggctactacttatccatgtgccaacataactatttcatgttctagttgaaaaagtttccacccgtgatgcaggataaacccacataatgaggccgcaaagaaaggattggaacgcttagagaagcaaatgaaggttcgtgttccatatgtaaccatctatcatggagcctacccagctctcacatccagaacaagaaaaaaaatgactctgattttccatatgcagggagtagacccggacgcgcctgaagaggacgaagagaacgaagctgacgatgtcgacggtgatcaagacgacgctgaactactgtagaaaaaacctgatcaactcacatcaacccaaggcaccacctcttaccaagcgtcaactgcgaaagaggaccaaatctgcagccgctgccacagcaggagagcccctcaattgccatatatcaactagcaacttggaaggcacggcaactggaagacgagtgacgacgacgggtgcctctcccttaccgcgagtaagttttcttgctaacgcgaaacctcgtcgtagagttgcaatgctcaccgtaggtttatttttctaatgctggggaaatgtgaactgaacttgttggtttcaagtcaaactttattactacctctgtcctaacatatagcaacttagtacccaacagtccaaattcctggtatctaggatgtctcatttgatattagggtgctatattttgagacggggtagtagttaatttgctctccatgtattattgttttttacattattgtgttatatatcatggcgacaaaaaaggggctgcaagtcgtacaacctgtgcagtgatcagatacgtacggtatgtataagtacggcgattctaccacgcacagtggtacatacgtatacgtacactagccagcagctggagctggctggcttctctactacactggcatgcagcttggtgtggcaggctacacccagagcgcgccggcgtcgcggaggagcgggacaaggccgccggcgacgtggagcgacatgacccggtcggtggagccgacgagcctgccgccgatgaacactgtcggcaccacgacgccgcggccgcggccaccgccgttggcggcggtgccggcgagcaacatcccggcgagcgcgttctccatgtcggcgccggcgggctcctcgtcgagctccaccacgcgggcgtcgacgccgagctcccggagcaggcgcgtcacggcgtgggacatgccgcacgagctcttgctgaacaccaccaccgccttctgcgacgccagccttgtcaccctgtccatctctatatatgcaaatgtctatgtgcctagtgtcttcttccccgtctccggcgactacgacctggccgcggaatgcgccgggatctttggctggatggatgtcaccggcggtgatcgcccgatcgatcgaggttgtgtcacttgttagtgatgctgatctgctggttgtgcttgcatttgagaggttagggaaggcatgcttatatagtgttcttatgcatgttggcgaaatggtatatcgcgcgtgcaaatgctgggtgaagatggagttaaagaatcttcagaggaataattaaaggcgatcgatcgatttatgcatttctgcgggttttttttttcttctctctctctcttttggttttgggataatgcttggcaccatttctgggttgtgaaaaagagagctgatagataggttggtaaggaatatggaacattttggcggcgacggaaacgatttgcggcgtttttttttgcacaaaaggtggtgcactttttaaaaggcttgatacaccgaataaattatgttatgcaccatgttcgtgctgcgaaggatcacttcttcgattatgatttctttcttttatccggtaaggatgatcagcaatccactagactgtcgatacgtaacaatgtaactcggtactatgtatgatgtttgggagtgaattaacacacgatcagagataaccaatgtgaatactggctgtcagattaacttaatccatggtctacacatgccgacatgcgtatacgtaaagagacctgcaagttatgatgatcttaggagtcaaagaagatcagcaattaaattagtttatcctatgttctgataaacttgtttcatttgagacaatacagagcagccaaactgacaaaatcttgctttgctacgtacaacaaaagctacttctgcaggtatatcactgaagctacaacaaaggctaaagagcatccttggacatttgtgaggctattaaactctggatccgggatagggactgatccaatcagacatctgatgcaaagggacaaagaaatactaggaaactaatacattttgtacttcatgtcagctatacttgacaattcagtaatttcagtcagtactgtggtacctggattatcaaattgtcacagaacttactcttatcttttactttcacattcagaccacatcattccttagagttatcgtcagctcaagaacaatgttctcaagtctgaaccacagctagtgataattacagacaatttcagtttctgccgtattaacccagaatcaacctctcgaagggtcagatcagcaatcaggggagccagattccacacagaatccctcaagaacaacaatggccattaaccacttgatcagtgctgctctatccaataacttaaagcgaatctccaaaagcagcagaggcttctcttctccccactagttttctcaccagatatggacagcaagcgatgccgcgatccgagatcgcttttgccatcggtaaatctttcaaaacagaccaggatgatggaatttcatatggataaggagcatctggtctgatatagggtagggattccaggtagagtgtggtctcaggagatcccatgccacactgtatgtggcagattgtgggaaacatggaaccttgggcagttgcagcaatgatatttataatgaaaggaatggaatggattctgcaagtggaagatcaaccatgcatattgtatttgacagattagggaatttcttctgtgaggataatctttatcttccaaactgtgacaaaaagcattcagtgttgtacaacagtacggtataaagaaccttgatgtggacaacataattcttagagaagtttactggaattgaagcatggaacctgcgaattatagagcaatggcgatggcaaaacgagtattgttcagggaaaaaaaatcagagatcattgggtaaatgatgagttaatcaattgttttaaatttttgtaggagacaagttatgatttcatacaacatcacacaatgaaacatagcttctgtggtctat

SEQ ID NO: 44488 - DNA, 8864 bp, Oryza sativa
caatgctggacagtataacaataaggaacagagatgcaaacaatcatatgaattctattgtaagtttataaccaacccaacgcatgtagatctgttgctaccagaaattaagttaaaaagtagtactgtaaaggaaattagagtacccacattcttctccactggtgttgacctggactaagactttaaggggttttcttcccaagtcagctaccacacgatcaaggcgattggcaatctgaaaaagcaaacattgcatttatcttgttacagttgcaagattgcgaaactgatctgacaaccaattattcttccctaacttatgagtgatgcaactgaagtcatgctatacaaaatatgaaataatatcaagttctactacaacattgatatgcaatcattaaggcatactatttttttgttatgttactttcattgaacctgtaagtgatacctaattatccgaaaataagtatgttgagttgatgattgatcagataaatatggtgtatcttatagcgttagtatttcaaagcaaaaagtaatcacacgaagaaatattaatttgatgtttaccttctgatcatcaacactctcgaccatgtcaagatttggtacaccagctgtaggtcaaaacacaagaagataaaacttagttgaattttaaacctggaaaaaaaacttcaaatacctaatattcaaacaaaattgatagcttcattgataaagaatgagtctaacgttccatgaaaccagaacaagaatgtaattcagtgctttacatttaggaacatacagaaggcccacataatagtcaattgcacagttaactattcaacaaactgagtaattgagagtagataactctggctgctagaataaaagaacaagaaagcatatattgaacggccgacaaaattggcagtaagaaactaaagccatgttttagagatagccatggctaaccagtgaaagagagggaaaaaaaaagttcaagcacatcgtcttaattacaagtaccaacctaggagggctctggccttgttgctttgaaggttcccgatgaaatgccactcaatatcctctggaagctgcaaaacagacaatacttgctcagttgccaaagtttgaatatgtttgaggtcatttaattcaagaaaaacatccaagaagaactccaagtgaatataaaagaggaagaaaaggaataatgcttcactaagtggagtgcttgttacatatgaacacagaacacggtgagaggaataatcagtgaattccttgacatttatctttattttcatgaatcatgattcactacaggttcaaaatcaaacaatacttatgtatacattaccatgagaagagaaaccatgaatgagaatatctcaaaataatctacagataaggtttagtgatgtacatgattcacatgatgtgaggccaatccaaacaaaattatcaccacacaaaaccaacacatcctctcttcaaagtacaactgattgtaagccaaactctttggaactaatcatagtgcaacggcagagcgcctacagcttccaatcagttgacaacacggggatccctctgctctttacccagaatcgaactgtttgctatggaattgctgtgaaaaacctatgaaactcagtgttccaaatggagctataatgttcgaggatcaagattctactacaaagccgctttccagttcatttactaacaagctaacatgatcgatgattctattctaatcgacgaagcagtaaagcttacacacaaaattaacgcgctgcgaaggattgattacgaaattaactacttgctgatttttattacgggaaaatgcatgacgatgctaaattgctcactaccgtatatctatgagacctcaggagtgagttggatcaacaattttctctcaatcgcaatcgataaattcacaatcacacagccagcgagaaaagataaaagggcgagagctccgcgaggaaagctaagtagggcgagggaaacctgggaggccttgtcgatgagctcctggacgtagttctccccgaagcagcggtggccggcgtcgtacacgccgcggatgacgcccaccggcttcgtcttgctcaccgccaccacgcgcacggactccggcgcccgccccgaccgcgccgccgcctgctgcgcgcgggacagcaccgaccggagcgccgccgccgcgccctccgccgcggcaaccgacgccatcgcccccgacccctctccctcctcctccgccgtggccgccgtctccgccgccgccgctggtgttcggtggatagtccgccgcctccgcttcggatggagagatcctttcaccttaattcacatgagttttgagtcactgacatgtgggcctggtatggacctacatgtcagtgactctaggtggtgtttggatccagggactctaactttagtccctctatttagacactaatttagagtattaaatatagactacttacaaaactaattacataaatgaaagctaattcgcgtgacaaattttttaagtctaattaatccataattagagaatgtttactgtagcatcacataggctaatcatgtattaattaggctcaatagatacgtatcgcgaattagtccaagattatgtatgggttttattaatagtctacgtttaatatttataattaatttccaaacatccgatgtgatagagacttagaagttttagtcccgtcctagtttttcttttcgcttcttctcgaacttctcgagtttatcttttcttttttttagaaaacaagagagaatcgtgtggagggagaaaaatatacagaggtgcgggaacactctggaccgtgcgatatgaagtgaacggataagattgatcccccaccatgcgaaaaacaaatgtaaaaagaaaaaaaaaatccccttcggcgccaagctgagctgacacctccaagtccaaccaactcgtctccgacccaacggcaacgttttttttttttaaaaaatagactttttatgctttaattttattaatagacattttcaaaaaatattttcgaaaactgaacttttgcgtggcagcattgtcctgccacgccaacaatggtgacatgataaaagttatttggccacgctagacgaacagacgtggctaaaagtttcagattttaaaatacttttggaaatggtatattaataaaattaaaatataaaaactctaaacaaaatttcacggcaatgggaatcattttgaaacaaatcaaactgaaaatccactcctcaatcttaaatttttccttagtataataggctaattaggtccaactacataggaacttcttcgagctaaagccaaacggtttggcttggtcccgtgggaacaatgtcgacttgcaccactcctcttccctagggccgctctggcgagcaaaggaagcggcaacgatggaggggatccggtgatgggacgacaacaaaagcggaggaggaacacgtcctatgccttagtgcatccatcgattatggcaaacttagggtgcgttcgttccatggacaatgagtgagatagcacatcgttttccgcgcgcacgcttcccaaactattaaatggtgtgttttttgcaaaaaatttctataggaaagttgctttaaaaaatcatattaatccattcttacaatttgaaatagttaatactcaattaatcacatgctaatggcttacctcgttttgcgtatcttcccaatcttctcaatcccctattcctcaaactcacccttagagaacatggggataatggaacgtgctatgaattgaagctcgggttattggataaaggaggaaggtcgatggcgagttacgagtggagatatcggctgacttgaggtgtgacaacatgttcccagcatggggaatccattttcgacgttgtggaaagtggatgagaactatgtgatggctagtgcagctaaagtgcagttgggagtagaggcatgccttaatggtggactccacaatggtggagatgaagggaaaagggagggaaaccctagcttcggcgacacgaggaatcgacaagagattgtatgtagcgatagaaggatgagatgtcttgaccctccggattggctaatgccgatcaagaaccaaactagaaaagctatccactgcgtgacggagaaaaatatagatttatacctaattaaaaaatacatgtaaacatagagatttagtgatgctaacaagagcttgtgtgttgcaatggaaaacaaatgattttgtagcttattaagttaatcctatcttactataaaattacagcccactagtataaagctcgacatacaaatataccacctcaatggtggagatagggcccggccagcgcgggcaagtgcccaggctccaccactatgcagcagtttatcagcacttagttacaatgtttagtcaccagctaatcagcatacaatttataggtaatgccctcttgcacgtgaatcttcttgttgattaccatgcttaactaaatgcctgttactttcagataattaattcaatttcacaccatcacaattatgatctaaagataaaattatataactttctggtatcagtcttatttttttttcaataagatagtacaaactccatactctagcctatatagccatcatctcattgatatattctcataggatttcctctcctaaattagaactcgatgaccgtcaattttacatacgtatatgataaaaggtatacatatttgaattgatttatgtatatttgtttttcgctgttagacttgcccaagctcaaaagtattcctggatccgccactgtgccactcatcatccactagcaataattacactgaaaaacttatgtaagcatgcaacatcatctataattcattgaattctataaattaacatacaatcatctttctttatattgttttttataatgtttctaacatcctccggacaacataaacttcttttattttttaagtagatagtagatagaagtagaactgtagaagtagatagatagatagtataaaagagaagagaagagaagagaagagatagagataggctgtgtttaattctcttcaaactttcaacttttccgttacatccaacgtttgaacatatacatgaaacattaaatgtgaataaaaaaatcaattgcacagtttgtatataaattgcgagacgaatcttttgagcctaattatgccatgatttgataatgttgtgctacagtaaacatttactaatgacatattaattagacttaatagatttatctcgcagtttataggtgaaatatgtaatttgttttattattagtctatatttaatactttaaatgtatgtccgtatacgttaatttttttttcgccaaaacaactcaacacggtcatagagatatagaaaaggtcgtgttggatttaggcatgatttggttcggacttgttgattgggaggaggcttgttagattccacccttctttttttcttgggggtaagaagaggaccttcactgttggttccctccatggtgtctcccacgaaaaagaagagatgtttaggcaaagggatggacggtggcgccggcgatggcggctggtccaccctgagctacgacgccgacgtgctccacatccaccaggtttgcgcccattggcgcgcctccacggcccccttggctgccgcccggccatggatcgtggccggccacgagacgtcgcgcattgtcagcgccatcggcgaggactactccttctggctcccccatggcggcggccagaggatcatcccctgcttcggcgacgcgccgccggcggggctcccgtactgctgcggcacgccgcgcgggtggctcgccctggcggacgcgccgcgctccccgacgcggctcgtcctctgggagcccgtctccagggcggagatcgcgatgcccccgctgccccgcgcggggttcgccccgcagatcttcctctccggcgaccccctcgccgccgcggcctcgccggggtggatggcgatcgccagccagcccttcagcgtcgcgggcaagtggcagacgctcttcttctggcgccccggcgacgccgcctggacgccgcagcgcgagccgccgatggacaggatcgacagcgcggcgttccacggcggcttcttctacctcaccgtcaggtactggtacctctacgcgtacgacctccgccacgacgccggcgcgccatggccaccgccgcgcgtccgctccaccttcgtctacctcgacgccgaccgcgcgtgcgagctgtccaggcaaggccgcagcctgcgcgccgcgcacgtggtcgccgccgccgacggcgtcgacctgctgctcgccgtgctctactgggaatgccaccgccggagtgtacagatggtcgccaaggtgttcaggatggagtgggcggcggcggcggcggacctcgagctctcgccggtgacggacctcggcgagcacgcgctcttgctgggccgcggcgacgcgctcgcgctctccgctgcggagttccccgcgatcaggaggaactgtgtctacttcgtcgagcacgacaatgccccgcatcggcattgggctatcgccatggatttaggggcaaatgcttcggagctgattccgcatccacaatttcaggaagatgagccaagcgaagaagatggcaaatgcgccgccgatcgctccttgttgccgtattcctggttttgcctcaaacaacccttcttcaagcataagtgacatggccttcgccatcaataattgacatcattgactttactgtatacttcctctgtttcacaatataagactttttagcattactcacattcatataagactttttagcattactcacattcatatagatgttaataaatctagacatatgtgtgtgactagattcattaacatctatatgaatgtgggcaatgttagaaagtcttacattatgaaacggagggagtaaatttgatctattatggcaagtacaaaggtagagaccgatatggtctctacgttaattagaggctatcacgttacaatagttaagacaatacggtctctaatcattaatgtaccaaaatactttcttactagtcatctttcctttattagactcaatgcaataaaaaatttcctaataaatgctaagagtcgactctatgctgttgtcatgtgtagcaaccatctttctcttttcttttctctctctcttccacatcaccaaatatgcttgcatgacaataaagagagaccgctaataaagaccattgtacatgcccttagtttcatcaaggattctagtgattaggaaactatggaagggagatttttcccttctatgggaatttgttcccaagtagagttgtagagggaccaagcttaagagtgttttgccagtttgccggtttggtggtttgggagaatgcgaaagaatcagcatcttactcctgacaattcaatttgcatctgtaagtacaaaccaaagcttgtgacataatttaatttgaaaccggattaattcaagtgacatgacctttaccatcaataattgacatcatcgactttactgtgtaaaatttgatctgatagtttcatcacggattctggtgattaggaatctaaggaagggagatttttcccttccatatgggaatttgttcccaagtagagttgtagagggactgagagtgtgtccctagctagcttaagagttaagagtgctttgccggtttgccagtttgggagaatgcggaagcatcagcatctactcctgccaatttcaatttccatgggtaagtagaaaccaaagcttgtgatataatttattgtgaaatcggattaattcaagcgagtgccctttcctttgatgtggttattttctcttttagtttctctactgtgtggtgagcctacaacatctcatgtttcattggtccggtgatggtgtcgtatactaactgaaacaaatttatatttgctagtattgtcatcctctgtgttaaagaaaagaaataaaggcatttttattcaatttttgtgttactatcctgattcctgacacaagattgcatcgttgcgtagagctatcccagcaatatatcctttgtaaacacagtgagcaaagtgaattctttagtcttcaaatgaagtttgatttcccttggtcttctttttttgttgaaagaaaagagtatatatttgaaattttgtactttcagtgccttgtagaagaaatttgcagaacttgtccttgcttatgtttcagtcgttctaggagtccaagttttcccaagatcagttacattacaggggtttgagagcacagaagccctttgcttagtctggacatcagtttcaagtctttgggcactgtgataggatatggtgaagagatgatacattatgttggctgggagaaattccatagcaacaaatgagatagggatattgttcaatgagctgtatgattatatttcatctcaattgattttccattctaatgagtgaactaagagccgaagacttttctcgatttttcatcaatgcatccaaagaggaatcaaggtcctcataaggttaagtttttttgtcaacaagcagggtggctcaggaagcaatggattctctccctcagaatctcagatgttaaagcggtgtgagtaaggcgggtaagttcgctgacttgttcgttatgtctgattgcttaatgctgttctaagttgaccgctctgcctattttatgtgaccatgtagatgtgagaataatcttcagtagtggtgaggcccttgtgca

SEQ ID NO: 44489 - DNA, 892 bp, Oryza sativa
caataatccagagaaacaaatagctcgcagcttattctatttcaacttattataatacagcttagagtaatctgatttaataatctagtttataataattttaagctgaaacaaacaaaaccttagttttttttttctcatttggagtttatacatttcctttccttggcaaaacaaggtttctgaaacataaagcaaagtgatcaattaagcatggtttcttaattatatcgaaatttgatggtgcaatgaaggttgacactcttagttccacttactatgaccactcaattattttcagctacattatcactacaatatatacatcaggacatccaaattaatttttttttgtccaatacaaaaaaggctccagcttataaatataagtccctggatggatggctacaatgtgagaatatttgtagcaaatgctgcttaattaacacaattaagcactccattaattaactcagtaattaattaactaattaatcaactaatcgatccccctctcacatgacgctgcatgcgttggcgttctcctcgctgaacatgtagtacgacgacgccggcggcggcgccgccgccgccgtcgagtagaggtagccgccaccgccgccgccgccgaaaccgccggccatcgggtagtagtaggcgctgctccggagcgggtgcgccgtgctgtagctcatgacgtacggcggcatgtgcccgccgccgccgccgccgtagtaggacgccgggtagctcatcggcgtcgccggcgggtagaagacgccgccgtcgacgacggcgagaggacccgcgttgccgggggacggtttcgtcggcgcgtcctgcgggcttgcctccactactgcaccggcgccgtctccggtggcattggcgg

SEQ ID NO: 44490 - DNA, 14258 bp, Oryza sativa
cagtacatatttgtttcaaatcagtataaatttcactggtttttttaatataaatttgctcaaaaagcattgtgctaacatttcgattcagataatgtaagcattgtatgaccattatgttgcagctaaatttgagacagggagcagagttttgtggtgagtttcagagtatggttgtaataggaaacaggggatgaacataaaagaaattaattttctgaagataaacagtgcaggtctgcaggattgcaaataaaatgatatccttgatgagattcttcttccgtacatgtatcattagcttgatagtaaccgaactgtttgaaatttaataggagtactgtccatgggtaaaagtaaacatgcaaaaataattgtaagaactgaaacacttctctataataggaacatcaggagctatatatgcttatcaaggagcataaatgaaagttttgaaggtgtaattttctcacttcagttctgtgatttcctcacttcaaaaaaaaaagagagagagaggaatctttcatgattttttttttgttgctacaactctaaaatagagaacatttttttgacgatcaacaaaaaaaatgcagttgtatgaagtcattctcttatgtccttcaaaatgttctgataagatgtggtaataactaaaagatttcttcaaagttgtgttttgtttttactccatctataccttctatgctatgtagcaccttcttgaccttcttcttgcagccctcacagtggatgctaaccttcaaagccaaagtctggaggagaaaaaaaggaggaaaaagagcacaaaccaaagacaaaaagaacaccatcagcatcttcctacaagcagaagaatgaccagtagctctgcatatctgccaacaagattgcaagaaccctaaactgcttacctgatacttgagtggctctggaccttcttcagcagctgccatggctggagacagagagagaaagagaagtctgagagagatgatgacagaagtgaggagaagagagaatataatgttgtgctagtgtctagtattggtgcaagtatttgagggagtgaaaggggtcaccaagaagagagagagagagagagagagagagagagagagagagagagagagagagaggggggggcagaacaaagtggcaatgtttggccctgaggagggacatgactaaatagcatcagagagcaaaagggaacaattctattggttttcttttgtattcttttctttttctctttttgttttttgggaggagggaatggtattgatgaggtatttattccccacatctccagatgcccaagaaaatgcattcacaacaataactagccttttatcttctcactctcctggttttgtttgaatgttcaaggtactcgcattttcttttttgcgaccctgtttggaacgcatgaattttcgcaggaaacagttctcaattcatgtgtttcaaatagatctgaaggacacatcttactccaaccggtcgtaaatatttgatgcttagcaaaagattcaatcaaccttttaaaattctgaccatcaatagtttctcaaatatgcttagtttgaaaacaaaagaaatgatttatgtagatttacctcgaaaagtactatttaaatatcataaatttattctaatataaaattaatggtcggaattctaaaatatatatgatcagagggaaactatgagtacacagctacatgcagcgaccattttatctattgtctaaaaatgtattccctccggattgataatacttgtcgttatagataaggacacaatctccaaaaagtaactttaacaactattgtctattataatttatatagaaatattaacaaatatatgattttgttgaagtactttttaagactaatctatacatatggttttcatatttctaagataaatattttaaatatttatagttaaaaattctaaagtttgcttcacccttgtccaaaacgactaatattatcagtccgaagggagtaatcaaacggaatttctacatgcttttcatcgagaaaaagcacagaagatgtatatgcatgggggttgcacttgcaacccagcagcatcacatgcaaagtccataatttgccacacctacatgagaaaaaaggggatgtactatgaactgctatcgcctcgggaattgagggcaatgataagacagacagcagaggaaggccctcccctgtcttctatgctagtactccactccagtatgcaaacctggaagagaatcatattcatcaccttcacatcctcctgctatctatacggatatgcaattatgcacaaaccatgtcagtgaatgattctctcaagatagctgatgtaaacaagcgcgcaaacacacacatttctttgcattgtgaagattcttttttcttacctgctgaagcatggctcgttccagtggattggatgcatcctagagctcttcagattgtgcctgaatgttgatgacaaactgaatttttctctctgtcaagaagatccatacaatgagttttatgaccataatactcaatcttcagaatgcagctgagaggtgatgaactgttcaaagctcacttttgcagttctgaagaatcagaagttcagaacccaatcgtcaagagtgtgcctgaatgttcaaggcacactgagcttttctctgtttttttttcaggaagatccatacaaaccatacacattgtgaccatgacactcaatcttcaggttgcagctgagatctgatgctgctctgcaaattccaactagatgtgatgcaaaaccatctaccttgcaattctgaagaatcagaaagttcagagtccccaatgctcaatgacaccatcatccccgccgggatttcagcaatgccatgaagcaccggagtttcctatccaagaacggcggtgtctaccttgtctgctcctccggccggaccggagctgccgccgccgccgccgccggctgatcgccaccagcgggagcggcggcggctttgcctctccctgcacctccgaaacgccggagttgggatcgatacgaagcacatagcggaggcgccgcagagaacggcaggccacctcgccgcagctgagcggcggccgcccttctccggcggcggcggcgccgtctacggcggagacgacgtggcacgtcgtccaccgtccgatcaggcgcctacggcccagatgaatccgcgagatccctcgagggcaccctgagccactgacagcgtgggcccacatgtcagcgacagaatcgcggggtttcttcctccttttccctcgcgcgattcgaaaccaaaaacgaaaccctcgccgccggggccatcccaatcctcgcggcgagcggcggcggcggcggcggcggcggagggcaaccgattgtggccggtctatcctcgtcggctcgccattccttctcgccgcgccaggttcgatctgaccaattccccaagaatcgttcgacctgaatcgatcgacgccgcgtgttcctgccatttcggcgtgcttgattccctcaaaatggttttggtctagggatcgtgcttagctattggtggcggtgctcctctagcggcgggttctcgacggcagaatagtgcgttgtgagggagcctcggtttagttggttctggggatggaggacggcgccgcggggggcgatgtgtccgccgaccgtgtcatcgctgagttgctcgacatggggttcgagttcgacgagatcagccgagcgatcggtgcagtcggcacgcgctgcgccgatgtgctggagtttatgctgggtggttcaggcaatgggaaaatgaaaaaggcgagtagggaaacacgaagccgtagttgtgtctcatctaatgcagaagcacgcccgagtgatgatgggaacaaattggttaatcctaggaaaagattaaagcaatcgagcattaccgatcatcttgcatcgaataccggctgcagaaggggatcttgtggtgagaaagctagcacgtcatatccctgtttagcggcttccgatgatcctagagcgccagtggcagtcagtgctgatgtgtgttctgcattgaagcctgaatctcaatttttgcttgctaattcaagaagtgagtctgacctcggacacaaaattagtgctgttctgcggaaacactttggattttcctgtgtgaaaggattccaaaaggaagctttggatgcttggtttgctcacaaggattctcttgttctagcagcaacaggctcaggtattctttaaataaatgctttgctctttatctttttgagtaatttgggggcttcctccattgttatgcaactagcagttttgatgtgatggttgagtggctgtgttgccaggaaaatccctttgttttcagatcccggctcttctgactgcaaaggttgtggtagtgatttcaccattgattagtctaatgcacgatcaatgtctaaaacttgcaaagcatgggatatctgcatgctttcttggttcagggcaacctgatagccgtgttgagggcaaagcaatgtctggcatgtataagattatttatgtttgccctgagacagtattaaggtaatcactctgcttttggactgatgatttcctaattacgtattgctgcacttattttgggaacttatttacatgtaggcttatggaaccattgaagaaacttgcagaaaagccagggattgcactttttgctatcgatgaggttcactgtgtttctaaatggggtcatgattttcgaccggactataggtctgctcttgtgttcgatatcctctactgaaggtgcatgtcattgtttacattgttttttctaccacaattagtaaatttatatgtgcaagccttcactgagatgtttttctcttggtactaaaaaactaacatgtgtctgccatactttttaggagaatgccttatattttcttgcagcatcttaaatctctactttattttccacatacaggagattatctgtgcttcgagaaaatttcagtgcaagcaaattgaagttcttggagcatgatattcctttgatggcattgactgctactgctaccatccccgtaagagcagacattatcaagtcgctgaaaatgtcagaagatacagtggtcgtcttgacatcttttttccggcctaatctcagattcagagtaagtcaaacttgaaacttctgaatttgttctgctggtttccatttttatgttctttctagaggatgtgtaaaagcaagtagagaacattacattataatatgctacattaaattgtaaaaagtttaaattatttggcctttctaacagtttagctacatgtaattatgttgaatgaccaatattttattacattttgtaaatagatgcctccttgcaagtagatgggcacctggggtgtgcatttcacttaaaagatgtactacatcaaagatatgaatggttagctttgctagaattgaatctgtattttggactagtatatcatgtgaatttgaaataatcttgtccggggctacacaaacaagtttccaaactgctctattttgttattgcctgatgaattgccttactaaaaattcatagttagatataatttgagaagttttatagaactacctactgtttatcttatgccactgtattaaactgggcttcttagttcttaccctctcccctccccctccctcatgtttctggttgcaggtaaagcacagtaggacctcagtctcagcttacaaaaaggacttcagagaacttgtagtaacatataatgattcaaggaattttagggggaagggacagaaagctcttagtgagatcaaccctgattctgaaagcagttcatatgagtctccggatgatgctatgtcagatgatgaagatgcaaatgttgattccatgagccatgaagataatagttttggaaaaactaaagtcggcatgcccttgataaatgaaaatgctgaaaatgagttggatgtatatccaggagtagatgattttgatggtaatggactattttatatgacttttttcttttgagtggaaattatctgcttgatcctgaaaagaaatactggttacattattttcgaacataaatgtttcacggccaatgcttatgtaaaaaattatcattcttttggggatttaagatcctttgatggaaatcatatgtaagcttaatatggctattggaaattttggaggatatgtggtagcagtgcttttaatttcgtcattttgtaatttcatgtatgtatctgattgacatgcttctcttgtagttacatgcggagagttccttgagtgctcgtggcctgagaactctgcatcttcttctcaatgcaacaaaactggttccagttcctcagaaattgctgatcaaggtcctaccattatttacgtacccaccaggaaacaaactgtggagttagcaaactatttgtgcaaaactggtctcaaagctgcagcatataatgcgaaggtaaatcttctttgattgatttgtgtggcaaatgatacttgatcagtagggcccatttcctgatatatgctaattctctagaagcaatcagcttttttgtaacttacagtacatttgattatatttatttcttaattgctattcacagtcctgtaacttgttttgagctatttgactcttttttcagatgcctaaatcacatttgagacaggtgcatcaacagtttcattgcaatgccttggaggtaataattacttgtttcacttcctagcttatatcttgccactgctaggtgcaatttccatgtgctcatatgatggtatacaaatttagtttgagaaaacagtatgcatgaaaaagtgataatgttagagcaagttacttctctgtagaggcagtcagatgtacttccacagtaacatatttttgtctaggagatcttgaaaatcttgatgtctggtgttgtactgttccatggttacacaagcttacaggttaaccagtgtatttgagttttgagacacttaaaagtttttcaacaatccaacaaggaaactttccacatttctatttgttaatatgatacaatcttggatggatgactgctatggtgactgattttttagaagaatgttgtagaacaaattcattgtgtaccattcaaattcttggttgtaaaagttctctatattttcttcatatctccgtctctttgtgaacccttcaagcctttatcccaactctaatggccttatcctctttatataggttgtggtggctaccatagcatttggcatgggaattgacaaatcaaatgtcaggagaattattcactatggtttcccacaggttggtttaacctttagtgcttcattcacgaaaatacatagaagcctctctaatgctgccaaagacttgctctgactctgatgatggcagacagatttccacacttgaacctgtaggatgccaagctagaatgtaacagtgatggcaattgaaggagatactgtgtgcagtatgaaaattgtaggagttgattatacattttccttcttcttgttgaatggtggagacaatattcaaaaggcttagtgttgggttgcattactgatctgcaacatgcagaaacaatatggcttttgttctctaagaatccagatacatcccaaattggattaatttatgtttatgcttcttttccgtgagttttactggtcagaacttgattgatgcagagtttggaagcatattatcaagaagctggccgtgctggtagagatgggaagttggcggattgcagtgagttgttatactccatagctcatacttgctataattaggaagcttcaattattttcttactacatccaaaagtaagccacgttgtttcgtattataagaaaataacaacttgcagacaagcataatgttacaagtaaaaacttcaattattttcctactacatccaaaagcttcagttataagaaaataacaacttacatccaaaaggcttcgcatgccttatttttattaggaagctgaccgtgctgttagtttagagttttgctgacatcttatcacccatctattccttttcacgctaaaaatctcctgttgttgtcttcttattcaaagtcatcttacaaaccaaaggttgtattaatgttagtattaatgcactacttttatgaataattattaggccttgctttaattttccattcaacgtgtcacttgtttttattttgagatttctatacattttacatgcagctctatattgtaaccttttgagagcaccgacactccttcctaataaaagaagcaaggaacagacaaaagtagcatacagaatgctacgtgattgctttcagtatgtatcgtaaccatatgttcaaattctggtaatgtcgtaatatgtatatttgctaaaatgtttggcaactaaacttgattaatgtttatttatattttctatgttgcagttatgctttgaacacttcaatttgtagagccaaaatattagtaaagtacttcggggaggaatttggtcctgatggatgccgcatgtacttttctctaatttctccatgtctcctctcctttaatgaaataatacatgctcattccagtttcatgtgatgcgaatttcttaatggtatgacagtagtatcacaaatatttaaaagatgttctgtaatattgacatgaggggctgtgggctcacacgttactgcaaaaaatattggtcgttgtggaacttgcatttttaacggctctatttcaaatttatctcatcaagcattttatgagtctaactgacttgtcacctcaggtgtgacatctgtattaatggccctcctcaaatgcatgatttcaaggaagacgcagttatgtttatgagtgtgctccaagctcaaaacgtgagtttataattataaattaccctaaattgtgctgaactgtgatggatgtgatgcccattacaagttgaagtatttttttttctttacaaccttagttatgtgactttgattggtcattttattttgttgcatcctcaagcatatcttaataaatccagggacaagcaacggaagatatgggttgcagcaatataccccgttatatatctggaaggcaaaggtttggggaggttccgaatttcagaggggtggtcagttatataagggaaaaggtttgtgttctcgtgtatttcccatctcctatttatgaaatcgggagcaataagcagggaatttgccttaaggatgcaaaatagattaataaaggttgcatgataggctgatagcaacacaagtatttgaagtatcttttgctcgaccatagctgctgagtagcaatgctaaacctcaaatctgttgtcttgattaaatattgtttatagtttcctagatttgccacaactgacaaggtatggtgggaaggccttgctcgcatattagaaggcaggggatacatacaagaagctgctgaaattgtaagtgatttacttcagtagtttgttgcagatttatagttctttttgttgtgaagctcgtgatgtacctcacacctcagtttatattgttcagatagttgaatgatgggcatactgagatccaagtagggatagtgaatatttctctgacatgagttggacatatgtaatgttaaataatttccttgattaattaagtgaaaatcaattgtatccatataccattaacatgtttaaaagataacccatgaactacatgatttgctttgataaaagaaaatatagcatgcatctctagggactatttggaggattgcatcttccatcatttttctactttagttcagagattgaaatcctaaaggtagcctgttaactatcatggattattgataatcaccaaaactagcttgttactgacatcaaatggacacaaatatcaaccctgaactacattcagttttcagaaaaccaacttgcatgtgttttgttcatttgtaatggataagcccaatctagatataacggttgtatcacatggtcaacaaattcaattcatcagtggatcatctatgtgtatcacaccggtactgcattattgagtcctcattgctttattaaaaggacagataatcctgaatagagccaggacaaaatgagttgctaagaaaaaaaaactgcttatttgtttccaatattatttccgttttatcccccgactgattaatggatccgctttcagcctcgtgttttaatccagtatcctgaggtgacagaggccggactgaactttttgagtatgcaatcagaagaggaaggtttatatgaataccttaatgctgctatgctattggtaatgaatgacccaaaacctatttctacatcttccgagtggggcaggggttgggcagatcctgcgatacgccgccagcgtctagcaggcaagaaaatggggagaagaaaaggaaagaggcattctcggagccactctacaggtttcaccactgcaagacagagattagctgaaatactctcaaaacgcagaagataatacagaaactattgagatgctgggatagcgggatgaaaattattcatctaagcctgttactacttgtttggttttagcttgatttacacagcttctgtggttatttgctgcaatttcctttgtggcgtatgaattttttttctcaagggaacaatatgaagtaaaaaaatgatggggattattgtatagcactgttttggctacccatctgaacattgacactccatctgaacaagaatttcctgatgtgattttaaggaggtacagttccgttcccagatattattgcccaaggctgattcatctgaacagtgatggcatcacatcagttttcacatcaaatcccgtagggttttgtcaacaatgttcactctcacttgtgatcttttcaaccaacaggtggatctgtgtggatcctggagtgccaaactggaacttgtttttcccaatggatggtccagttaactccaagtgttaggaagatatatctgacaaggtgattgtgttgtatactgttttcatactgttcacttgcctgaaatgaaaaattgtttggcgcagagctgctaaaccctacctcgtggcagtaatgcaattttttaatcctgccgacgagtgacacgagtacgattctggcactgtggtgttttgtttttctctccttttttcgacatggcaattggcactgccacggagtatggtctcacagtgttaaagatgcatacggaatataggagtagagctttgttatagaatctaattaaactaagagtaaattatactcacggtactaggtgggtgcaatgaaaagcctgagaatgaaacagtgtaataacttgacaagtgggtgtgctctgatacaagaacttgagaatgtaacgtctaagtgcaataacctaacaagcgggtgcagttcaatataagaatttgataatttagtattttggtgcaataagttggcataggtatgtactactttgattaagagtgctatgtaagttgtttcacgatatcaatatgtcattacatagcaatgttttggatattatcattgatttaatctgcaagaattatgttcatccatttttagagtcgctcatccaattttcaccatcggttttgaattttttttttaatcttccaccatctcaacttaaaaaatttctacacaataaattttgattgacaaataagcatgcttatacaaatctgtataagtaaattaacaaaacaagtacttagaaactgaatgcgtatagccgaaaaatcttatgttattgtaccaaaattacgcgcacctttcaaattgttttacccatacgttcacttattaagttcttgtatagattgcatccgcttaacaagttgttatacatgctcatttctcaagtttttacattaaattacttccacatgctaagttgattatcgggaatgcaatttatcttgacgtggtagtgttattcttgcatgtaaagttcaaatatgaacttacatgacatatggactttgtttaaaaatagaagtctttaacactgatgtactgtactaaatttatgtgaagaaccaaaaacgtaaagcatttgcttccaccttactacacaataccagttttgatctcgaggtataaaagctttgaccaatactcctactatttttcagagtactcaattgtgaatcatgaaagtagtactcctatcatttgattcccaatcaaaagcacttcactatatccattcgtttagcattttgcttacctttcatggtcgaaatttgatccatagctctcagtcaaatacatttacacaacaattacgaccaaaacttgaattttaaaacttaatgttaaaactgattctgagatccctgcattagcttctaaaatgaaaataatacatatataaagctttattcataaattattattaaatttaaactttttggtaaaaatttatcaatataaaattttactttgttcatttttttttacccaaccaatcagacactaccacatcccctagctgcttggaagcacgttactacacggacgcggaaaaaaaaaggaaaaaaaaaggtgcatgtgcatcagcattattaaattcactgtaccctctccaaactccaaaggccatcacgcatcaccaccttacgtatatcggtaccttttatttaatcgttcccaaaaaaaaattagaaatttagaagaaagaaagtgaaaaaaaaaagctggacaagtcgatgatgttttcgtgaaggcaggcctgaaaaaggagccgggcccacagtgtcagaccaaagagaggagaaaaataaaaaaaagcaagaaacacaagcctggggcagtgacgtcacccaggggtgttttggtaattttaccgtgcaaatgatttggtcaatcggatctggacatccgggcccacctcctacctcccatcatgcactcctctccctttttattttcccctcattttttaaatcttttttaaaatggatagattgcacttggggtgtggagaaaaggggatttaaaatggagaaaaaaaagttggaaaaggagggggttaaaaaaaaggagaaaatgatgggcatcatgagatgggatgatgcattgcagagtgtactaggcctgcctctctgtagccttttgccggccaaaaaaatgggaaaagtgaggggctcccatgaaaagagcagatggcaggatgccatctaggatcatcgatctctgcctacaaaggtcatcagattctactactactccgtatgatttcataatagcatttgggttttatagggtttggatgagattcaaacttttggcatcatggtttctctggatatgatttcttggttagcatttgactaattgctctcttacatccagtgtaagatatccgatccgagctatatagtcaggctaccagatgacggattatcgtggacacacttttaaagcttatgatatgtttttttaaaaaaaactttcaccaaactgatttgggtagagttaccaccccctcacggtttgtggttatcgcgaggtatatcatggttttaaaaactgataaggttaccacacatgataaccatgcgataattgtacggtcttgcaaaccctgtcctgttattagcttaggtgctacataaatattgtaaaaaaaattgggtaggaataaatttttaaccacggtaatattatcattcaaaatataacgcggtaaattattattggagtgaagtgcacgagcggtccttaaacttgtacggatatattatctaactccctagactcttaagatgtattttttgataccaaacttgttatgggtgtcatataggccagacatgacatgccatggtgacgcctatgtgttagtgggatccacatgtcaatcgcatagaaaaagtaaaaattaaaaagagaggagagatgagaaaatatatttaaattttgaaaaaataaattaaaaagagaggagaaaatgtgcgttcttaaattttctatatgtgattgacatgtttgttccattaacacatagacgtcaagcacacaagcaagttgaagtccgtttggatctaaatgacactcaatgaaagtttaaaaacctaaaaatacattttgagagttcatcagccttagggggggcttctggaaactatagaatcagctca

SEQ ID NO: 44491 - DNA, 7017 bp, Oryza sativa
tgcttctgctgctaatgtttgatccgatttgatttggatcgggtttaatgttagattacgcggttcgatggcttaattaagcattaattagcttaatgctgggaccagtgcgtgctgcagtattttttcacggctctcgaagattttgcaaaacaccacgtacttcgagatcaccgtaaaaaaataaattatgagtaattagcaggaccagtaaatattctagttctgcccactgacatgggccaggattaattaaaagataagaatggttatgcttatcatctgatggaatactatattagaggggttaggacttaagaagtggtatattttattttatgcggagaaaaaccttcttaatttacagcagtttatatttaagatgtaaaattcattttcttaagtaagagggaaatgcaaagtgcaaagtagataaatgtgaaaagttttaatgagacttgtttttaaatatttaaaatcagtttccttaattataaatgggaaatttgcagctaacaaaaagtgttggatctttgtctagaagttatatttaagatgtcaaatctttttagtttttattgcattgttccctttatagttgcccttaaaaccattgttttcctttgcattttagaaaaaaatattgttaaaagtgtaacatagaactttttatcctaacaagtgtgcattgaaaaaaattatcactgagtacattttaaaattgacaagtacgttgggctcagagtaaatagtctaaaaaaaatcctaaaacacgatactaacccatataccgatataatctccgtaatacaatctcaatgcaagtttcctcttacattagtcaaaatatctttagatgctaactaaggtatatatatattttttaaaaaaatgatgttaaccgagattaacatttgcatccctctctctttttaccgtgaaaagttgttcgtagcagcgagagagattggtttgcaacagtaaaaaggcggcgagaataaaaacttctcgagattgggatttgagagagaatgaacgagcgagcaagcaatcaggtcaaaaaaggagaaagtaaaattcttttggttaatttgtattttaaaattttatttttgggggaggaggcaggccgttctgtgactggggcagtaaaaaggtagagaggcccatgcgcccatcacatgctgccgtggttgcccccactctgtggtgggaccaccccccaaaataaaccaggatcttctctaaacaatgggctccaatggtctctcatgtaccatgggctactatgcataaatgttggaatttataatgacatttatataatgtaattaccacttatgatggaaagaagtcatgctagttgttatcttcatgtgtgatgtgatgagctagttaaagatcatataaatggtgatgaggatccacctataatacaaaaatgatatagacatgtacgataattggaaattctatccaaagatgggaaatcaggaaaatataagcaagaatattttaagaaataaaataagaaaaatacgaattgactacaatggatcaaaacaaatcgagaaccaagagtatgtcaattagtcgaataatctttctcaaacccaaattagtttcatctcgagaggatgatgtgtttcctataccactaaatataattaattctaattctcttttttcttatgaaataatatcacctcaattgctttcatttagatcaatttatctatggtgcaaattgtccatatatctcatgagccatgcatatgcatatcatcttcattttgtctagcttttttttagcacaatcacctcaactcatttttagcattcttttctcttatgaagcgacatcgcgatatcatttatatttcaacagttggatgttctatttagatgttattgtgtaaagcatgtgaaatcaaattgtcaatgtacaaatcaattctatattgtacataatgtttacatattattatataattttccgcataaatgcgtggggtttcatttagtatgtacgatgttcaagtgaaattgtttggtttgtaacaagaaagcatgattataaatatttttggtgtcaaacaaccggacatgtgaaaatattgacaataattggatgaagataaatgttcatagagaattaacacatagatgcacttgaataaaaaagaaacttgcatgacttggtatgaaaatataggttaagaaaaggggcaccgatattgtttatggccaatacaccatatcatgattacctttattgttttttgtggataagaagtgaaaaccaacattcttttggtaagtcaaaataaagttatctatatttagctatgctacacctcgctacttttctcgtattatgccccaaatacaataatagtataacacatatgatacattagattgagaaaaacaacaatggcataaccaatttctctaaacaaataaatgacattattacaatccataatcccatataacactaagaattgagtagcaatgatcaaatatcggcatacttgctcatcaccataaacctaacctaaacacacagctcactccacaaacaatcccatcacaattggtccaagctaagaacaaagaggcacaccccttcctacccccactcctatcactattcatcccaacattttcacctcatcatgctcactccccaaaaacttacccactgaaaaaagcctttcagcacaagtaaataacactaaaaataaaaataaaaatagaataagtattgaggcaggcagagagtgatcacctccatgagatgagcaagaaaaaccaaatataaaaataaaacaaaatttttattcacaaaacaagtgagagaaagagaaagagaagaagaagaagagaagtactactagtagtagagaagtgagagcaagagagaagagaggagaagaggaggcttcaccttcccaaccaaacccaacctcgagcacaagcggagcagatgccgccgccgccgccgccgcgcgcgccgcgccgcgccgccgggtagctcagcgcaaaaaagccacagccgcccgcccgcccgatccgttgcagcatggggcgcggcggctcgcgcgcggcgtgcgccgccgcggcgccgccgtggcactcgctcccggacgaggtctgggagcacgccttctccttcctccccgccgccgcggacaggggcgccgcggcgggggcgtgcagctcgtggctccgcgccgagcgccggtcgcgccgccgcctcgccgtcgccaactgctacgccgccgcgccgcgggacgccgtcgagcggttcccgtccgtgcgcgccgccgaggtcaagggcaagccccacttcgccgacttcggcctcgtcccccccgcctggggcgccgccgcggcgccgtggatcgccgccgccgccgacgggtggccgctgctcgaggagctcagcttcaagcgcatggtcgtcaccgacgagtgcctcgagatgatcgccgcgtccttcaggaacttccaggtgctccgcctcgtctcctgcgacggcttcagcaccgcgggcctcgccgccattgctgccggttgcaggtgaggtggagagtgttgtttgggtcaaatctttttagctaaataagcatgggatctttgggttgttcttggatttgagaggaatctttcacggcccaagctttgattcgtcttctttttagctaaaacatgacagatttcttggtgccatttctttcttcacagtgttctttagtgagttcatggtctagctgaagtgatttgttcttccatgattcctatattaactttgttttgaacttcattgagtagtatgtggaagtagatgtggctttctgctaagatttgatctattcttggtgtttaatttgcaaagggacagtttttttttctgtttacttgtgtatgatctggatttacttttggtgtttcctaagttgaagaccaagaagtcttcttgtgacagtattttagatgcttataacgtgttaatgtcaaaggaatgattcccatgaaaattctgctgtgatttgtacattttattaggagttaagtaacagagtgaattgagtgatgctcacgtcttctttaaatcttagctatgatttgttcctaggaagctttgacttgtatttgagtgcctggtttgcgaagatgtgattctcttgcacggatctgtgtgattgacagaagaaatatttctacctgtttaagcaatgatggatccatctctttgtttctttttgtgctttttacccaaaagaatgggatatttcaagtttacaaacaactggtgatgcgcctttataattttgggcttttttaaaagaatgtattcttcccatcatgagttactagatctgagttgaactgttttcctttatattttcctgatatttaagtgaatttgttgagttcctatcctgatttgaacttccagattctaaagaaccaggtcttttaagcatgtttttgtcatgtagattcccagtttatcccctccccctccttttgtgctcaagaatctactaccttttatcttgcttttggtgagggaaagtgatttttgctccaatatttgtgatgtcctcatgtaatggacagttaaaacaaacagatttgttcttgcgagtatcttctggactccccccagaaaagaattaggaatgtgtgggattcctatcattggggaatttatatcctaaaccagatagaaggatctaatagtgggagtttcgatcctgattcatccattagtagtagtttaatatgccaaagcagtatcatttgcatcattttgaggaactcgaaacagttgaactgtgaagtttaactactgtacacttcaaacaggcagatagaataggttgtgagataactaaatttggttcggtgatcgtataaggccatattcttggatattaggacgaaatgagcctgagcaccacatgtgtacttgctgatggttgagaacttagcatagatactagtttttatgctagactagagggctactggtacattcacttgtttgataaatccagatgtatttaagttttgattcaaaatattttgactctagattggagactacattttagagcattcaaaatttacaatggaagcaggattttagcaaaactattttcatacatttactctgttattgagccagaatcattttttagttcttgctacttttttgttaacactgttatgcatgtaaactcagcgttacatttatttcaattacaaggatctacacttgtagctctgggtgcagatggtagttaacattgatgaatcttagctatatcgaaatactatcttctaagtacaaacttttcttgtgtgattcttatccttgttgttactgttgctacttatatccattgattgagcatgctttgaattaccttaagaatttctctctccagtcaaatttatttgactttgagagaactgtgtttatttctcccaacgtcaaatgttttgaattttgaatggacagagtatgtagtagtgggcagcacattggtgccctagctgcaaataaaaccttttttttttgttaaaacaatgattatgaggatgtcggtttacactgtccactcagaaatttgacttgattatggatagggtacaccttgttgttttagatggttccttcttaacaagatgctagattttgatgatttgattctttacaaggagtagtctaaaatactggaagtgtcaacttaaaaagttcaaacttgccctagccatacgtgatacattagacaactgatgtgctgtgttatctgcaactgacaattattgttgttgctatctcctttttttgctttagagtaggcaggtattttgtgtcaactaaaagtgtgtttcacgtgttgcctttcttaataccttttgaataatagggtataagaaaattttcatgaatggtttgctttccaattgttgatgttgctttccttcaccttattttttaaaccaccatgattaatctatttatctaggtaatattgctcatgctgattcatgatacgtggtaaaaaaataggtcttttcaactttcagaggctgctggactccatttatttagttgattttgatccctacaccgattttatccattggtttatattcactgctaacatatgatactcgctatcatttacttcactgttgatcatcaatgttttaattttgaccattattaacttttatatgattaatttagtattaatgaaagttgtgcggttgtatttatggcatgacacacatttctaacatggcatacttttaagcatacataactttttttgtaaaaaggacaagcgatcaaaggtaaaaaggtgaatagcatacagtgagaagtatttgagaccaaagggagtataatcattatctactaaacaaatacaataccattcattataagctgagttcgcatagtgtaattgaaagtggggaatgctagtatagctcacacatgaaatcaagtccctgtgaaatgatagtaaaccctacgtgttcattgttttagtcttatgatatgttccagttatgtttgccatggttgttgaatgcagtagtcaaagtttgcttctgtttgtttgagtggattctcatttaccttgccttttccaccatatactcatatgggctttgtttcacaagtgataacattggttaatggctatatgctatccttacagtttcattcttcttttaagatatgagtcaccatgcacatttcttcaacttctgattttgtctaatattgcagacacctaagagaacttgacctgcaagagaacgctctttttaaactagcatagaaatcatgcatgcaagctttttctttttttaaaaaaaaacacattacaatacagatactccctccgtccaaaaaaaaaaagacaaaccccaggtttccgtgtccaactttgactgtccgtcttatataaagggctgcaggaa

SEQ ID NO: 44492 - DNA, 15153 bp, Oryza sativa
  unsure (1)..(15153): unsure at all n locations
tttcttctaaaagttaagctgcaatttttcaggtgatggacctcattgaggatcatggtttagctgttgtggcatcatcttgcaataaacttcaagagttgcgggtcttcccttctgacccttttggtgcaggattcttgactgaaagaggtcttgttgatgtctctgcaagttgtccaatgttggagtcagtgctctacttctgcagacggatgacaaatgaggcacttattaccattgcaaagaaccgtcccaacttcacttgcttccgcctatgcatccttgagccacacactccagactacatcacacgggagcctcttgatgcaggtttcagcgccattgtggagtcatgcaggggccttaggcgtctctctatctcaggccttctcacagatcttgtgtttaaatccattggggcacatgctgatcgtcttgagatgctttcaatcgccttcgctgggaacagcgacttgggcctgcattacatcctctcaggctgcaagagcctgaagaaactggagatcagggactgcccatttggtgataagccattgctggcgaacgcagcaaagctggagacaatgcgatccctttggatgtcgtcgtgcttgttgaccctgggcgcatgccgacagcttgcacgcaagatgccccgccttagtgtggagatcatgaacgatcctggaaggtcatgccccttggattcgcttccggatgaaacacctgttgagaaactgtacgtctaccggacgatcgcaggtccaaggtccgacacaccagcctgcgtccagattgtgtagggggcagtatgtgcggtatcggtatgcgggtgttatggaggtatttattttcaatctcgattagtaccttcaaacaccttcctcgcataacatagaattgtttccttccaagtagaaaggctgatggttggatagacttgtcatgatctctactcggctacaaaactgttgcaggtgtagaatgaaaattcacagcctttttcaggtgttaataactgtaggaggagactggatgaattacagaaaactactagatagcatcatgagaaaacttcggtttgttttcttagcgtgtttagcactttgtatgtataaaaatatggcatccatttgtactgtactagtggaaaatttgtatctggagctgagctttgtcacttctacttttttgacctaaattatgaattgttgttgcttcagcatgttgtgaatgtttaataattattggcctgtgctgttcatcatccatttgatattactttatttgctgcaaactgtttaacatactggcttggtgataacacttggaagctgtgcccaactatattcaggctcaagttcacagcttgaagccttaaacctcatcaggacagtatgaatttgctccttaattactgtacttgtttactctttgttttaaaatacaggacatggaaatgcatggactctagataatactcctattttaaaatatagcgatctaggacagattaggggaccgtccagatttatatcacaggttgtatctaatctgatctagattattatatatcctagattattatatttgggttggagggattatatgatatgcataagcaagcaatgaacctggtaaaaaataattgattacctggctctacccagcttaagaattgattacctggctctacccagcttaagataagcagaaaggggaaatgatgaggggatcttcatacagctggagcaagtgtcatttgactacttgtaagtacatgtaagttcatccactttgttagggtgtgtttagttgaggaaatgaaaatttttggatgtcacatcggacgtttgaccgaatgtcggaaagagttttcggacacaaatgaaaaaactaatttcataactcggctggaaaccgcgagacgaatcttttgagcctaattaacccgtcattagtatatgtgggttactgtagcacttatagctaatcatggactaattagactcaaaagattcgtctcgcgatttcctccctaactgtgtaattagtttttttatttatctacatctaatgcttcatgcatgtgtccaaagatttgatgtgatgtttttgggaaaaaaatttgaggaactaaacagggccttagtagaagaaaacctgcgatcttcaatgataactgataaacaattccaaaagggtggtcagtgctgcctagcttagcttgatactaggaacctagcacaatatattttggtcatgtttgggggaaacaaagatgtaattatcagaatctctcctaaacctaaacagggcttttgcttctctactacaccttccatctcaaaatataagtttatttatgtattctgtatttaacgggtgatcgtccgttttatttaaaaaaaatataaaaaattaaaagaaataactcacacacaaaatattatacatgtttttatcatctaataacaacaaaaatactgatcataacaaaattttaaataaaacggatggtcaagtattgaagacaaacccataaataaacttattttggaaaggagtggaaaggagggggtgtagtaaaacaatcgcagtaatgtactttgtggtagcatcttgcttgatctgtctctagctgtgactgagtcatcatgctcaaagctacctacttgcatctgctgccttgcatggacagcttgcttgatcttccttcatttcgcaaatctcgacacatggataatcccaaatgtatctacttcataaattgaaaagaaagtaaaagttatattcataggcaagcaaatctcgacacatgaatctcgggaaaatgggccgtatggaatagcacaacctaaaacgaagggtcaaacttaagtactactactagcatgagatgaacacaatcattttggccacaattaattatagtgggcactttgcttctgactaaggcatcgttcgtttaggggtgataggggagattggctctcgtttgccgcgcgtacgcttttcaaactactaaacggtgcgttttttacaaaaaatttcaataggaaagttgctttaaaaaatcatattaatctatttttggaatttaaaatagttaatacttaattaatcatgagctaatggctcacctcgttttgcgtatcttcccaatctcctcaatccccttctcctcaaacactccctaaagcttcctttggccacaattcggtcaagatgcaactttgacctttaattccgattgcaaattatctcaaaaccccaatgaactataacaccgtgaagtactttagatataaaagttggatatagttaaaagtatttgatgtttgaagttattaaagtttgacatggaattcaaaaagcaacttgttttttgacaggagagacctatagtaatattgattaaggcttcatcctaaatggatattcggttcggctaacttcacaatttgtagaagtttcttttaaaaaaataaaatatatctttttaagtttgtaataattaatacccaactaatcatgcgttaatagcttgtcttgtttcacgcgttgccgataacttaaggtaaaaactggtttgagtttaagcctaaggtctgatttaggagagtttatagcagctgcaggttctttcaaaatccctaattcccaaaacaatctgaattcttatatagttatagaatttagtaaataaattagaatccagaaactaaaaaaatccagttgttttctagattcttagaaacttattaccaaccaatcattactcagaattttaagctctttaaacataaccataaactcgacggtttcttagcttctcattaattagatactaacatatgcttatctgaatctccagctctaaatcattctaatgttcttatttgtttcattattagataatagtactagtaatatgatgagaaatgaaagcggacaaaaaggttagcaaagccgacacaccccttccctcccttccatagttccattcccccgccctgacctcttaattactccctctctctcacactcacactcccctactgctctatgaccattcctaacctaataactaggataatattaaataaactgacatctaggataaaaaataatatggcaagtgaataaacgagaaaaaagaagaaaaccatgtcttggatgagacttagtttctacacaatatctaagatatcatgtgagataagtagcattaaatttaagtatggaatagtggtgtttgcattggaagagtaatgtttagtactagtttctcgatgatgtggagtttatagaaactatgtctagtgtcttgggttgagaataaccttaattctatcactattcactcctactcctctagtagcagtggttagcacttagctctcgcctaatgctgctctccgagcttaagcttaagctcaagcttaacccatcctcctctcctctcctcccactcgctctctctcccgcagcgtcagccgctttgccgcactagcagcagtagctactactaccaagcaagcgtagacgacagcagcagcagcagcagcctgcgccgcgatcccacccacccggacgaggaggaggaggattttttccccctctctccccttcgctttcctggagcttgaaggatagggatcgaggaggaagaagacgaatcaagaagcaagcaaggttggttttgctaacctctcgctgtgcttggggtttgttttcttgattggcttcttcgatctgggtgacggggggtttcgtcgatcttgttggtggtggtggtgagggtttcttggtctcttctccggcggcggcggcggccatggcgatggctgggctggcttcgtggagggtccggctgctgcctccgccgtcgcgggattttgggtgttaccccagcgcctgaatttgattagtgtgtgggtttaacttcaattaatcatacgcgaatttggtttctggattttgctcttcgtccgggctgtgttcttgattttattttatttttactgcggcgttgcattgattgggtggagctgaatcagccgttcttgctgtcctccggttgttccattgactccgctgctccggtaccgatgagctaagctgtgagccacaattgttctggataattgcattgatctcgttcccgtacgattgttaccgcgaacgctagcattcggtttattgcgtctcttaaatccgagaattatgtcatcatctgcagcattgcgagtacaaacagatgacacttttcctctttatttatgtagtactgtgttgcagcaagaagaggatagcaatggcaaaagagaacttagagagagagagagacagagacagaggagatagtatgagcaaaagcagttctcaactctgaacattgatagcttcatcttcatagcttgatagaattatatccgaggtatgtgcctcttcgcgtcatcggtatatgctgtttttgtatcattgagggaacaagatatgatcattctccaccttttcgggttgcaattaccgacctgtaattgtgacgtagtttctgagtgcatttttttgctttcttggtgtgcagcttgcaggcatgtacaagaaccagcttcaggagcttgctcagaggagctgcttcaatctgccatcctatgcgtgcatccgcgagggtccagatcacgcgccacggtttaaggccacggttaatttcaatggagaaacgttcgaaagccccgccttctgttctactctgcggctggcagagcatgcggcggcagaggttgcgctcaatgagctgtcgaagagagggccatcatcgtcacttgctgcaaaagttctggtaggttctgttgatccctccagaaattgattctcaagcattatgatatggaaatcagttgcattcttgtgtgaaaaacttttgcatttgtcatcttgagaaatctctggtatgttttgactgacatcctggaagagcgctaaccttagatctcattgtagttctatgtagaatcagagatttagtaacttgtcatggatgtttttttgttgataaacagataaagtgcttgaaccaggggacagttaaattgtatcctttcagctttgccaaataagattcatgtcacatgtgtactagctagcagatcacctcagattgcatagttgccaatcatctattgagaaccacaaaaggatatcactgtcacatcatcatgcttgttagtaccgaaaaaatcagattggcataggaagttgaaagtaacagtcatcatcagttctctatttaacttgttgtagcttagtttgatatggtaagagtgaggaattgtccatagctcaagtccataactcacaagtcacagttagactttttgcttaacatgctagacttactgacatattacgcatcatctcattgctttatctgtaaaaatacttagttcagtccttgtgctttatttgacaagttgtacttgctgatgctattatggcggcttgtacatgctgcttctactatattgtagtacatattatagtagtttctcagtggatggacattgtgaaatgtcctggatcactggatgtaattggtggtaaaccaacctttcctttggtcaaaggacaataaatctcatctacgctgtggatgtatctaagatacttccagtggcaggtgtattaaaagttcagtgttcttgacaattcccccaagcaataagtcaaagggatgtggtattatttatgatggatcggttgggatggtttaactcatttatgatatctgatgttgatttgccagttgtcccatctagttgcatcattcctgattttgcagtaaaaacaaatcagtatacaacgttggcagccatgtgattttcttcttccagtgtgcatctctacaatgctcactgatgtcagcatatgaaatggatattaaataaataaacattgagcttacttgtgtttattgtgcatatccttatattgtgcattctgtaacctcttgaggaatggtttttcaagctgagggcctaaagctgtttcactccacaggatgaaactgggatctacaagaacttgcttcaagaaacagctcatcgagcaggtttaaaactgccagtgtacactacaattcgatctgggccaggtcatacacctgtgttcacatgcacagtggagttggcagggattgaccttacttgcaattcccggcaagaccaagaaacaagcacagaanaatgctgctatggcagcctggtctgaattgaagcaatgtgagtatcttctcaccttcttaccacctttggtctcttaatgcatggttcactggatgtacaacaatggaccgcctatgtgctaagtactttattggaaaaataaagaggaaagacaatcatatatgttaatggatcttcccttattaacctatgcataatgcactgcggcatttcctagtcattccattgtatcaacttcagaactttttcactgactatttggttttgttgtgcctaacagtgccccgagtaggtgagccatcatcctcatcttgtccaccagatcatgacgatgatgatcaggaacagattatagtggctcgtactcttgcaagcttgaatcagacaaatggaggaaagacaccacagcaaaaggaaaaacagcaaagcagtaaccgcccgtcatctcggagaccctcttatccgaaatcaaatgcatcattttatggccggttgcatttacaaaagcatgcatacccaagtgttccaccagagcaagcaatgtaccatatgtggcatcaggtgcaagcaacacagcagaagccgcattttccaatggtacccactatgggcagtacaggctttccaccgcctccaactgtgctccacatgtaccctccacctagagggcaattcaccatgccatccagccaagatggtttaggtcttattccatgttatcctgaagcttcccccgtccttccacggtacttctcgccttatcctgcctcctttgtaccaagacgtccattgccagttaatgttcacaaaattcatgagaaaaggttagtgggtgctgatatggttgagcttcctgatgctgcggtcttctcccgatacactgctccagatttctctggtacatcagaaaatgctgttcaagataacaagaaagaagaatataccgagagcagtcctgcctccgagcaagaaagcaaatctcatactgcctcaagctccgccacgcgttcaccatcacaacagctagaatcaaatcaagatatagaaatcatgggcggtttgcggttggaatcaaagaagcccgcagaacagccaccggagtcatcaccatccagggtcaatcctgttcttctgtgtgaaactggccaacggcaccattacagttctgttcgccatggtgatcctgtccacagaaatagtcctcaaataagtgtggctacatcacctagtcctattcgtcgtggtgatcctgcccacataaacattcctcaaataagtgtggccacaccacctgagtgccggtctccccgtgcacaagctccaccaagatttggaacaagaatgccggtaaatttgccgagttcgttataccagcaacggcctccttggttagctgcctcagttacaatcagaacaactatccctgtatgctcagcgaggccaaatgtggtgaactctagtgctggagcagctcaacctgctgttcagatcctctcggcctcgcctagaaaagaagaacctgaagctcgcacgaacaccagtgacacaagcaatgctgcaacggcgagttctgagctcaatagcttccatatttgaaagtcacagttttggttcatctgagctttagtcagggctgagaactgaactctcagctgcatctcagttttgattgtttcttttcctttcattttttttatctccttgggtatttagctagatagacataactatatgaagagttggagagcgggcatctctcgcgatatctgaacctgttggattttttatgtaccacatcttatcaagaagagtgaatgggaacagtatatataccgaatgcaatttttgtttgtgagatttcagaccgcactgagcatccataaaatgtagtgcagtggagtacatcttcactccagctctctgcatctttatggagcctgttgtaatgttcgtcacatgaatgcttttatctcttttgattctcagtacttggaagttggaagctatttgattctctcaatacttggaagttggaagtagtagttgcaggattgcctgtgtatgatattctcacaccgctattgcaagatatagtttgcctgcagtcgactgggtaattactaattaggcagcagaaggcataaaatgatacatgcgatgccatatcccctttccaggaaaaggagagtatcattacctgtgcaatgatgcagacgcctgacgagcggtggtacattggtgtggagacgacatgcatacaggtaaaagcaactttgttttatttgattgatgtctccaaaagagagatcaactacttgttatagttatgatcacctaaaatttgtaatgttgcccgtccaatttaaaactttaaaacacaaccactttaaccggtatacaagctaaccatctcactagagttatgtctgctagtttttttttttttttttgagctaaagctactgctagacaattgggatgtatctggggtttccccttgggtttcatgtcaacctccaaatgagctccctaaatgcatatggggggaggaacgaacaataatcagatcaccctcgccttctccttccctgtgagaaaaacaagtgggtgaggtcctactttactgtaataaccaaaacagtgtgtggttctagtaaagatgaacagaatgcgatgtaaataacacttaccgagcctgcattggcttcagtgtaggactggcgcctcctcttcgaagagctttgtggaggggtatcgagcgaccttgatgaagaacgctttgctggcgacatattctgcaagtgcaagaaagtaaaaaactgaagattagaaagattgcattgtgatgactactagggcaatatgtttgtacttcactatgaagtgaactagaagccaaacgggaattgaaaaaggtctactatgaccaaccttcttatctttcctggccaatctctcacgctcatcatattcttggttctccttctccactagacgaatgagggtctcgcacctcctagctagctcttgggttgttctagacttcacaaaccaatcaaatcggaacaagggcgacatgcgaaaggctgctttcagttcatcccagtttccgtatccgagtttgtgcaccatgcataactgtaatagacacaagctgttaaaatgcaaaaaagaaaggggcttaaattgttcaggaacaattgtggtgtagcataccataaaacgatcacattcttcgttgtataacttccctttattctggccatactgaattttcaactctaaccaagggttcttatagcggtctagctttttcccaatagctttcataatctcatccttccggtatatccttgcttctcctttctcaatgttcttaataactcggtcataatctgataggatgaggacatcatatttagtcaaaacagattttgtatctgaccattactcagctcagcatgtaagcaatccattacttggttacaagttaataacaaagtcagctacacattaaataggtcatcagtagggaatacaaacagtaagagaaaaggttacaaaatataccatttaattccttgtatctttcctggaaaactttagcgtaccgctgcacctcctcttctgttttcccctccatttcagaggatatgttctttatgtcattacgaccgtacttctcacaagcacggatgaatgtattgaagtccctccttgtccatgtcgaaaagccctggatattatacaatgcaaaaccaaacaaactcagagaaggaaccagatataaagcaggcagatatattgaacgacaaaaacagcatgtcctttttcccccctagaataaacaacagtaacactaaatccaaaaaggattttcattgtttgtaaccacctcttccaatagctgctctttctcttcttgctcctccacagtcaacggttccagttgatctaaatattaaaacagaacttgtcagaacaaaaaaaaaacatctatctgctttagtgccactataaatgcatagttggtaataccttcgtcatcaccctcaccaaccgtatcctttttctgatttgcttgctggttaagatttgtaaacaggtaaaaattaagatcaagaatcacgaaaacaattctcagtctcatttagtagcatgtacacatagacaatatgttggacattgggaaaaccaatttatctggaaattctacatgactagggaataatatatcacaaacaaaggcaacctaatgacctatcatatagtaatataatgtctcatgcttctgacataagtaaaaaaactgatatcgcaaatagttctagtggagagattaccacaaggtatttgacttccttctcatataattcattgagtctctgagtgttgaagaactggaaatcatgcctaacaaaaacaaaaccaaaatgagtacaccactgcaattaaatgaaaaaaatattaaaaattttgaaaaatgaaaaaaaaaagactatgtgaacaagcttacaagtgtggcattcgaggaattctcggttccctaggttttgctggtgcaccttggcgaagtgcttgcttgaaataatcagactcagagtagctaatagaaacatattaacaaaaaaatagtctgatcagaaggagactattattctcgttattaaaaatggacataacatagttatataaagcatactttcgcttcctttctcttctgctggttggctctatccagttgtcagtgaccaacttcttaaaatcaagtttgttttcatccttcagaaaaaataacgtgcattcaattatcacaaaatcggaccaaatatgacagcacatcttaatataaaaaacaatgatgataattaaactgaacttagagcatgcagcaaacaacagaacatagcactgtttcattaccttatcatcatcaaaatcatacagttcagcagctgcagaaaaaacatgaatgaataagcttggtaagaatacattccatatgtacactagagccatgtggtgatttttttgggaaacattaatttgtgcagacatatttaaccataacctttagtctagaaaactatagaagtagttagaatgcattatacaatttgacaatatttcaaaatgagtccgaagtatgcggacaagtacttgaacctccatttccagatattttcttagagttattaagaaccaaagagaccaaactttatgagtttgtactgaatatatgcagacatagagaaggaagtgtgtgagagatattgagagagagagagagagagagagagggtcatactgtcatccattttgaacttaatagcatcttctgtgaacttcttcatttttgcatcaagttgtgctgttgcttcttctcccttagnnnnnnnnnnnnnnnnnnnnnnnnctgttattgtgctatccttggagctgaataccatttcagcaccaaatctgaccatctgcaatagctcatccttattgacagctgaaacaccacgacagaagaacattaattgatgtttgaattttcatttgtcaagcaacattttatgaagcaaaaaactaacctttctgctctgccaatcgaccctgttgtatgaccaaagcatccagggcaagcttcttataagctctctcaatcaccttttcctcaattgtatactgcatagaatatgaagcatattctgttatataaataaatagaagatattgcttagtgctaaaccagtgtttttaaatcttaaaataaattaaataaaacctcagtgcagaaacgaaaaacttgaacttctttcttttgaccaattctatgtgcacgatcttgcgcttgcagatccacttgaggattcctgtgaaaccaaataaccataacctttaacttcacaaattgtagaatgagaaaaaattacgatttgaaaaggacataccagtcactgtcataaagaataacaacatcagcagtagcaagatttatcccaagaccacctgccctagtcgaaagcaagaaaacaaatttttcactccctggcttgttgaaagcttcaatcgaagcatcacgatcttcaccaccagtattcccatcaattcggcaatattgataccccttgtacatcagataatcttccaagatgtccaagagcctagtcatctgcaggatacacagttgtgtatacacaaatgttatgaaaacataaaacataggcagaaaagcattatatataaaaaaaacacaagataaaaatgtggacatttgcatcaaaccagctcacaagtagaacacacacaaatcatgaaataagattgctatcatatccttgatgctgtctgaactctgacacaatgcaaattcaacttgagtgtaacagaaagaaaatagtgacctgtgagaaaataagtactctggaatcacgttcctttagcttgggaagtaatttatctaacagaaccatttttcctgtaaaataagagtgcatgatcatatgtgcagtattgcagaaatagtaccaaattatgacaaatactagagtggatgaatagtacctgcattctcaattagatggtctccagtggtatagggtggaccaggctcagcaccttggaataaatatggatggttgcagcacttccgcaattgcatggctatgttaagaaggcgtttgcgttcaccaccggcattgacaacctccagatctttctgaagcagagcacgataatattgtttttgcatctcagacattccaactttaagtatagtttccttttttggtggtaaacctttctcaacatcagatttaagcctccgaagcagaaatggacgaagaaccttcaagtgtaacatgttacacaaatcatacaaggaaaaccaacatgatctatcaattgagaatatggatatcaaatctgttaccttatgaagctgctgaacaacttcatgttgatcattttcccctgagatttggaaccaatcatcaaaagtctcagcagagctaaatatttcaggcaacaagaagttgagaagagaccaaagttcatgaagattattctgcagcataatcaagtcagtggtgataaaattggacataacttgaacttgaagaaatgtatactgaagcaaattaccataattagattagaaagagtacaaaatttgcataggtagcaatgtagaattaatgtgacaaggtggtgctaacatacctgtagtggagtgcccgtaatgaggagacgataattagtattgtaaatcctcatagtcttagagagaagggaattttcattttttatccggtgggcttcatcaataataatataacgccagctgaaacgcttcaatgcagttttttctttaattgccatttcaaaactagtaacacagacgtcaaacttccctgggactaacaaattttcccggatatggttctgaccaagtatgacaaatatgttagcaatataccacaagaagttcacatgaatgacagagataacatggggattaccctttcttcggggtttcctaagaacttgatagcacgcagaacaggacaaaaccgttgtatttccttcatccagttcccaagagtggactttggtgcaacaaccatgtggggaccggttattcctctaaactcatgcaaatatccaagcagtgatatagtttgaagggtttttccaagaccctgaacgagaaggatttcatgccaaatatgagctcatgaagttgaattaagcataaccatataagagtcaataagtataatcttaatgttaattgatatgtgtaacaacaatgaagagcaatagagtaccatctcatcagccaatattccattgatgccattctcatacaagcgtatgagccaattaagtccagctagttggtaatctctcatct

SEQ ID NO: 44493 - DNA, 3618 bp, Oryza sativa
tctcatctttccttttatgcctgtcaagtaaaccaacaagaatataatgatcatttagtagttaacataaactgatgagattgcacgagtctgtgacggactcattttaatcacaaagaaagctaccagggcatttgtacataaacactaccattcagttataacaaggatgtgaagataacaacatctggacataaacacgggttaaatgctgtgaaggatgcagacttatccccaaaaaatataatcaaatgaatgaactaggagtctaggacaacaactagcgtaattgcaccttgctatcacacacacctacgaactaagagagagccagctgagcagcagcagatcgggtatgtccagatctaccgggtagaaactaccgggtacctgttgtatgtatttttcttctacaattaagtgcaatccatgaaagccacaattaatccctctaattcctcctctttaatagataaaaaactaacaacttttgttctacagactgctttgatgtttttttctttaaaaaacagactattttgacaaaaagctgatgttgcacagcatacggtcgctgacttggaccttggttcacacaagaacaaaagcatgtcgactaaacaagcagcatgcaaaagaacaattttagaaagacagaagtcagtttcttcttcctttctaaatttaccgcgtcctttttgtctgttttcagtggagcaaatattcgaaccgtttacgcttaattatatcagggtgccgtgaaaagctccctaatcggagtcctcatagatatcatttcaagggctttttcgggggaatatcatcaatcgtctgatcaatgacaaaataaatttgaattgacctaaagatgaaacattttaggagaattaaaactagcaaacttggacaaacaattttatagctttgtttggatggaacggaatccttgcccaacacgtgtaagccaatgaaaattagtataattctcacgtggacatggaaacgtgtgccggaatccgactcgactagtgtgtctgattcggcacaaaagaatttgacacacaaaatccttcctggaatccaacacgagcgtcaaaacccgattcggactcgggatgtccgattcagcaaaataaattcaaagcaacacatatgttctagtcaaagtgttcgaggttgcatttcatcgaaacaatggctttattctcaggtgacactgaacaaaatgtgtgagtggtgtttatgggaggttctctctattggtatgtcttctcgacggtgtgcctttggcacaaaagaattgggcacacaaaatacttcttggaatccagcatggatgtcggaagccgacttggattctggggtccgattcggcaaaaaaaattggacacgagtgtctaggtaatattgtaaattcaaagcaacgcctatgttctagtcaaagtgtttgaggttgcatttcatcgaaacaatggctttatacttgggtgaggccgaacaaaatgtgtgagtggtctttatgagaggttctctctattggtacgtcttcttgacttgggttggtgttggtattttattgcacctttcccagtcttaaattaacggctgagttcctacatccgtttcagaaaaaaaaaaaaagggggaggagcacatcctattcctatccagtacaaaaaaaacacggagaatacaaatctagttatggccatcaggctctacatcctcatcactaacacagacaaacaacattaacactttcacccagtcttgctcaaataatggctatagatattatctcctttcctgccagtaggagcaagagtagttgagaaatcagaaccagggtttcctttccataacaggccgtgagatgaagcaacataatttactgcattccctcacaacagctttcgttttaaacaccatccgaacagaaaaaaaaatcacaaaatgttgattaattcagcacaagtaatcgcaaattcgcaatgaaattgcgaaccgttctatactgtttcgccatcaaacaaatcgaaccttccatgcaaaataaacattttcgttacacaaactgcatttaagactggcttgtaaaacaaaaggtttgacagaatcatcaagcaaatgctcacatgatggttgtgaaaccagacgggtccctcctgcaccatcaagggcatcttcctcctccttgagatactcctcatcttcttcctcctctgtcatctttgatgcatgacgtcccctaagatccttaccacattagctaaacaaagaagacctatgaagaacaaagaaatatgtaccacaacaagaagagatagatgccctggataaatagatctgaatgttgtggtaagtagtaccattccccaaaaattattgaaatatgtttaacaaataccacttgatactagaatactagatagctagggcacaaaaagatgttgaaagctctatgcactcatcaaaatttactgaaaatgataaatgagccaaagatgactggttaggtgcatgttttaacagcttgaccatttttaactactttaaatctgaaatctgaatatgttgaagttccaatagagaaaagcttttcttaataatcctgacaatgttcagctaaaggaatgcactacatgatatcttggagttcatcaaggctatgaagatgggaatgggacggcaagtcatcactaccaggtctcaaaaacagaaagtatttcgcatattacagaaaaatattggcactgtactgttgtaacaaatgacaaatggttagcagtaacttcccttaatggaaagtatggggttagcatatttatccaaggaagaatataccttccacgtgatttcttctctgtcgattggtttcctttcgcaaaatgagcaaatatttcagtttgctgcaggagatacttcagacgtcccttccccttgttgttctgtccatgaatttaatattctaagctaccacagaactcaaagccatgaagtgaacgcaaaaaagcacagaagatttagatcacatgtcaataaggtattcctatttggaggttaatcgctaggagatatgggaacttatcaaaccatgtcagcatcaatggccttattttgggcatccagtatttcctggattttgtgcttcttcagcttttgcatctccctgagctttgctcgctcccgcttcccgatctctgcgtttccagtagcatcttccaactgcaattgaagacaagcaactcagtgatgttgagtgacactcagagtagtcactccccttcaaaatattttgaaactcttttttagaactaacaatcactcctttgataactgtaaaccatgctgattggctaattgcgataaaaaactacttcagtagcacaaatataccacgaagctttaaacattttgctacagcacacttacgcataaagaaaacccaaacggatacaggaatcctcaccagatggaccaaacaagaacaactttactaaaatttacaacctattgcacgggagaggactgcctctctttctaaaaaaaaacaatctacaattttaaatgaacactaatatcatccctcaaatgtctacaggagtatagacgcataac

SEQ ID NO: 44494 - DNA, 1554 bp, Oryza sativa
tcctcctccacttgctccccatccgcctcaccctccacctcttgctcctcctggtccccgctaaacccctcctcctcctccccctgctcctcgtgctgctcctccccctcttcctcttctacctcctcctcctcctcctcgccggcggaagacgaaggggagagctgctcctcctccgagtcgtcgtcgtcgccgtcgccatacttccccggcttccccatcacgcctcgctcgaggcggcggcggcggcggtggcggctagggtttcgggagatttgcgagaggcggatcgggggtggggaattgaattggattggagttgccgaattgggggattggggtgatcttatattgaagcggtttcgccttgtcgccgctcgcgcgggggcggcgtgaaatgaactagtgaagaaacggaagaggaaagaaattggagcggagtggaggtagggggcttttttacgatttggtccctccagaattgagtatttcttcccgcccagcgtgtggggagggagggccgggctgtggatgttggggggccttcttgggctggaatacaaaatgtagttttagccaatgggcttaattgatagtgggccttttttatgttttgcttccttcgtcggcttttcagcgaaaatgaccttccgtatctaacgttgatcggccgaatgttgtgatgaattgacaccggcgacttcactgtgcaaatttgatatagttctatcatctactgataccattcaatacttcttaaaagtgatggagtctcttctgccacaccatctataccaccgatattagggttctacaatctatattattacatcacccttcaacgatttctctcccgtttcatagctaactctctataaatttggaatcacctacttgttcaataagaaaaataatgaaagtactatttggattaaatatgtgcttaattaacttaataagccgaaactcaaatttgttttccgttgcaacgcaaaggctcttagcatcactaaatctttatgtttaccttgcgtatttttttagttaggtatagatctatcctttttcacgtcgcgcagtggatagcttttctagtttggttaggtcaagacatctcatccttatgccgccacatgcaatctcttgccgattcctcgcgtcgctgaagctagggtttccctccatttttcccttcatctgcaccactgtggagtccaccataaggcatgtctctacacctccactgcactttattggcattagccatcacacagttctcatccgcttttcacaatgttgcaaatggattccccgtgctgggaagacgttgtgacacctcaaatccgccgatatctccaccgtagcttgacatcgaccttcctcctttctccaataactgagcttcaattcatggcacgttccattatccccatattccctaagctggccaccataatcgatagatgcactgagccataggacgcattcctcctccgttttttgttgtcgtcacatcttcggatcccctccatcattgccacttcctctgctcgg

SEQ ID NO: 44495 - DNA, 6962 bp, Oryza sativa
acactagaatgaatggggattattgttcttgtagtaagaacggatggattagatataccatggacggctgggtcggcgttgaggcggtggacctcggcgacgagcgccgcctcggagatgtcctcggcgaggtcgacgtcgacggagcggatgccgacctcggcgcacgccttgcgcttcatctgcacgtacgtctgcgagtccttcctgctccccacgatcaccaccgccagcccgggcacctgccaagaaacactcaagctctcatcatctccaacctatccgccgccgcagccggcgagtgagtgagtgagtgggtgacttacgaggttgtgggcggaggagagggcggcgacgtcggcggcgacctcgcggcggatgtcggcggcgaccgccttcccgtcgatgatctgcgccattgggggtgagacgagattctttttttttttttcttttcgtcgtcgcgattgttggtgagaggtgagtggcggcgacgaggcgacggcgacgggcggcgaggtgggtggattggaggggaagcggcggatgtgggttaggtgactgggctcatgggccccacttgggtggggacggggagcgttttgggccttgggccggacgggccctacttagggaatggggtgggggagcgtttgggacttgggcctgatgggccctacttgggtggggatgggaagggtgtaagccttgggccgtatgggtcccacttgggtgggggacggaaaggttttgggccttgggctggatgggatttgtggaggaatagccgaataggtggatgaatttatgggccggaccgcttttccgatagttttggtttacagctgatgtaaaagctttacttctgacaatgtatttaggcataatctatatttagattcgtagtcaagattctggaatttagtttgttttttcatgctttcaaattggagaattttttttcaaagacctttgataaaatttggagggttgagttccattgaatataagtttgtgagccttttgttttcttttcaccaaatttgtgaatcttttttattatacccggtccttaataactcggtgagtaatccctaagttctatatataagttattttggatttgttctaagttaaaaaaaaaataggtttgattaagtttgtagaaaaatgtagtgacatttacaacattaaataagcttttgaatatatttttatagtatatatatatatatatatatatatatatatatatatatatatatatatatattgtgttggatatattgtagccctttggtttaaaatatttgatgctgttgacttttggtcatccaatttattagaaattctatgcaagcaaatatatatgtcatgcttaaagtgtctttaatgataaaagaaatcaataagtcccaaagtcagtgacaccaaacattaaaattagagggaatactttttcctacagagttagttgaacttagataagtttgacttagtacaaatctaaaataactagagagagtgtatgaaagaataaagttattcttttcttgtggataagaagccttcgtaccttaattgaggaaaaattggaatttttttctttagatatttgaccaaataggatcgtccaatttctatagagcttatcactaaaatacccgataaggctaagcggaatgaaaaggattttatctgagattgtagatgaaaacgagtagccccatacgaggtttgggaataagtgatgaacaaggaatatacatctttctactaaagaggttttattaaactcataactcattagatcattcttatcaatgttaactaggtagttgcgctgccgggctatgtatatccattgtggatgtagaggccggattttaatccattttcttaaaaaaaaaaaaaggtagttgcgttgccacagctgacagctacaaataatggacagagtgtttaattggtatcaactttttcaagttttggtcagacatttccctactgagcactagcattgagcagtgaacagaagcaactgaacacttggccattgttgatgaccatggatttcttgtctcgagcaaccggccactgccggcttaaaccggcctgcaacccactggtcccggctatatgcttaatcttgcactagcagctggatttcttttacatagttctaggctcttatgtacatccttttgaggtcaggtttttaatccattatctgaaaaataagacttatgttggatgcatgtgtgatgatataattaatcaatggtgggtctgcaacctgttaagaacctaaaattcccttcccttgaaactttttttttaaaaaaaaaggatacatgagaacactaactcttaacttaacctgtagaatagaagcccttctatatctaaagtggatgtacacaaccaaagaaacctaattcctatgtatagttaatccatctatattttggtatattttttgtcactttgttgcaagatgacacaacaacaattcagaaagaattattcggttcccctacgtcgaccagcacctaaccaatttgatccaacatttcagagcatcattaccacagttcattatattgtgatacgatatgtatcgatgttgattgatatcaagaagtagagttatatcgctgtttgggatgaggtacagaaaaataacttctgattaacactaaaatatacctttatatcttgtacctcccaagatcgtaaaagaagtcatgttacttattgctagccaatgcttttttatcttaaaaaaggtgagtggaagctatatcccaattgtgtagatctcaagtctcaactctttttcatcatgttgtcacatcagatggctagcaatagtgtatcttcttggcatatcacagtggtccatggatggagctatccctctgcaatctccattgctgaagaggcaatgatacaatggatattttggaatgtaccaatccaattgatcattctagagagagaaatagagagagggggatgtgattctctctcattcttctatgtggttgatgggtagagggagagaagatgctacaaaaatgtaccaaaattcagtgagactgcctagggagggatcgatttttcggcatcaccagtgttaggggggaataatagcatggagaatcaagccacccaatgtatatatcttcaccatatgccttttagttttttttcactttctagatagtgctagagggatcacatggagatctaacacaagatttggacctgtatgaagatcagattaggtacacttctttttcattatgataatcaactactgcagggaaaaccggaggagggtccatcagggttttcaattttgaaatttctttattttctgaggggggccgaaattttggattttttggctgaaattatttgaaattttgactgattttgaatgaatttgaataaaatttgaccaaatttgcaaaaaaaaaaggggaaaattttgggtgagatatgagcttgccagtgggagacgaaatttcagaaatttcaaaacgaaatttcaaaccctagggtccatcaatgattattactaccttgttagacgttccacactcaaaataaagtgatgggggtagtatttctttaaagtggagatcatgaaaggggttaataattatttcatttccttattacccgaatattgagctaaaatttctgcagaggaatatcgctgaagaactgaagatgatctagctcgctcatgaataaatttgcatatttttttagaggacagcgcaatacctaatatatcacccacacatatactccttttttttttctctcttttgtatttttgtttaacttgagaatatgtcgataattgaaccttgagatgccgcagttttcagataaaagagaagaggaggcatgaaaagggtctctcctatcagaatcagcctatggagataagtttgagagggaaagaaagaaataaaggttccctttgcttgtattgacatcaaagaggctgaggtcaactaggcatcaaaaaaattggccaggaacaaaaacaaggtacatccatgtatctggccatgtaaaacacccaatgcattgcatgaaagaatgcacggtgagagcatttgtggcaatgtgcatgacatatgattgaaagcaaattgctagctgcaggattattcagataagtctttgcaatctcaggctatagctgctccatccataacctcactgaaaaaaagttactagagaagcaaagagaaaagggggagcaaaagaggggagataagtgacatcaaatcatgccttgttctgatcagtgagtgatccaaggagacggcataagtttgtttcctcatcagataatattgctctgtgcatggctttccctgcagtgcattgtttgagcacagttatgcttgtcatggtgtcatgttacatacattgtatcaatcaggggattctctacttttgcagggaagcatttcggtgtgccgtgccctggctacaatgccgacatttaattataaacatgcatggtacaaacgcacccatatacatcctattcctatgagcatctccgaaaaattggaccgatatatcttgagattgacgaagtcactacgggtgcctcgctgctgacggatacgtcacctaccactgaaagaataattagccgtaaatacgagcacccgtgtcaagtctgaacttgaacctgggtggattggttacaccactaaaaaactaactagttgagttatgcttactccgcacattcttgacggtttgatcaaatctaggtatttttttacctatttggaatatataaattctacaaaataatttatttatcgtgatatttttttaaaaaaaataagttgcaaaggatagattaacatgatcaagcttttctcttggtccaaaacccatggcactgatgcatacccaatgtttttgcattgtgttcccttttttaaaaaataaatccctgtcttgtggtatgtttgtgcatggaaggtttatacctagtgttcctttttgcagatataaatccctatgttgaggtatgtttctgcagggaaaggtttatgtcttgtgttcctttttgcggatatgaatcccgatgttgatttgtaacagtaaggtttgctctctccgtttatttttccaaagaatattaggaaatgcaatcatatttacatggaatcactggccaactaatcattttatttcctcctttttggggcaatgagctttgctaattgttataatgccatgttcctctacttgtcttgtgtttggtcaaatggctagtcaagttcaagcatacaatatttagtaggtggttagagaacaattaaagttaagaatcctttcaaaggaaagcaagaaacaaaggacaaagagagtgtaccctctcatggagaagtgttccattctttggtataaaaatttgagatctccagtgtaccaccatggcattatattgtgatcttcctctgttgtttgttactggtgttgctcttgtggaagaacattggtaactgatgtggacaaatcttctccttgttgctttctcttctaaaggaatcttaccaactttctcaacgttgggttgtgcagttaaagctagctggactcaaagtagagcccattgaaatttaatttttctctgaaaaaaagagaggcatttattatgctggtatgtttgctaaacatgaaaactactcccaccgtttcaaaatgtagaaacttctagcatttaaatcttgttccagaatataagaatttctagtaatattcgtagtattacttatcaaatcaattacctcccactcaaagttgctcttattttacccacaattattctcaccttcacacatccttatttattgagtactaaagtattttcttttcacccttaatctgtactaaacaatttaatctctactccctccgtctcagaatgtaaaactttctagcattgtcatatttatatagatgttaatgaatctagactcacatgatttataccattgtctacattcatatagatattaatggatcgcattgtctacattcatatagatattaatgaatctagacacacatgatttctagcattgcccatattcatatatatagatgttaatgaatctagacacacatgtctagatttattaacatctatatgaatgtgggtaatgctaaaaagtcttacatcgtaaaacggagggagtactaaacaacctataagtactaatattttggaacggagttacccctttcacagaaattaaatagaaaaacaacatataatttgctttaaccatatttagaccctagctataatacgatgtatttttttatataaaagaatattatacaaaaaattctcgcattccaaacagggacggagggccgctatctcgaactgtggtatatcaataattcagctttcttccccagcttagttccatgaagatcttatgggctttgattttgattaaacaagtgaagttggagttaggtcctacctgttgattctgcattagcgttcctctcacattgtttaatttgcatctccaatcaatccattcttttaaggtttatttatagtgtccgttctaatcacgtagattgagcccgtacaaatgttgtttatttttctcttctcaaagtaatccatgcatatctttaaaaggtttgtattggtttctctgtccaaattaaaaatggtgattttgattagctgctcgaagtccattagtggttgcaaaagttcctttccaagccaccacttttatgctaatataattaaaatctaagttgatgattttttttattgcacggtagacgtgcaagcataccctcattttactaaattcattttgaaaacttatttatgtatggataatattcatgagtatctagatttgaaacccggg

SEQ ID NO: 44496 - DNA, 756 bp, Oryza sativa
attcctgcagccctacaaatattacctgtatgaatcagtgccatcttcaaggctgcactctttagtttcactgctgttatgagaaccataagaatgacaccggaaattctggccttgttggatcaaggaaccatttgactgcccggtggtttgtccattttctcatttacacaaaacctgaatgttgattgatatccattcatgcacttccttaccttcgctttttgcggtatacaattcaatgccatgcaatgaattcctttcagcttacatggcattctgtattgatcattgtagtacaccccgctagctgctacagtaccaggaatgcgagtagccatatgcgcacagtctgtatgttggcttgggtttggccactaaaatcaatccaattgtgtcttcattaagtaagcttcctaaccagtttgaagagatatgatctttagtacctgatgtgaaatttggacattagttgcacgcaacagtaagtgaatcttgagcaaaactgatgctaatacgtcgcgtcaaaaatactgtagaacttcattccttatcagatcaataatagctgcttgctgttaacaaccatgtagtaacagtttcctttctaaatacctgctgtgcattgtattgtcagaatcacagctactctatgaatggggtaatagaattctaggccttctgtaatcttcagcagttatctcaaatttaacttgacagcatgcagccatgacaattaggaaatgcataattgat

SEQ ID NO: 44497 - DNA, 749 bp, Oryza sativa
atatttggtgcaagagaatacccaaagaagaattaggatggttatgcgatcaggttttgctgcgacatagcatgcatagaatatgtatgattttgctttaacagttggaaagttgataataaattatccattgaaacttcagctttttgcaccatttggaaataataaggatatcagtttgcctgagtgcctaatcttttatttaaaatattcagacagcataggatgacaggaattccaatttatttctttggttcttaagctgtatcctgcctgattcatccttagtttcacaataatataggcattaagtggtcaaatacttctaagcaccttgacaggtgcaatcaacaaacacccattctttttatgaacgaaacaaacatctattctgcctaaatgtgaattgacttttttgtgatactgtgacaacaaaccgcagatggcatccatctttgtttggatctcctctaattccagttgattctcgtctttgccctcctcaccgtaaagtttcaaatatcttcaattggtatacgtgtaaaagctatcaactggaatcatctggaagactgtagagacattttagatgcagcacacggcatttggaatatcatagacaggcaccccaagaaggcacttcagctcatcacctgagctgaagcccatagtcatccaaccttgttgcattgtagcagatagattctgataactcctagcagcaatcagaaagcataaatatggaaatg

SEQ ID NO: 44498 - DNA, 796 bp, Oryza sativa
gttttttttttccaaatgttagctagtcagtccttataaaaatttcgctcaatttgaacgaaattgtgaagtctatagctctggagcctagatagaattcaaagtaaatttcaataaccttacttcctgacattaggactgcaatacgtcaatatatagatttgaaaacttttccatacaccactaaatctaagtcatctctaacataaacccaccactactcactactagaaaaccaattttcccaggcggccaaaactaattttcgcaggcgggagggaggtccgcctgcaccacagcgactgcgaaaatcatcgattttcacagtcggggcaacggcccgcctgcgaaaatgcaaaaaaaaaaacgaacaaaaaaaatcgccgcacgcggctcaccgccgccaccctcccccggccggatctgagaggggaggggaggggagccgccgccgccgtcgtcaccgccaccgccgccgtcgtcgtcgccgccgccgctccacgccatcgttgctgccggcggcctcccccctctctccttcggccagatctgcgagggagggagggaggggagacgccgccggccgccccgcgcgcatcgtagccgccgtcgcccccaccggctttcccccttcctcctccggccagatgtaggagggagggggcgaggggagccgccgccgtcgcccccgctggcctccccctccctcctccggccagatctgtgaggaagggagggaggggagacgccgccggccgcgctgccacgccgccacagtagccgccatgccgcgccg

SEQ ID NO: 44499 - DNA, 3680 bp, Oryza sativa
  unsure (1)..(3680): unsure at all n locations
nnnnnnnnnnnnnnnnnnnnnnnnnnnnnnnnnnnnnnnnnnnnnnnnnnnnnnaggcggttatttggttctaagggtcatgtccgtctgcgaaaaaaagacccctatatttagaaaaatgctttttctagtagtgacttttcctctcgttgaaatcatcataggcgggagaggttcattagatcgatggatatattgtagctcaaaacgttattagcctcgatatatatctcgcatatcttagcattgacactactagaaaaaagaattttccaggcagcccaaaaccattttcgcagtcgggggagaggaccgccgctaccatatcgactgtgaaaatggaccattttcgcaagcgggcgcatggcccgcctgcgaaaatcatctcaggaaaataaaaaaaaaacacggggcgccgccggccagggctcccctccgtccgctgccgtcggcgccatcatcgtcgtcgtcgcggcggcggagggggcgaggagatgaagcggccagcggaggcggcgaggagagaagccggcggcgcgcgtcgtcgctcgtcgtggccagcagcagagggatgcggcagcgcgcggacgtcgtcgtggagggagccggcggcgcggacgtggcagatgagggagccggcggcgtgcggatctggagcggagggagccgttggcggcatcgcggtcatcgtcgtcgtcgaggagggaggtcgccggcggcgaggagggatgaggcggctcgcggacgtcatcgtggagggcgccggcggcgcggacgtgggagaggagggagctggcggcgcgcggatctagagtggagggagccatcggcggcgtcgcgggcgtcgtcgtcgtcgaggaggggggccgccggcggcgaggagggatgcggcggctcgcggacgtcgtcgtggagggcgccggcggcgcggacgtgggagacgagggagccgacggcgcgcggatctagagcggagggagccgtcagcggcgtcgaggaggggggccgccgacgccgccggcggcgaggagggatgcggcggcgcgtggacgtcgtcgtggagggcgctggcggcgcggacgtgggagaggagggagccggcggcgcgtggatctggagcggagggagccgtcggcggtgttgcggtcgtcgtcgtcgaggagggaggccgccggcggcgaggagggatgcggcggctcgcgggagtgggagaggagggagcagggcaacttttccaagtgtggggggagagagagaggagggggagggaaatgagtggtggagaggagaggataaagatggtggtggagaggataaggatgaggatgactagatttttttttggtaggtactatttttgcagacggaccacgtaaggtgcgcctacgaaaatctattttcgcaggcgtcgcttaagtggtccgcctgcgaaaacacgcggacagcgaacttcatgccgatttatattttttttaggcggtcatttggttcccagaatcatgtccgattacgaaaataaaacccccacgtcggggaaaatgccttttcttgtagtgtgatacccgttcaacccaaaacatatcaacattgtttcacaacaggtgtatatttgcgacatctctacctccacctctataactcctcatctctagagccattagcaaattaaacattgtatacacacgttctccaattatgggctcatggcagcatgccaccaatcaaagataaatgttgacaaatagctacgtggtttagaccggtacttagtatcaatactaatatatttaatacatctctacctactgaaatattggtaccaaaatatgccaaaaaattggtactactatagattatttggtaggataaagaaccaaacaaccccataatatttatatcttagaatggaggaaatataaaatattcttggtgaggttatatatttcatgattatctataaagttaaagactatatagatacactccctcgaaacacatgattaaaaaaagagaggaataaaaaagaatacataatgttaacaggaatgtaagtacaaaataaaagattataaaatatagaaataatcttttaaatatatagaccatagaaaaaacatggaaattggatgagagatatatagagtcaaaattttccaatcggttcaagctcttcctaacatgtctccgtaatctttataagtgtgtccatttcataagaattttaaagtaaagaatatgattcaaccctttatttcaaatactatagtaggatttttttttataagattaaaattatttttcttacaaatgaaagtgggcaaggatctcatactagctagtagttaagaagaacggagggcgcacatgttttttctgataataagggaaacacacgtccggcctctaaatcaaatatgcatgtattttttaccacaatttattacaagattacatcatcagttggtagattcctgtttttaagaataaacaactcattactcaataaaatccatagtaaatcaaccacgaggtcatgttactgaatctcaatccatagtaaatttttacgaggacggaggaccatttcaatggtgcgcaactaaaacgctggccgctgatataaaataatcgaatcctggccactggctgcacgtctttcgtggcgattggcgaacatatatatgtacagttctacttctacactccatctaattgaaaccaccggcagggagaagtcacttgatcaggtcaattaactgaatattagtactactagctggaattaatgttgactgcaaagtgattcgtccgaggatgagccagagcgacagccatccaccatccatgcatccatgatccatccatcgcttggtagtagttggtagtactttttttagaactagtagtagttgcctagttggtactccctccattctaaaatgaataaatgtagttttgcatgattcacatttaacgtttaagcgttcgtcttatttaaatttttttttatgattagtatttttattgctattagatgataaaacatgaatagtactttatgtgcgactaaatatttttatttttttcacaaatttttcaaataagatagacggtcaaacgttggacacggatatccacggctgcacttattttaggacggaggaagtacatggtagtactatcttcttcttcattgactctttttagtgagcatactcaccttttgtgatgtagatatttttttagtaataaactttattctaatatttgcttaaaatgcaattattacatatagaggttgcagtgtaaacaacaatgaaatataaaatcatggcttgattaaaaataagaagtctactttaaaataccacctaaagacagagatacacatggctaaactttcaaacaccggtggagaaacgatttttactcccggtttgcaacccccttagtcccggttttccaaccgggactacgaatccgggactaaagatcgctatctttagtcccggaaatcgatctttggtcccggttagtaacaccaaccgggattaaagatggagccatttttaaccccggttggtattactaaccggagtaaaaatgaagccagatccggttagtattttcttttttcttttattgttttttactttgaatattgatttccccacatcccc

SEQ ID NO: 44500 - DNA, 2580 bp, Oryza sativa
ccgttgcctgcgccgccacaactgcatctgccgcgcgcgaccgcgcctatgtcggggagggatctgccgtggccgcaggggagggggaggagaggggaaggggaggaagggggaagaagagaagaaggagatgagaagatgagaagggagaagaagattggagaagataagggagaggaggagagatgagaggatgagaggataaggctgttggtcctctcgaggaggcgcggtgcgatttttttttcgtttttcttttgtctcggttgttataagcaaccgggattaaaaatagatctttagtcccggttggtcatagaggggtctgacacagcctgccttctttcgaaccgggactaccaaccgggactaaagatcaaaaagtgacgtcagctttttcaaccgggactaaagatcatcggttcttattcaaaccgagattattgtagattttggacaaccgaccaaagctggtttctctaccattgaaatgtgattggtaagagtataccgtttgtttctccccagcggcttataagatgcatttagtttttgtctaccttaaaatagaatacataatctctgtaatcaacggttgatcattgtgctgattggatttcactcacattcgataaccaacgttgaaccaaaaataaaaaaaaaacgtcggaaagtaaatgagttgtaaattaatcattcagccaaatctcgccaccatcatagccatcaaatccagtttgacgagagcattgctaccaaggacaccacgtcatcagagaacccccaatgcgactcctccaagaaggtcacaacatataagatgtcgttgtcactatttccaacttccaaaactaggttttaacccagagattctaaaactagattcctagactaggataaacggtctacattcgctgtcaggtaaatttagacagtgtatcctaattatacaaatctagacagtttatcttactataaatttagtcagtctatctaaatttgtagtagtctaatctaaggccctatttgattcagcttaggattattataatctggattattagtagtaagctaaaacaaacaagtagattattataatctataagctagattagtataatccaataaactcctctataggagctttttctagattattgagtggctaaagacccactacccttatatgcctctaataatccagagaaacaaacaactcgcagcttattctgtcagcttattataatccagcttatagtaatctgatttaataatctagttacaataatcttaactgaaacaaacagggcctaagactagttatatttccagacacagcagtaggtggttagaagatttgttggacggattgtatcacctaaaagtctctaattttggacttgagaggatgttacgggaaccttggtgatgctaatcggtactcctatccttaaaaaaacaatttttgactatgtatctagatatagccaacgtctagatacttaattacataggtaaaagttgtcttttttttagacggaggatatagacttgtagattgtagactagtctggtttaatgttggtcgatcacattacatttcaatccaaataacacaataaccatccattaaatacatatagttaaaattttaacttgcaattaatagctaaaattcgattgttttggacgggaagtagtagacagtacaagctgagtggttggttaatttgttttccttgttggcgtctttcgccgtcgttatcgatcgatatcgacggatcgatccgggagaagtgacatcgatttttttcaggtttgaatcatatcgatcgcatcgcttgactggctgctactagcagagagagacgagacgagatagagctaagcttacaacttccccggtcaacgtagccggcgcaaccgcgcgcgctccagtccaagcctagccctacttatgcgcgccaccgcccgcgcacgcacgcactcgccgaggagaattggaggaggagaccacctcgccggagagagggggaaaccaccgtgtgcttaggtcgccggcggcgtgcgtgcgtgcgtgagtgagtgagtgagaagtgagagagaagaagaaggggccgggcttttgatttcgttctccatggctcgagccgccactgcggcggcgctgctgctcctgccgctcgtcgtcgtcgtcgtcgctgccgcggcggcggcggcggcggaggagataggtacggcggcggggaacgcgggcggaggctggggcggcactgcggcggcggcggcggtggcggcgggggcgcttccacgcaggtaagtgactgggtttataactctactattgtaggcgtatatacgtggaaatgtcaatggcgaatagatttaagtggtgttgcgttgccaacttatctcgtaagtatctttacggcatggtcacaggaacatatatttccttgtgcataaatatttttaaaatcttgattcaaatccggactctatatttaaactggatgtacacgtgcataaatatttttaaaattttgattaatatccagactctatgtttaaactggatgt

SEQ ID NO: 44501 - DNA, 8788 bp, Oryza sativa
caatacaaacaaatatattatcaaaatatatttaatgctatatttaattaaactaatttggtgttgtaaatggtgctattttttctataaatttagttaaacccaaaaaattataactaagaaaaaatcaaataacttataatattaaagagagaggaagtatatccgatgatcaaattggataaaggataatataatactaacaagtatatatattctcaaaaatactacaatactaatccttaatttaccagcaggttctgtaaatatctccgaatagaaaattacgtttaccaaagtgacattcaaaaccttttttagaaattaagttcaattctatatatgctatatcactgcatattatcgaaagagggcgtcctagaaattgagtaatatagtataaggacattcgtaatagttaggatccctttgaatcgcagaaataaaaaaacgaagaaatagaaaaaacacaggattctaacaggaattaaaatgtaaaacaaatgattgcaaaatatagaaaaacacacataaataaccgtttaaaccgtaggaaaaactcaaaaatcggatgagggagatagacccaaagcaaaatttccaagagctttgagctcttgctaaatttcctccaaaatctctataggattgtctattccataggagtttcaaatgattggataggattcatttctttgattcaaaagtatttatagaaattttttatatagtagaattgaaatcctctaaaatactgctatgttttttctctaaatcaaagcatgttagaatacgttctggattgtctactgtaggttgggagtactaacatatttggcattgactaattaatgctcgtggaatcacgggctaggttagttgtgtcgtattcacggtcatacccagatctgtgtagactggtggttgtagcgtgcgcatgcaagggtggatcactgcatgttactgtatgttagctgcgccatgaatgctatccgcagtgaccagtagtagggcaccagctgttgaggttcaggtctcctgcttctgctgctttcatgcagcctttggaccgtcaacatgctgggctgtacgttcagtaaagtagggccattaatctttgaggcccacttccattcaccctgggccgggccgggccgggtgatacctattccatgagagttttttttttcctcttgtgcttctcatcgtcttcttgttaacttattatcagccacaaccaaattttgaagtcctttcatcgtggtatatttttatgttagatttacatattatttatttatttatttattttatttgttgttgtatggtttatgcgctataaggaaaatgattagagcagcatgattctttccccgcatggaagcttctttgggatcagcttaaagaacaagcatattgcaacctttttaagttgtgtttactagggcttaaatttagacctctagctacgaattgaacgtatatcaactagttaaatttcttgtggtgaaaataatccacccgggttcaagtcctaaacttgacataggtgctcgcatttacgactaattattattatggtcagtggcagatatgccatgcagctatggggtcttgaatccccactcactactaaatttttttgacatatatctattagaagagtggactatagttttgtatagtttgttcagccctcctgttagttctttctagatccgtctctgattctatttaattattcttttaatggtaggtgacgtacccatcgatacgttgcttaaatcggtaagagaggacagacaatttaatcatagtctcgtcaacagaattattatacacgcgtgaccaacttaagtatgatggaaaatgcctaagagcaagttaaaaggagtgcacggggagggaagatcgctaattcactagggcaggatgggcttgttaggacaagagcaatgcgtcacattatttgttctgcctggggatgtcacattggatggaacttgtaccaagcaacttaacccacagtgcaagctaattgaaatggctccaccaacatcactttttcatctttcacctatctctctctctcctctttacctttcccatccatcccctcccaacagattcctctccatcttcgggcaaccccatcggcgcctgcctccctcccctacccgcctcagtgttcaatggcggtggcggtggcgaacggcatcccacgggctcggcgcccgacggcggcggcagacttggccacgtctcctcttgcgtgcccccgccacctcgtccgcgtcttcctcggcgcgagcagcgatgtcgcccgcggcggatcgagggcggcgcgaggcgcgagcgccgggacggcccgagcggcggcgacggcggtggcggatcgagggcggcccggcggagcggcggggtggcgagatccaacccccctctcctcttcctaagcggcagcggcggggcggctaggtgccttctcgttcacctcctcctcgtcgcctctcgtccggtcctctctctctcccctcatctcgccgtcttcggtggagctcggcacggcggatgacggcggcggcgtcgagcggccgcggcacctttgagtggcgtggcagaagacgaaaacggcgtcaagcggcgcagcggatctcacggccgcggcactgtggatgacggcggggcgcaggcacagagccacggacaacggcggcggcagcggcgctcctactcctctccctctccggcgagcttcttcggcgtggaagtggcttctccggcgagcttcttccctctctctcctgctctgtgtgtggcatgctttttctctgacaaatttagttgaggttctcggagccaaaacaagccacacgaacctagtttttacatgggtcccacctccttctctcctccacacggacattgtgcatagttggatagactttgccacatgtcatgtgtgtgcattgtgaacacccttacggctgcacaaaacacatgtttttttttcttttttttaaaaaagatcagcaccgactgcacgtctgttacggagtgcgatagattgtgctatcaactgacgatgagtcgcccactttattttcctttagttctttctccacatatatagaaattagaatgacatagcatattttatagtccactaagttagtctactgcacccactctgctctaattccaatttcgtctgctgttcaaagtgcagtggattcgtaatgtgacaaccgacaacaaagcttcttcatcctgattaatcccctgaatcaactctaattaacaagcttattcgcccatagtagaatagtgcgtgacgcttatcgataggaatttgtcatatatgttggagctgcatataattgctcgatcaaggcatctttaaaaaaactcattaatgataataggatacgataataactgaaacgcccttttgcattattgcgcttgtcggtgccgttgccattcccatttttcataaagtggcaccattcattatgaagctgatttgaattaataaaaattatgctttcaatcgaattatcattacttcatcatgtgatcctttttcgattatatttctctcaaacatcagcgacaataattggatatgctcccatgtgttaaaatagaaaaaaaaaatgaaccaacgcagtgcacatgctcatttgtttatgatccattcacagacatgcgcatgagagcagctcaagaacaaacaaaatatgcgctacagaatttggatatcattttataatatcctgatcaccctgggccccgtgtttaagctgttcaaggcacgtgctgcgtttcagtatgaaaatcgaaaatattgggtgattaatgtagagtgacagtgtgacacaccttcactttgagggagcaattatgttccacgtggcccataaaagatgacatcgatcttatattaagaacagcaaataaaaatatctcggcaaaatatttcaaaaagaaacaacggcaaaatagaaaagcactagctccctctcatcataaatatttgacgcgactgatgtagtttgatcgctcgttttatttaaaaattatatgcaaatatgaaaaatatataagtcacacttaaaatatcattgataacaaaacaaatgatgacaaaataaatagcatttacacgattattttaataagatgactggtccaactttattggtaaagttaattgtgtcaaaataattatgagatggagggagtattatgcatcaaaatttatttaaattcgtggagcatcaagtattggtgaccaaactatataagattcgatatgtatggttaacaatttaatattgtactcgcttcgttttaagttacaggatgtattttgttttttaaagtcttgaccaacagttacttcattaaatgtatccttttgaaaaaaaatgataccactcgattcgtattcaaaaatacttttttataattatatttttcgtgttatataaatattacttgttggccaaagtcctacatcctatattttaaaaccaagggagcagtaaacatcgttggtgaaatctagaataatgatccatagttacaacgccagcaacaaacacggtataaaacagtaatcatcgatcctgcaggttttgtttgatcctttgcacgttataaatttcacataaccatggtttgaacttggaaatgttttagaatttcgagtgtaacatttggagctaaaaatgagttcacaattaatagacgtatattaagggtttaaatgagttcacaataaaggagggtaactcatctgggtttaaaattcgttgtccacgtatattaagtacacaataaggacgttttcagtgggatttattgatggtattgggagttgctgctggtctctactccctccttccaaaaatataaggcctattcctttttcatcaaaacatcaaaaccaaaaagcaattaactcactcaccatatagcaaaaccaatgaacatgtaaccaataagtattagaatggcttcttggttttcaatcaacaatttaatttagcacacaggactcatattttttgagaaatcgaagaatgaaatatgtctcatatttttttttgaaggagggagtatttattttcttctttttttttttgagaaactgcgtacttcatccatcccataaaaaaccaatctaatactagatatgacacatcctaatacaatgaatctggacatacatctgtccagattcgttgtactaggatatgtcacatccagtcccagatttatttatttttggacggagggagtaagtagtaactctatttaagtcacatttgtacaatcgtcctcttgagaagatagaataaaacccttaggaacaaataccctgtaaaacagctagagaaacaacttcttttacgagcctatgtgctaccatattcgtcgagcaatgaactctgaaagacgtttaatctggacttaaactaacttcatgattctataaatagaacggtttagttctgactaaaataccgtcctagtcatttccatagcatcattattcaattagaacggtctccatttcttttaatgtgggttagaaacgtattagtgtgcgtatgttcacaaatgcttcattcattataaaaacttctgctagtagaagcaccagtgatgcgtggtagagttgtgggtgtataattttacccaccataatttaaattctggtgcccacgaatattacgtatatgcaaatgaactttcgaacatgattttagtgagatcagtgatgtgtcgctagtttccgtctcttagagcatgtgttaggggacatattagtggggtgttacgtgtgtagtggtgtgtgcgtgtgtgtaaaaagaaaacttccgctatataagtaggagtatgaaacatgtggagtagattcggatgaaactgacttttttttttttttgctgtgatgataatttgactgtcactgtcagtcgttggctagacgttaatactcctacttccgatagattataaaaccaaaccccgcacgcttcgcctttgctcgccgcgtcttcccttcttctctctctctcggccttaactaaacccgaatcttttctcttaatcccgcgcgcagtgcacgaatctcaaagcggccccggctccttccccttcaccggcggcgatggcgccggctccggctccggcgggctcggcgaccagttccgcgggcaggcgaggctgccgcggttcgcggcgccgcggcggtacgagctccgcctccggcccgacctcgacgcatgcgtcttcaccggcgacgcgtccgtggtcgtcgacgtctccgcgcccacccgcttcctcgtcctcaacgccgccgacctcgccgtcgaccgcgcctccatccgcttccaggtagtagatatatagacctctctgcaccttctcctcctcctcctcctcctcgccgcgccgcagtctcactcgccgtggttggggttggttgcaggggttggcgccgacggaggtgtcgctgttcgaggacgacgagatcctggtgctggagttcgacggggagctgccgctcggcgagggcgtgctcgccatggacttcaacggcacgctcaacgatcagatgaggggattttaccgaaggtaatttttaatgcatttaaatcaccaatggcagtggcaagttcacagcctgaaagctggcactttcgtttgttgaaatttctgctttattccgtgaacctctgttgaaatgctcggaatcgtcagtgcaaaatcgtggagttgtaggcaaaggagataactgataaatatatagtctgatggtctgcctactttgcacttatattgattgtgattcacaaatcagttgcaagaatacttttctatagatgctgagggctttttatgcaagcatgtggttggaaagtagttatgaatctgtgctttgggtctatttcgacaagttgtgtgtatcatctacattttcatatgagaaaatgccattcgttgcagtaaatatgagtataaaggggagacaaaaaacatggcggtgacacagtttgaggctgtggatgctcgacggtgcttcccctgctgggatgagcctgcattcaaggttaattcttatgatagcacgacttgttcaataatcataattttcttgtccagatgtttgatgcaatatgtgttgacatatcatatctattttttctgttgtttcccctcttcatatttaatattttcaggcaaagttcaagttaacacttgaagttccatctgagctagtagcattgtccaacatgccagtagcttgtgagacaattgctggtcctatcaagaccatccactacgaagaatcgccgcttatgtcaacttatttggtggccatagttgttggtttgtttgattatgtagaaggtgtaacatcggaaggtaaccatctttattctcgtcccagtaattcaacattgttgatggttcatagtttctcacattgaaggtgctttaggagccattttttcccttttacattccatttcattagtgtgtttaattgtgttcaggcaacaaagtccgtgtgtacactcaagttggtaagagtagtcaagggaagtttgcactagatattggagtgaagtcattgaatttctacaaagagtatgatcacaacctgtacctgtattgctttctaattagtttctaaacaactataataattcagctaatgcatattctatgtgcccaaggttgttgcttgaattaaatcattaaccaatagttcattccttctgtgctctagctactttgatactccatatccactccctaagttggacatggttgctattcctgatttcgctgctggggccatggagaactatggattggtcacttaccgggaagtttctttgctttttgatgagcagtcttcatcagcatctttcaaacagaatgtatatatcataactcagattctttttagttacatatttcatcatttatggttcactttgtaaatagtgatgcattattatttattagacattttctttgggacgtccaaattccttcagtgtaagcaactgttctttttaggttgcaattaccgtggcacatgaactggctcatcaatggtttggtaatcttgtaaccatggaatggtggactcacttgtggctaaacgagggttttgctacatgggtaatcaattatacaacactgaattttagaaatttaatatcaggatactactgtatactgaatggttggaccttttatttcgacagatgagccatttgtcagtagattcttttttccctcaatggaatatctggacacagtttcttgatagtacaacctctgctctcaaattggattcacaagctgagtcccatcctattgaggtaatagctgtttgatacatgccatggtctggtactctggttcaatggttcaaaacattgatgcatttcttatggtgtacaccaaatttgtctaaaaccgtaaatgctatgcattatatcgctgtagaaagtagagaatatattgttgtgcaaattttgaccatgataagtgacgctgatgcataatatgctggttacattcttaaatatccactagctaattcactgttgaatcttgacttttctatgtggtaataagatggaaatgttaattttgaggtcaaattaataagtgcaccaatacaattacacttcagctggtggcactttaacattttgtttcaatgctgactagtgatttgtttcaatatttg

SEQ ID NO: 44502 - DNA, 3818 bp, Oryza sativa
  unsure (1)..(3818): unsure at all n locations
nnnnnnnnnnnnnnnnnnnnnnnnnnnnnnnnnnnnnnnnnnnnnnnnnnnnnnncttcctatattttttagggcaaatattaccatttcccccctaatcatcttgcttttgtttaacgagtaccctgttatcgatgacgagtcaaccattaatacttcattgcacgtacttgcatggtacttttggacatatactcaaatgatataaagaagcaagattcaacagatgaaaatattaatcctgtagagagaggcacaacttcaataagggtttgatggccatcttgtgtacttctctagggtgggtaacaatttacaacctgtaacaccatgtacaagttacaggagttggagctatctttgccctttttttgttgatcatatcataaatatgaacaaattgtaaacccactaatatgataaagctccatttttgttaattacatatttatcgaaggtcaattcttgcttacttctttatcttgtttcttcattattgctgtgtgactccacaaattctcctaatgcatcctcttgtactaaacttgtggaactgttactctttcagaaagcattaacttcatatataaaaaagtatgcctactcaaatgctaaaaccgaggacttgtgggctgttcttgaagaggtatctggtgaacctgtcaaggatttgatgactacgtggacgaagcaacaaggttatcctgttatcagcgtgaagcttaaagggcacgacttggaacttgaacaggtaataaattatcgaaaagagtagcgtcattccaatgtactgcacattcatctacttctgaaccacctatatgtaaattcattatgcatatggtttgcttttcctttctattttgccgaggtatgattagtgaggtacaattcctaaattaaaatcctgtatgaaatgtttatgacaaatattacataaaaaaattatgacagaacttcatcttagtttaatttttgtgcctgctatttatgaagatgtaattggctgactagaatttacgttgccctttcagtgcaagacaagttccacaagtagttcccataatatcaaaatttcaacggcacacgggtcaaattctgttttgacgcatttctgacgctctctctctctctcttttttgtcacaggaccaatttttgttaaatggaacctctggtgctggcatctggattgtccctataactttaggatgctgttcacatgataaacagaaaagattattgttgaaacataaacatgataacataaaggccattgtttcgcaatgtgatagccgacagaagggtggaaacttttggattaagttgaacattgatgaaacaggattttatagggttaaatatgatgatgagcttacagctgcacttcgaaatgcattgcaggccaagaagctctctctaatggacgaaattggtaaacacaacctgtggcactattaaatttctattgcaatgttttttttcctgggcgctattgcagcgattaaaggtgttataacactatattacaggcattgtggacgatgcacatgccctttctattgcctgcaagcaaacattgtcatcgttgctccacttgctgtatgcgttccgtgacgaggctgattacagtgttctttcacacataaattctgtatgtgtattttatgttgaattaaattccaggatattcagttattcgttggcaatgatttgtatatatcttttactttggcttgtcaggtaacttcaagtgttgcgaaaatatcaattgatgctactcctgacctggctggtgacatcaagcaactttttatcaagcttcttctcccgcctgctaagtatgtttaccatgtttgctgctttttagttctcaatatattatttcccattgtatgttcatactatgtgtatgtttgttaaacatgccttcctttgtggccatgcatacacgatgacataaattttatttgcagaaaattaggttgggaccctaaagatggtgaaagccacctgaatgcaatgctcagaccaatgcttttggttgcccttgttcagcttgggcatgataagactataaatgagggattcaggcgtttccaaatcttctttgatgatcgcaacacttcccttcttactccagatactagaaaggtccttcttttacccctactttacatggtcctctttcttttttgactcatctgtatctttttttacaaaaatgaattgatatctgtatatcttctatttgaagacgaattcatctctgtatattttgcatttttttttcaggctgcatacctctctgtgatgcataatgttagtagcacaaacagatctggttatgatgctcttctaaaggtctacaggaaatcagctgaaggggaggaaaagttacgtgtcttaggttgatatcttctcagccatcttgtgttaacaatgcttgctgatattttgggttatccagacttcctgagggctctgtctccttatctgtaggcacactttcttcttgccaggataaggatattgttcttgaatcattgaatttaattttcacagatgaggtaaattgctaaatggtttttttcttccatgactccattggaaggacctgattgaacttatacttttacattagctacctgtaagttatatacaggtctcatttgtttctcttgcttataggttcgcaatcaagatgcatatcgtgtgcttggaggtgtcataatagaggcacgtgaaactgcatggtcctggttgaaggtacaaaaagtccagttacctctatgcgttaccgcaacataaaatttgtgatatctggacctttgaagcatgtgattctcctaggatctttaaatataatgaaatatccacttattggatgttttttctgccctagaaagcatcaaaattatgcaaattttctacattcaaaattataagtaaatagctaaatttcgtgctttcttcaagtagcatttccttcaagtaatcgaattgtgtagatacgtcaaatgggggttatatttgtaagagaaaaggacaattatagtttccttagctactttgctggactattttacactatattattttcatgttaccttacccattgaatccttcttttaaagtcacttcactccctgatgatattgtctttttttgcctccttgtacaagtcatgttttacaaagaaattttgtaggatggtagattaccgcatatgctatattactaattattctcgaaaatttccataatttttgaaaatcagtttttattggtatgaacctatgaaagtagcctttccgaagaacactttgaatggataaatgaaatgggttacccttgtttaaaatgagtaacttccattcaagttaatctagtttctaaccatttcctgacaaaagacccctttcgtctctaaatataagagattcacacattcaaagtgtgtcctcgcaaacaaggggtcatagagtcttgttaatccctccaaccaccggtgattgaaatttctccccatattgccgcaaccaccctcccactccttacacacccctcattatttaatgatgggctcatagtatttttcctctatccttaatttctccgaaacaacctagactcccttatatttggggacggagggagtattaaacatgcaatgaagtaatagaaaatgttgagcttacaaatgttgtttcgttcggatgcaggaaaactgggatcgtatctcggaggcattttcaggaagttccctcatatcggatttcataagatctattgttacactggtattactcatctgca

SEQ ID NO: 44503 - DNA, 8603 bp, Oryza sativa
  unsure (1)..(8603): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcagatgtgctctcaaataaattgaaatgtaaatgcaggaaagaagagtcaccatacaacagtagaatgaaagaaaatctcaagcatgaattgtgtggcaaactggcaatacgtcattgatccattttcataaaacgtacacagcaattgccatcatcattgtcaacgcattcattaccaataccaccagccagcaagacaacatagttttgcaaaatagcaaatctcatatcggcaggccagttcaatctattttctacttatgcttagatcccaaagaacataaataacgtatgttaatacaggatcacgggaacaagcacagtttgcgaaacaagatacttggtcaaccaaaatttaatggattgcagggcagctgagctcgcattgatcaccgcatcttgtagtgttgtgttcttgacacttggcatctatgcccacttagggcgtagcagagcttaatgtcaatatctcggggattctttttattcggtgtaacagtcatactgcctgtgatggtttccccctcacagatggtcagtacatcctccaggtacagaacagtttgcttccagtgagtggcttttgatcttgggcctgcatcaattaaattatacaagaattacaacacagcatgaagaaaagaaaatagatgggcgtaatttggatggttagttgagaagagaatgaacctgttgagaagcccatcatcttatggcatttggtgaaggacacattgaaataggcaacaagagcatggatatagtcattacgctctgctactaactaaatggtactggaaaggacgcatctccaggtgtcattttggaaatatccattgtctgaaataaatatattggaagaagatttagtctaaaatatcacctgaacaaataattgctaagcaaatttaacttgtttcaaagcgttggtaccttcagtaactggcagttagtgacaatctgatttgcatccaccgtatctacaagtggctccatcattgcctgtttcttgatacagcgcatatcaaagccatacacattattccaaactgcaagatatagaacaatgccatcagaaagaattctaataacccagaaagaaacaaataacacacagaacttctgaagcaaaatggattcatggctaatagtcatttgccgttttcctcatgcactacatacattcaattttgtcttctttgtattctgcatcttcgattgcagtaagatgcaaagaagctttgtcaggtaggacaacaccaccatcagcctgcatgacattaacataatatacaagttatatatccccaaaattttaaatattgtccatagaacaaacaaaccaagtttagttttcatagcctacaaaactggcaaacaccatgaacattaatggtaaataagcacttacaagccatttatcacgtgcatatagaacagtgttcagcatattctcgaacaggaggaaatagcccatccattcggagattattacatctacttttgggacaggaagctcaatttcttccactttcccttttattaccgttataactgtgaagatagaaatgatattaacaacttctcaaagtcaaacaagcatgatactgaatggtcatcatagatgatagtaagatagaaaggaaatcaccattagaatatccatttgttttcacaatttcctttgccatatctgccatttgagaacactcaatctgtaaatggaagaacaggtatatcaagtttgaggaaaaaacaatatttgataagaacaggtaatgcgaaataatcctaacaaactactatatatgtaacttgaaatcctaaacaccatgggaactatacaggacaccaacagtttggataatcagcatccaaaaagaacactcattttaagttgttagcgaagagcacaataacagtccaacagataagcttgtatcagcttgcaaagagtcgttaaagtctgatacatgtgaataaaatagtagccttcctgctcttcccaaattctattatattccatgtaatagatagatgggaggaaactacaacatgccgaactagattctaaagttgtggcctcatcaaatagtgaagcagcaaatggctaacagtcttagattaaagaacaagaatgggatcatcaaaatagcttatttagtacaacaaaactatcacagcattaaaatgaaaacataaaagtatgttagaaaactaaccgcatagacatgcttagcccctgcttttgcacagaaaagtgagaggatcccagtcccagcaccaacatcaaggactattttgtccttgaaaagaaagctgttctgggtgataacattttgatatgattttgtccgaaccacatcttttagcatttcctgcaatcagcacgataaagtaattggcatctcgacaacacttggtttgcacatttagatgcataaatcatctgcctaaagttaatgtgcacaaaaaaatcggatgaaaactggtttcttgtgaactgtggtgcaacaaaggaggctgatttcttccagattcacttacttcatgaatacctgcaagacaagtacacctcataaagttactgcgcaaaacagagcaggagcattataaactgcgcaaggtaataaattacacaataactttaggcaaaaccggagcacacagtatcaatgaaaatctcaagacctgtacagatcaaaagctaaaattattcagcagtgcaaagtgaaaatcccaaaagaccaactgaatctcaaaaaacctatgttcaattgcagtcctgataaatcaacaacagaagtacaaaaccaactaaataccaatctgtcatacaaccaccattgccaaaaaacaaaaatgaattgttaccacccaacctgctactaaatgaatgatgcgggtgcacttaacggctaacacgcaaaaaaccttcaatctttcacagcattactgtcaagaacaaccaaaatataatatctcaatccaagtaacaacactacatatgaatatacgttatattttaggccgcacaaattcgcaccagatatcgaaccttccccctaacaactaaaacagcacaaaaatctaaaaacttcattgctctattaattagcattatcatcacccaaaaaagaaaatctgcggaacagtacagcatctccaagaaaccggatcgagcgcgagcgccgcttaccgaagtgggagtaggagtcgaagtagtagtcggcgctggtcttgtcgctgccgatcacctcctcccctcctcctccctctcccccttcctcctccgccccgacggtggcggcggcggcggcggggttctcctccatgacctcgtcggggtcctcgaacctcagcctcgacgccgtcgcctccgccaggccgccgttggcgtcgctgccgctgcccttgcgctgatccatcgctgggactgggaggggtttggggtgattggctggcgcgccgcaaagcaggggaaggagaaagctagggttttggagagggagacgagggagggagagaggttttatagcatccgtggcataaatatcaagtccctcaatccactcctactaggacacaacaattaccttgatgttcatgactttaggtttgggggattattttagggttatttaattaagttttaagttgaggtttttttaccggaaatattttaatttatatttttattgcaaaattttccatttaaattcactactactaggacacaacaaaaatagcctgatgttcatgactttaggttgggggattatttcagggttatttaattaagtttcaatttgaagttttttttaccggaaatatttcaatttatgtttttattgcaaaagttttttcatttaaatattttgtttgaaaacaagaaatagtttccatttaagtatttttattgaaatatttcaatttatatttggactagaaaaatgcctgtgcgttacgacgggtgagctattttaatcttattctattgttataaggtttaattaaggtgaaatttaccgtgggaatttgtttgaaatcatgagctgtaattagattccatttaagtatttttattgaaatatttcaatttatatttggattggttttctactaaattgatgtccttaaagcttcgttttatgagattgtcgatttaatgccaatgttatcaagtaaaggtaaataaaaattcttgcattgagaacataaaatttcaagtttacaatttgtaaaatatggatttagactcctatgcatttttttaataatgttgttcctcgcaaattttataatataataataacagtgaacacaaaaataaattgtatcgcactctaataaataaataaatcatcaacaatacatgaatatcttaaaaaggaaatttgaaccctaaatatttcatttgtaaattaatttctattctattcaaaaggcccaggttttcaaaaaagcaaatatagagctttccccttcgcctccgcgccgccgccgcctctgtccgttccgccgtggtttgcgccgcccgtccgccgccgccggcggccgtactccgtgtagcctactcgtcgctgctcgagctgaaagcccagggtcagggagggtggtgcccacagctacgcacaaacaatggagggcaaagagaccaagaacaccgtcgctgccgctgcctcctcctcccctctcttctccttctccaactccaacgcttccttcggcttcggcttcggcttcagcgcgtcatccggacctcctccgccgccgccgccgccagccgtcgaggtgctcctctccgaggtatatctcgcccgctttcctttttttttcttcttcttcttcttcttcttttgtgggcttatcctactacgtatttaccgggttactttgatgcgagattcggtcgtttcttggttgaattgcaggaatcgcccgtcgcggccggcgaattggagcctgtggtgattgatgactccctgtcgatttacaaggtgcgtctgcagaaatgcttacattgtgtttgtggaaatgcctctgtggccgcggcaagactctgcagtgctactgattctattaggctgctaatagttatctagtatcttagaatgataaatgcaattattactttactaaccatacaactcatgctgtcgagaatgttctgtttatcattgaacatcgcgcgttgggactgctgctgagtgagaaaattatgagattattatagctgtccatcatgttcagtatatgcttcaccaatggaaacaataacagaggaaaccggatgtaatcatgtaaacattgaggaatattcttatcctccctcccctctgcctaaaaccaaacaaaaatgaagaacatttgttagcactgaaatggttctctcagctatttgttgaatcctcccttggtaagtcatatgctcagagcgcatggtgacattccacacacccacgtttggtgcaaacataatgttcactcggtcatcgctgttccaataacttctagggaacttacaataaatttctctagttgttctgctgcatgctacaggtcattgttacatcctcccacaaattcaacttaatctatcttttttgccttactgttttaggggagagcaagtacttctgatgtttttggagtcaaaaactctgatttagtcccagggaaatatgaaggtcaggactgaatacattttgatccttgtaacgtatttcttactgtttgtctttgtaagcttggaaatatatgtgtgcactaggtgggttgaagctctgggaaggttcactagacttggtgaagactttaaactcagacatcaaagaagaccgattgcttttagaaggcaaacgtgtattggaggtgagatacttcacgcctaaaaatattttgagtagaactgtgttgtgttttgatagttaaagtaataacaaaagaaataagactttacaagagtcataacagaataaggtatatccagaatgagttttttctttttggaaagcgaggtatgtccacaaccacattgactctttaagaaaaagctttatcacattctattttccacttgctttttcaactgtttatgttgaagtcactaataccaggttttcgaggttcaatctctctcgatagttagtaacagcctgtagtggaatatctaaataattaagtccttcagtttgatacaagtagctgtaatctcagaagatgtacccaacttgctgcttacagttatccatctctgtgattctgtagctaggatgtggacatggcctccctggtatctatgctattcttaaggtatttatctatattcccctgtgaaattttgtaaatgactccttaactctattgatttctcaaaagctaaaactatcagggtgctgttctagtccacttccaagatttcaatgctgaggtccttagatgccttaccataccaaatgtaaaggctaatctattgaaggaatcatctgaagaaaagtttacatctggtagtgttggtttctttgctggtgactggagcgaaattgacagtctgcttcttcgtggagatgctgacctggataaatcaaccaacagtcatgaaaacgatacagcgtataatggctatgatatcatccttatggctgagactgtctatgcagtatcttccctccctaatctctacaggctcatcaagaaggtcagcatccacaacattcattttgctgatatttttcttttcacttgaatttttcatgtttattatagtttacttaccaaaaatactttgcagtgcctgcgctaccctggaggtatagtttacatggcgggtaaaaagcattacttcggagtaggtggtggcacaaggcactttgttcgcttggttacagaagatggtaaatttatttctagttttttagtcattgagttatttatccatgtacctccataatattactcctgatgacatgcttgtttgcaaactttgaattagcaagattggagcaatacctactttttatgttgcatgaatgttaaacattttcctctgtgaaacactaaatgttatttcttttaagcttatataccaagatagcgtccattgtatgagttatgtttttgtttctttaaaggcagacatcagttgcagatgttttaaatgaatgaatttagcactctttttgaggatatgtgcattgaactatgcatatgcatatgcttaacatatcacatgccaaagctatagactagttattaacgcattgtgctaaaattcaaaatttttttggatactttatgtgtgtattacagttgcatgtcatttggtatttatgcagattttcactgttattttgttgtcatttaggggccatgcagtccgacctacttgctgaagttgctgatggatcatcgaatgttcgggaggtttggaaattatcgttcaaatagactagtattctgcttgtgatcgttgaagaaaccacaaacatgtactggctccatattggtcgagtggaagccttagtttaggtgtttcttgttctattaatgtactgggtcagttctgagataattgctacctcttttcagaggtcttatattgaatacaggaacatccttttactctttgaaaaactcatctaagtaagttttactgagatcttgatagttaccactggattgcatctcttccacttatccccttctctctgtcattatgaggtttacatcgtcttctcttgtactctcatatttgctctgacaaagctaacacttttttaattactctttgcaaagattctgtgtaattccaatggcagacagaactgattcactgacaactgacacagtgacaagtcagcagattaaggaacaagaaacaaaactgtacccccgaaaacatcaccttccttatttccagatgaaatcattcatgccatgctgtcatgcaatgcagccaggaaatttctccagtaattacaagatggggatgttctccgacaaatgataagggagcagctgtgaatgcatgaggaagggacatggatgtgaaaggtcaggggtagtcccatgtggcataaggaatcaaacattagagcaatccttgtccttttcttcatgtttcattgttgctaatgtttgtaccacattggggtcattccatgtgcaccatactgttcatccctccatatgatctgcattcatcttgcagtgttatatatatctttgtctgtcagctaaactcaccttgagcttacaatgatgggcttgcaggaatccagcatcggtggtcggacggccagcttcttccactaccagaggctggaatgccgggatgacggtggcccgccgcggccat

SEQ ID NO: 44504 - DNA, 23958 bp, Oryza sativa
tcttccatgtcaaaaagctgaaatggagcaggatcacctcggtcctcctgccaaggaaggtggtggcggagctctcctccaagatccgccgtgccggggcgacgacgatggagggcgccaccgacatctgcccgaccatcatcttcgcgtcgcagtgggggctcccggtgctctccaggccattgctggctggtaacaaggccaggtatcttcaccatgggaagggcttctgaggaagtgagaagctttgtttctgtgcctctccaagtttgatctctgctcctagtgagatgttcttgtgtgtcaatatgtgatgatttgtgtccggtgaattacttagttgaccctgtagattcagttgtgtgttctattgttgtatacttttgtgttggtctcccatcgatcaggatctgatcttaggcactttgctatagttggccatgatcagatcttccttttttgtgataattcagtatagtccaagttaatgccgagtacatacaggatcaataatgtttgattgttgctgtcctctgatgcaaaaataaaaagaaaatataggaagaaagaatgcagtggctagaattaaaaataaatatcagatttataccataaatttagttgaatcaaatccatcagtaaagactgaataagtgtgaatatgtacgaaccaataatcagctgatcttttttcccctggccattgatccggcactgctgctggctcgatccgatcgtacatcggtgagctcagaacatctgcgcgacgctgctgggtcacttggctagttgggttggagaggcactaggagacactcgtatcattatttcattcattcacggagagattgtagtataatttgtgttccagatcttgggcctagggaaggccctctcatatattatgaattgatctgtttggtgacgttagtggaagtcccattatttgcgtttaatcaggcttatccagctgagctgatcgtgacatagaaaacgtgacaaatcattacaaacttaaaatgtgaaatcagcggatggatgatgtggaatttagccatttggtttcatgctctatcaaattttagtagtacaagcgaagcgaagtgagtgtagtttaactaattagttttcttatggtgtaaccaatccaaccgagttcaagttctagatttcacactggtacttttatttatggctaattattttttattgataaacgatgtacccgtcaacagtaaggtgttcatggtgaattcattaatctcagtatgtcggtctagtcttccagtctagagcgtttgtgttttgtttctaaaaaaaattggtagtacaaagtttgggaaactacaaaatttggtatagtaaagttgctattatataatacaatgtgtttgtcatataggagtagttgattgtaatggtaagtttgccacatatttgagtgcggtatctagtacatttgacactttctctgtctatccccatttttcctctctttattgaatttctttcacctatacttttcttaaactttcacttagatcaactaaccgtcgaggaactgacaaaaggttcaaaggtgagaagagattatattctgtaacaattcctcactccagtcaaagtctcccatccactattgtcaccactacctatatggctatatcctgtacaattctttcatagccctctacctagatcttgtgctctcaagcctatgctaatgtgacttcgcattcgtctcaacgatatacctttacgtttcaaaatattatatcccatactaaattggtttattcacattccataatcttagtttgttttaggatagagaacgtatgtaaaaagtaacttaacatattatttgttaaatgtgaaaatttatcaaaaccaacttatattgttttgcgatattttaaccggttttttagtccaatgtgacaagtccttttttaaaataaaaagtgtgtccagttttagattaagtattgattttttagaccatttattaaatatcactttgtagccccattatacaccgtgagacatgtacgtttgaatcgaccttattaagcttaaggctatcttttactttatgaccaacaataaggaatataaaaaaaatcttcaaattctcactcctcgcaccacgctcacctctggctgtgtttagatccaaacttccaactttttctatcacatcaacctgtcatacacacacaacttttcagtcacatcgtaccaattttaacccaaacttccaactttggaaggaactaaacacagcctctgtcctcaaaattttgtcatgattctgaccttactcagagctggtgtcaaggttacgggtaaggtataccctttacccttcgacatacgtcacatatcgatatggtatacttgcgcgctgtcacaccctgaaaattcaaaatatataaattgttgtttaattggaatttttagaaataattttaaaagtcttgaagagaagatctagttttaattaataaatgccaatataaaaagtggccagataaaatttcattaaatactttgcttaattctataattcctagatttttctgggatttatttgagctaaggaagtattttaataaatggaattgcatttaagaaataatttaaattgaaaaaggttttaaaagtcttcttttggcgtcggcccaaaacctctcttctctctcttcggcccagccggcccagtccgccaccgcgcgcgcgcgcgtccgcccgctgacaggtggggcccacctgtcgggttcgtcgtcctcctccggccgaaaccctagtttcgcgtcgccgccgccgctttccaatccggccgctcctttccttctccggccgaattgatagaggggaaacaatctccgggatctcctctaccttttctcctttggaatctttggctaaatcgttttggaagttcgtggaatcgagttcgtttcggatcggtttccctctctccaagccgagctttccttcgccgttgccgccgccatgggccttcgtcgtcgcctcctagcccctttaaaaggatccccggtgtctcctctacccgtcgccaccttcgccttcgcctctcgtcgtcggaaaagccctagcgccgtgtgccctagctttgccgtcgccgccgccgctccagccgtgcgccgccgtcgtttcagccgtcgccgtcgctcgggaagaccaccgtcgtgctcgccaagtcgtcgccgtcctcgtctgccccttcgccgtcgccggagatcgtcggagcttcgtcgccgtcgtcaagccgaagagcttcgccgcttcctcctcgtcgccgtcgccgtccgttgaccttccgccgtcgttttggtcgccggtgagttcgccgtgccgcccgcttcgtcttggtgccctccgtttgcgtcctcgcgccgccgttcgccggcgagcgtgcgccgttcgagccgtctcctccgccgagccgccgctgtcggtgacgtcaccgctgacgtcatcggggtcgtccgccgtgagccgccgtggacccgatcgatctcggccgtccgttttggattggttcgatctcggccgtccgttcgtgtgaaccgccgcccgtgcgcccggttcaccaaaccctagcccgctgacgcaataaaccctcttttccttttcaaaaataattcattattgcgtcataattcaattttaaccgatataagtgttttaatccgatttaatctttaaaaattcataactaattcatcttagctccgatttagttggttcaagtctctaaatttttctaagattgagatttacactttaaaaatatccacatgtactgttcatgcttgtttatgtgctgttttggtgattttgctcttttctgcttagattccgtcgtttccggagagtccgttttcgcagaagaagagtttgaagagttccaaggccagcaaggcaagtcacacagatcccaaacaaccctttgagcatgttgatcctatttaaagctattgtttctattcaactattgcatctattttcgaatgtcattgggtggaattgacctattctttgttatggcccttttgtacttgattaccttattccttgataccttgggttattacaatttgactagttgagctttatttatattggttcaactagatattagatataattgcttagccctgtttagaaacattagtacacattcgggataactaatgactcactattatttaatgatggtttcatgatagttcacgatggtcaatcgtgattagttaattaattaatgtgccaactaaaacctggtaatggtgggttgtgagcacatggttttgttggtcgtgctcatgacaattaaggaccggttcacgagtttcggttgtgaaacattaaccgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtggattgtgttatgcgaggggtattgtcacaactcctttccgagataccgtggtggtattgaggcacatggtgacatgatgtggggttgtgtcttgtgggtacagtggtacacctctgatcagagtaaaactattcgaatagccgtgccagcggttatgggcgggtctaacaatgtctttcgtgattagtttcacacttctcaccatagtaaatgatgattaaattggtaataatttgattagctcctggtttggaatggaatattcctggtttggagatagaactgtgcagacggggtggttgttcagaatggttgggcctatacaacagggtatgttgtatagcgttggattaatattgtttaattacttaactgttttattaaattctcaaatgtttgctaaatgctgcttttgcaaatgaaaccctattatgccatcctttgttatcttgtgcacttgcatatttgctgcgtggcttgctgagtatgtcatatactcaccttgcaatcattcatcagaggaagagttctacaatgaggctgatggagtggaggaataggtgtagccttggtcaagctgcctgtggagtggagccgtctgcgccgtttatttattttccgctgcttagatctttattgattgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattccgggcgtgacacgcgtatacggacgtttttggcatacgttaaaggaattcatcatggagttcacggatggaaggagtcatacttagacagaactgggtcatcattgtaccgtgccgggtccgatgtctccgagtcctacttggagaccagtcgacttgcgatataaaagggaccccccgggaggacctaaggcattgaatctcatagccaagacaaccaccacagcctacgaagccggagcctacaggagccaagtcgccgggtgatctagtcgaatcaactcgactacgatctcgtcggtatcatcgagttccgcttttcccttcgtaatatgtggtttacatcatataatcccatatcaactggattagggctattacctattaaggggcctaaaccagtataatctttgttttctgtctgcttgatgtcgtattacgtagatcttcgtactagcgtaccccaataccctctatatccagtctacgggtatcccccgtcgacagtggcgtgccaggtagggggacttggtgttcaagattctactactatgacaaccagcttcgtcgacaacagcgtcaacaccaacctcaaccaaggagttcctacttcaacaatgctggtgtggattcaagtcaacgaaatcgtcttcccggtttacaccacggtgccgatctcggctggtccatcaatgatcggaagcgagaacacaatagctacaacccaggatgactccatgtcgaaggatcctcccgctgaagcggagaacggaacgtcgacgacatccgagcccgagaaggatcctagtgcggccaaaccttgtctttccgacaagaatcacgagccgacgaggatgacttccgaggtcaaggtcctggtgtcctatccacaaaaccagaaaacacaccttgcaagcctgctgggtttttctcaacgtccacactgaaattcgtgcctacaaagagcgtggaattcagcgtacttcttcaacccgtgatgtctattgtcctattcacaagataaagaatcacgacctctcaacctgcaaggtctttctcagcgccatgaagacgtcacctcctaaggtccagcagtcacagatccccctcaaggatgaggacaaggaacaaggagcgacgttgatttcagatcgattccttggggtaatcgacatcgatccccacgaaccatcagtcttgcacctgctcgaagactatggctcatcatcaacaagtacgccgcgcgaggtattggctatcgatgagaccggcacatcagcgcgcactaatgcggaagcggagaatcaagtgactacaccagcccagcacatcagggccgtcaacgcaatactgagggaaaccccttacgatcccgttctgaacgacgatctcgcacgatggacagaacggttacgggaatcagtgaccaacctcagcaacgcgttcgaagaggctgctgctgcagcgcacctagaacagccaccaactggcggtgctaatggtgaaaaccctgaacagcgggaatcgcctcatcgagccacccctccacctcgtggcaccggcgatctccgcgatcacctaaatggccgccgagaggcgcgacgcgcatgagacaacaagaaccgttcccgacatcgcgtctcttcacggcgtcacgataacgaagaacgaggaggccgttcgagcgaagaccgagatcgtgataaccgccacaaccgccacgatcacgacgatcgcgaaccgcgggtgctgggcgatactggtcgaggacgtcgccataatgacgacgacgatggagatcggcgctgagacaacaacgggagacgacaacaggattctcgataacccgggcgatgtcctcgtaatcgtacaccggaatcaagtgacccatcatcatcgtcgtcatcttcctcatcctcatcatcagatagacatccacgaaggacgtacgatcaccgacaacccaccacccccagcgctgggtgtagagctttcagccgttcgctacgtgatgtccgatggcctgagagattctgaccaggagcaatagagaagtacgatgggagtactgacccacaagaattccttcaggtttactccacggtactctacgctgccggagaggacgacaacgtgttggcgaattacttgccaaccgcattgaaaggctccacgcgttcatggctgatgcatctctccctactcgatttcttcgtgggcagacctgtggtagaagttcgtcgccaacttccaaggaacttacaagcgccacgcgatcgaagacaacttacatgcgttgacacagaacccgaatgaatccttgagggattatgttcggcgctttaatgagtgcagaaatacaatccccgaaatcaccgacgcttctgtaatccgcgccttcaagtccggtgtgagagattgctatactacccaggagttggcaacgaggcgtatcacgactactcggagattattcgaaattgtcgatcgatgtgtgtggagatcatgggtatcccatatctacacggcgatggtattcgaactaggtacaggatacctaatgtagatagaatatcttatttgtatcttgggtttgtttcttaacttgtgtatcaaggaaacaccctgaaacttagtcggttacgactgtatcttacctatattttcatattccgttagggatatagattatcttttgtaacccggactcctttccatatataaggggggtccgggcgcctctaggggcatatgctgatttctcctgaatcatacaatcaataatacactcggcggattcatccccggatccatctacgcttaaccttatcattgtatttccctattttgactgtcaaacgtcaagttttctccttgaagttgtcagtcgggggctatcatcataataatggagtgtgattttttatcaattcagtttgcttacttggtttatcattgccttgtttggtttttctacttagtttgcgaggactgaaggtttttaatagcttctttgggttttaggctcaacaaagcttagcaaaaacttttaagaaatcaaaaactttgcaagaatcatcaagcacagcataaatacaccagtattgtacaaattgagcctccatacattacattcatgatcagtcagaatcagttctttcatcatcagagtcttcattactcggctggaggtcgttgttgcgaaattgctctacaacatcgctcgcaattttgtcggccgcattttgcgcactgctgataagatcaagggcagcttcttcacttgtcccgtctgcaaatccatcaatggtgtcgacttcaattctcgggtacaaggattttgtcatcgccaaggccatgccagctcccatacttccagctttcttgatattcttgaaatatacttccggagcaacactcagcttgtcaaatatttcggttgcgtcgagtgcactcggaccaccattattgaggaacatggcttggataattggtgcagcggcgttggcgacgtcatcccttgctccttcaagcctcttgatcttaccaaccaggacgtcaaactgagcttgagatttgatcttgcgatctacaaaacacattcatgatgagcatctgttgcattataaggagagaagctcagactgttagctggcgctaccttcgacttccttcaaggctgagtccctttgcgcagccagttctgtcttgtctctctccagggcttcaatttgcctcgccatctgttccatcctggcggcttgcgctgtttgaaatccagatggttgaggatgcaattatgacagcataaatcaatggaacagatcgggatgattaccttttgaagaaccacttagttcgaagtttgcatcctggagctgggcgattcggtcccttaactctttttctgtctttttggcgcactccttggcctcatgcagctggtccctgactgcttctagagttcccaaatgaggaaccagcttttccaaagttgtagtcttggcctcattgcgaagatggattctctgcatgatggatcatggtttagtttctgctaaaaagagaacaaagttatcgaaggctgtcacccggaagacttacatttacaatacgagtggcttctccaagcgctttctttagctggcacacttcttcatcttctttttgacggtttatgactataccggcggcttgtgagttctcatcccaccatttgatcaagataggaggacgagagtcgtcggtcgcctttatgcgaggaatttcttccccgtcatcatctgatggtcctggtgtgtttccaagatattagacggataaactgaggttatttaaatcgccattgtttgagaagacaactaacctgaagatgtacctagctgagcgtgaggagatctttgttctttacctgaagacccagctatcgagtcgttaccaacctctggtccttgcgaagtcgtcgtctgcgcttctacttcgggaatctctggatcagggcctgcgtccgactggtttccagtcgggggctcttgagttgttgccgtttcagtcgttgccgactggtttccagtcggcggcaggtcactcggattggccctatctcctgaagcatgggcgccagtcggctggctttcagcagtcggctggttttcattagtcggctcggggtccttggatatattttgctctgtcatagccggatcagggtcttttccagatggatctatatcagatggtttcctgcagagtgttctttcagtattcagtatcattttcatgagaaaaacatgccgaagcggaatcatatcgagaggtctaatacctggaggatgttctgatctttggtatcgcacggccagccagttttttcctgggcatggtacgctttgggggtttattaggcgagcccttatccccagatttatcatcgtcgccttcatcatcatcaagtaccagctttcttttacgaggacctgtttgatcagccaatttggaggtctgaggttgcggatctggtctgatcgttggccctccgcctccctgagcggtgtgttggcgaggagaccggcgctgagagactggtggatctgacttcatcaatgcatattcctggacaagatgcttccatagttagtcaactcagcgtgaagataaaactatgttctgatcacggtttgaggatttccgatgcatacctgtggaggcggattgaatgcattatatggcacgactggcagttgatgagagtagctgactacaattgcatttgagaagattttatacatcctctccttcatgattttgaaatccagggagtctggttcttcacggttgggatcatgtttgccgtcgaactcgaatgctgtgcgggatctttccttgattggcgccagtcggcatttaatgaagtgccgagtgatctgctctccctgtaagccttgttctttaagatttaacatacgatccaacaactccaaggcttgtactgcttcatctccgatcggaagagaattccaagtatcttggtacactggaggaagacaagagtacccgggaagagcaggctcgggattctgaacatagaaccagtttgcatgccatcctttgttcgaagtcttgaagggcatcgagaaatatttttgactcagagttccccttagttggaatcctgcccccccgactacacacggtttgttcttgtttggttggggtttgaggaagaagatccggcggaatagggcaaagtgaggtttgatccccaaaaaggcttcacaaacatggacgaagttggcgatatgcactatggaattcgggtttaggtgatgtaagctgattccgtagaaattcaggatcccgcggaaaaatttcgaggtcggaagagcgaagccgccatagaagaaatgcgagaagactacgatctcatgtgtatcaggggtcggaaaagtctcaccgctcgctggccgccacccgatgatctccttggctgggagaacgccgtgcgccaccatctccttcaagttctcttccgttacgtcggatggcgcccattgaccttcgaagctttctctctcttccgccattggtttcactcaaatgtgttgatttgatttgagggatggcttgggagaggtgagggattgaggcggtggatcacgggaaggattttgatgcacttttcggaggtggatttggccggagttgagaaccctagttcgccggcgcagctttacactgtagcagggagtggggaaaatggcgagagttccggcggggaagacgaagcgtcgcttggatatcggattttttcagttaagggtatcggaggtgctaatgggcctaggcctgaacagtacttcagcccaatacttttaacagcgtggcccattgtgttccttagggacttaggcatattttgctttggcaatattatgcgcacaacagtgttgcccaatgctgatgaaatcctttttatgcggtcatataattctttggaattattgcaatgcaaattaaaaaggtgcccgacagaaaggcgttatgctgtttttgcaagcttttttaggctacaaaagctgtttgggttaactagggatgacttgtttttattatagtcatttccttggcgtgttatatgcctgttttcatggtaaatagtcatggcctaggctattcgacttatttattaccataatctttataatacttgatgggtaatctttagagtttttatattcggatgcctgtcgagtgtgttcattcgtgaaccttttagagtgtaaaccactcggatttcttttattgtggctaaaaagcagtcggctagcatgcctatttaggcgccgcgtatgcttttgtcatataatgcacaattgtgttattattttgtctttcaactatatgtttagtttgttaactaatcacatagttgggggctacacctaattaggtgcatctattcgatgcaccatattctttatcttttcgccctttacagtccactcggcaggttttggcttgaagagtttgaagtactcggattatcatctttgagaaggctacgatggtcgactgcaaaggactcgggggctactgtggagatcatgggtatcccatatctacacggcgatggtattcgaactaggtacaggatacctaatgtagatagaatatcttatttgtatcttgggtttgtttcttaacttgtgtatcaaggaaacaccctgaaacttagtcggttacgactgtatcttacctatattttcatattccgttagggatatagattatcttttgtaacccggactcctttccatatataaggggggtccgggcgcctctaggggcatatgctgatttctcctgaatcatacaatcaataatacacccggcggattcatccccggacaggagtagggtattacttcttttataagaaggcctgaacctgtataaatcctttgtctccaaacccatacactttcctagcttgatagccacccccttttattattgccgaaatctagtttcgacaatgtgctcatgcggacgacgcactgaggcacaagaacgacaaaccgaagaccggaggagataagaaaccagccaaggacgcacctgagtcaagcaagaagaaaaatcgcaagagtgggaaaaggaaagctcaagcggaagttctcgcaacagaatacgcggaccctcccaagcgcccagacccataaggcagcgacacaaagaaaacatggtgccctatacacaagtcggacatacactctctagaagattgcctcgtcttcaaaaagtcgctcgcaaaacacatggcattggaaaaaggcaagcgagtacgcgtggtcgagaaggacgctgaggcaactgctcaggaatcggactcagcatacccagactctgatctccatgtctcgtacatctttggaggttccacggcatactcctcaaagcgagaatacaagaaagtggaacgggaagtttgttcgacgtggcaaggagctgtgcccaaaatgaagtggtctgagcagaagatagaattctcagaagaggaccaccccaagactgctgtcatcccagggcgatatccgatcgtggtcgaacccactattcggaatatcaaggttgcgcaagttctgatcgacggcggcagctcaatcaaccttctcttcgccagcaccttggacgcggtggggatcccaagaagcgagttgacacccaccgatcaaccctttcatggaatcactcctcagtcatcgtccaaaccattgggcaaaattatgttgcctgtgactttcggccaagcaaataacttccgaacagagcagatcaccattgatgtcgctgaattcgatacaacatacaatgctatcattgggagaactgcactcccgaagttcatggccgcatctcactacgcatatcaagtgcttaagatgccgggactgaagggaacaatcactattcaagggaatgctaagctggcagtgcaatgcgacaagcggagcctcgacatggtcgagcacacgcccagcccacccgccacagctgagccacccaagaaagtgagcaaaacaaacaagacgccgaaatcggacggcgcaatcaagattgttccactctccagtgccaaccccgacaagaccgtcaagatcggggcatcactaggtgagaaataggaactcgcgctcatcaccttcctccgcgacaatgctgacgtgttcgcttggcagccatccgacatgccgggggtacccagggaggtgattgagcacaaactcatggtgcgacttgatgccaagccagtaaagcaaaaactgcggagatttgcaccagatcgaaaacaagccatacaagaagagctcgacaagcttctcaaagctggtttcatcagagaggtactccatctagagtggctagccaacccagtcatggtgcggaaggccaacgggaaatggagaatgtgtgtcgatttcaccgacctcaacaaggcgtgtcccaaggatcacttccctcttcctcgaatagaccaaccgatggactcaacagccggttgtgagttgttgagctttcttgacgcgtactccggctaccaccaaatcagcatggcgaaagaggacgaggagaagacagcattcatcacgccgttcggggtattctgctacgttaagatgccgttcggactaataaccgcaggaaacactttccagcgcacggtccagggcgtactcagtgaccaactcggaaacaatgtcgaggcctacgtcgacgacattgttgtcaagaccaagacaaccgactcattgattgacaatctgcgggaaatgttcgacaacctccgacgataccgcctcatgctcaatccagagaagtgcacgttcggagtaccatcgggcaagctgctcagtttcctcgtctctggcagagaaatagaagcaaatctcgagaagatcaaggcaatcgagaacatgaagtcgcctacaagactcaaggaagtacagaagctaaccggatgcatggtggcactaagcaggttcgtcgctaggatgagagagcgaggaccacctttctttgccctgctgaagaagcaagacaaatttgtatggacacaggaagccgaagaggcattcattgcactcaagcgctacctatcaaatccacctgtacttgttgccccctaacctaatgaagaattatttctatatattgccaccacgccatattccgttagcactgtcattgttgtcaagagagagaaggtgcaacgaccagtctactatgtcagcgaagctctccacgacgcaaagacaagatattcacagatccaaaaactgctctacgcggtaataatgacatcaagaaagctacgccactacttttaagcccatagggtcatagttctatcctccttccctctcggtgaagtagtgagaaacaaagacgttgtcggccgcattgcgaaatgggtagtcgagctaagccaatttgatgtccgctttgtgccacgaacagccatcaagtcccaggtacttgccgacttcgtagccgattggactatgcctgataataagtcagacaaccaaatcgacaacgaaacgtggacaatggcgttcgacggtgcacacaacagccaaggagtaggggcagcattcatcttgacatcacctttgggagatcaattcaagcatgcaattcacctcaacttcagggcgactaataacacagccgagtacgaaggactactcgccgggataagagctgcagctgcactcggagtcaggcaactgatcatgaaaggggattctgaactagtcgtgaacaaggtgcataaagattacaagtgctctagccccgagttatccaagtatctcgcagaagtcaagaagctggaaaaaaggttcgatgggatcgaggtccgacatgtataccgcaaggacaacatcgaaccagatgatctagcacggcgtgcatccagacgagagccactcgaacctggcacctttctggacgtcctgacaaggccattagtgaaagacgcaagcgacgaagatagcccgatctccctcaacaacagctcgggggctacatagatagagcgcgccgttgccgatatcgagaccacagacgactggcgcaccccactcatcaaattcatacacagcgaagagttgcccgaggacgatgcagaagccgagaaaatatcccgtaaagcaaaagtctactgtataataggtaacgatctgtacaagaacgcaccaaacggggtactcctaaaatgtgtctcgtcggacaacggcagacatctcctcctcgacatacacgaagggatctgtaggtcacataccgccggtcggacattagttggaaaagcttttcgacaggggttcttctagccaaccgccctcaaagacgcctgcgacatggttcagcggtgtgaagtcgacatgattcgacagagcggctacaggttcctattcgtggcgattgacaaattcactaagtggattgaagcgacacctacaggggaaatcaaggccgacaacgcaatcaaattcatcaaagggatattctgcagattcggattgccccaccatattataacggacaacggctcccagttcatcaatgccgatttccaggattactgcatcaggctgggagtcaagatctgcttcgcctcggtttctcaccctcagagcaacggacaagtcaagagggcaaacaacatagtactacagggaatcaagacccgcgtctacgacaggctcatgtcacatgacaagaagtgggtcgaagaacttccatcagtactatgggccgtgcgtaccacaccaacaacgtgtacggctcagaggccatgctccccaccgagctacgatatcaaagcgcacgagcacagaagtactccaatgagaatcaggaggagcagcgaaacgacgatgtgaatctactcgaggaacatcgcgaacgagtcgccgttcgagcagccagctaccaacaggcccttcgccgctaccacgagaaacgcatctgagcacgcacactttcgatcggcgactacgtcctccgacgggttcaaagtcaagcagggcggaacaagctctcacccaaataggaaggaccgtacacgatcacacaagttctgcggccaggcgcattcaaaattgcaaacggcgatggtcgtgagttggctaattcctggaacattgatcaattacgtaaattctatgtataagtcaatagtatccatacttgtaagacatcttacagcttcagtaaagcctattttcaggtacatactacaatcaaagtgttcattcccgatgatcccttacccagatgacacctagcgttgaaacctatcctcatgtccctttacgccgtcttgacaaggcctctgaggaacctaagggaacttcggctggggacgcccagagcagataaggccttgtcggatcctgtagagacgaaagaccatgtaagatctggtcgtgtaagagttctcgccgtgcgtattaaccaagctgtgtaaatcggaaattaactttccaacttcacggctgggggctaggatcagtgcttgttcaaccgaggcaggtcaaaggtccaagagccttatcttccaagaagaattctccgatgacaaggctgggggctagggagagtgtataactcaaacgattgatcgaagtcgcgaagtgagaagacactcatacacgctacaaccagagtaagaaagcttagttagatagatctcttttctatttcacaagtacttcttacaattccataaaaatccaaaattatattacactttttccctaagacatttgtcacaggacacggagactaccaggaaggccaacgccagtccatggactggaagaccttctccgccagcggcaccatcgacttcgccaggccatctatctccgtaggagttctccgagaacgagaaaacccttcgtggaggaactcgaggtgcagctgcggacgatgatctcgtatgcaagccaatatatgccccccagcatatcggctcgatcgacgacactactgcttcagggcttcgtcgatacgctggctgatgccttcgagctaggcgcaggccccattcatccatgagatgtatccagccgccgattcctcgggatccccacggggtactcagagctctctacagactcttcacatagaggtgcagcaactcttcaaatacgagttgaaccacacctcgcatagagtgaaagtgcatctaggacccctcatttattttggtgttaatgacaacacaattagagggtaactaatgctttttgttgagatgtatgcaaggatgaaaaaggagtggatgtcaacacaataagtattgcggcatcttttgtggtaattgtcttctaatccatgtatatcttgtgttcttgagtattaggatgccgtactattaagagggatgccacatgcatataattggtagaacactagtgctcaaaatcatttatttgaagtgttcctgttttatgtctgtcggactatccgatgttgatcagactatccgatgctcagactatctgaaatttcacagaactttgctcactatcttgggtctgagtgttggctaaaaaatatcggactatccgatataaggtcggactatccgatacgtcggactatctgaaatttctcagaacttcactctctgttttgaattgctttttattccttttgagtgagttttaaatcagactatccgatgtgatcggagtatccgatgatccagagactccgaaattcaatggaacttgagtctctgtgagaggatgaaattcttggttcaaaaataacggaatatccgatatgacatcggactatccgatcgatcggattgtccgaaattctccagaatttcgttctctgtctctggcctgcttgggggtcaaaaacatcggactatccgatgtcacctcggactttccgaggtgggatgaaaagattctctcccaacggccacattttgggggcttctataaataccccccacctaacccttttctagggttacccaactcatttcattctcattcactttgggttgtgcttggtgctaaggtgctttggatctttgagctctttctccctctctcaaatctctccttgttctttgtgtggtggatcttggtggttgtggatttggggtttgtgggcctagtgtgtgtttcacttgatcttgagcactagggttgaccaagagttgtgtggtgtttgttactcttggaggttgaggactcctagacggctaggtgtcactcccgagccaccgatctacgtgtggttggccgggagaagtttgtgaaggccggatctcgcctccacaaggaaagagataccccttagtggaaggagaagtgcttagtgcaacctcttgaggaaagggttagcaaagacccggctcttagtgagctcctcaacggagagtagaatcccctcaaggatttgaactccgggaacaacctggtgaacttcattgttggtgatatctcttctcccattatttagctttgcttttgtgccgctatagatctagtcgctgtttgcgccatactcttgtttgtgcactagatcttcttgtagtgttcttttagtggatcagacactctgatccaacatcagactatctgatattttcggatagtctgactgtggatcagactttccgatcctaactcagttttagcttctgcataaagttttaaattatcctattcaccccctctctaggcctaattgaccctttcagagagttttacaaaacatgactaaagagtacaagaaagccaaaatcctactcttcaaaaagcgggaggacagactcccccagatcgtcgacttcttccatcacatccttgcgcgcgttgctagccgccccctgatccaaaatcttccgcagatcgagtttaggatgcgccagcctcacatatgcaaggacatggcacgccctagtatagatcccgttggacgtctcctcttcgatcctggccgcgtgcttggaggggatcgcctccatcgccgtcgccagctcagcaagcgaagttgtcagcgagaactcatcgggattcgccgggatggtggacttgataccgcactccccggcgagctggtgcagaccagtgtaggtgacccgcaacgagcaacggatttccgacaagttgttctcgagctccgacatgcggtgctcaagcccctgcccttgtcgcttgttgccggccaccagttccctcattttctggaggtcctcgcgactccgccagatcacgcgtcagccggtcgacgcgttcattcgccgacgacgccatcgccgctctcgcctccgcgatctcgcggctaacaccgcgagcaccagcctcgaggaggcgccccatcgcgatctggagctcttcccatgtgaggacggcagtcggcggaccccgaccagccgcgagatcgctggctgggccgcttggcttcacctcgcggctcctgggtacgaccacgacatgtgtcgaggccacagcaggagacacgctggaagtccctccggacccatcttgcgccgcttttgcctgcgccgccctgtgaaaggctgcaattgagacatgctgcaagagctcgatgaagtgataaaacctcaaagttcacccacttctcgccaagcgtcacaagccattgccgtcgtggaggcaggggagatgcatccgaggcctggagtataacgggcatgatatgagggggaagtttcccgactacgcgatgaaggaccaggaaaacttaccgaaggggtggacgtcttccgacgatgtccgaccacagaggagaatttcctcccctttttcggaacgttgccgccactcattgtggcagcagcggcaacagcgtcagacgcctccttagcgactttctccttcagcgacgctgccacctgatggtccacgagcggcccgatgatatcagttagagggagagcctacgcttcatgatgtcataatgcgatcccggaagaaaaatgcaaaagggccactgagtacacttacattgatggcagtttcgcgttcggctacccctttctcgcaaagggggacagggacgttgctcgccgttgtcgagccactgatcatattttggccaacgcggcgcctcacggttgcgctgtccaagcctgtaaatcgagaccagaattcgataagtcgggaggaacacacacataagggagtcaatttaactacaaagaaaaatactccgaggagaaacccgggtcgcgtccttcggtccagaataatcaaaggctgggtgggcttgagcttggagcggcaggatccgcctaccaatgaagtcggcaacgacttcataccccgacaacccccgtactcggaggtcatcaatgatatcgatgaaagattggagggatggggtcaaggcgggtttgacggtccaagatgaaatcttgtctggttgctcctcaggaataatgaagaccggatccgaatcttctatctgaagacagaaccacctcccccgccatttgctgcgagatgaggggcactggaaggggatgtatcgcgacttcagaccatcccgaagtcggaaaccaacacatccggacaccctttttaggctccatccagcgcaactcatagtaaaagcggaagaggtcaagaaacggctctaccccaatataggcctcacaaagatacgaaaagatacttaggaaggcgatagaattggagttcaaatggagcaaggaaaggccgtagaaattcaagaccaagagaagaaattcagaaggcggaggaagaaaaccacagagaataaagtcctcgatcgcaactatgcgacccaggacaggctggggttcagtacctcctacttctctctccatggtcccgcgaccgggaagggcgccatcctcctgcagtttcttcagcgacgcgctggtggaggtagacttgtcgagatccattgccgccgaagatcaccggagaagggaccgagatgcgctagctagggtttttgcgggagcggagaagatgaggaacgcttggaggctggagagttttttcacaataggcggacttcaaaagggatccccaaaactcatttaagtagctgtacttccgacggtgcgaattccaaggaaaggagagagattgccgccggaaatttctggatccgttacgcgcggcagttttttggacttcggtttaaattcactcgtgaccgttgagcttcatcgggcgctgtcgatcactccttgtctctcggtccttacactgagaacaacgacagcctcgacatcagaagtcatgatcggctacatgagttcatttaagcagaagtcgggggccattgtcagggttacgggtaaggtataccctctacccttcaacatacgtcacatatcgatatggtatacttgcgcgcatacggacgttttcggcatacgttaagggaattcatcatggagttcacggatggaaggagtcatacttagacagaactgggtcgtcattgtatcatgccgggtccgatgtctccgagtcctacttggagactagctgacttgcgatataaaagggactccctgggaggacctaaggcatcgaatctcatagccaagacaaccaccacagcctacgaagccggagcctacaggagccaagtcgccgggtgatctagtcgaatcaacttgactacgatctcgtcgatatcatcgagttccgcttttccctttgtaatctgtggcttacatcatataatcccatatcaactggattagggctattacctatcaaggggcctgaaccagtataatctttgttttctgcctgcttgatgtcgtattacgtagatcctcgtaccagcgtaccccaataccctctatatccggtctacggttatccccgtcgacaactggtaataaacattagaacttgtttttatggacagagcaactacctacgagaggcccaacttaaaggtgatataagcatcatacattgagaatgcctttaaaacacaccaaccaaaaactctattgtaaatcttgttttggaaacccctatcgaggatttaagtattaaaagatgtactttttatacaggagataatactccctaaaataaaaaagggtagaccaccccatcgttatcccctcctttcgtgcgggatctctctcgactgagagttggcagtgctcaaccccaccagtagaaaccaagaagaagagcaagaggattctaatttttgatagattgaaaccaacttttcaccgatacatctctaaaaaatcatatagtaagctttagaaaacctaatgttttatgtcaaaactgtagaaaaccacaagtgttatggcttgtaggatataatcctagatagtaataccatgattgtaaagtttcacagaatcccacctttgtttgtactttaaaatctaaaacataagagtgtatttaaaatttttaatttattatgttattggctaatgttgatagtttacctcttcactactttcaagattttaataaatgcataattttatgaatcgcatagaccatgaaaaaccgtgtttatatgtcacgcgttgtaatactcgtggttgtgtataactttgacttcaaataatactccctccgccccataacataagggatattgactttttcttacactgtttaaccattcgtcttattcaaaaaaattttagaattattatttattttatttgtgacttactttgttatccaaaatactttaagcataatttttcgttttttatatttgcacaattttttttaataaaacaaaaagaaaaaaatacaaaattatttatattatgaggggaaggaagtaagattttctaaaatttctgttgctgtaaaaaccattgaggtcggcaagaggaggttcccagtcggtcaactcgagtacgacctcactctactggtcacaagtcacaactaccagcacggaatacctgccactgccagaaaggacacccccttccccacatgccaccaccggaccccacccgtcagcgacccccaacccctaca

SEQ ID NO: 44505 - DNA, 1523 bp, Oryza sativa
  unsure (1)..(1523): unsure at all n locations
gaagaagcggaaggcggaggcggcgcggctggaggagacggacagggcgctgtacggggcgttccggggcgcggccaactcgctgtcccagctctacacgctcgccatgggcggccagaagctctccttccaggccggcgagcgccacgccatggtacggccctccccgaccctcccgtcttcccttcttcctgtgatgggttgtgggtgtttgggggttcggtctgatgtgatgtgatgtggtgtgggcgtgttgttctggggatgtttggggatttctcggttttgcagcgggaggattcggtttccccggtgaatttggcctttctgtggtgtttgtgttgtggggaaaggcttgtttttcggctcgatttgatgagggatttttgttccgatgcgccttcttgttagtgaaattcagattccctaagaaatttgtgtgttcgattgacccctctagtgatgtggaaattttctgaaattttggtgaaattttgattatgctttctgaaatttaggtgaaattttgattcctgtatgttttctgcctgaatctggtacctaccatgcacatataaatttcgaatagtgggtaaagaccaactaattctgtatgcaattttagttcgtagtgcgtcccttgacctcaccgaatattatattcttcgtgatgcgatgcgccaatacaattgatagcttcacaagtgctctcgcactagtagtgcgattctcgtagttgttatatcatcagttgccttttaacggcgatgcagccaaactcatttgcttcaattgtcggtgatctttttctccaataggttctgtgccaatatggctttttccacctctgggttgaaatggttgtagacatcccacccttgtgctttacaagactcaggattaggttgctctcagagggggaggggaatggaaagcagatgagaggaggcttagcttgtggaacaggttacttctgcactagtactatggatgcatccttttcagctttgcttcaacttgtgtactgttaaatgtaaagtatcgccagttggtgtgggatgcttctttcagacttggatggcattgttagcttatgcagttgcggtttacgaggatgttgatacttagttatgtttgctgattttggttttgctgtggctctgtggatccagtcctggcctattctggtgctgtttgacttcgtcaagcatcaaaactgtctgttttcgtttcctcttaaagacttaatgtgatgtgcaagacttttgcatgttcttgcaaaagctttggacggcatatcttggtattaatgcttggaaacatcctgaagctatggtttgatcagaactcaagatgtggctcagctgtgttcctggtctttgttttcacaggacagggaaacactctagctaactaccattgagcattgtctgctttactcatcagatgacaatattactagactctcatcaaacaatacactagnnnnnnnnnnnnnnnnnnnnnnnnnnnnnnnnnnnnnn

SEQ ID NO: 44506 - DNA, 771 bp, Oryza sativa
ccagcccgcccgtcgtggagggcggcggcgtggcctcatgggggccctgccattgtgaagggcgcgggccggtggcgtagcctccgctatgcgtgcaacggttgaggcagaggcggaagcgggacaccccgcgtcgtcggcgttctggatgagctcctgcagcgtggttgtgccctccgggtagttggcaagcacggagggcgggcggccaatggcgtggccacgcggagggcggcgcccagagcggcggtcgccggtgtgaccgtcgtggagcagaaaaggtagaagaataggggttgctttttagttgtttttgtgaatgattttctgatgtaattttgtggatgattttgtgatgtttttgtaaatgtggatgattttgttgttgaatttttaaatgtggatgattttgttattgaatttgtggatgattctgtgaatgaggacggtttgaaatcaatattcaagtagcaaaaaaagaaaagaaaatctttagtcccggttggtaacacccaaccaggattaaagatggatcttttgtcccaggtatttgaaccgggactaaagatcagatctttaaccctgtaactgggagtacaaatgctttctctaggagtgagtacttttggagaaggaagagatcctgtgcaatccctactttactccttcaatccttgaaaactcaattagcttatcagattcattgttttagaataaatcacattatcctaggttgagttttcttttactagcaaaaatgcccatgcgttg

SEQ ID NO: 44507 - DNA, 703 bp, Oryza sativa
ctttataacagaaatatgttcttcactcattgttcactttccagcaaagcatgaaaaaaagaaaaaatagaacgagattggagtaaacctttgtctttgtttcgcagcggacatccagctgcttcacacgcagtgagaggtaaccagcaatttgctgtcctatgcaccaaggtaagaagtggcacccaggctctagaacctcactaaacttgccgaaattttctttgatggctacagttgactgatcaatctgtactaaacccaaacactgacccatgtcttacctgcaaaggaaaacgacttaaacttgaaagatggttcagatactgcagaaagtataattttatttatttatcatctcacaagtgaagcttgcaatgcaaaatcagtgaaggtatcactgaaaagcgaggctacaaattttaggatatgcttcacaataatttgtacagattgaagttaacagtcccaactcccaagtaacagttagaaaagtgtgaatcatgcccaatcagaatgacattacatgatgacaaatataaagtagttcgtaatgcagctcaatgctttgaaaattagtaaatctgagacaccacaaaacagctcaatcatatcaactcgtggcacaatatcaaattcatcccccaaagaactcatcccatctaattatttcaaataagcgcatgcttgagacagtaaaaaa

SEQ ID NO: 44508 - DNA, 1630 bp, Oryza sativa
  unsure (1)..(1630): unsure at all n locations
nnnnnnnnnnnnnnnnnnnnnnnnnnnnnnnnnnnnnnatcggagatgcaaaaacaagaagcacacgatgcaaccaacttacctaatagtaacgtgtacttgaagttttgctttgtcacagattttcaaatctactaaccagtgatggagctagtgatgtcgtgaaacccgagcgaatactaatatttttggtgatcgatcgatttttttaacatcaacagctatctataaggaagacgctagcagccgaacccagaaagccgtccgacctgtctgggagctagctcctcaccgctgctactacccaagaattagcatatctcttatataggtttctgctaatatggaggagggaaggtgagggaaaagagcagctataaccctccctcgaaatatattagacatgttatgtttcatttgggcgatcaacaattagttaattaggtataatttgtatacgaaattaatgtgattgcattcgtattaaaaatattagattttatttttgaaatcacataaataatatattagtaaaaaaagtgtcacataaataatatattagtaaagaaattcttggataatacggattaccttgttaaacaaaatgtgccttatatttttggcaaattttgctaaaggacacttcgacttcgtagttttagccgtggaacaccgctcgaactcacttttgggggaaaatactccataaacgtggtaatttgccaatggacaccgcgtcgattagaataataatttccggttgaagaggagagaaatcatgtgaaatgtcaaaaatgcccttgggcccacatgtcagctctcttgtctgtcttctctctcttctctgtctatcttctctcccagaggggcacggggcggcgtcggccgccggggcttgaggacggcgggagcggccgcggcgcttgcgacgggagtggcggaggacggcggggaggagagccgcgtcatcgtcaccaactgcggcggaggacggcgaggccatggcgaagcagcacggggcggcgccgggcgggaggatcatgctccagagccgggctgtgcgcggtactgacacgatgggcgtgccgatgaggcggctctcggcgggggtgcactcctcaccgccgaagaatgcctggatcacgcatgaagaaatccacgagagcacggatcacgcatcaagaaatccacaagggcatatgatgcgcatgaagaagtccacgagcgcatggaccgcgcgtgaagaagtttttccccccccaaattggaaagggggggtgtttgcgatgcgnncataaagaagcacatgcacaacccgagcacatgacttttcctaagatatcatgcctcaccgttggcctctcgttgtccacatgatatctggactgcatcttggtgtcatgtgctatagaacactcacactacactcacgctgcattatctggacatgtgcattgaactcactaatttcctattaaaacccacctatatgcgcgtaatattcatgacactagacttgaatcgtagtgggcggagacatgcatcacgactccaccatcacaccgctaatgcttccccctgctccacctcactttnnnnnnnnnnnnnnnnnnnnnnnnnnnnnnnnnnn

SEQ ID NO: 44509 - DNA, 1105 bp, Oryza sativa
tttattttattctagggacagtattgttgaagttaccaaggctgtgtttagttggatccaaagtttggattttggttaaaattgaaaatgatgtgactgaaaagttgtgtgtgtatgacaagttgatgtgatggaaaaggactgaagtttggatccaaactttggatctaaacacagcccaagtcttttgaatgggacgagcttgcgccaaatcatctcaggcatctgatttaacttatgatgatttgctgcgatgtactgtattttggtttaaaatcctaacgcatcccatttccaactattattagttcgatcgcaaagtttttacagtatgaagaactacatatttgcttgcaagaggcttaaaacatggggacggtgatttgaattgagatttcagagattatttttaaaaatcattggtttgtttaattgaattttcatattttttaggatctggtgggaatatttttaaaataataatcaatgtagcatctgaatggttcgttcaaaaaaaaaaaacttcattgtcatatactaagaaaatctacaacacaaaatttctgatattttttactgccggtgtgatgatggtcagaagcatatccccgactttcatgctattgtcttttacactgtttccagggagtttttgtttgatgtgaagaagattgcttttttttttccctgacgtgaacttcaaaggattttcttgttcaagtgcttgtatttgtatacaaaactagacatttctgatcaatcacacgcctccaatatatgcaaccgctaaagtacaaactcgagcagacaatcctgatcaaagttgcaaatggtacaagtattcaaataaaagcattgatctagatcagtatatgtacaataactctaacagctcagtgcagttgtgcaagtgtacactgaactccatagtgtgtggctctttcgaattacttatattatacatgtgattctttggtaacatcaataattaaacatacagatacacatttgatcagcatgtacagggttgtacataacatccatagttcaataccaagatcaaaccatgcaagaaaaccaaaccagcaaaaaggaaaaaaaaaca

SEQ ID NO: 44510 - DNA, 709 bp, Oryza sativa; identical to SEQ ID NO: 40846

SEQ ID NO: 44511 - DNA, 5963 bp, Oryza sativa
  unsure (1)..(5963): unsure at all n locations
nnnnnnnnnnnnnnnnnnnnnnnnnnnnnnnnnnnnnnnnnnnnnnnnnnnnnnttggtttatttcaactcctagattcacctcaaatcaagctagagcccaccaaatagtctagctccaaaaaagaaaaatggaacggagcagactagatcgctccacaaaattgtactagcggcgtggagcagcattcccgtagctccacaactccaacttcaactcaatttcagaagtaacccgaaactggaaccaaaattacccgcaaatgcatgtaccgcttcccccacgaagaggagcgcacggtgcgggcgaaaaaagcggtacatcgcactactacaaaattgattttttatggcatcaccttattattttctctagcggttatatgtggaaaccgccagcgaaaatataacaagggatggggggttacaaaccgccagtgaaaataaatcttcactggtggcgagttaaaagagccgctagcaaaaacatagctattttcgctagcggactacttaaatagccgccagcaatttttgctagcaaatgtttaggaacgccgcctgagaaaataaattcaacatataaatacacccacctcagcctccctcctctctctctctctccgcctttctctggaaaacaagaattttcagaatataccaccgattacgcaccgttttcaggataggccactcaattcgcactacttttagaatatgccatttggatgcgaattttcttcgttccgtgacactcccgtccttccaccgtcacttcttaccggcgccagcaattccgtgacggagaaggaggagatgtcacctccggctcaccggccacctcctccgtagacacgcccgttcgccccaccggccattgccggtgagccccaccgtcgacggcggcggcttgtagccgagaggatctggtcgccgaggtcctacacgcgccgttccccgcacgcgcatctggagctcgctggcatgggggaggaggagcttgccgttgcatgaagaagctcgctggtgtgggggagggggagcttgccggtgtgtgggaggaggagctcgccggtgtgtgggagggggagctcgccggtgtgggggaggaggagctcgccggcgtgggtgggggagttcaccgctgtgggggaggaggagcttgcccgcgtggggaacaggagctcgccgatgtgggggaggaggagctcgccagcacgggtacaagagctcgccggcggtgcccagatgagcgcttgaaaatggcgcaagaggaggaactgacgccacgcggcttcgggagacggagtgtcacgaactgaagaaaatttgcgtccaaatgacatgttctgaaagtagtgcgaattgagtggcctatcctgaaaactatgcgtattcggtggcatattctgaaaattctcctctctccctactgctctctctgcggccttcctctaccactgccggctgccgtggcttccatcgccgccgccgcatccgtcctagggaaagcaagggcgagggggatggatccgctgccggcggcacgcggggagcgcggggcagccactgcccgccgcagggtctcgtcgtcacggtcgtcgccgcgggccgctgggaggacggatccgccgccgtcgagccgcggggagcgcggatccagcgctgccgggccgcggggtggatggatccgccaccgttgacgccgggcaacggggtggatggatccgccgccgtcgagccacggagagcgcgggatccaccgccgccagcacacggggagagcggagccaccaccggccgtggggcctcgtcgttggctgcgtcgcggatctcgttgtcaccgtcgggctgtggggagcgcggatccgccgcccgggctgcgagcggtggtgctcggtcgacgacggcgacaacaggtggtagcggcttaaaatttatgtggatttgtgtttggatttctgtgaatttctatggactcgtgcaacgatccgatccggttagtgtgtttggagatgggaacggaaatttgtgtgattgtgaatggaaatttgtgactgtaaattggtgatgtaaatttatgtggatttgtggatcgatgagtggatttgggattaatttgaactggcgttgacggaggcggacggagcggtgttgctccgtcattttttttagcctcggcaagtattaacattggcagctggtatagtctaccgcctgtgaaaattcattttcactggtggctagcttacaaaaacagctagagaaaatggattggtgctggcggttggctaccgccagcgaaaacactgtattatcactggcctttactcactggcggtggcgttggccgtcagcaaaaactcattttggccgccagcaaaaatagtttttctagtagtgtcggcagcacagcggctgtagtgcaggttccttcccctctctttccctcttctttctcttctcccctcatgtctcttccctctcctgtccatgagattttgaccaccggtggctcttgctacagacaagggtgacggtggaggcgtgaggaagcaagcccccatccctccccccctcccccaagccccaaacggtgtcccctcctcaaacacctagaaatcccccaattttttctttcaaaggtgcatgatttctgtgggatggatttatttttcggggtacattgaatcacagcaggtgttttgttctctatttctctttcaaggtgagatgataatgtctgtaggtgggttgggttgtatgcttgatttattacaagttgtttccacggttctatgacattatttcagattgatgcatatacttgtatttaaggaaaacatgatgtatccaaggatgtattttgtgatgacctagtcgttcgtattacaggataatgtattttgtggtcctgctacccgttattatttctaaacatttttattattacatatatgtcatgcaacaactaaaattttatcaattttactttaatagaaaaaatacccatgtgttgcaacgggtaaaaatattttttcagtgatacaacaactattaagaattgagcaataaattgcatgcctctctttgacttagcccacaagtgaagccacaggcccagctcgcacatacggtgcgtagctcgcacatatggcatcttcaacctacgagagacaatcacgtgcccgtatgccagagccgatcctccctatcaaattgggctgaatctttctcgatattccaaaattggctgagggtgtttgatccgctcgatccctttttatattttttttctcaaaatcggagtaaatccataacactcgggataaaaatggttaggggaagtcaccggtcggccatcattggcgaattgagattaaatctgaataatttaaagtccaattgaaagggaaaacgcgaggaaaataatgaaagataagtgtggaatcgattttttaattaattgaaggagaaaacatacggtgatacaaaccgacgggacagcgggacggaaaaaataatacggcggtaaaaaaacaacgaaaaaatggcgatgagaaaaaccggaggaaggctgatcgggaaaccagcgacaaaaaaataatacgagacagaaaaaaaaacaaaagttttatgtattttttaattagttatatatagatatgaattataaaaaaccaactaaaaatcgactcagaaacggatgacgtacgaagatcctgataaaaatattttcaatttttataatagtagagattaaattttaaccttccatacttatagcgttcaaatcattaataacaataacaactattaatcctacatcaaataaatagaaaaataacaagggtagcattttccatcaccctgggctagccaaacacttttagggctcctttggcagcccgggatcccaccgggatcccagcccattccctgggagaaaggcccgcgggggaaattgtcacgggttttattccatgtccatttggaagcccacgaggcagggatttcccggcccaatccgctaggaaaccctagggaaaggtccccgacctccggaggtcaggaatttttcctctctcgatccgccgctgcttctcgctcgcgcaaccggagtcgcttctctctcgcgcgaacaacagcgggcgccgccgcgcctccttctccggcgagacggccaccgccgggactcctcctccggcgagaagggtaagcccttctccttattcccctcctctcctcctcctgggtttccattctcctcctcctctagggtttccgcctcctctagttagctcccaatctcgctctccggtctcagcgcttgcatcgcaggcaccgacgcgtgggcgcggcgggtggcaccacggcagccggtgcaacgacgacgaagcggcgagccgacagcgcgggcacacggctccaagcaggcggggacaggggggatccaaggcagcgcgactcaccagcagaggaggcgctgaggcgcagatccgcctcctcctcctcgctgcgcgacgcccgccggtggttgcccggctaggtttgtgcgtgcccttgtagctgctgcttgattcttgggggttcgttcagtacttcagttttcttggtgtatgtatggcatgtttcttgatttggtttgggagagttataatctgttctcctattctttctaatacattgtagtattgtaccctgcagtagcatttcattttgttatggaagcgattcagaaggggatatgggtgggcgtgtggtgctcttgttttagatcatgaatgagttttggtaagatgatgttctaatttgatggagtaggttgtgctctggttttttctgcagtgtaattatcatgcttagtgcagtctaaatatgtgagatcaatgtgccagtcccaagaaatgaggaattatcacacatgcagtgaggatcattcaactagtgaggtatatgagaaattttagtctgcaaaccagtaacagtttttttctagttaattagagatgcagttcttttagttagatgctgtcagctctgttaacctagaggtagatctcagtactggttgagctgctagcatcaagttttttgttttttctggaggtattttttagtctgatccattcttgtagtctctgtcagggaactgtagaattagtggtcaatttagcatgcatgttgggactaaataaatggtaacaatcatatttttgataggaactcatacttactacaaaataaagtcttttatgctctatacttatacattagtccaaactttagtttcatgtcatgtatcaccagcagaaaatgagcaaggtggcattgtgcattcaaaaaacacaagctttggcagcaacctatatacaaagacacgcacacacagatgtttcaatctcctctctctcactcgctgcacaatacactggccaaacaaagtgacctagtagtactgattaattaaaacaacaactactactactactttttttccttatcatgtccataatgataattcataattgtgctcttgcattcttcctcttgccaggattcaatttgaattgcatgctcaacttactttcaaatatggacttgaaatagagtattgttggaaaactatcaatacaaaaacatggacttcaaatgcgtttgatttaaaaataatggtgtgtatctgcatgtagggtgtttgataccaagagtttgtttacgctgatgtagctgacaattgcaatatgttggttgatgtgcatgcatttttttacctaagctagtatcaatggccgtccttcaaatttgattgctgaagtatcactattttatatttattacttaaatttcagattatctttttcatcctggcagatttattagaatatatgaagatttgttgaagagatgatgaagaagatagaagagataaagatttaaatggacccatgtctcattcttgat

SEQ ID NO: 44512 - DNA, 1791 bp, Oryza sativa
actatagggcgaattcgagctcggtaccctttttcttgaaatttctataatatttctagagacatattttgttgttcaaacactgtttagcagtttgcctgtctaaatcccccttcccccatcaaccccctcaccctactcccaaatggtatcagggaaaattcccctaacaggagtgattcccctggaggtggaaggggatcggttagtgcaggggaaaatctctgtacgggactttttcccgggggtttcctccccctgcatccaaaggagcccttagggataaagctagctcccactagagctagtgtttgaggggaattaactatttgccacttatccaaatggtatttttagatttgccttttttttttgcccttttaaggtgatggcttcttaacaattttaccacttttgtttacgtggcgtgccaacgtggcttgcaaccttaaaaagcagagcgggacccacaaatcagcctctcccctagctttatcttccttctcgttcatcctccagcttgccgacagggaggagctcgctcccaatccggcatccctccctgcctccctccgagcccagcaccggcgagctccctacccccctccaagcctggtgccaacaagctcccttcctccctccaagcctggctccggcgcgtcggaccagttgtgcaagtctacgaagatcgggaccgtcgggttcgtggctcatcgcgcggcggcccttggggcatgctgccatgaggttgcagagcgcggcgagcacgtggtccaccgccataggcgatggagaggttcgacggcgacaagcgacggcgctggcccgatggatagcaggtgtgacgcgcccgctggcgcgatggagaggttcagagcgtgcgcagcggcgcagggcgtcgtgccgcgcttgctccgtcggcacggcctcgcccaccggagctacgcacgggtggccctccccttagcggcatatctcctcggtggcgggcgtgtggaggtgggcggccgtcctctcagcggcggtgccggagctcggggacaccgggcatggagcgggcttgtccccattggcaagctggaggatgagtgaggaggaagatgaagtgaaggggagagactggcttgtgggtcccactctgctttttaggttacaagtcacgttggcacgccacgtaggtaaaaatggcaaattgttaagaactcatcatcttataagggcaagaaaataagagcaaatttaagaggggtatttggataaatggcaaatgcaatagtgacaaatagttaaattcccaagagtttgaagctagaatttgagttcgagcccttccaaacatgctactccttccatcccaaaataagtgcagttttagcactgttcatgttcaacatttgaccgttcgtcttatttgaaaaacaattatgattagtatttttattattgttagatgataatacatgaatagtactttatgtgactaatatttttaattttttataaattttttaaataagacagatggtcaaaacgctggagacgaatatctatagctgcacttattttgggactggagatagtaggagctatctgaaggagactacgtcgagacagagacaaaacgattacgtaaagcttgatttccgccttcaggggtttctgaacgagagagagacagacggcggcgggcggcggcggcggcggcgagggagccgaagcctgagaggatggtgtttggccggagcaagtcgtcctcgtcgacggcgtctcctccccctgctgcggcggctt

SEQ ID NO: 44513 - DNA, 927 bp, Oryza sativa
  unsure (1)..(927): unsure at all n locations
tgcatcgatgcaaattttcaatacctcctatatgccatcttccaaagtcctttgagcatagttctggtagcgtgacagtgacttgcagtcttggaggctcttgtgttgtccgaatcagatgccttgactttgttgtctattatgatggattcattcaacaaagcttattgtttgtcacataggcctgatcctctctgatgtggtggcaaacaagcagtgaaagctaccagtctaccactcactcagggaagcttcgtagcaaagcaaagcatcagccttcaccttgtccagagcccagagaaaagggatccccttcaagctgctgttcttcatggccaagaaaggcaagaacaactctaccagaagagcctctgcttcttcttcttcttcctctgccgcagccgatggcgatggatcgccatggctgcggctgacggccttcgccgtgctcaccctccactcggctttctctgcatatctggctagagatgacgcgaggctggtcgccctcgtcgtcgtcggctacctcctgatgctggtgctgctgttctatggcctggccgtgcctgtccaacagaagagagactaaggtgaggcttcagcaatcagtcctcaagcatgaacctgccttgtttttttttcctttttgctggtttggttttcttgcatggtttgatcttggtattgaactatggatgttatgtacaaccctgtacatgctgatcaaatgtgtatctgtatgtttaattattgatgttaccaaagaatcacatgtataatataagtaattcgaaagagccacacactatggagttcagtgtacacttgcacaactgcactgagctgttagagttattgtacatatactgatnnnnnnnnnnnnnnnnnnnnnnnnnnnnnnnnnnnnnnnnnnnnnnnnnnnnnnnn

SEQ ID NO: 44514 - DNA, 4152 bp, Oryza sativa
agattttcctttcatgctcattgtttttttttgtgaatacacctgactgcaaaaccctaatgaactagataaaactccttatttgccatttaatgctaactcaatggaaacgcggcattcccttactgccactagttcactattgcctttcattatttgccacgtccgtcaactctgttaggatgaaacaccattaaccgtggatccaccttttttttttttggaaatattccatttgtaccctcacaaaatgggtgccatctttttcttctggccatacccacagcacctaagtccatccgttgccatctagaattctagatggacctgaactggtgccactgtttgttggcagaagctttggctagtcagcctctgtggctccaccaaatgctcagcaccatgatctggcttgagaatccggtgagcttgcatttgtacgctgctgttcttttggggaatggatgcagggatagatatggcttggaaatccggtgagcttggatcggtgtcgtatgattgaccatgtttttcaggttatatgggaatagcaattttatgctacaagacatggtttgattgggcattaggtgagtataatacttctagtgccactccccagcaagcttgaatcctctagacctagtgccatgctagacacaagtattaagtgtctggtcttattgttttggaatgggactataggattgtgcagattgttattttttttgttgcatagcatgacttcattttcttataagtttgtaaaatttgcgaaagtacttcctggatttggtggataccaccaatgtggcggcacatctcttacatgccaccaaggatgaccatgctagatgcccatgaatctgcctcattggaatggatgcaggcattaggcacacaacccatattcactagccattgctggtaaggatgcctacctttggtagagggtgagtgctctgtcatgtgttcaggaagaacgaagccgctgggttggatgagtttactgttctgttgctggcattttttttaaatttaccatggataaggaagagaaggagaaacgaggaattaggaagaatgaggaagggcaaattatcttttcttgtttagtttaacagcaagatgacagaaggggcaaatgggaagacaaaatgaactagttgcaaataagggaacatcatttttttatcctgtaagggataaggtttatatttgatggcaaataaggaaatgaataagatgaatcctatgctttgattgttttctttgccaattcatgcctccaggctccagctacaacttttcaaaatatagtttgtacttatgccgtatcttctccttaagcaccatcctagacctagcacaactacatgtgcctaataatcatctgtgtttgtagcacgagatccagtatggaggtgacaatgcatcagcctctccaagatcacagcatgcaagccaaagcactcaagctacagtgcctattcccaacacaatgagccagcagccatcaccaaacttatttgcgctaggaaatacaggattggtgcagtccaagaactcagcggtcttttcaaatgcactatctagccccgttcgccggagcctgcaaccattccacctggagcagggtggcgatgcggggtacttcgcaaacggcgttaaccgcgatcaaaactcgacggcttcgaacgattcatccatggacatgcattcagacagcccagctcatgactcttactgagttgtttgccccctctgtggagctggaagagcaacacttccagtggaacagaatgtgtgcctttgctaccacagctcatgtaggactattcaatttaacccccctcccctagcctccaatgatgctaagcttgtattctgttgctgccaatcaccagttactagtaccgattacattgctaagatattgtaacttgcatgtatttatgtccagagtaaaactgtactcggtttacctgtgcatactactacagttggtatgtggtgaaaatgtaggtggcaaagcaaaattgagaagaataaacagtattgtactgttgttccctctcctagactcctacgctaaccatttctgaagttgttatcaagctgtcgttttgttctgtcattcttatagatatactaacgttgactatttgttttatttgaaaaaatagtgtaaatataaaaaagataaatcacacttaaagtacttttgaagtgtacttttgttgataaagaaagtcacgaacaaaataaataataattttaatttttttaataagacgaatgatcaaatattataaataaaaaattaaagtgacaagtaatatgttataaataaaaacttaaagtgacaagtaatataggatggaggcagtatattttaaatttattcccaagaccaaaaacagtgcgagtgtgatcacatcatcacatgtctgctgtgtatgctgctgctccacagtaatttttggtgcgtatacggtcataaaagcgttggcataaaagcgttgaattgagctatagtattctcttttggcttgatgtgaagtgtttttttttgtttacgtgattagcgggattgtgtactgatgtttgaattttttttttcctgtaaaattttaaaactttgataaacaatatgtttcaacacaccttgagctagcatttttatatttgatatctatcttaaagagtattttcatgaacatactatttaattatttattctaagaaataattagtcaagccttacttcaaaaacacagaaagttatgtcagtaattctttttgactgttgggagtggctcatggctcctgcttgcgtactttgggcagtttaggggcactgtatcagtgcattactgaatcagactggttcaactgttctcttctttattttttggattggctagttcaactgttcttgataggccttggggtaggcagggcagtttatactccttcagaaatgagtcaggactctggatgttaaatcccacttcaccagtacagtacatttcagctgaaataggccctcaaaaaatcaaaatgcagagaaacagaggattcagactttcagattcacagccgccattacttgtgactgctgatttttcagtccatatcaccaacagtgtgcatctgtataccgtgggtaggtggtgtgaaattaagcactagtagacaacaagtccatacctggatagacaaggatatttggaatgcaggattttcacataaaaatcaacagtaaactttattttatccaagtagtatactaaaccgaagaaaatcctcacatcataatggcaagtcttaggagggttgtagagggcacacatcactataaacaactattaaagggattatcacactcatattcagtgttctttgaagtagaaattttacaggatttcacaggttttagtatgttcccctaaaatctttaaaattttccattccaagaattgagtcaagaatactttagactatgacatgattaatttatagcaacaactcctacccctacattctagtgcatcttgtgtgcactattatataggagatatttaaccatttgccacatttagatgtgacaattactttttgtcattggacccatatgtcatagacatatgtggacccacatgtcattgagataggggtggcaaatagttatttgccaaaactaaccgtggcaaatagttaaaagccccattatatagggtatctttaaatcatttcggaatgaagcgacataggaagcatgtttatacattcataccaactcctaccacttctaccgcatccaaagcaggtttcccttaccttctgatgagcggccgtaagttgattcccatggtaaaatgtaaaggattgaacaaaaatttaccaaaaaaatttttttttggtagtagggacgtagggttaccatttagaaagccttattgttctcgtatccctgtgataaacctatttaccatggtagctgaaatcgtgacccgaaactcaacctttcgaatatagaatatgcctatcgattacagccacgctaatgatttattttgggacggcgctaataatttattttgggatgaatagaataacacgtaacatgggggatcctctagagtcgac

SEQ ID NO: 44515 - DNA, 1680 bp, Oryza sativa
cgcagccgcagctgagaaaatgacagcgaacacacctattagatgtatttggtcaagacacgtagggataactcatatatagggataactcatatatatgtataattagtgatagataattaaagggctatgcattgggtccaggcgtctaggtataactattcaataattggatcatactttgcgttttactatgcaatatatgaatatatatgaataaagtattaaaaatgatggatagacatgtagaaatattataaaaatcatgtgttggattaatagtcagtaataatgggtgcacgagccccctctgtactggagctggaaacattacatttggaatccaagaattatatcttatatacccactaaatagcaattctgttttttttttcgagccaaggaaataatatttctctccttttttgggaactatgtaaatgtcactttactgaatttttatttgtggttcgaatagaattcagagatggagttttacaatgacacatttaattttagaaaaattacaatgaagtcatttaattttaccacttaagtattaatccaacaagcaaaatagttcttaattagtggggaagtcatgtggcggtagagttatgggtgtataatttcactccaccaggtttaaatcccagtgtctagaagtattacacacataagtgggtttttaacataaatttagtgagataagatatgtatagttgttttatttttataaaaaagatcgttgttatacttcaagctttcaagctctgccactcaatccaagtatagagtagacatatctgctgggtcaaatatggcaaattaagcgaaacaaaacgagtaacatttgagaatgaccagaacgaatatataactttacataataaatagatacatacatgtagataaagaacaataacactagtggattaatccgttcgatcacaaatatatatcatttaactttttttaaaaaaattgaggaagtacgaagaaaatagaaaaaaaatacatgttacttgatggaatataaaaactcaacccaactttttagaatactaaagtttattttcattttttattttcaaaatggtaacttaaggcaacttatcatttttcaagtgtgtaaaatccattgcgggcgcaccgccactcgacctacgcgttgaaggcggtggcagcgcagcagggtagcggtgggcgcatgcattccaggggttgtcggcatcgggtgcagagtcacggagcgcacgccagacgttactgcaagccttgaagccggtgccgaaggcaagcatccagaggcggtcaccggcacggacgcgacgcttggcctcaaagtaggcgagctcgtagaagacgaggctgctcgacgtgttgccgaacctatgcagtgtggcgcgcgccggctctacgacctgtggcccaaacgccatcagcttcaccaccgcgtcaatcaccgccttcccgccggagtggatgcacatgtgctcgaacgcgcgttggaaatctggcacaatcgccgccacggcctttgggttcccggcgacatatgcgcgcgccacccgccacacgtacctgcgtcatgcaccccaattcatcactgaattagtagcaaaataactataagttaaccaataaattaattaatcattaattatgtgtttgctggct

SEQ ID NO: 44516 - DNA, 7660 bp, Oryza sativa
ccaatgcaaacactaccattccatacttaaatttaatgctccgtattacacatgatgtcttgtatgttgtgtagaaactatgtcttatgcaagacatatttccttctctttcctcatttattcacttgccacatcatttttcatcctaggtggcaccttatttaatgctatggacactatcctagccattgagttgggaatggcctaatataaaacgtgcatgcatgtatacattaactagcatctcttggtcctataaaattaatttgttttaaatcttatatcattaagcctcacaatcatattacttgtatgtattaaggtgatccaatcaagaaggtgattaaatgttttcttgatcttgtgttataagtggttatgtgttatattttttatattttgatatagagggagtactctcttagcataaagtttctgtgggacaaattttacaggataaagtctgtgggatggaaggagtatgattctcgaagacaaaaaaaaccaatgctgtacatgtggggcgtgtggtattaaatgtgcacagaaatggcataccacgtagcactgtataccaattaaaagtttgagattgtacctaaatttgtactacagtgcatcaattaattcgtcctgataaactagtgaaaaaatatacttgctctatcctaaaatataagaatttttaggtagatgcatgagatatattctagtactacgaatttaaacgaagctgtccagattcatagtacttaaaaatatgctcatccacctaaaatcccttatattttggaacgggggagtaaggtaacatagcaaaaaaaaataaaattcacttattaagggggaaaagattgacgatctgtctagggagtgactagccatttaaggatagatctaactatccacaggagaagtccgtggagttgtctattttaaatcaagatcataccaaatctacgatatatcacaaccatgaaaagtgatctggctttaacagcaaaatagaataacactgtgtaaaaatgggtaaaatctgatgtagttaatgtgaaaaaaacgattggtgctaggcgagaactaattaaagaccatggctcagtttctataattgggactacctatacatttgtcgacaaatttttcccccaaaatttgatagatgtaattacagtacaatcgtagtgtaattacactgtaacttgcatgtaactacagtgtaacttatatgtaagtttcacgtagatctattacaagatttgttttggtaaggaagaaaaaaaatcatagcacacacatatatgaaagaatttgttcccacgacctccattttaccgaaataacatgttacagagagatttttgaaagttacatataagttacactatagttatagtgtaattacatgcaagttacagtgtaattacactacgattgtactgtaattacatctgtcaaatttttggggaaaaatttatcgacaaatatatagcaaaatcgctataattttatatgcatgtcttgagagttgaccgatttgatttataaatattttggatttttggttctaaagacgggagccagtgataatttaatggggaggggactgtttctagagatgacaagtacaattaaagcatcaaaactcgttacatactccctcgtcaaaaaaaaaaaatactcatgagtttgaatccgttcggattttttgttacggagggtgtatataattgtagagtacaaacaactttaaatgtgctcatcagagaacaagttgtcgtcctataatagtaacatctaatcaaataaaactaactttaactgaaatatctcttcgagattatataaaataagatattgtaaaaaataagtagttcaaatgcatgggaaaggtcactgaaaaattttgttgccaaaatatttggataatattgcattgttaaaaaaacaacgtcaaatatatggtactaaaatttatcaatttattgaccaaagtgataatgttaacttttagtttcacctcctgtactgttcaataactgacagtgatgactgttctatccaaactttaatcaataatagtttttgttttattttgtttatatgttaaaacttgtatatacgttggagagccccaagtatttataaatgcattgttggaagaatagtgatcgaattgtatattttagtcgatgcttaatcatgtactgaagtgattttgtacacatttataagttggtttgtctaagttgtagaataattatttatatttgcaaatataacttgattagctatgagaacatatcctatgcacacaagattcccgtgcacactccatacaaaccaactagcaaatgtcacagaaaattctagaaaaaattagacacatacttccaagagtattacaccaacatgttaaatcttatcttcaaatttattatattttaactgtaaaaagaagataaaattctgacatatttttaccctaacaattggtagattttttatttttatgggtaaaatataatgaattacgagactttgcagatatgtataatactattaaaaaattgccatttttttctagaatattttgtgacatttgctagttgatgtacatggagtgcgcacgaaaaaattatgtgcataggatatattcccttagctatagcacatcttcacgggcaatatcataaacatagaatattgttctccttgattatttcgtaaactcgttcgcatcttagatctacacacctcagggaattgaaaaataatatactgcctccatcataaatggagttactttaattagtatatacgtaaagcttggtttattatatatatttttatctcaaaattatacatgtacttttcttacaaaattaaagcttcttcaaatcaaaattttcgtatgtcgtcgttatagcaatgttacaagcatgagaaaatttcatgtgcatcactgagagttcacctaattgctcttctatgttttcgagttttgctcattctcttacaaactcttaaattttagtttggattctgccatgatcttttcgttagttgaacgttttgtcctttgctatgaagaaacaaataaataaatatagaaatttgttggatggaactattatatttatgaatttattatgcgttatatcatttgaatactactctcttcgtcaaaaaaaactcaacctgtgatctctcctagaacagcattctaggagaatttggacatcacatcttctctaggttgagtttcttctctaggttaagtttttttcttgagagagggattactcattttaagagtgtagtaccacataagctctgtttttcagctcagatatttgatatgttgcagcaaaaagagcaaattttcatgtccatttaaggcgtctgaaatctgtgaaagcctgaacgcaatcaaaggctgcatgcttcgttcagctagccattatggcggcgaagagcaaaggagagagagagagagagagagagagagagagagagacctgacctgaggagctcggagacggggaggacgtgcggcgcgagcgtggcgatgtgctggcggaggcccgcgccggcgacgcggacgaggtccttggtgagcgcgacgccgacgttcccctcctcgtcctccatctgcacggcggcgttgtacgccgcgtcgtcgccgccgtggtgcgtccgcagcgtgcgcaccagctcgtacttggcgtcgccgcgccgcgccgccacgtcggtcaccagcgccgccgcgctgcccacccggaagatgcagtttgtcaccagcatgtgcttgttctcgccgaagtaccagttcaggctcatgttctccgtcaccaccaccagcgcgtacccgccccgccgcgacacccgcagcgccctcgccgccatgtcgatccccaccgtgccggcgctgcaccccatcccggcgaggctgtacgtcctcgtccccggcggcatcccgaaccgccgcacgatcatcgacgccagcgacggcgccggcgagaacatggagcaggcgacgacgacgaacccgacgtcgcgcgggcgcacgtcggacttcgccagcaggtgcgccaccgtggcaaacagcccctcctccgcctcctgcaccgcgaacgcctgcgtcttctggaactcgccggagaagatgaagggcggcgcgtacgtctcctggccgaggccggacttgcggtagatgagccgcatgaagtcggcggtgtcgtcggagtagtggcggcagcgctggccgaagtactcgcacacctccaggttcaccttccggtccacgtccgggaggtggcagctgtagttcagcaggtacaccggccgccgccgccgccgcagcacgacggccaccacgaagaggagcgccgacgcgacgagtggcactagggcgtgtgccgagagggagcgcagcgacgtcaccagcgacgccgccatggatgaggacatggtggtggtggtggcggccatgctcggagaagcaagctagctagaagctagaggtgtgtgttgcactacctagctaggggaagtgagagtagctgcactatttataggggtcaagaattttttttactactgtagcttattattactccctccgttccataatataatactccctctgtcccgttatatttgacactgtagttcattttaaaaggagtctaaatgtttgacgtcgtagtacaatcagaaaaaccgtttccatctttatccctctgtcatcctccactggtcgctagcctgctgagtgtctacctccgccacctgaggatgaggctgctaggggaacggcgccgtgacatcggccgatgatccgccgccgctgatgccttcctgcgccatcttcttccatggcgtgaggaatttccgccgcctacccaccccaccattcatggtcgcagcttgtcgtggcggtgagcttaggcaacgacttcaggagtgggagcagcggcgcaggaggaggactcgccagtgtcttggggatgctggggcttgaaagaacgtcactggtgccacagcggcgtcgggagagagcgtctgcggcttaggagaatggcgccgccgacggctctggcaaggaggggtggcggcggcggctccggcgagtacaggtggcggcgacagcgtttaccggctcgagaggaatgccgccggtgccgcagcagtgttgggggagggtgccggcggctccgaccaattgggatggcggcggtagcggcggcgcttttgttttcttccgatgatgaagccgatgcgggatctccctcctccggggtgcttggagcaggaggagggcctcgccgacgtcttaggggtgagccccggcggctggcgcggcggccggcgtttccggtgttaggggtggagacgcctctttcttccagtgttggggatttctcccgcgtgtatcacgcattcacgtgttgacgaggagaaggcacataggcaaatatgtactttcatagcttccttaattttcacaagcctgttagaaacgacaaacattacaggacagacggagtataatgcacaactattttttttaacgtttcataatataaggcatggataaatgcatgacattaactagcacctcttttctattaaattattattatttaaatccttcattctcaagatttttaattctattgggtacatgctttatatttatttgggtgatccaaacaataaggtaataataaatatttcttggtctttagattaagagtggttgagtctggtattttggaatggagggaattatgtttgacaactatagtatgggtgaaaacgggacgggtattttccactcgtctgcataacccaaggctggtgagaaggatataggagactatacaaattcgaattcaaaaaatttttatagggttagagtacttcaagagttgaatcagcccgtatatcccatattatcaaacatatgcatatcgattaattattattttacgagctcacaagtaatattgcataattttccttgatgtattagcatttaacacttttttatcttcaaactctcgtttatttgccaggttagttagatactgccttcgatcccttgcatttcttttttaaggcaaccttcctatttatttaattaattaagggacccctcatatatccgttccctatccaattcggaggaaaaaaatatgggatatgatagaatgtaggatgggtcatatgttattagcactatctatacccaattctaaatttgaattaaaaataagggttaggatataagaatactatgatccgaacgtcttcgacccaacttcagcccctaaaaatagggattttttatttgtcaaacaactgattttttttcttatctatatcaattacctttgggactagctaagtttatgatgtcacatttttttaaaaaaaggtcaaatcaaacattgtaaattacccatatttaaattgttgttacactataaatttgaaaatataattacactgtaaatgtcagtaattaaattgtattttttaatacacgctatatatataaaagaagtataggtactcggtataagaaataagatatatagaaacatactatcgtataagagagatagctattgatatcacataagggaagaagtgactaaaatggtaaaaagaaacagtaaggttgacatatttttcgagaaacgtaacactagatcactaccaacaactcacactacttatgtatatttttttattgaggtgaagcaaataatgtctaaaagaaaaaaaaacttttgtgctaaattcttaccggtatgaaactgaaaattatgaattacagaagcataataatacgtccagaaaacaaaaaaaaaacaaagaaagtaaaaaaaatgtgcttcattatactgaagttgttgttttttctatatattgtgaaagtttagtaaataagctcgtacaaatttaggtgacagataaataagtagaaatcaggctgctgataaataccaaaactgtttaatattagcaaatggatggtctgcgcaggaaagacagcaagagatttgtagaaccctgacgaccgtaaggacggattaaaaagaaaaaagtccgccgatgtcatggatgacccattaatgttaatgttattcaacatatgaaattatgttctatgtatatgtagagtgttttcatcctttgaggggatatctactcgatatctactcattttatgcatgtcacataaataatcactagataaattgaagaaaactgacaagatatattaatatgaaatatatcactatacaaatatgcaagttgaaatttaacatgtatgtgttgtaacaagaataagaaatatagttgtgaatgtacgataattatttttaatttaatttgttctttttttttgcatattttagaagttaaatttggtcttacatgtttgtggagtgatatattttatattaatttatactactatttttttcagattttttattgttatttagatgacatgtaagtaatgagggacatcttctcaagcgatgaaaatccatatctgtatgcgtaataaatagattttaccgaagattgtagaggaggcgaggcagcaaaccgaatccaaaattaatgtagggctttc

SEQ ID NO: 44517 - DNA, 2060 bp, Oryza sativa
cataaataatcactagataaattgaagaaaactgacaagatatattaatatgaaatatatcactatacaaatatgcaagttgaaatttaacatgtatgtgttgtaacaagaataagaaatatagttgtgaatgtacgataattatttttaatttaatttgttctttttttttgcatattttagaagttaaatttggtcttacatgtttgtggagtgatatattttatattaatttatactactattttttcagattttttattgttatttagatgacatgtaagtaatgagggacatcttctcaagcgatgaaaatccatatctgtatgcgtaataaatagattttaccgaagattgtagaggaggcgaggcagcaaaccgaatccaaaattaatgtcgtgctttcctgctttatcatatacttgaaaaattcctgtgtgttacaacgggtggatgctattttaatcttattattatcgttatacagtttagctaaaataaaattcactgtgtgaattcgtttgaaattttttttaagaaaataatgagccgcaattaggagttcgactttcatctcaagttagcgtacggagttttttaaaagagatttcttatacgacttcttttgtatttccaaaagcaaatgagtttaaaatctaatttaaacacggatttgtatttccaaaagcgaactattttaaaaaccggctcaaatacggataacgtactaaagtaccgacaaaaatatattcaatttttataatagtaaaaataatgtaatcttcttgcctttcttttaaaaaaatagcgttgtgccgtggatagtccttgcctccttggtgggcatgcatcatcgacattgataataaggcaacggagaggatgctcgtaggtaaaggaggtgtactgagtactgtgccggtgaatgggcagcttggtttatgagggttagttactgtgatggtcaggataggcacagtcgtacagatcggatgaaatatggaccgttatatattcatcgaaggaccacaaatctatctgtatttttgatagaaactagaatattgatttgcaaccatattgaaatgtatatgtcgaaatgtatggaaatgttgcattttcatttgtgagttaacatacgcatcttcacccataattccatatgcattttcatttgcgagttaacatatgcatctttgcgagttatagaagtagatttctaaaggcgatctgttggaactagagcttatttgaaaagttactacatttgcatccactgatttattgcggaataaagtgtaccggtttatcctaaacttatacgagtatgtcatccagatacctaaactttcaaattatatctccggatgcttaaacttgtcttgggtatcatataggtctaaacgggcgtcaacctactctgtgcacttacatggcatgccacatcaacacctatgtgtcagtggaacctacatagctacatgtcattcacattataaaatataaagttaaaaacattttggtatccctatcccccctaatcttatgatttattatttttttaagaaaaaatggttggtttttcctagtagaaggacgcccaatgatggttcagctatgccagcagtgagagaggcggtgaagcagcgaggggaggctggttccacggtccttgagcaacaaagaacccaatctgtggcttctccccacgcgcgtggcaacggcggtggcgttagcagtaactcccagtaactcccatgacctaggctttgaggagggggtggtgagcatcatggtatcgagatgaagcggatggaggcagcggcttcgcacaaggtggtgtagaacaacgcatgatgtgtggtcaaaatagggtggcagcgaggaggggtggctccggcgagatctggaggtggttaggttggaaaagtttgatattttcgctcggattttataccacggatgtcgttttcattatgcaacaaactttgttgtcaaagttatttgctatgtgatctttatgcattatagcttaggctgtgcatatttttaaaccactt

SEQ ID NO: 44518 - DNA, 4534 bp, Oryza sativa
taggtatatttttttttctaatcttttaatttttcagcccttcaaagcttgttgaattggtaaaggcactcagtagactaaggcagagatgattgaagcactcggttcgatttgatacgttcgagagaagattatcttatcgactataaaggtctcaggggctatttatgaagattatgggtactatgcatctgcgcacacggctgggctatcggactggttataggggatagatcatgtatatggaatatgtaaaggattgggactcaggtattacgtttacttgtgtatcgaggaaacgacttatagtgctggttcggcaagattttaaagtagttgtaggagatttcaacgggattgggttgaatctctattttgtaaacatatctcctccgcctatataaagaggacagcgtgtgtcccttgagagcataaccacaatccaaattgtcggatcaatgcaacaataggcagattcaatccctaaatagaagtaaggtattacttctcatcaagaaggtctgaacctgtataaacccttgtcttatcacccatccactttagatactttgcgcaacctttttttttatgttaccaagttctagttcgataattttgaaggtccagaaaactagataccctattcaatttaagataacttagaccattctcaacccaagacactagacataattttcataaattccacatcatcaagaaactagtactaaacactaccctcccaatgcaaacaccactattccataattaaatttaatgctacttatctcacatgatgtcttggatgttgtgtagaaaccatgtctcatgcaagacatggtttccttctctttccttatttattcacttgccacatcatttttcatcttaggtgacagcttatttaatactatggacatcatcctagtcattgggttgggaatggccttatacacttcgctcttgacagctctcgcccccgtacgtgccgattagccacaccggtcgccgctctcgttctcctcaccgttgtccccctcctaccaaatttagtggatagccagtacaagcatttgatgcaaagaaataatcgtacgtttcatccatgcattcacatgggcacgggggtgaacgtggcaatcgggggttcaattctcgatcctccttcattaaacatgatgactgtaccgtactgttgcttgcgccatactactgaatcatgcaatgctcattaattaaacaaaccaaacaacaatccatcactaaaccggctgtaggggccttcctaacattgggctatttggatgtaggataggcagcggcagggtgggctctcagatctagtcccacgtcacacggattcgtttctctctgcatgtcgtatggatttgtttcgcttgtgttatggtatgttactgtatctaggagaaactttatagccaatacgtggtttagttggtaggtatcttactgttagagcttcaatccgttctagacacaaaccagtacacccttgatatgtttgacagcttgatcaaatattgatggggagtaacaaacatcaaaaaaattgtaaatgtgcaagggaaagacaatgcgacgtgtccctttttgtgttattatcgggcatgattttgaatgcatagagtagtggttattcaaactacggatgctaaattaaacagagacaatgggttgaacaataactatgctactctttcagccgttcatttgaggttttcattgtttgctagctcatttgttaaacataggtcaacccctactaaataattatttttttgtgagaccctctttatattgcaggtggaccataactgctccagctgtagaaattgtttacacggggtcggttcaagggccgcattcgaaaattcgacttacttttgcaggcgggcaaaatgcattttcgcatgtgggcctcttaaatacctgcctacgagtctaaccttcctactctcttccctctcaatatcttcaaaattttaagtcttcattcttatctcctcaccttctctctcccacttactcctggatcccaatgacaggctcgagctggcgttggcaatggcgggagcagtggcgggaggcttctactccatcatgcatacatgctcattaattaaacaaccaaacaataatccatatcactaaaaccggctgtaggggaacattgggctatatgaatggaggataggcagcagggtgggttctcagatctagcctcacgtcacacggatttgtttctctgcacgtcgtatggtttttgtttcactcgtattatggtatgttattgtacctaggagaaacattatagctaatagtggtttagttggtagattgttgttggagattaattcaatccactccagataggaaccagtacaccaatatgcatgtttgacagcttgataaaacattaattgatagatagtaacaaacaatatcaacaaaatttgtgaatgtgcgagggaaagacaatgcctttttgggttattgttgggcatgattttgaacgcatagagtagttacattcaaactacggatgctttagccaatgcaaacacttaacaaattaaacagagacaatgagttgaaaaataactatgctaatccttgagccgttcatttgaagctttgatcgtctgctagctcattggttaaccgtaggtcaaccactactaaataattgatttttttacgagaccctttttagactgtaggtggaccataacggctctctgcaaaaatcgtttacgcggggtcggttcgtgggccacatacaaaagtccgacttattgcaggcggcaaaatgcatttttgcacgtgggtctcttaaagacctgcctacgagtctaaccttcctactctcttccctctcaacatcttcaaaattttaagtcttcatccatatctcctcaccttttctctctcacttcctcctggatcccgacgacaggctcgggcaagcattggtgatgacgagcgcggcgcggtgggtggtggatctggaggtggggaggcacagtggtagcggatctagcggtgggaaggcgcagagtggtggcagcctcagcgatgacctcgggggtcgggaggcgcggaggcggtggccctggtgacgacgaccggctgcagactgcggcgacgatgatgatgagctgctgggctttggcgacggtgatgaagagcagcggcgatggtgacgatgagcggtggcggatgggggttttggggaatttttttttcacgaattttatttttgcgtgcagacgacataatcacccccataaaatagcaatttccgcatatacttttggttggacggccggctcaaccgcttggataaatgggctcttaccgcatgaaaaatattttttttataaatgagcctgaggttctaattggaatcatctgaccacgctgctagtaacttcgaaacattaccaaaacatccaataaaatataaaccaacacaaattaatcaatcatacgatcgactgtttggatgggacttaaaaaattttcgctatcacatcagatgtttgaacactaattagaagtattaaacgtagactattgttaaaagtcattccataaccctggattaattcacgagactaatctattgagcctaattaatacatgattagtctatgtgatgctacagtaaatatgtgctaattatagattaattaagcttaaaaaaatatcacgtgaattagcttttatttatgtaattagttttataaataatctatatttaatactttaaattaatattaaatattctatgtgacaggaactaaagttagtctcgggatcaaacaccacctgaagctagctgtagtagtctagtctggagtctggaccatattgcagagagagcaagatgatcactgctgctttctgcgtctctctgcgtcagtgccggccggttgccggcacggccgccgagggcaggcactcatatcgttgcagcgacgatgaccgatcgaccagcgagctgcagtacgtgcgggggcgtgcacggccgcgcgctagctgccactgtcgagcgtcgccccgttccaacctcatcggagtacatagctagtgggatttgaagttggctcagagaggtagtacgtactatatgcacactgctataaaagttggcatatgcaattcaacccattgccatattgcagccatagcgaaccagaaaacgaccttacagtcactgccggacaaaccatctttcatctttcatgtgttggatagaaatcacaataattccggttgaatcaaaaaccgggactaaaaactatttttagtcctggggtataagttcagaggtatttttttatctgtagtcccggttaatgagattatttttagtcccggttcattcattgtcaggatatggcaagcccccctaatatctttagtcccgattggtgtcaacaattgggactaaagattaaaaaaatcacgcataggaaggggagagagaaaaatttcagagattccctcc

SEQ ID NO: 44519 - DNA, 1365 bp, Oryza sativa
gttccatcactcaatttagacttcaattagaagtcccctgttgtggagtaatctgcacctcaccgtcgttctggttggatccagtggccaccactccaggccagtgaatagaagaggcggttgtcgccatgccgtgccatgatggggagaggagtgataggagacgggagatggtgaacgaaggggatggagagacggagggaaaacgctccatgagcactagccgtcatcggctttgctcggctcccggtaaaagtgccggcttttctaaaactggcacttttatctcaagtataggtgccggcttattaaaaattgacacttatattgttgagaaaatttcttgtgtacccctaaaactttacaaaatccctaatatgtccctaagttttgctcatccccttgcgtacctcccaaatattagtttgggccccttccatatccttttcattagttgaccattaaattcttagtaaaatttccattttaccctttggtacgaagaaacatataaattggcggagtataaaaatttattgtataagaattttatattatgattttattatgtgagatactatttacaacaaaatttatttttagatatgacataaagtactagcatttattgtttaattattaaaaaattatataagaagtatttttttgttgattatagcacaacatatttggtgtataagacaaatctatttatatgctacataaacaatttttaataaataataaacaaatattaattttatggcatatttataaataaattttcataaataatatcctgcataacaagctcataaatacaatagtctcatataacaaatttctaccatccaataatatacttcataaatatatatgtttctaacgaatactatattccataaatatatatatgttttttcatacccaagagcaaaatagacttttagactttttataggaatttaatgtttaactcacggtcaactaaagagtatgaaagggatcctaactaaaattcgaaattacataaagaaatgaccaataactccatgatatatataaagaattagataaaagttttagggatacataggaattttctcaatacagttaactgatgaatagttggtccctttcacttttggtgggtgtcgatttatgatcatggttgtgtttctgtacctctggctaaggtggctagttaattggctactcgtacttctatagctctaagatgacataccctagaatggccacttcatgactcttgccacttgccataagggtacaagcgactacccgcgaaaacccacttataggctaaactaatctacgaacttacttattttgacttatatgtag

SEQ ID NO: 44520 - DNA, 1409 bp, Oryza sativa
gcatgcatgcatgcatgcatgtagactcaatttgcatgtataaaaacaataatgcttcacgtcaaataaaaacgcaagggttatatgatgatcaacaagaacggaggaagtattatttaaggagactacgcaaaaactttcatatattttttcaaaaattctaatgggtcaattaattgccaagtattcaaggacattttaagcttttttttaaaaaagtatttacttcactggcatattgtattgtaaaggaagataaagtcgatcgtaaatcgttaaactagagtaaattaaatcaatgacatactccgtaggacatattctctcattatcccaatccacacccctctcctcagtgagtccacacccttcctgaattatccgccgccactctctcgatccccaccacttcgcctacatgcgtcaccctcccttctcctcccccacctttaccggatctaccaatgacatcgtattttccaggtgtcatcaagtccagcaagattatccacaccaggcctcctaaactacatgacctcctttgtgttataaaaactagctctgatatatgtagacctcaatagctgacgtagaagatccaatcttaatgacgatgccaaggtatgaaaattttttaacgaggtttagcctacacttgtatccccgatacactgattatagatgctctttctcgatccagcgtaattacagagtattaggatatcagtgatcctcgactagttaggccgccaacagataggggtgaaaatagggcgggtattttccgtccacccacccggccacattatttcgggacaaattcgggtcaaaaattcgggtacctaggactttttacggatattgggtccgaatacgggtcttttgtggatacgagatcgggttcgggaacataatatctgacggatacggattatccggcaaaaaatccgggtattacccggataaatattcggatattacccgtattacgtttctgtgaggcaaaaaaatctcagaatgaattcaaaggtctgatagcttgtaatgctgtataatgcctctaatttggtagtgcctaattattaagcttgtttttatgcacctgttacttaaaaatatatcccctcgtacaaaattttcttatagttgctcaatagctgtaggtttaattgtttaaactacagctttgttagggtactgacagttgtggcttgtaggatacctggcctgtgtgctcgctgttcaagtaccggaactctggtgcttactgaaccggtttcaacattcagcgatggtgatcagcctttatctacgccaagaacagagacgtgcccaaattgttcgggtgcaggaaaggtaaattagccttctgcacaatgatgtattgtattattcatgaactactgtac

SEQ ID NO: 44521 - DNA, 2271 bp, Oryza sativa
  unsure (1)..(2271): unsure at all n locations
ttattcatacaatagttacataatacactattaatatctggtcccacctgtcatacacacactatatcttggagtccgtgatacagctggctataaatctatagcccgctgactttctcttttcttatttatctgtttaaaatatatttacagctagcttatagcctgctattgtacctgctcttatccgccgctgctgcatgctgctgctgctggagcaatcactgcgagttccatgtccaatggcttcacgttatttgtagctactcgtgctgcctaagcactaccaggagagaaagataggcccacttaactcctggccgctagctatagcaataaggtatccgcaatgtgttaaaaagtactctctccctcggtgaatataagggaatatattttttaatgaaacaaatttaaaaaatgatagaaaacaaaggttcaaatggtaatggttgggagaataaaatagcaaaggggatgagagaaataaccagtaaaaaatgtgatgggtgaaaaataagatagtataaaagtggtagctagtatgtgagaaataaagtatcgttttgggattacaaaatccttcatattccaggacaaatttgaacggtataatcccttatattttgggatggagacagtaagtagtaagaagtcctatcgcctgattcaccattgtggaagtaggtcgtagtgttaaatgttaatatccaaatttaccttctaaggtaagaaataggaaatcatagacaaacttggaaagacctcagacttgtcacgtcacgtgaggtcggtctgaccagcagcttgtggctgttcagagcggcagagtccaactctaagttcgatttgtcggttttcgagtttccttgctaaagcctaagattttagagttctaattggtttctacacctaattggacgtcaaaaagacctcgaaagcaagtccacctctccttaaaaatataagggggctaaagttgattgagacaaccaccaaacaatcgtccaaatcaatttagtatccaaaccctttatattctacatttccctccttcttgctacctatcctaagtctattctccttaaatccccaattgcttgtcgtctctcgtctctatggcgccaaaggacatcctagctagcttgccgagcctaggacaaatcggcgcgcgttcacccttgacggagcttgggggctcctcaccgggagaccgcgcaggcccccctttgccggttcggccggggacaatgggtgagattctaagctccttctttgtggaagggggatccgcgagagtcgaaatacaggcaagacacgggtgatgtatacaggttcgggccgctgagaagcgtaataccctactcctgtgatttggtggatctgtgtatgaagaagctacaaagagctggagagctcaagaactcaaactccctccttcctctctcctttcgtccgtttttttcttcctttttttctaagtgggcaaggtcctccttttatatctcaaggggataccacatgcaccatctctcttttttgtgtggggacttatctctctttttaccaacttgacttgccttctcttcatgaatggacggagatttgcatggttgccgtccgaatcaccttctgatgggacggcccatacctacctccacttncgccggaagcaggcgcgacgtgggatcatggctgtctgctgacgacatgaccagtgtcagaccggtcataaatcggtcattcttgtccaccacgcgtcagtttagcaatctgcatgttcgccccttcttcatacaatattttgattggtatggttaggatgaagcctggcatatatctgaccgggatcaacgtgccatcttcaggagataacacgctggctccggctaaggacgagtgcttggaggcgctcatcctgacgggatggggcgaggcgtgtgtcagaccgcttgtcgccacctaacccacgatctgatcggtccgtgactggtcacagaccggataaacgagcgtgctgcactgcgttacatgcggcatgacggactcgtccaaaccgcaataaatgtggttaggtgagccccgctgcgttcacctaacctatacancgctgggcgccaaaaaaacccctccaacccaaaaaaagggggggtcgggcgcctcaccctcgggccgaaaggaagcggtccgacccctcggggagacaaagaggggggcggccacttcaccctcgggcccgacccccccgagggggtcaggcctcgtgggtga

SEQ ID NO: 44522 - DNA, 14369 bp, Oryza sativa
gggtagtagcatcatttgatagtagcactactactaggcaataagcaataaacaaatattaaaactagtgctagtagtattttgaaactttgcctttttttcattgcctttatctcgtgctgcatttacttggtttatttcacttgcacccaactctattcatgattgttctcagctagaacaaaattttcatgactactttaatggtgagttcgaattaaatttgacgcacttaaaatcggttaaacaaaaatataatgagcctgaatacattagaagatttagaaacagaagaaaacgatgttatagtttaacactttctgatagatttgtcttattctggtttacttgaatatttaaaagaaaagttatatggtcatagtttcttagatataagccaattacttcgaaaagctctagctaaagaaagccgcgttagagaagccaaaatcgcatagaatgtcaggtctgatcaccctcatgttaatatagttgatcaacaaaaatcttcggatgatgagacaattgttgtatccacaaccaaatgggcttggaactccaaatctaaaccattcgtttggtcctctcttaagtcggtggtcgcaagaattggcaagaggaggtaaagttcacattttatatggccaaatgcgataggattttttactacttattagaaaagaatcaaattaaattgtcacaaggccgtgtcataccaacacttgaggaattgaagcggtgagtatattgtatgtggcgcaactcttattctcatgccacaaatcattgcaatgtattccgtagacaaattcaattggccattgatgaaggatgattgacttttacaaaaatgcaagtggatgagctaccttttcctatacgcaccattggattgctaaaggacaagaccacattgaagacttcaaaactcagggggggcaatatgacaagtcgaagattccaaaagatgagcaaccaaggaaatcaagttatttaccaagcaaggtaggagacaagcgagagcgtaccaccgacgacaacctacttctccttcttcatggtattagccttggtatgcaccatggagcttcaatggtacatggatgatgcccacttatatattgtattattatccattatgggcattgccacaaagaccgatttttaataatcaatcgtgttcttctcataggtggttgagagaaaagaataggttacaaaggaatcaacacaaaaaagtgccgaggaaagagtggaggccaaatcaaaacaaaacacaatctgaacaagacggggcctctcgtagtattcttgtatcatcatgaacacatatttcttagaggcatgtcttgccgatattagaggatatatatcatccttagataaccccgtgcttagtgctttttggttcacaagtttaccaaaaaggtaggaggggcatgtgttaatatccaaatttggctcaaggcaggtgtggccatacgattataagtcaccatgtagtaaagtgggtagtagtatcattcgatagtagcactactaccaggcaataagcaataaacaaatactaaaactctcttctctctcattccttctctcttcttcacccatctatttctcttataaatatgaggtctagcttactgactatatattatgagaattaaaataactactatctagttttgtaagtctcacttttactacttaataaacatatatattgaggatgctttatggttgagaatgatgacgaggaggaggaggaggaggataacgacgacaatatcaaagctagcaggatgaggtgattacgataacgattataagaaagcttgtcgtgatttgatggttgtgcacgtacgacgtttttggtgttcaaattattatgcatatacatcgtgagattcatgatatgtccatgcatatctaggactgaccaagcgaccagccggtacggtggagttggacattttaatttgtagattctgaaatttctgaacccatatttgatgaacatgcagaggttgtctttcttctgtcgttgtacagtgagcaagaacatggaatgctttgcccccaatcagttatatatagtagcaaccaaattaatgaccaatcgcaatcaagccaagcaaccaatcgatctcaatcaagccaacagtgtgattgtgtatgaatcgatcgatcgatcaccttttaattaatgaccggccatatgcatgcattcaggtcgccagcaaagaaatttaagaagtgttcagctaacaaggtgtactcctatattctctctactaattacacaaaaagtttgtagtactctttttaccatatgatcgcgtgtacgtttagtatagtgaatggtgcggaactgaacagattagagtagtgaatgattttcgcagacacctcgttcagtgatgagttgttctcttgtactagtactagtttgcagctttctttgacatatgaccaaatggaacggcattattttgcctgccttgtaaatctccaattaattgattggcttctccactcactagtacaataacgatttttccgtgtggttagaatcgggttttgcgtgcggatgttccacccgtctagaatgaggtgtctgagaaaatactgattttccgcacgcgaaaatcgtgatttccatgtgcgggcgcttaagccgcccgcaaggaaaaataacaaatggaaacaaaaaaaaaatcaaaaacaccgtcaccgtcgtcgtcgtccgcgcagtcgccagcgacggattcggcctccccgcggtggccggcgacggatccccccccctacggtcgccggcgacggatccccccccccctcccggtggccggcaacggatcaggcctccccgtggcggccggtgatggatccgctccgccgccaccaccatagccaatggtcgcctccgccgccctagccgagaccaccgccgccgtcgccggagatgggagaagtgggaggaggaggcggatagggggaggaaggagtgggaggaggaggcggatagggagggaggagtgggtgtgggggctgagagggagatgggaggagagaatgggtgtggggcgatctgagagggcgaggggaggagatagttgggtgtagggcgatctaaaaggtcggtggctattttcgtgtgcgggccacttaacaggtccgcacgagaaaataagccctgttaagtggcccgtctaggaaaattgatttttccgtgcggtcgtcttagagagccgcacacgaaaatgtagcacgattttcgcagatgcgaccacttaaggtccgtctgcaatttaaaatgactcctgcctaggaaaatcattcctgtagtagtgtgtagtagtgactgaagctgcatgtgcatcagtggttgctttaatttagatcaactgggccccatggatcgaggaaaatctatagctgaaaacaagcgaacatggatgtatacgacatgattgtttgtatatgctgcggctcaataattaacttttccgaaatattttgtaatcatttccgctggatataaaaaatgagggcacgtgctatttagagctcaaaatagtttttcgcatcaaatgtatagaaacaatacacgatgtgtatgtaataaagacggccaaccgtaatataatactacgtatgttttacatgcatgcctcaaccgtgttaccgcattgtcggtcttctattaagtattacctccgtttcagaatatcatattcattcataaatattttaggacgaagggagtacttctttagaagtaaacttatgcctccaagttacggatcgagtgctaagatacgatgccaatttggaggcgtaagttaaacaaagttttaatggactgaagaagaatgtgtgaagtattttaaaagataaagtaagatttgttcatatcatactactatattaagttgatgtaattaatctaaaatcacgctcgatcggtctatgtatatataaataggatatgataacgatatgcacacaacctacaattattttttaaaagaacgacatgacaacaagtttcataatacaacgagctacaacacatgcacatattatttccacctctattgaccaccgtaacaggaccggggtccacgctagaacgaaacggagtaaagcttaatttgttctattttagatcaagtgtaaactgatgcgggtgctaaagtttatattgaggggtgcacacatgcatgatgaaaaataggtgaggctaaaaaattttttttggacgggttcgtgggcaccctccccctcccatactctacctctgccctaacttcgactggcccttccaaaacaaagtctccaaaagtgcacgtagcgggtggtaataggttaaggctcatggaccttttcacaacccatttcagttcttaaatatttttagctcattaaacctcagcctaactcttttttggtttcagccatcatattttgtaggctaaaatgttgggcacatattaccacccctatgcacaagccgttggttgttgccatgatgcaaaaccagtaaatgctgcatagcttaacctacctgaacgtgtcctcttggacaattggattgtgtatgccatctgcaaatgttgtcaagaacctcattctggccatgcatctaagtccactgtagaataataagagtaactgccgagaacgtgagagcccatacttgaataggtgcagatatgggccggaacgtgttcgtgcatatgctccgcgtagctaagcttgcgtctactagcattcaagagcaactggcactattacgaatagggtcatatatccatcgctggcggccttaacacgatttcatctgtggatggttgatcacgccgccagcgacaacagtacagtgaaaacataactttttaaaagatataaagcttgattcaactagttattgagggtttatttgaaatgcaggatagaaaaaaagtaaaacatggtgtttgaagggattagttaaacacataaatatttcatagaatcatagtaaggctttgttcggaacccagggttcccaaccccactccatcgtattccactcgcacgcttttcaaactgctaaatggtacgttttttataaaaaaaaaagtttctatacaaaaattgcttaaaaaatcatagtgatcaaacttttttaaaaaaattagctaatacctaattaatcacgcgctaatggaccgctctgttttccgtgtgtactgcgcgtgttgggaagagatacttccgaacacagcctaaatcaatcaagcttgtttatgattttttttgaaaaaattatagtcacaggatgttttgagcattaattgatttgtcttgaacttagggaaggaaaaaagaattggtagtacgttgtagtggatgtctaagtttttcctttgaaatctgtagcaaagatatatttcctctatttgtcctataccccaatcgtccatttcgaatgagtgaatagctggtatcaattcctatagcaagttgaaccctccacttttcctccacaaatctttcaaactcagaagaagaacattaggacgagcccatcatgagtatgctactgacccctttgaagcgcaagaaattttcgtgacacggatagggtgaacctatatatttctttataatagatgacaccgttaactttgggcatgttgttttaaaaaaaaatatatgtgtgcgggtgcgcacgcaaaacgataagtcaagtttaaaagtttctctaataataacgtttatacattttttaataagatgaatggtcgaatattatatcaaaatttaatgacattatctgtcaagaaaaatgcagagtactatggtagtttcactaatcaatataccatctgcactggtttgaagcaaatattttttcccattttactatgagaattttaatcatctttattcaaatgataaaagaacgtatttttatgtatatcaacttaattcccataaaactccgtttgatttttaatcatccgtacccttttgaatcacgataattctcacaagtcacatcccagccgtcataaaattcagtttgccctacaccgtctcaatggcttcttgcaagttaaaccagagagagagagagaaaaacaggcccaaaaaaggtccaatagcatcaacttcacccgaattaatcgggctggcacaaatcatcggcccgatatccttaatgggccagaaccggacaaatatgctcggcccatgaaagttgtgcttttgattggcccaactccaacccttacccggcccatcctgtagatctactactgctatgacctaaataatccctccgtcaaaaaaataaatcaatctcgcatttgatttgagacggagggagtacgagggtaacaacaataatgcaatatactaccgctatggtcagtacttcatgtcaataagcaacacaattttgcttgtcgataaatttctcctaataattttacattgtaatttatacacaattgctatttaacttgtatgcgacttttacataattttgaatcgttatatttgcttcaagattaatgcaggagggaaatgaaaaaattacagcgcacgccatcgggatgaatgggtttggccccacgaccttcacttgacggaaataatgcgttattactgggttttgaaagttagtactatagttttatcttatagaaattacaatataattacacactaagcgtactacatataaatttcagagggaagtgcacgggtggtctataggcttgtgtagatatgtcatctatttccttaagctctcaaaacacatatttagttttttaacatgtcgtggcatgccatggtggcatctatatattagtggaacccacgtgtcagttacatagaaaaataaaattaaaaaacagagagaagaaaatatatttttagttctttttatatgtgactgcgcgggttttcccttatcaacgggagcaagcttagcgcaccctagtgataagcacgcggttaccttggcaaatcacaagaaaacatataaaatttatcaaaattttaaattatttttaaatttatttgaatttagcggtgttaccacgattttgaccttggcagagcgattaccgctggtttcgcaaaccctggatgatacgtatcgacatgacatgttgcgtcactgcacgaagcggagtgaaccctatttagacatatatagcactcaccatgataaattcagaaacccaaaaatatattttaatactccctccgtttcgaaatatttgacgccgttgacttttttaaacatgtttgaccgttcgtcttattcaaaaaatttaagtaattattaattcttttcctatcatttgtttcattattaaatatatttttatgtaggcatataattttacatatttcacaaaagtttttgaataagacgaacagtcaaacatgtgctaaaaagacaacggtgtcaaacatttcgaaacggagggagtagttcataaatctaaatcataggaaagtgcattaaaggtcaaatagctctcaaaataatccttggatccaaacaacttagggatattttattaaaggtttttttcttgtataaaaaatagtagctttcaaaataacttagttagttctccaaacaggacagtagtatacgagtatagggaccgtacgtgcaatttaatcgatagcatagacagtccctagtccctaagcaccgacggagaaagcggatttggcgggagccgagccgagccgagaaatcgacggcatatataaaccgcgacaagttaaaccaaacccaatcaatcggtttaactcaaaatcccaactccgaacgcctcttcttctcctcaccgccgccgaagcgtagcggctactccccatctgcctccgcctccgcctctcccatggatgatgacgattccgcgaggaggagggggaggagccccgccagcttctccacccaggcctccgccctcctccgcaagaacctctgcttccaggaaagccgcaccgattgatcccttctctgtgtctgccttgctgcccgcgacgtgtttgtggatatgcctgcccggttcttatggtttaatcatgctgctctggtttggggcttttggatggatgatgggcagccatcgatttcatctgtgttcttgggagggtgggaggcatatggttgatggtttttggtggtggcatctgattcttgtctctttggctgcgggtgcagaggcggaacctgaagacgaacgtcggcatcaccgtcttcccgatcctcatctgcgtgctgctcgtcgtgcttcagaacgtgatcaacggggagctcgacaagcccaagtaccagtgcggctgcgaatgcaccgagagtgacctggatgggacctgcctgcggaaggagtgcggcatccagcactcgacgctggagcaggtatggagctgcgaggtgcccagcccaccacggtggccggccctgattcaggtcccctggccagggttccgggctgtcgggaccgcatcgcagccgttcgacgatttgcctaacccattgtgccgtggcgacgggtcttgccctgtcactctcctcgtcactggagagaaccaaacattagctgagcgtatgtgtcatattttccatattgctgatcgattgctaaaatgaatacttgaacttttcatatttcaaaaaattaggtgaatgtgttcatagttcttgagtacttccaattgacaggtgtttcaggtcgggtgtttcctgccctttatccgttgcctaatgtgacagactacctgatgcctcctcccttttctccctctcaagtgacagactatcttgatatcctctccaggatagttgttgtgagttccttcgatggctgcatgagtatacatcttgtagatcacgcttttttcttgaaaaatagcttatggagttattggttggactgatttgtcatagggttcagacacacagccatggtatacccaattgctagagcccgctttttcctctggtaaaactttgcatcttctccagcctcgttgcatgcccttcatgtttgggaccattccatacaatgcagggggcgtacccttacatatcggtaagttaaagcttccttctttgcaatgttgaatttgtgacttgtgttgaaaaacttaagttactttgctagtaagtcaggctagggatgcaaatatgcaattcaaaacttttcctgtacaaattcatttacatttgaagggactaaaaaatattttcctgttctgttattcattttgcatggtttctactttcaatacaatcaaacagaaacaagacaactagtttttttagataatggaatatagtagttgtgtggtgagacttgtacatgtctagtacgttgtgtagtgtagcttttcctaactatttatgcagtctgtttgacaacaataaatacaatatgttcatcgttcatttagactctttcgtagggctgcctagattgtattctgatgtcctgttgaatgaaccagatatacagtgtattgaagttcagatgttgtggcgtgaaagtgcatcagttatcaactatgaactgtttaagggttacgtacaaagaggaggagaaacaaatgagtttgttgcaggttatctttctatctcaatgtgaccattttgtggtcaatttgcaaccagaatgagtttgtgtaacagtggttttttttcacattttgaatttgaataccttccaacagactgcttttgaatgccacacatagtacagataattccatggccccatctccaaataattgcttcaaaacataacaaatgtagtttttcgtataaatggtggtggttatttgcaatgatgtgtgctgtatagtttaattgttctctgcaggttatgacttcttgaacacgacaggatatgacctcaatataaatgtttggtacaactctacttataatgataacactgcatattcatttatcgcagcattacgagttccacgattggtgaatgcagtatgttttccttttcataacttcgtcctgagtaatttcggtgtattacagaaccatctgacaattcagcaatttatgctttgtttcctgcagatatccaatgcatacctaaaatttatcagaggaagtggggtggatatgctgcttgaatatgtaaaagagatgcccaaagttggaacaaggtttaggcttgatctctcttctcttctcagtgtgctattcttcacatggatagttgaactacttttcccagtgagtatgatgtgatttaacaagttcagatgcaaaagaaaaagggagtgttgagtgtgttatggtcaggatttgtacagcttgcaaattgactctcttttccaggttatgttgacatatctggtgtatgagaaggaacaaaagctaaaaattatgatgaagatgcatggtctgaaggatgggccttactggctaatttcttatgcttatttctttgctctatcggttatctatatgacattttttgtgatttttggctccttaattggtaattttcttccaatctattttcacgaaggtgctgttctgacaaataaatctagatatttcaatagattttttttgtaggtctaaatttcttcagactcaatgactacagcatacagtttgctttcttcttcatttatataaatttgcagattgcacttgcattttttgtggcatctttcttttcatctgtcaagacagccactggttagtgattcaaccttgtaagttataagtccaaaatgtttcttactggaagtcacaaattacatatttcctcctgcagtgattggatacatttatgtatttggctctggcttgctaggggcatttctttttcgtttctttgttgaggacaggacctttcccagtaagttattatatctgttgtatttttcaacttaatttacataatatgggtaacaagcatttttgttttctactcagatggttggttgttagtaatggagattgtcccaggattttccctctatcgaggactatatgaacttggccaatatgctttctctggaagtgctatgggagcctctggcatgacatggggaaatttgagagacccaatcaatggaatgtgtggtatatttatcatcatgacagtagaatgggcatttctccttatgttagcattctatttggatcaagtctctccagtaggtggtggtgtcaggaaaaggcccttattcttcttcaggtgtttacagaagaagcacacaccgtcattgcagaagcctagctttgtgcaacagggttctaaagtaattgtcgatatggagaagccagatgttgctcaagaagtaggttacctgctatactttgccagtccagatttaatggagtacatatgttctaaatttattcattatacaaattctatccagagagaagtagttgagcaacttttggtaggccgcaatgcaaatcaagctattatatgtcacaacctcaagaagatctatcctggaagggatggaaaccctgataagctggcggttcgaggattatctcttgccgtaccaaaagggcagtgctttggaatgcttggcccaaatggagctgggaaaacatccttcattagtatggtatagtactaaaatggcacgtggtaccattttttgtgaaaattgcttagttgtggcagctcacctttattaaccttgttttgttattttaccagatgattgggcttgttaaacctacatctggtacttcctatgttcatggaatggatatcaatatggatatggatcacatatatacaaacatgggggtgtgcccacagcatgagtatttgctacaactagcacttatctgaccaaaaagaatctttcccagaccagattattttttttatagtaatacgttttaatctgaaatgcagcttactttgggaaccattgactggaaaagaacatctgttcttttatggcaggctgaagaatcttaaaggtgctgtgttggtgaaggtacctctactctgcctcacttatttttaaatttaatatccacatttcattgttgaccatatgaagttgttttgtcacgtatttcataaactatactgctcagctatctcagcatatgtacatcttgtatttgaaccatgtctgggatttttccactgttaggctgttgaggatgctctgaagagcgtaaatctgttccatggtggtgttggtgataagcaagtgggaaagtacagcggaggcatgaaaagaaggctcagtgtggcaatatcattgattggagaccccaaagtacttttctgtatatttttttaacccttccataggatgtccttttgttcttttgttaatgtgttatgcaacctgacaacacattctgtaggtcgttttcatggatgaaccaagcactgggctagaccccgcatcaagaaataacttgtggaatgttgtgaaggaggccaagcgaaaccgtgcgatcgttcttactagtacttatccttttccctttctactttcgcgtccaattcttagattcctaacgcgtcacttattgattttaaaatttacaagagtatcaaatagtgttgatcaaatgtgattctcgcagcgcactcgatggaggaggctgaagtactttgtgatcgacttggcatctttgtcgatggcgatttccaatgtcttggaaatcctaaggaggtacattttattgccttcttgaatcacactgtgtgctttatgaccagatctaaaacctcatttgcacaatgcagctaaaggcgagatatgggggagcatacatattcacaatgacaacatctccagaccaagaacaagaggttgaacggctagttcatgacttgtctccgagcgcaaataagatctaccacctatctggaactcaaaagttcgagctgccaaagcaagaggtgaaaatagccgaggtatttcgcgcagttgaggatgcgaagaaacggttcaccgtgcatgcctggggcctggttgataccaccttggaggatgtcttcataaaggttgccaagggagcaaaggcatccagtgttaatagttagtttgtgcattgataatattgtgagatttataggccgactaatattcttttatgtcttgactttagcatatatgattctttaaagttcgagctgccaaagcaagaggtgaaaatagccgaggtatttcgcgcagttgaggatgcgaagaaacggttcaccgtgcatgcctggggcctggttgataccaccttggaggatgtcttcataaaggttgccaagggagcaaaggcatccagtgataatagttagtttgtgcattgataatattgtgagatttataggccgactaatattcttttatgtcttgactttagcatatatgattcttttgtggttgtacagaaacatattattctcatacatcagaaaaaaaagtaaccatatgtaacatttttgtttattttaaatgtacaaatgactcaatatatcattgcagatatgcgggaattacaaaatataagcatccaatgcgtgttgctaagtgaggccttaactcactgacccacatgtcactgatgtcagtgacacattggatgctatttttaaattatttttctaatagcatgtggagacggaacccaacgttgaccagctgggttgggagattagtcggcagccatttgacctggagtttctctaaaaccgttgtttatgtcttgagctgaactggcaataatgcaatgcaagatacatgtgagaccatgtactatttacaccaaaagagcacgtgtgatctgactaatgcaatgcagttgaagcatacttggatcttccgatgctgatcggtttatctgcaaaaaaaaatccatgccgatctttgcttaatttatctaatggccatttggaatacgcagaagaaagaagaaaatttgattaaattaaccacgactccacgagagtcaaacgagcgccgttttgccggtgcatgtgagagtgcatgttagatgtggccgttttgtcaacacgaacgttttgatatttggtcggaataattgacagtcacgtcagcaaaatggacgtcatggatcggagatgcaaaaacaagaagcacacgatgcaaccaacttacctaatagtaacgtgtacttgaagttttgctttgtcacagattttcaaatctactaaccagtgatggagctagtgatgtcgtgaaacccgagcgaatactaatatttttggtgatcgatcgatttttttaacatcaacagctatctataaggaagacgctagcagccgaacccagaaagccgtccgacctgtctggga

SEQ ID NO: 44523 - DNA, 16398 bp, Oryza sativa
gcatcttggtgtcatgtgctatagaacactcacactacactcacgctgcataatctgaacatgtgcattgaactcactaatttcctattaaaacccacctatatgcgcgtaatattcatgacactagacttgaatcgtagtgggcggagacatgcatcacgactccaccatcacaccgctaatgcttccccctgctccacctcactttgtcaaagggatgagacatgcatgtttagattagtgccaaaatgaactttcaaaaatttggcaaaaccaaaattttagtaaagtgataacaatgtaaagttttgataaggctaaatgtgttgttgccaaaattctctagatattactaatatttggtaacaaactaaatgcatccatatatttatcacatttaccttaaaaaaaatcgtatggtataaattagcactaatcgaaacatgccaacatgtcatataaaatgtgggcaacaataagttagagataactatgccagtagagtttacgatgttctaaaaaaaaaaggtagagtccaccatatgcgaattcgagaagtaataaaagtgtataaccaatcaagcaaacgctaggttaacaaattatgagtttgtgacaccttttggacgccaacaaaatcaaactaagaaacgacgagagtagcactgtaacccttcacatctctaatctcttcaccgacgaactgggacaagaaaaaaatctcacaaagggacagcccttcattcccccctatccccaatcattccctgcaaaaacaacaagattacacagtactctctttgttttatattactaagctattacgatttactttttaatcaaattatttttattttgactaactttataaaaaaactgtaacaaaattttaacacaaaataaatatattatcaaaatatattcaacattacctttaataaacctaatttaacattctcaatgttgttaaatttgtttataaacttaattaaaccttaaaaaaagttcgatttaaaatgacgaaacggagggagaagtgcagggtacgccgacgtccacgtcagcgccacatcggctcggtgggccccacccctcgccgcgggccccagccgacagtgccgccgcacgctgcaaaagcggtccacgtagaccacgtgctcccttcccctaaagccgagaagaagaagagaagcagcacaaaaaaaaaaaaaaaaggaaaaaagcgaagagaagagagagagagagtgtgaagcgaagcgaggaacatttgtgcttttcctccgcttccttgtctcctccttccttccttcttttgacgcaaatccattattctctccgcttattccccctccacctctcgccgccgcctcctcctcctccgccgccgccgccgccgccggcgagcgaggcaggtgggctgtcctgctgtctacctggttcagctgctgcggtaagccgggcgtggtggtgagcttgggttgggtgaggatggggggtggtggtggtggtggtggggttgagggagatttggtggtgtaggtgggggtgatttgatttggtttggtttgatttgtgggcgtgttcgtcggcggaaatactggtgggattttgttctgcggtggcggcggcggtggtgatttttggtgctttcgttgatgcgtgagggcggcggttttgtggccgatctgatgcgtccgaggcgcccggagtgaggtggttttgcgcgatttggaggaggaggtggtggtggtggtggaggggatctctcctctttgtgaggtttttgggaaagtgtgtgtagtgcgaggtggggatgggggtggcgccgccggagctggggcagttcgacgggtgggagagctccggggaggaggagagggagaggtgggggtggtgccgccgcagccggagccgcagcgggagccgtagcggcagcggcagcgggagcagcaggcggcggctgccacggaagggcagcggcggcggcggtggcggggaggacgccacggtggccaccgggtgctgcatccggctgtggccgatggggagctgcccaccgccgccgcggtccaaggtggacacctccaccagcagcgccagcacgcacggcggtaacgtccctttcgtcctttctaaagatgagctaacctgcaacgactataattggaatttggaatctgttatgtaaatggattttggccataaataggatatttagagtcgacctgcaggcacatggccttgattagcgctgaggttatagtaagttagaatgtaaatgttgagtacctatgcatatgcctatagttttgtagagagctgattgcagctttgtttttgttcttagaatccttaacactttgcgcgcgtccctgttttgggcattgaatgtacaaattgactagtaattattacgacaagcgtgtaggacacgtaattatcggtaaacagtcggcaaatcatacatatcatccagcatcatatttcaagctgagctgtagttctcattactacctattaccgtttaaattggaagatagatattggatgagcgactgtatgggaccagtggcatgagtgttcttttggggtttctattctatttttagtgtggcatgtggttgttcgtgctccttgcatgccacacttaatctcgtagcaaattaattagaacggcacacataaatgagcaccattggtttctccagtcaggaatggttgttgatatgttaggatcagccacctgactttgatggtgttttgacagcagatgtggtgtttgaaatcatgagtcatcactcatcaaggctgcttggctgctttaagcattcattgatggacatgaatgaatggaacatgagaaagtcgtattttcttgggatccatacccaaaaagaccaaaactaaactttacacttcactgtgtccttcagctgtatcccagaagttactgtacagtttgccaatttcattacttgtgtttatctgaattagtgttgtggggtttatttattgctgaggagatggtctttcgtttctcattagtatgccatattaaaactgttatccatttcatggaacagcagaaaagtcaaccgaaaatggtagcaggaaccatccagttgtatcagtagtctcaggctcaacaactactagtaatgctgagagcagttcatcagcatctaaagctggagaggaaataaaagttgcctcacagttgcgcaagtttgcattcaatgatctaaaatgtgccacccggaacttcaggcctgagagtatccttggagaggggggttttggatgtgtttttaaagggtggattgaagagaatggaactgcacctatgaaacctggtacaggccttacagttgctgtcaaaacactcaatcatgatgggcttcaagggcacaaagaatgggtggtatgtgctttgttattcttattgttcaaattgcttttgttccgttcatgtttggtaccattcccattagaacccccaatgactgacatttgttctgcttcgtttcaggcagaggttgatttcctaggtaaccttcaccatcccaatttggtgaggctgattggatattgtgttgaagatgaccaaagattgctggtttatgaattcatgcctcgtggaagtttagataaccatctattcagaagtacgtgtctgaccagtttctcaagacattgaaacttcaatttgtatacaatgcctgtgctttaatgaatgaacttatcattcatatttgagtagctcttctgaagtgtttggtcattgcatcttgctgctggaaaaaatattaaatagatagaaatattgaatcttatatgatttatgattcacctatagggtctcttcctctcccttggtccatcagaatgaaggttgctcttggagcagcaaagggtcttgctttccttcatgaagaagcagaaagaccagttatttaccgtgattttaaaacatctaatatactgctagatgctgtaagttttaagtccttgaattggattacgtattgcacaccacacgattcacatcttgtaattttgtatattatgctactcttgcaggattacaatgcaaaactctcagattttgggcttgccaaagatggccctgtaggtgacaaaactcacgtgtctactcgagtaatgggaacatatggttatgcagctccggagtatgttatgacaggtaagtgcttcatcagtcatcaccagggttgacgttaccgccggtaaccgcgggggtacggtaatataaataccgcagtaacctccttaaattcaaataaatttaaaaaataatttaaagttttgataaattttgcacggttttgtatggtttttcacggttatcgcggttactgcgtggtaaccgtgcttactgccggggtgcggtaaccctggccccggcggtttgggaaaccctggtcatcactcagacaaaacataactggtctgaagatagttccacttccactttgttttatctctcctatgtatgccaaaaacaagtcagctatggcgatttactattacagttcttgcatcaacgatcagcttatgcaccctatggtctttcggtctctcttatcggcgacacttaaatctatggaatggaaatgattataagaagaattgtcatgatatagtagattagtggttaatgtacaaaatattgtgaatgtaatatacaaaatattttagttagttcttcctagaattaataatatgtatacagtgtatcaattagtttctttggctatgattaatgtaattaatgtcagctctatttatgaactatattaagcctttacacttgatcttgggaaaataatgtagaagggaaataccataatatttaattacttgtcattacaattaatagtagttgcacaagtgcgtcttgtttgattagaaatcccagcactgttgtgaaaacacatttgcaggggcaaaacaaatatgtctaagagtgcaactgtagagtaagtgatgttgtccatatggtagatgtttgtcattcatttgatttccaggaaaatgtattattgcctgcatatcatcaacaatctttttgaatattaggctaatgctgggcactgggtttttcaatgattatttgtgcaaatgaagttcaaacacagatttgttgcctttggtattttatgcgattttcattatgactcttggtataattttcttgtattttttcacttttcaggccatttgacatcaaagagtgatgctatagttttggtgtggtgctacttgagatgatgtcagggcgcaggtcaatggacaagaaccgcccaaatggtgagcacaaccttgttgagtgggcacgccccctcctaggagaaaggcagcgcttctacaagctaattgaccctcgtttggagggtaacttctcggtcaaaggtgcccagaaggcagcacagttagcacgtgcttgtctcaaccgggacccgaaagcccggccactgatgagccaagtggtagaggttctcaagccactgctcaacctcaaggacatggctagctcctcgtacttctatcagacaatgcaagctgagagaatggcgcactcaagcagcatgaatggtaggagccatgcccttaaggtgcagggttcatttgctcggaacgggcagcaaccgatgaggagcctgtccgatggcccccgtgcttccccgttccgctactcacccaagccgaacgtgaaataactagagaatcctggtctagttggtggaacttggttggggggctgagtggcttggctgaacattgttgtgcaatctgaattgatctttcctgtagattgacatgtgaaaatggatataggtgaaaaggagctgtaggtaccagatttcccttgtggatgtttgcactgaggttttaactggatgctgatagacccttttctatatatttttcctccaaagtaagctagctttggttaatttaattacacaatgatcctcctaatgattgcccttacatcatttaggaggcataggtgcatcctaccagactgtttatgcgaaactgcacataccctaaaatgcaaaaatggttggtagatatgccaatgtggttctgttgtgagtgcattattgttctccaaaaaatgccctcttgttgatctataggcattttcccagctgtgctctcttgttctcttgtggatgcatatttgcagagagccatactgttttcttgcagcaagccaagtcttggttgcagacctgcagcagaggcaacgtgattctctgcgttttgcctagaaacggatagtgatacacaccccgcggttttacctgcatttcgcttaaagaaggcaatgccatcattcctacactgtttcctggaaggtgcaaaacctgaatttcctgcatggtcataaattttcttggctcatgaacacgctgtgaatgtgaggttgtgttcttttctgcgtattcaccagattattgccgtgcattacttgctccacgcttctaaagatatatctttgaaaagttctctttagtatattgcttgtaatttcaaatcctcgtgtccacgaataatctatttattagaatgttaccatatgttttctcagaaatcagcactcacaaatttagtcatgtttgtgatggaagaattttggtggcgaaaattcgattttattcccttgttccaaacagagggtttggtttgtgtatcactgcctctcgatcgaacgtctaacctaaaggctgattcaattaggccttgtaatgatgcaggatgccacttgcaatttcaagtattactcgaagatagtagcttgcgaggaacgatccaattatgtgtgccagtgctattatattataccaataatgtgtccttcctaattcacgcaggtcatcatttagggatataatcttcctatatatgtgcattgcatatggaccattggaaaccattcctgttttcatatatattgtacatctttccaaacataaaaaggaaatgtgacagagagatgcttgcacatttagaaatatctcataactcatttttagaaaatcgacgatatttttagtctatgttgtttctcttctcgtattgaaagtttacacggtacttcccggtgggttcgtggaaaatatactccaaaaatttaaaacctgtcaatgttaccaccataattctcgaccaaaattttatggatttgctgaaaaagtgtcgctacattacgtggctgagtacagttggattttaatggcttggatgcgctgcgctggacatcgtgtgcacaatgaacatccgtttctccacctcctgtctttgtagcagtcaaatttgttattctaattatatatttatacaaatttgcacagtaattacatcccactggggtcttctcggtcaattcacattatatagctcttgttcatacggacgtcccaaatattaatagacgtatttggaagattaaagtaccgctaaaagtaaaagtttttctttggtacttacgtcggggagtaattctaaccaaggataacctagctaaacaaaattggaaaggcagtaaaaaatgttgctttcgtcataaggatgaaaccattcaacatttgttcttccaatgtcatctatctcgtttggtatggtccgttattcatatggcctctaactttcaacctccttgaaatgttactcatatgtttgggcgttggctttcatgtgttcctaaagaaatgagaaatctgcttttgatgggtgcagcagctctttgttggtccatttggctaagcagaaacggggttatttttttataacaagttagtgtcttctcctttacaggttattactctagttacccggtggctgcgtacctgggctatcctccacaaaccgggattgcaggatactattgcggtggtatctcgacgtttggaccaggtggcacgggatgtttttacccaagagcataagtggcgatctattctacggattgatagtcactaacatctatgtttcgtgatgggggtttagtttcgtccttttattggttgtgtgcattttatgcagaggccgggggtgagctcagttgaaatgtatcatcttggtatatttgactgagtcttaataaagcttccattatctaaaaaattacaccccacttacacatcacttacatatgtaattaatacgtaattttggtatttacatatgtaatgtaattttaagacttacattaaaattacatatgtaatttaggaacttacaatgtaaatacatgtcaactattttttggtgaaaaatatgatgctataactataaatataggtagtcccaaattttatctcattttctaaaagaaaaggtaataaatatatcgatcaggacattgtaaatatggaccaaaataaaaccctactagaaactttcttaaaacatcgaccaaaaataaaactatttcctaattacagtcctttcccgtcaccaagaagtatccgcgactaccatattcgacggacaggcgaatcaccgccgtccgatcgtcatcgagagaagatctgggccgtccatcgcggtaattaattaaattaaagagcaccgcctctacttctcggccgcgtctgtgtgtatatatagacccccacacgatggagctctcaaaaccccaaagcaaatcaaagctgcaaccgctcacgaatcatctcctctcagtgtttacttcggcgaatttgaattcttcgtcggattctcctctgcctcgatcgaaggtaagaaggttttcgaggatttcttgaaggttttcatctcctctccgagtattagatggattttggtaatgcgggcacgggcctggggttctttggggggattttgtgagatggttatgcttgtgaaaaattaaagtggaagaaatattttcttcttttttgtggggtatattcagcgtgtttaaaccctactaaaaagctttggttcgagagtcgtttttgcgggtttgtgtgatggatctgtttgtttatgtagtttgggtgtgctagtttagtttgcctttaggtggccaagaaatttgcatcttggtggcgatcgtttcctttgatcccagtgttcttttagtgcgccatgccaacactcgtttgtcttgcggtgcttactgatctgatcagttggttttagtgattcgagtttttctaacggataccgctgaatgtttttttgtgacttatttttcgaggtgttgtggtgtttcatatgtatatatatattttaagtttccatgatgtattattattttgattgcatatgatccactttttttactgtctcaagcatgcgcttatttgaaataattagatgggatgagttctttgggggatgaatttgatattgtgccacgagttgatatgattgagctgttttgtggtgtctcagatttactaattttcaaagcattgagctgcattacgaactactttatatttgtcatcatgtaatgtcattctgattgggcatgattcacacttttctaactgttacttgggagttgggactgttaacttcaatctgtacaaattattgtgaagcatatcctaaaatttgtagcctcgcttttcagtgataccttcactgattttgcattgcaagcttcacttgtgagatgataaataaataaaattatactttctgcagtatctgaaccatctttcaagtttaagtcgttttcctttgcaggtaagacatgggtcagtgtttgggtttagtacagattgatcagtcaactgtagccatcaaagaaaatttcggcaagtttagtgaggttctagagcctgggtgccacttcttaccttggtgcataggacagcaaattgctggttacctctcactgcgtgtgaagcagctggatgtccgctgcgaaacaaagacaaaggtttactccaatctcgttctattttttctttttttcatgctttgctggaaagtgaacaatgagtgaagaacatatttctgttataaagtgaaacccagataactcactaactcagtatgagtgaagaacagaaatatttcattaacatttttgagataactcactaggtatattttttcctagctctaatgtatggatctttgtgaatttaggacaatgtctttgtcactgttgttgcatctgtgcaataccgtgctcttgctgacaaggcatctgatgccttctacaaactaagcaacaccagggaacaaatccagtcgtatgtctttgatggtaaatgttctgcacttccatctgtctgaaaattctatttcacatgtcgaagtccccatctcttttcatatatagttttgtcttcgtgtgttctttgctaggctagttgaagttaacagtttcagttttgagcatcatatatacctgctaagtttttaattagtgaacgaaaggaattctacgtttctcattgggcgacatcgtttatcttttagtcattagagctactgttccaaagctgaacttggatgatgcatttgagcagaagaatgatattgcaaaggctgttgaagatgagcttgaaaaggtttgtctactatttgctatcctagagacaagaaaacatttgtttttggactgactggatttatgattgctgtaggcaatgtctgcatatgggtatgagattgtgcaaactctgatcattgatattgagcctgatgtccatgtcaagagagcaatgaatgagatcaacgcaggcaagtaaccattgccctttccctgcataattgttgcttgctttcgatcttctcgccaaagattgagttggcaatagctttttgggaatactgagttggcaatagttccttccatcaatcacataatcatttacacattgattgttttgattgattctgtaacatgtactcagaattatttccatctaacatcttgatttatggtattgttgagcagctgcaagattgagggtggcagccaatgagaaagccgaagccgagaagatactacagatcaagaaagctgaaggagaggcagagtccaagtacctggctggtgtcggtatcgcgaggcagcgtcaggccatagtggatgggctgagagacagcgtgctcgccttctcggagaatgtccctggaaccactgcaaaggatatcatggacatggttcttgttacccagtactttgacaccatgaaggagattggggcctcctccaagtccacctcagtgttcatcccccatggccccggagcagtcaaggatgtcgcggcgcagataagagatggcctcctccaggccaatgccgaacgcaatgactgaatgatggcttcggttttgcaagcagcatggagttcttcatcactatcctagaaacatatcgtgtgagattaaatgttacagcaatggttaagtggagtatattttaggtctacacgcatgcaaatctctctttaagttgtggatcttatacttgttacctactagatgagtagatggttgttaagactttcatgagttgcgctaaaccatttgtcagacatatattatagtactggttggtatatcacttataacagattgcaagttccaggaatttggtgatattatgctgtgttgtatggttgtagaaaatccatcagattgagcttgatgtgtgcctatcaggctttgtgttgtgcaaagctggaggggtttatgtgaacagggcctagaggcaatgttcataataatggtgtgtgcatgtacttggtttttggtggctcaataatggcagattcacatgaatttgctgtttggttttgttcacatgaattttcttgcatatatcaagaggcacattgcattactgcattacacaccaatcaacaatacaattatacagaagagcaatccaccatgtaactaacatcagttttattcaccatgtacacacatactgatgaatctgttgcagaggcagcactgacactacccaaaacacacaagtctgccaccaccaatgctcatgtgcaatacagaagttggtgccatctacaaatgttttgcctttgtgaaaatggcaggacagggaatggagggagcagcagttctcaggaacacaggcctcgcagggttctgatcgagcttgagcaggtcgggcatggctgctgcggctgctgcttgacgtagagaccaaactggttccaggcctccatgtactcctttctccactcctctcgcagctccgcggagtcgcggtaccattgcctgatgattcacaaaatgatgagcaaagtttcaggtcagaagggtactagtactgagcaaattgcttgaggtaacagaagaaaagatgaatattcttgtgttcagtattcacttcttttacaaaaaaaaaaaagagtattcacttcttttagcaactgatcaagcaccaattaaactaactgtagtttcactttggtcagaaaattcagcaagaaatatgatggccgtttgcttgaccgaaatgttcttaaaacacgaaaattaatcggatttagggatctccctaattcaccagcgatgatccatcatcaattcaactctccactgttaagagcagagctatgatccagcctgtaagcaaaaggcagataccaatagacagcaagctacatcatagccattgactcggagagatcgagcaaaacggattcgattcactgcatcgagcgagctcgaggcgtcggggtgggcattacgtcgaacacgccgcgtgcaagaaccgggaatcgcgtcgtgctctgctcactgacctgcacacgagcgagcagctgaggaggtcgacgcagtccagctgcgagaacacccgcgcgatcacgtccgccggcgcccgcagcgccgccgcctcgcctccgccggcaaccatctcctcctcctgctgctgcttccgcggcggcgccatcgccttcctctcctaggaaatccccacctggccggttgaatttaagcgatcttggcataaaaatttaaggggaaaacaacaaatttgcagcgatttgtttaaagcccgagtggatcgggatgatcgattgcttggcccaggtcaagagagatgacgcgagatttggggataacacgaaatgaattcgggtgattgcgaaatcgcggacgcagaataattaaaaggtgatttggatggggagggggaagggattattggatcgtttggaagaattgatgctgggcagctgatggtgtggtgatgcacattgtcatgacttttctttgagatccacagcgttgtggcttatgcctattgttgggcggctgatgatgccatatgatttatcttgatatgacaggatgtttataggtgatttgttgcataactttgtggttacttcctccgtaaaaaaacttagggcctgtttggtacaactccaacttttaaatttagcttcagggtctggagtggagttgtgaagctgcataaacccagctccacaactctatagtttattttgtgatagagctccacaaaactgttgggagtacctatacatctttcgaaagatttttataatcgtatcacacagatttttaatctttatattaaaatccgatagatataataaaaagcaaaaagcaattaagaaacaccataatgaatattaaattaccatatcctcaagaaaaagaccaaatccaatacaaaatttaaaatttacatgtgaagattcaaaaattacagtgtaacttacaaaagttacagtgtaagttttataaattacactgtaacttacaagaaaatgcactgtaaatttgagtgagaaaatcgagtgagagataagaaaaaatctttcgagtgagatatagcaaaatcgaaactgtttggctaatatgataggatgggactccagattcgttatatgggagatggagctgtgccaatctgataggacgggactccagattcgttatatggggtatattcactcctagattgattttttttttacggataaggccatattatctttgtagataataaaatactcgtattttatattccatcgtcccgaaaaaatataacttacgaggatgagcctgaaagtgttttgtttttttagggaggcgtacattacagtaatatttgattagaaaatgtattaacaacacatatttttttcctttgtcacgtacgatgttgactttcatgcttcacaattgactatatatcttatttaaaattttagtgtgcataagaaaatataagccatttttaaagtatttaatgataaaacaagtcataacataataaattatatttacatatatatatttaataaaataagtggtgatatttaaaaacattatgcatttaaaaatggaggtagtataatgttacatgtagggtgctatatttcaaaatggataagtaataaagagcaacattcccttgtcaaaatacctaatacattaggccaagaaagtcaaacacttgcctgtttatttatacatagaactttttatttgacaggtttatttctgtagaatgtttttccttgatggcctcatcttttcacttattattatgcttattagtcaaaatttaaatttgtaaccttaaatttgaagctgattttgaggttttttcatcgaagtttatttttcagtcgttgcttttagatcgataagaacacgtatataaaagttttattcatgaattatttttcgtttgtaaatatgccgtttgatggggccttaagtttgttttggacaaagcaaagacagcgttgctttcctttgcagaagaaacagtttctctatttttaccccaaaaaaaaagagcaaaacatctgggttaaaaactcctgcaaatttcatgtaaatttccatatgttttggattggttaattctttaatttacattctaacatatttctgctattctcattcccttttcaaaaggaaatttctagttggaataacaaagcctaacaagcctaccaaaaagcaagatgttctggctgttccaacattaggcctagctaagggcttgtttgttcagtttaagatttttttaatcaagattattaaatttgattactctaagctggattataataagctggtttagaataagctacgagttatttgtctctagattattggaagcatctaagggtagtgggtctttagccactcaataatccggaaaaagctcctccctagaagattattagattatactaatctagcttatagattataataatatatcataataatctacttgtttattttcagcttacttctaataatacagattataataattctaagctgaatgaaacagggcctaaaccaacatctccttaacctcttgtttaattgattttgggctacgtagacacggccctcaaagcctgggccatgttggcttgggtaggattatgggcttgaagtgacattttgatgtgtaggttttgccctcttcatcaattttaagctagtaaattttgctacaggtcattcaaattttgtgtgatttgttggtagtcatcgtaaaaaacgtgtcacggttaaaagataccctaaaacctgataatttgctagaggacactttcgcctcaattgaagagataagttcttatgaaagacgagaatgtccctagtaccacatgcttcaaacatggagtgaaattttgaaaattatgcaactttaaatttgccatcaccccaagtatatcgctagcatacatcatattccattttcgctctagccacaggttgtgtttagttcacactgaaattggaaatttggttgacggaaaagttggaagtttatgtgtgttggaaagttttgatgtgatggaaaagttggaagtttggaaaaaaaaaaactttggaactaaacacgacctcagcttggaagtttttggccttaggggcatcctcatccttttaaagaatttttctctccaattgagtcgaaagtgtcctgagcaaattactagttttttctctccaattgagccgaaagtgtccttagcaaattagcaaattactagtttttatggtatctttcagtggtaacacgttttgcgatatctataagctaattacataaaatatgagtgtcatatagcaaaatttgcctttgaagcatgattcatttgaaaaatgttggaggtttttttttttctctctctctctttatttgtttatttcagaatgcattatatttatagatttatcagcaattcgtgtctttcgtttatcctcttttctaaccttcgctccttcgtttttcacgcacacgtttcctaaactactaaatgatgcgttcttttttaaaaaaatagaaaaaaatgctaatacttgaaaataaattatagaaaaattgcttgaaaaaaatcatattaa

SEQ ID NO: 44524 - DNA, 14095 bp, Oryza sativa
  unsure (1)..(14095): unsure at all n locations
tttatttttttaactaaaattgccgtgtttgctatggagacagctttataagaatgtcaccttagtcgaattttaattgcctaatgtaccatggcttgtaaatcaacatccaactctttctttatcctaagtcatccctaacttgccctttttattttgcttttccatttttttttctaatggaacctcaaatgacattcgtgctatactttcacggtacattcactcattggctgatgaagagttaggcctagtttggatatatttggtttagcttttttacgacagctaaaacgaagtaagccattagagtataattaattgaatattaatgattataaaatttaaatataagtttatttgatttttaaaataaacttctatataaaagattttgcaaaaaaaacacacgcacaccatttaacagattgaaaaaaaacgtgttaatggaaaataaagaagttacagtttggagttagggcaaaagtaagtatttgttattgaaaatctcacaatatatatgtataagcaggcaatacggtgggttccatgaaaatataagaatctagcagaagaactattttatttctctatttcctggttttaaagaaaagaatacagccttagttacatttaagctgcaatggaaataaaaacccacacacggtattatgtatttattatccattggccatttggaccattggatcaagatatgtatatatcatggacctttgtcgcattttcaatattttccattataccgatatgcactctgtatacaattgcaatgcattcgtgatttggaacataagaacatatgaatctagctagacaagattttgatcaaaagtttagacacaatatcaaaaggactatttgattatacatcgctcaatcatgtacatcttgttgaatagagaatatatgccttagaatccttacattcaatcacatggtttggaaaagaataaacccgtttgatgctctagctctcaagtctcagcaggctagacagccacatctccagcctgtgtattcagctactctgaaaaaatgaaaatgctatggggcacaacaaaagcaacacataattatagctgcacaaccaggttattagttgacataggctttgaccttttgagttataactgacaagtcgtgacaaaataaacgaaacaattataataaattttgaaaaaagttttatatctatattatgttgggtgtaaaagacagtgctgaaaattagattgtgatgaaaacacatcaaaattaagttttaaaatattgtagctgataagttaacaagtagatgataagaggcatacaatatactttcaattgtgaattatgaaaatgtgaaatttagattcaatgaaatagtatttacatttatttgcaataaatggttaaaatattattgaactaacccattctgcacctgatatcatcacaaatttataaaccatttgaattttgaacaacaaaaaaaaatccgataccaagatgataccaaaggacgggttagatacttgagacatctagagataacaacgtcatttgaactcaagatataacagaagcaaaggataaaataaagaaaaaaaccgaagaaaaaaaaagataaaaccagaaacgaaataaaaatctagggtttatcagggcccacacgcagcctcgccgcgccgtgttttttttttcctccgcctttattttctcctctcctctcctctcccgcaacctccacctcctatccgccgccgccttcttcttcctcctcccacccgcgcaagctatccgccgccgcatcgcgtcgtcgacgaggagatggtggggccaggcctgtacccggagatcggcaagaaggccaggggtgagcggccgcgtccccttctcttgtgggattagagctttggtggttcttggatttgattttctttttgtttgtttgtttgtttgtttgtttgttgttgatgatgagttgtttgtttttgctgcagatctgctgtacagggactaccagaccgaccacaagttcaccctcaccacctacaccagcaatggcgtcgtaagtgctctcgagttttttttgttgttgacttgttgtatgtaagaggctttcttgatttatttgtgtgatttactgcccctacctgctgttgttaatgtgtgatgtgtgatctttgcgatggattagtttatttatagtccatagttagtggattgtaggaggtatatgaatgccgggagatttgccaggtctcgcttgtgccttggtttgtttcgcttgtttaggaggattagcaatgtacctgttgcttagtgagacgcgggatttgtaagctaaaagattgttcgagagattatctcttggatagtggtaaaatgatttaggagtaatctatatcctaggtaggtcttttttgttattgataatgataggtagggagttgggttaaaacaacagcatgcttggcaactgattggtggtttgattgttttgaaagagggttgaacatgaacttgttggttgcagaacattagtttaattagtcttctttatttaagaaagcaagtctattactgaagcagggaggactcttgtttggtacattatgcaattattatactttgcccttggtatgcttacggtttttaaagaaaactaaaagttatgggagaaatcccttcatgcaagtgcttgtaagtggaatagttgaagtgtgctcctgctaagagaagcattgatgaaagtgaattttgtgcataataaacacaaaactgtcttgtattgttggaataacctaaactactaaaggctgtactaatcaattacatgttcgtaatgatagcttgtaaaggtggtgactggttggggtgtatatttgagggttatcttagtgttgcttttcctgtatgattgtaaattttgatacaatcatgcctgttgtggcagctatgatgttatttgtttagctctttgacttgttattccttgatgcaggcaatcactgctaccagtacaaagaaggctgatctgatttttggtgagatccaatcacagataaagaacaagaacatcactgtagatgtgaaagcaaactcagactcaaatgtatgactctttctctcacgcacacacatcgtgtgcacacgcttgcgcacacatacacacagataaacgtgcacacaactaatttacattttgtgattgccttctacattgcaatggtctgaaatccttgttctatatgaaatacacagacacacccaaataaacttgcacacaacttatttagattttgtggttgcctgctacattgcaatggtttgaatccttgttctatatgaaatgattttacgttgccatctgacgaattcgtaccgaatatgctactagttttgattgcattgagcaatatgttctgtgattagctgttatgccatgctctcccttttttgtattgactgcttctatctttggccaggttgttactactgtaaccgttgatgagctaacaccaggattgaagtccatcttgagctttgctgttccggatcaaagatctggaaaggtaatttgctcatgcaccacattactgcttattttcaatgaaaccttcttggttggttgtcctcactctccctctttttggtttcagtttgagcttcaatactcgcatgattatgctggtgttagtgcaagtattggtttgactgccagtcctgtagtcaatctctccagtgtttttggaaccaaggctcttgctgttggtgctgatgtctcacttgataccgccacggggaacttgaccaaatataatgctggattgagcttcagtaatgatgatcttatcgcgtcattgaacctgtaagtgtcttgggcttacagtgaattgttaccttcatcatcttctaacttcataactctttaagttattgtgaaatccacatttgtacatcctattgaccattccatctgtcccgctagaagcaatgtgtctgttcttgccatctgaacaacttatagcccaaatagagtttatatatatatatttttatcaggtttcatgatctacctctttcaataatggtaggaaacatgagataaaatagagtaaacttatcaatgttaatatcttattgtagttgacatgtttccttgttctcgttaactacagagagcaagataatgtttacaagccatgtttgtgatctccattcaaaagccgctactattttagttgaccatatacgatcaagatactttgcacaatacacaccttatcaacattgaaaactgacgtttggtgttacattcttttattaaaatcaaacaaatatgttgaatctagaaataagtatcttggcttgcatctcatatcaactaatcatcaatctctattatcctcatctttagatagatataactgatcccatatgtaggacttgctagttgattgtattgtttaccaaaaatccaaaatccataattgatttgaaactgtcttgcaggaacaacaagggagatagtctcactgcatcttattaccacattgtgaaccattcggccacagctgttggagctgagctgacccacagcttctcgagcaacgagaactccctcaccttcggtacccagcacactctcgacccgcttaccgtcgtgaaggcccgcttcaacaattccggcaaggccagcgcgctgctccagcacgagtggaggccaaagtctgtgtggaccatctcagcagaagttgacaccaaggccattgacaagagctcaaaggtcggcattgcggtggccctcaagccttgatttttctcagggtgtacttacatttcaaagatgaaattgagatgagttgaaaaacatcttggcgcatgcgcatcttttggttgttgcagtctattagattccaagaactgccatgtttaatttgaggattttttttttctgttatcggtgttagcacttgttcaatgagcaacccttgcaccccaataattcaagctcggcaaaattatgaacttgcttctaggtgacaattttttgttactattttcacactgtcattgtccacactgtgcttgtggttatggtgctccaattaaactaactgtttatatgcttgtcaaggtgtctagtaaagtggttttaaatgctgagcaaatgagtactattaacatattcagtccctgtctaaatacctgtacaattacacgtactcttagacgtaaaaaatcattctgtggctacaccacgtaggcacgtgaattgtttataatatccttttgaaaataaaagcgacgcaggcatgtgaatttgtttaaaatctgtcggaaaagtaaaagaatagtcgcgtgaattgtttataatatcctttggaacataaaagtgacgtaggcatgcaaatttgtttaaaatctgtcggaaaagaaaaaaaatggtttcagataagtttgattgattgatttcgtgtaccatgcggacttcagatatactcctatataatagagacgagacaaaagataacaaaattattcaacactactttcttaaattattcaacactactttcttcttccaaaggaggaaacatattactgataataaagggttggggatgacctgggttgggtgccttcaaattaaattcccatccaatcacctctcttttctctttttatccacctatttattcttatatagatagtatcttttcattcttaattcttgtgtagagataatttcttgcatgagaaataatttctttatctttttacctctctcaccattaactcttgctacattagacttttgcttatgttacaatgtatttaatgatatggaaactagatgacatgtttaggggagtttaagattctgagatgcagctggttggtagccgctttctaagaaccagaatctacaaaaattaggtttcctaggtttttattctgggaaaagctgcagcagctagaagctcctccaaacaggcctttaaggtgaaaggtaaatgaccacagtgctgacctgtaggaatccccctgccacgtggcaggctggcagctaggggcgtggaaaattacggttgtgccacttatccccctgagaaatagagagaatctcctcttatctcttcgcgctttccctcgcgacgcgaactcccctccgcgcgcgcgtggggcacccctcacctcactctcactcaccctcttcttcctcctcacgcctcacaccgctcagtgacctcgcaaaccagccaatggcgccgccaccgcggacgctgtcgccgtcgtcttcgtcgccgtccctgcgctcctccggccgccgcccgctcccgtcggcgagactcgtacgtactctctctctctctcccacggtttcttttcgcttctgcttcctccgggagctgatcggtgacgcatttcttggcttttgcttggtataggtgggaagatgggtgcagcggccgtcgtgctcgctgtcgatgaatgggtgcggcgcggcggtggcgggggcgggggcggtggcggtgcgggagacgcgggcgttgccggcggcgggcgcggcgggggacgccgtggggcagctcagggaggcggtggcggcgctggaggccgccgacccgccggcgtcgccctccggcatcatccgcatcgaggtgcccgtccggcagcgaggggacgccgtggagtggctgcacgcgcagggcgacctgcgcgcgcgctgcttcttctccgcgcgtgccgccgctcccttgcccgagtgcccggccctcgccatcgcctccgccggcaacggcaacggcaacggagcaggcggcgtcggaggggagcagcggcagcggccggtgagcgtcgccggcgtcgggtccgccgtgttcttccgcgggaccgagccgttctccctccgcgactggcgcgccatcaagaggtaatcgatggtgccatctactactacattttttaatacatgatgataaatgttgattttgaactttgactatactaaaaacatatcctacgcacataagcttctcgtgctcactaactagcaaatttcacgaaaagttctacaaaaaattagacatttactcctattagtattacacatatatgcaaagtttcgtattcaaattcattaaattttagcagtaacaaaagatgaaaaatctgacagttttaagggtaaaaatctgtcagaattttatattttttattacggctaaaatataataaatttgaagataaaattttacatatagatgtaatactgtttgaagtatgtgtacaattttttatagaatttttcgtgacatttgctagttattgtgcacggagtgtgcacaaaaagtttgtatgcataggatatgttcctactaaaaagacatgaatattaggaaatgacctaatatcaaattattagaaggggtgaagcttcaaacttaggttgtctaactcaccactctatagagttagctgtagaccctggacgtttctcaccatactccgtttattgattttgaacatatttctttttattcttttgctattaagagtcaaagttaaaaatgtttgatttacactattcaaaaaataaaaatacttatattttaggatggggtagtatatgatgttattaactttttttaaaaaaatagagagattacaatagtagaaactaaccatgcgtagcaaatttaagaagtaaatgaacagctagttgctagtaatttttttgataaatttcagttggattaataagaaatttacggcgatttcttcctgaaaaataaatagaagggataaatgctcacttggaagtgctttgtgtattggtttaagacacttttctctggtgctcctttatcatgaagcacaaaacttttgcgtgtgttcaagagaaaaaaaaaccacatgatcttgcactgtgttagtgaattctttatatgatcttgaattatctttgaattccttgattgtttttataaatttatttatttatttatttcaatgagcttcatgctggtcttggcccatactgtgtcagtgaacacttcacatggtctcctactgtgttgttggtgatggtgaactattcacatgatcctttattatctttgaatttcttgattgttgcttcatgattgcttttatttttttttattccaatgaggttcatgctggtgctgacccaatgacttgatttatgtccataaagatttcttccaagggattgcccactgattcgtgcttatggtgctatccgcttcgatgccacgagcgatcattcagttgaatgggaggaatttggatcattttacttcattgttcctcaagtaagtccttacttaattaccaggatcaccccagttatggattggaatagatggaatgtgatactgactcctttgaagtgtttctgatacttggtgtaggttgagtacaatgagcttgaagagagctcggttctcgcaacgacgattgcatgggatgattcactttcttggacatggcaaaatgctgtgaaggagctccaatcaactttgcagaaggtatgcatttctctttcttccaattctgtcagtcatgtggaactgtggaagatagtaaccttgttgtgctttctgcagatatcatccagtccaattaaagtgaacaattccaccctgcaaacaaccatactaaatcttaatcatgtccccacaaaggcatcctgggatcttgccgttactaaagctctccagatgattaaagggaagcaaagagaattagtaaaggtaaattattcatttcatttactgtttgctaaagaaaaaatctagacaagtttattccccaaaagaaaaaaaaatctagacaagtcatgttgtgatcattattttgaaataagcttgcatcgatattttctgcaggtcgtactggcaaggtgtagcagatatattactgatacttgcattgaccctgttgaactgttggcatgtttaaaggtatattgcatctcttgtattgctgttaaaacaattagatctttctgacactgaatatacaggttgagggccaaaatgcttatcagttctgtatacagccacctgatgctcctgcatttgttggaaatagtgtatgtcaattctattctgaaaaacaaattccttcatcacatcttctgtgtgatctcttgtatcgattttactccaaatgatttattagaatatctcttactatatttacatgaacttggatgttttttcttattttggccttctcatgttaaataacaatgacctaagttctaactaatgttcattttatgcaaatattctgaatagccagagcaattatttcatcggaaatacttaaacatttccagcgaggctttagctggtacacgagcaagggggaaaacaagggctgatgactttcaaattggtcaagatttgctactaaggtacctttcccttcttcgattcataaacatataatgaacctatctccagatgatttaaggcgatatcaacaccgtccgtgaagaaaataaaaggaggtcctaatataaaactttcttgcagtagcaaagaggataatgaatttactatagtacgggacagcataaagaagaagctggaggcaagttgagttttacactgactgattttttttagtatgatactgacatagtttgttttgttcctagttgcaagaatattattgggggaaaacatggccagtgcagttttattcaaccaaggaatttattatattttacagatgatctgcgatgatgtggttgtccatcccagcaaggcccttcggaaacttccaagagtacaacacctgtcagctcagttagctgcaagaatgaggaatgaagacgatgaggtagtctatgattcagggctttcttcagtcttttatattggaattttcagaatttttgggggtttacttgcaagaagaattttggattttaatttaccatattgtcaaaaaaatgaccacacccgatctgattctttgtgttggcctggccattgcagtttgacatcctaaatactcttcatccgagcccagccgtttgtggtctgcccactgaagaggcacgccaattcatacaagattatggtatgtgcctctataatctattgcaactatattgttattttcataattacaaataaaattgacgataaaagattttttgatgaaagtaaggtttatttatggtgatcagtgaatgttctattgttatgtccatcagaaatttttgaccgtggaatgtatgctggacctgttggttggtttggaggagctgaaagtgagttcgctgttgggattagatcagcactactaggaaaagtaagaaaaaaatgtagtcagtacgattgatcatataattgggatgtgatgtttttttgtcaaatatgtccatgttgttaccatatcctaagggccaattagttaccaagctgttgtttgttctagggtcatagcactttagtttatgctggtgccggaattgttgaaggtacaaatccatcctttgaatgggatgagcttgacctcaaagcatctcaggtattattggtctaactcatgatggattactgctatatttctttttttttaaatgctaatgcatcccatttccaattattttcagtttgcaaagttactgcagtatcaagaacaacatatttgcttgcaagaggctgaaaatatgggaacagtgatttgaattgtaactagtaagtcatcacatattcatagattacttttctagttctttcttatccatttgacagtaatctacttctcaaacaaacacttgtttatatcccatggtttattcagttgaaaattttcatattttttgaaacacggacgcagaagttttaaggttattaatcaatgcagcatctgaacggttagttcaggaaaaaaatcatctcaaagaacataaaatttctgatatttttggtattcagaacaagcattttttttatacttactagttactacaagtatgacgattttcaaaagtatatcctttccactgaaggtcctgacgtcttgtgcacaattttttgcagggagtttttgttttgttgtgaagaagatttgcttttttttttcctgccatgaacttcaaaggattgtcttgttcaagtgcttgcataccaattatgtttccgatcaatcaaacacctcctacatacgcagccgctgaagcataaatccaagaaggcgacgaagataaaagttgcgaagagtacaaaggctatatgtacaataaattgttaattattcagttagtgcagttgtgcaagtatatattgaacctcatagtttgttagcttctttcgaatcgcttatacatttgattcttaaaataaataaatatatataaacacaccattttatgagcatacagactgattgttactacacatatacttcctccgtttcacgatgtaagtcattctaacatttcctatatttatattgatgttaataaatctagatggatagatcttttaacatcaatatgaatgtggaaaatgctagaatgacttacactgtgaaacggagggagtaccaaagatcaaatcgtgcgggaaaaccatacaaaaatataatgcaggattgcaggtaagataatactacctctgatacatggctggctgcagattctggtgtggatgtgggcgggcgacggcgagctcgattggctgctgattctggtaatgcatccggtagctcgtcgcccctcgccgccgacgaagcggaggcgggggggggggggggggggggcactnnnnctgnaacnctgnncnacggnnatngacctcgggcggcgaagctgagcttctggactctggaggtggcggtcgctccagggagatcggatgggggcggaggagcaggtccgcagcttccacgcgtgaacgccggcggaatctccggcggcggcggcggcggcgacggcgagggtaaactggatcgttggtttcgtgtccgccgttcgattgggaatttgagatcgtgagtcttttacccctacgccattaataaaattgaaggttacgcgtgtgccacaaaaaagtttcgagtcatctgtatgccattacataaactttcgtttacctgtgcgccactttggatggaataacactaacggagactaacggaggtttgaaagatctattttgcccttgctctatttggaacatttggaagagaaatcggcggcggctgcgaccggcggcgtgccggcgacgaccggcggcggcggcggctagagaggcggtggcgtgccggcgaggagaggcggcggctaggctagggcattgcacgggagaggagtagtagagatgaaaatgcttcaagggtaatttggtcattttcatatgtgggtctcatatatcagagctcattctctaacagaaggtggatggaatgacacataggtaaacgaaaatttgtgtcatggcatacaggtgactcgaaacttttttgtagcacacgtgtaacctccaactttcggagtaaaagactatgagatatcgtgtggttgagagaaaggtgaacacgtcagcacccacctagcaaaatatctaatctatcagacagatagctagccaagcctagtccatgtaggcccgctaaaatttacttcgcgactactaaatccggcccacctatatttttggactctaccaatggtagcggcccaaattagacccatctaaattaggcatgccgcctgcctcccggcctagagagatggaggaggggaaaagaggaagaagaaaggttggctgccaaagtgtggatcctgcgtgagttctacgttgactcggctgggttgactacagtcaactcgctataatagttaaaattgggcattattactgtcataaaacctctcgtatatcgtttttgtaagttgagagacacattgtatcttacatcgctaatgttcatcttatgcaaatgttctgaatagccgaagcaactgtttcaccggaataactacttttggtcttttgctgcatgatcctgatccttcctgacagactagtttgtttctgttcatagtgcttgcttgacagaacatttttgtgggaaaggaaaacatgtctaatgcagctctattcaaccaaggaggatgttctgatttacagatgatctgtgatgagatgattgtcccagcaaggccctttggaaacttaattacacctgtaataactagtaagttcagttttagctgcaggatttaggatttggttcttggattattctctttgtttgtgattgaccacaaatcattgattctctgtgttgaccattgcagcctgactgacattgcccactgaagagaagaggcatgtcagttcatacaaaatcatagtatctgttaccagtactatcattatgttctctttcatggtaacatatacaaatgggatttatgcattctttttggttgaaatgaaagtttatttgtggtgatctgtgaacgttatcttgtcatgtctatgactttattcagaaaatttatttgggaatagctgaaagcctgaaagtgagtttgctgttgggattaggtcagcacttgttggaaaagtaagaaaaacatgtatagtcaatacgatttatcctaagagccgggtagttagtactaagctattctctgttctagtgtcatatcattttattttattctagggacagtattgttgaagttaccaaggctgtgtttagttggatccaaagtttggattttggttaaaattgaaaatgatgtgactgaaaagttgtgtgtgtatgacaagttgatgtgatggaaaaggactgaagtttggatccaaactttggatctaaacacagcccaagtcttttgaatgggacgagcttgcgccaaatcatctcaggcatctgatttaacttatgatgatttgctgcgatgtactgtattttggtttaaaatcctaacgcatcccatttccaactattattagttcgatcgcaaagtttttacagtatgaagaactacatatttgcttgcaagaggcttaaaacatgg

SEQ ID NO: 44525 - DNA, 719 bp, Oryza sativa
tgggttttatacaaacattcataaatcacatagttttctgactctgttgcttgtggtaaagaactggacgattccctccggtcatggaaacatgttgttttggacatggacatgatctacaagatacagttttggtcactaatttttattgtgaaatatttggaaaccccaaaaaagattactatgcttgttttttgagacaagacaatccacagatatgattttcatgcggccaatctaaaaatttaaaaatataccttgtgcaaagtttataaagtttgagttgaaagttgaagcacttcacatgttatcgtgactggagggagtattggctgccatcgagagtaatgacggttgggtcacgcatacctaaaacctagacatattttgtacagaaaaacacatttctcttctttttcaacatttttttctttgactactcgacatctgtttcattgttttgtatttccccctttcactagtgtttctcaatctttttctaactgatgcaggaaaagctctatgaatggatcttgaggcagcatgaaaatggcttgaggctgacagttgctgatatagcctcgcacatccaggtttgcagttatcatcctccaagaactatttaattatcctctaaatttataacatggccttgaagaacttgtttagattttcctttcatgctcattgtttttttttgtgaatacacctgactgcaa

SEQ ID NO: 44526 - DNA, 851 bp, Oryza sativa
acttccgaccgccttgccaagttcgggttgcaacaccgggaggcatgcacactttgtgatcaggaagaagaaaccatttaacatctcttcgtcaaatgtgttttctcccgacaactttggtttttgatccttgagaagattggaatggcagctgcagcacctcagtcctcttcaactcgtttctctaactagtggtttaaggccattcaaaaagtccctaagaaggaaaagaagggcttgaattccttgtttatcctagtggcttgggaaatttggaagggtcataacgaccgtgtttttaatggggtacacctaatattttggtggttgttcaagcaggaaagtaccctttggagtattgctggggccaaagctccacgagctttttgtaggtcgctacctcttgatggctaattcctcttaggcctagttctttttctcaacttcaaactttgacttcctcgttttccgttagcacgtttttcaaactgttaaatgttgtgtttttggcaaaaagtttctacgtaaaagttatttaaaaaaatcgaataaatccattttttaattttataataattaatacttaattaattatgtgctaatgagttttctcatttcatgtgcaccggaaatgtccctctaatcggagagaacgaacggggccttagaggttgttttagtggtgtgtcatgttgtgacgcccttttcttttttggtgtcgcttgagggatactttggttctctctcttgtaaatatttcttttcttcttcatgaaatgaagcacaattctcatgcgttttcaataactaattgatgatatattattatgtggcattggagttgataattc

SEQ ID NO: 44527 - DNA, 12517 bp, Oryza sativa
gaagatcataagcaagaccaaatacatcacaaaaggcaaagagaaattacttttacgtattgcagttttttactaatcccttctagacctgcgagttttgctcaattctctatatacctctgagttctggtttttttcccttagatgcctgatctatctaataagtatgaaaaggcctgttttgaccccttttttagtcaagaaaattaacttctagctattttggttgggcacttttatttttattgttgataataaatcattttacaaattactattgcttcggtgcttcccttcaaatctgtttgtaattcattgggtcaatgccaaagcggttaatgggacaagaaaatgattttaaatttaaaatccagtgagaaaataccaaaattacaaaatttatgtatttttggcaatttcatcctcttgattctttttttcaaaattagaaaatagttactaggtgtggttttgatctaggtagggtgtcttctttctttgggtttctagtgaggggcaataatgatagatcatggttggatccaggacattcaaggtgctatttctggtggagtcctagcggattttctcaatctatgagatatgctttctaagattgttttatagctcggcatgaaggatattcatagatggagattctcaactttaggcatagtggaaaaaaacggaccgggctggtggttcaacaggaaaaaactagaaccaaaggtctccaattttcggttgagcctaaagaccggacatgcattcaacccgaatagaaacgactgaaccgaccgggtttagatctccatggttcggttgagcttaaagaccggacatgcattcgacccggataaaaaacaactgaacggactaggtttagactataccgggcactaaaccactttggtacaaccgggtaaaaggagataaatgggccaaattaaggcccagtccattgccttcaggcccacgcggctgtttttttttacaaaaatcataggaaggcttgtggtatagggactcgaaactgggtttgtgcattgagagcgcttggctctagccatcctacccttgttcccttgtattttagagcaaatacacaccgtatatatttgctattgaaccacggttcaaccggcagtccaccggtcagaccgtcggacaggtgcaccaaggggtcatccaggtcactcaccagtccagttttttgcactatgaatttaagacaatattcagctaaggatgcttatgattcctccttccaaggtgccactaaattttcaggccatgggaacgtatttggaaaacatgggcatctggaaagtgtcacttttttcatgtgacttgtcgtgcataatcactgctagacaccagattgtcttgcctgacaaggtctgccacatccagacctttgcgctcattgcgaccaagatgatgaaactattgatcactttctcacaaattgtgtcttcatgaaacagttttggtactccctcctgtagaggtttgtcctaaattctttggtcccccttgaatgacgatcaaaataagtggtggagcataatcattgagggtgcaatatggcctgaattctatagtcattcttggttcttggacgctttggatgcatcgaaaccattgtgttttttatgggactgctcctaaattggccgatgctcttttgcttgccaaggaggaagcacaactgtggtttttgccggcctcaggggctatcattattgactactcaagagccgggtggttagtctcacatcatggtttggtttgtggttgtggtcttgtgttgtggtttggtttgcaacatgtatggttcctagaactcattatgtgcgtgtttggttctgtactcagggttatagcccatctttttttcttgttaatatgatgataaacagatctcctacgtattggagaaaaaaatgaggggtgatatggtcattctagaacaaccaatgatataggaacaaaaaggtatgcatggaatgaagagccaaacatattggcatacatgatatcgagctaaacttagaagttgtatataagtaatagaataataaaataataggcagcatacaacgaattatctcaaagataaattaacaggacaacaataccaaataaaataggcattctcatttcagataaatatgattttcaagattgcactttctgatacttggattatgtcactttctactgtgatatatgttcaatcattttattatgttcattgcacatactggatgaaacaacaaatcaatgacttaatcctcatctgcaccaacatccatcacatcaaatacttgtccctgcagtagcatattcatattagtcaattcctttgccatggtttggttcttcacccggtcttgaatgttcactccaataatcatctctactgcttcaagggttctcttttcctagtaaatagtagaaagtgttccaattagttttctttacataatttttaatataataatatataattttcttttcagaaataataataatacatataagtcttacctctaaatccaagagttgctcagccagaaggttggaactattgaaagatactatgctagaattgacatctttggagaattgagatggcaccaaaaatgccattgtttcatttgttggtttgcatatcttctctaatttagggaacttgatgggacggaaatttctttcttgatgaacagttgagatcgctcgctttggaaagactagcaaatttgttatatgcccacctagtgacgaaatgacaaggcaaaaaaaatgttaaaataagaacctttcggaaagaacaaaagtgaccctttcagaaagaacaaaagtgaccctttcagaaagaacaaaagtgaactaaaatggacttcatgtagacttacctattttgttttctattttattaataacttgccatgctcttgtgtcccaaacaaggatagtgcaatcctttgatgcagaaaccaaccttactcctttagaacaaaatgctaatgcagtaattggagcgctgttgacaagttggaatcagccaattagttttatgttgtgctaattattttatggattcacaacacttaaaatcaaatattttatcaatgttaggtatagattagatatcaagactttatagaactttgttaaaaaatacttcggaacaatcataatctaacatagaaagaaactaatactcaagattggatacaatagaaactaacgtatagatacatattacataagtttagaaaagtctaaatacaccccgcccaaaagaaactttgattgaaagtccatttggcaccctaatctattaaaccaaatacccaaccctccgaactatataatatcatacataaaccaaatactagtgcattttgcaaactggtttttatgtaatttgcatatacgttcgatgactgcatgacattggacatatatgctaatatctccacctaaatctttcattcttacccacttttttcttgaacttacaaatgaatgtcgatataatactagtatggcataactatatcttatatattgatgaccaatgactgatgatgtgtaacaggctcatttaagcttccaaatgcacaaagccactatccaaaatcactttaggaaataatatgaatggtattccaaagtctgggggttatgtttagggtgctacacggaattttacccaaagtttagaggttatgttcaccgtttccttgaagttttaattgtgataaagaaatgtgttctcattttggaaatccctataattgttttatattcttgataataatatttgttctaaatttaaaatagtacattgcatcttattgtcaattattgatatgtcttgagtaacatttgcaaaatttaccaatcaatgctcttaattcaactataacttacttgtgtcctgaaagaatttgacaattatcctcaaaacatgttaaactggatttttttgtcccaattccattcaacacagtgacatatatacaagtatcaccagccccacaaagtagaaattgttccaaaggatcaactgcgattgtagtaactgaactggagagtgaaatggtgtgaagtagtaacccagacaatagatccgtaacctagaaaaataacatattctcaaagttgtcatcagcgccaatggaaatcatgctcaaatctacattcaaaaagtgtgctaaatcttacgagtaagtgttctgttgcattttggtcttggtactattattgaatatattttaagcaatgaataacacaagcacaagaaattgaccacatcgagttttgtgttgatatgagatctagttataatattgaagcaaacatcagaatagtaaattgtatagacaacaaacatatatgtaagttatattgtttaaaaagaactaagcatatagaaccattttactgaataatatattttgaatgtatggagtatcagtagtcataattcattgctaaattatgaaagtgtacatgacatttagtacaggaactagatttcaagtttcatataggatgctgataaagttgcaatattgatcactgcaaaaggaaacaacatatttcatctgaggtgcattaaaccttgcaattgccatcgagtgagctcgttattagaatgggacattgaccccttagcattgttaaaatgccagttattgacgccttgtgctcatttttctttacattataaaagttgggatatatctctgtaccttcaatgggtcgaggttcctctgcttgaaataaactgcaaagttcatatgcagagcgaaaaataggttattgaaagcatgtgttaacttaaatgcttagttgattattcccattggagggtttggtgcctcatctgatatcaaatagccttacataccaacaataatatactggtaacactgttctttttctgaagtggagcatttctcaaatatttattgtactgcttttatgagatgtttggtatgataatatatagttagaagagtgagactttgtctctggagtggagtgagaagaacagaggacaattgttgacatgatgaattgtaaaaatagcttattttcaactacctacatacatatcattgaattctggaaaattgttgcatagatgatttcaatggtggagatagtgagacaacggctcagttctaggaaatgtggtcatttgtctcatggtggttgggaaacattgataaaaatatatttacccaacatccctttacggcttatatatgatgggttttatcttatgcttgaatgagtccacaaacaagttggttctatcagaggtagcttataggtgaaatcatcctattggactaatgtgattgcattgacatttaatgcgattcattaaaaatgatctatatgttttaatacttgcctgtaagactcctttccaaatcaaactgtaaaaaatagtttgtgtagtgatagtgactaatggagtgggaagagcaagaagacattgacaccttgctggatcaactgaatatgagacaacttgctaaaggggttgtagcctagtggttacagtgctcaagtagcacctctaggtccttcattcgactttccaagggagcaaatttcatgcttgaataaaagaaaaagatgccgtgagggcctccctcgctatttccaataaaaaaataaacaactctaattgcaatccaaggattgtctcaaatagtctacaagcctgatgagactgttgcgcttatatagtttgcaagctatttgggacatttttctctttgtcataagtagttctttagctacctattcttgctagttggttctggtagtgctgaataatgtagtggtgctttgttcctatgcttgaatggcaagcctgcgtgtaatactagtaaacccaacaggaaaagttgggccttaaaaaaaaggaaaaaagtacaaattaccccctgaactatcacggtcgaccgaattaccccccccccccgaactcgaaaaccagatatcgctcaccctaaactttcaataccggacaaaacacccccctactcaatatcagagtggtttcagtccaacgtggcagtccagtcagcaactttttatttaaaaaaggcaaattttgctacagaatactacttatgtgtggttttagccctaggacactgctcaaactcacatttggggaaaaacactccataaacatggtaatttgctagtggacaccgcgccgattaaaataataatatccagttgaagaggagagagaaatcacatgaaatgtcaatgtcaaaaatacccttcggcccacatgtcagcactcatatctctcttcttttaatttctccctatcttcctccttccagcgtcactctgagaggcaagccggcgtgcggaggaccggcacgggtgcgacggccttgcgggtggcacggcgaggcgaggtggcgagcgccagcggggtgcggcggctgtgcgggcggtgcggcagtggcagcggctcgtggcgacaccatgcaaggtgcgtccggcggcgaggtgtagtggcgcggcgaccgtgcagacggtgtgccgtgcgagcacggcggcggacgttgtcgtggaggcgcgcaagtgcccctgctagcgcgcggagaagttcgtggtccaggcgagcgctacggtgcggagacgttcacggtccgcatggccgccgcgccactgcacctcgccgccggagcaccccgcaaggtgtcaccgcgagccaccgccgctgccgcaccactacacctcaccgcgccgcccgcacagccgccgcaccccactggcgctcgccgcctcgcctcgccgtgccacccgcaaggtcgtcgcgcctatgccggtcctctgcacgccggctcgcctatcagagtgacgctggaaggaggaagatagggagagattaaaagaagagagatatgagtgctgacatgtgggccgaagggtatttttgatatttcatgtgacttttctctcctcttctaccagatattattattttaattggggcggtgtccactggcaaattactatgtttatagagtgttttcccccaaaagtgagtttgggcagtgtcctagggttaaaaccacacataagcagtgtcctgtagcaaaatttgcctttaaaaaatggtggggctcacatatcatagtctctctcctctctatcccctctcacctctctatctctctctgatgtcgctcactcgccgctgagaacgagcagcgcatgcgccgacggtggctggcccgacgcagttggttggctgcaaaggccggcgaccgcggaaacgaaggtagcgtgatcgaggactagcggcgcgccagcggttgcgagtctcctcgaggcagaggccgaggatgtggcgtgccggcggtggccggcccatcaggctcaccaggcctcgtcctcctgtggttaggggagtagtggctcgcgccggacttacgcgagaaggcagccatggcgggggagaggggtgacgcggcggggcggctgcaaaggctgacgaccatagaggcgagggcagcgcggtcggtggcgaggctaaggcaactcggggtcacgggtgaggcagctcagggtcgcgggtgagcagtagggagaagagtagacgagtggttcatcgtcgccatcgccgtcgacgtcattggccggcgctgaggcaaaagcgccagcgctgttgctgctcccttccctggagacggcggtgaggcctctctctctctctctcaactcaggcaggcggcgagcgatgagtctgtcgatgtttaagatcgcgactagggtatttggatggtatggggatcgttggtaccaggtatatgcgagattgaggtaaaagagatggagacatggatttttatacaggttcgggcccctcatctgataggtaatagccctacatcctgttgaccgaagccagtgttgctcttattcatctgaatcacacaagtacaatatttgggataacctatctagttgtcgtcaacttggcggctagataaccaactcgtagtcgacaacagggcagtcttcctcctcgaatatgaacccgttgagatcagagatgatgctagatccctcttaccggcctccgtaggcaccggatggggtatgtctggctaatctctgatgtcgagatctggcggcgtgtgttagcgtgtgtatatgttggtcttgtggttttgtggcgtttggcttctgtctcctctcctcctaggggggcttgtatttatacccatagatgcccccttgtccaagtagaactagggagataaacatagatacgatccgagtagtccttgtagtttacatatagaactctttttgtccttccttatccggaactccttctatatacgaggtatgattccatataaaacatggtatgtggtgggccctgccgagcttagtcgattactattgggtatgtgatatccataaccctgacaaagtcctcatcggggaaggcgcgacacgtgcggtggggagggcgaggcgggcggtgggcgccgacgaggacattggagacggcaggctatggcgacgagtttgcagcccatccccgtcgtcccagcgcccggttgctcctcctccaccgcgtgctccaccgctctgtcatcgccgcctccgctccaatcacctctccttcccgacgccctcgttggcggctctacccctctagccccgtcgcgacgcgccctacccaatctcaccgccgcaccagagggaagaaagagaaaggagagattttagcagtactctgaccgccactgcgtcctccgcaccgccctcgcctccgcctacttgccgctgccggcacgcgccgccttcgcttccgcctacttgccgctgccggtcgcgtcgccatgttgtgtcgcccatctccccccatgccacgcgctacagaagaggagggagaagagcgccgcgtcacgccctctccctagccaccacccacttcagaaggggatggagaagagagatgtgggcggggattccaacgagtgggccctagcaatttttttttaaaaaaaactgatgtctggactgccacgtgtgctatttgaatcctaaaccgcttgcaacagtgctcggggggagggggtgttttgtccggtattaaaagttcaaggtgagcgatatctggttttcgagttcagggggtaattcagtcgaccacgatatttcagggagtaatttgtatttttttcctaaaaaaaatgcttcaccgacttctagcttgtagagagtacctgaccattgaccaagtataaaccatcccttctatagatccagagatgagaaacgaactatcttgagagaaggctaaacaacttatagcatttttatgtccgcaccatcttttcaataatgctccacttgctatctgaaatgaacaatattttcaagtgaaaaagagttcatattaaacagaaatttgtcactaagtgtgtgatgcaaaatttaaattattactctttttagatatttgtactatttgcaagaatatttcccatagaagatgcaatctttatttatgaatttggattaaaaaatacactcatacactaaccatccaagtagaatatcaaacaatgcagtaggttaaaaaatgttagtatgtcaagtgaagtagaatgagaggcattaagattttgttcaagcgaaatcatacatacaaaagggatattcaactgaactgcttctcaaatataaatacaaatcattatatatccttgctggaacagcactaccaatttatcgctaaatgaactcgtaatgttatttttagggaagttaacatagtgactagaagtataattaacttccatggtcataaactttcttccgtttgtcagttacatggacctccttatttagatcatccaaactaacattaacaaatggagcaaaccaatttatgatcagagtggcatcctttcgataaagatggagcataacgaatactaggttataaatgaaagaattggcggggcataagttttgatgtgatcttttattagttcaaacttcattttgtattgctggacaaaccagttgaagttcggtagattcatacatgtttaaataggaaatccccatgtctttcataaatcaaaataaaagaacttggtattgttggatataattatgcattagtgatgacaggataattcgtagaatgatttaaaaaacaaacataaacacaagccataccttcctttaatataaagatacccaattcaaacatcgaacaatgcatcaagagtctcttgttgatcataatctagctagaatagaacgacgtatgaatagtttaattcttttgtagaaagaggaagctttttttatttacctcccaaatataagtatgtccagaactagcaccaccaaccaaatacaccccatcttttgagcaagcaatgggcccaatggcttcagctacataacttttttgcacttccttgatctgtaaaaggaaaataatttaaatggaactagaataggactatagggtattcacaattgagatataaacactcacatgtttgagcattaatcctttgggcccatatgttaaaagtaatgccattttgttttctcactaaatgttaaatttgaacacttataatattttacaatcaatcagttttagtcatttaccatatagaaacatacaccgtatgtacttgttgtgtaagggtaatgagaagttgtagttagttgattctatgtcctcggttgattgagggaaaaaactattacatctagaaatgagcaatacatgccgagttttagatgaaataggaaaaatggacttaatgtattatcactttagcttgtaacttggatcacatttttcatctgaattatgactcaccctaatcacaatcacacttttacatcttgaatcccttctaccataatctggcatatgatttctgactaaaattgaaaaacctgaatttgtcaatactgatcgaattagatctactcctacaaacatgatagcgaaaaatctaacaaaatttagagtattttgataaaataatccatcttattttttaatgaaacatataatttaatttggaaccaatcataacacaaggaccagttctagccctagacttctgcaattaattcattctctagactaatttgctgccatgatccacacaatccaacctatgatctacacaaaatccattacctgaaagggcaaagacgaagaaaagacatcacatggcacaaaagaaatcttaccttacttggagcccagaaatatatagcacttccaaagattggttgatccttgtctgtccgagatgcagcgaggagaaatccatcaacaaaagcgaggccacatggaggagcaacgcagtcgtgtatgtacataatcttctcgcatgtgttgatatcgtacaccaaccctacatcattagcacacaccactagcattgcctctttctcccccattctctatcttaggtaggcaatggttctggtagagaggttaggaaagtgaagatattgtttataatgattttggtcttggagtactaggaagtgaaaagaggttaataaagacaatccaaaaaaagctccaaaaagtctgaaactgaaattcctttttaggagagttaaagatgtgcatctcatgaggcaaggaccacagagtttgctgagtacaaatggtccttatatactccatccgtttcacaatgtaagtcattctagcatgtcatatattaatattgatgttaatgaatctagacatatatatctatctaaattcattaacatcatataaatgtgggaaatgctagaatgacttacattgtgaaacggaggaagcagcttcttctataagggtacataaaaacttccttggttatctatggatgtttttagatgcagaaggccttgtttgttaaaatgggtcaggattttggccaaagaaagttctaggagattacacaagcatttaatagagaaaaaaacattttgatattgaaagttaattctttaggataaattgttctctaattgatacatccagttttataactaaagcatttattagttttgaggatttagatcatccactacaccctaacgagtcaacattttagagatatggagagagggttcatgtggtaaattcgaaaggccacttagagatcatatcttgtcatatatcatagcatcattcggtggcaaaggtcaacaaagatggcattgaaatgaacaacagggtaagtgcaaaaaaaagtatgcaatctcaccattgagcccctctctcgcgcaactttcccaccctcatccccctccttccgtcccctatgccactaagttgagaccctaaaaccatagagtagccactcattgtcatcctgctaggctggtatacatgccatcattcgcgcacttcctagcaggcactaagtgccgccatgctgtc

SEQ ID NO: 44528 - DNA, 1338 bp, Oryza sativa
ccactaagttgagaccctaaaaccatagagtagccactcattgtcatcctgctaggctggtatacatgccatcattcgcgcactccctagcaggcaataagtgccgccatgctgtctccaacccctcctaagctcctccacgctgcatatgtgaccgcacctcccccatgcctcctaggctagcagtcgttgttctgccgtcccaacaccacaagacatactgtagaagctcggtgcatctgcccgtagctgcacagccaacttctcgagctcctcccttcacactaaagtcttcccaatgctccttgatccatgctgaaggctttcccgagctcctcaaccactcccgtgttcctccccaataacgcaaggcatctgtggaagtcctcccccccccctcccctcccgtgctctagttgtgcaacttcaaggtcccccaacatcgttttcacctctgcctgaggacaattctgaggtcccccaaccgtggtttttcattcaaaattggttatgtacgtggaaattgaatttccttgtcaactaggaatcgtgaatttatatatcctacactacatagttggagccaaaagcttaacaatcattgagccacatcatctataaaatattgtcctttggatccatcttatgcttttatcttaatcattcatatgccataacatcacatagaaaataccagcctttggatccatcctatgctttgatgtcaaccattcatatgccatatgaatttaaaatccactacgtttattgccataaggcttaatgtacattgaaccatgacacctagaaaagtaataatcattagattactctcacacttataaaattgcaatttcacatcaattactatatagagctcaaaatattgtccatttaggtattacgagtacacgatttaaaaaaatacaagttttctttaaaatatttctaaattcccggttgcaacgtgtggggtatatccactaattatgcaaatattgtgatgtagattgccttctctgatgatgatgccaaaccttgggctaccatggaccatgctagttttctttcaatgattatttttcacatttttggggctgcaaaaggaataagccactttgactccctcaaatataagtacagacccgtttggtagagctccaactcctaaatttaattccgagggttgggtctggagtagagttgtggaacagtctaaactcaactccacctttctactttattttgtgagagcgctcaccaagctccactcccattttagatggagctgaaactatttggctatgctccaattccacgagaggtggagctggagct

SEQ ID NO: 44529 - DNA, 1707 bp, Oryza sativa
ttgacgcagttgtgggcgccgcactcccttcctctgccccgggtcttcagccttagcttctgcggtggccatctcgcggtgccggagacgatgtgatgaacctgagttcctctcgacactcaaggctgttgttggcccgatctttcggtgagttgtgataactacgatttgggagaaacgttgacgatccgactacaaccgtacgagacgttgtgttgcgccttagcgatcgatacacctctccgtgggttgctgatcttgccggtgcagatcaaccctattcctgcaagcaaatcgaagaaacaagcaagaacaagataaaagcaatctgatattgcaaataggaatttaatacaaatgataagttggggttccgaagaacaagcagacggacggtctagccgacacgcgcgctgcaagcaagtagcaatggctaaactttaatctaacaaaacccgagaaaccctgaaggggtaactagctatatataggggtgggaggacgacctaggggtgcctagggtcatgctccaccagcttggggcacaccccacatgggccccacctgggccggggtcccaaatgaagttacaagcccataggcccattataggtgatgcaacatcttgttcctgtgattctggccacacgagatagaattcagagaagaggctggatccgttagaaagagggctccgagagctttccatcaagtactcacgggccgaaaacggaggtcgtatgcagattcggtggccgtttgaagtcagcagtgtagtaggtggccgaatcggattccagcacttggagtacttgatctcgatatcttcttgttcatccatgatgtgagcaatggttgcatccgtggtagccatggtcacatcatcctccccttcttcacggaaaaccgtcctcggtttttccatatggtgctctttgcgtagtccatttacaacaacctgtttcttccaatcaaaacaaggcaaactcgagacaatttggttagcaataacatttttctctagcttgcatattttatccacatgtacaggaggttctaaatccgagcagatgtaaactctatgcacaaaatatattccaagatcattatattcaccaaagatgtgaaatagaacattggttggatatggcaaatcagacttagcaaataatttctccttgaaattatcgagctcacaaaaatcatcaaactgaacatagcccatagtatttaaagaagatctcaattcacgctcctctacttcattagcaatgtgaacaacatgcttaaaatcagtgcagtatgaattaacagtaggaatagcatgttcattcacaagttgtggcatggatataagtgaagcattatcgcataactcttctttatcacaaggaacagcaaacaaatcaatttgtgacaaaggaatctcagcagttggttccactaatggttgctctgctatagcatgaaaagtggacaaattcaattcattaacaacacactcacctttattaatttcagcaccattaagtttacctttgatgccctcttcagataatggaggtgcctcgactttgagtgtgatcaatgggactggtggctctttcatgtctctctcctccttttcatgattatgcacttcctgcaaatggttagtaatagaagacaaaaacatagcatgttgcttcttcatgtcctcctctattt

SEQ ID NO: 44530 - DNA, 729 bp, Oryza sativa
cataagcatatttacttgtgtaagatcccgacccagagattttctaaacatactgctccaacacattgcaaaattaacccatccaccaagtcacataattgtaaatattcataaatgaccagcatagtgaggcttcctagtatatcatctacccatcttctatttataagagcttgcactattgttctctgctttcttttatctttttagggatcataagaaagaggttaggagcccattctacaatttttttccctttcagccagcagtcagtccaaaacttggtctcctcccattaccatctgtagtaaccaccacaacgttgaaaagtgcgtgaacactttgcggcacttgaatgggcagcccagcccatggccttgtgggatcggtcttttggagccatagccatcacattcttagagcccatcctagtttctcttagttatgaagtccaagaccaccatattggagtagtcggtaaacatgatcccaaagactaggcagctaccatcactagcagtctagcattttcctgtcctttccaaaggaaacaccttcgccttttactctttatcaatagctttgatcacccattttggaagatccattaccatcatgagataaatatgaaccgccgtgaggaccaccttgaccataatcagcctactagctatattcatgagggaggcttcccaccccgggagattatcagccactttatcaaccaaa

SEQ ID NO: 44531 - DNA, 5084 bp, Oryza sativa
tgcattttcatatcaatttcacaatttttaggtttaatcgccgaatctttggagtatggcaattaaagaaatgttgggttggcaaaatgtttgagtgaaacttggtcaatggccttaccaaaaagctacccatcgtgagtgccgtatatagtgaaccagaggcatatctatgtttgggcatcaagaattcaagttcatttggttcagcagtacctctgttttaaaatatatgatgctgttggcatttggatatgatgtttgaccattcgtcttattggaaaaaataaactatgtaaatatcatttattttgttgtgacttgttttgtcattttagatactacttattttggttcagcagtacctctgttttaaaatatatgatgctgttggattttggattttatgtttgatcactcgtcttattggaaaaaataaactatgtaaatattatttattttgttgtgacttgttttgtcattgaagatactacttatattttttttcatatttactagccaaagcgcgacttttgatcctgtttaagaacttttatatatggtctattaatttaccttagctcttaataaggttttgatataagttaatttgtttacaaagtatctatacttagctagggcaatagataccaaaaacctccgtaaatttccatatgtttagcccatttgtgattttttttaatacatgcactctttcaatccaatgaccattatttatccgaactctttatccgacggctaaaatatttctgatgatgtggcacatcctcgtgcaagaaagcttgctgctttcactatataagaaggataagataagataaggtactaaagttttgaataagaaaattggttaaacgtaatgttcaaaagccaacagcatcatgcatttaaaaacattttaaaacggagggggttattgttatttagttaaattagcgtttataacttcaaaagcacacgtgcctagtgccttagtgttactgctctattcacttgtaacaacagtttgcttccttttgaaaaatacatctatttgtacataaactgttctcaaaattttaaataagcaattacatatattttgtggaacgtaatatccataactttatataatttcctactgatgctgtagtatttcaatttgtattctactgtggaactgatttatgcatgaactaactcttgcagatgaaatggtactactacttagtactagccttggtcgatgtagaggcaaattatctaggtatgtgcaatactttgttggttatttgttggataattcagcagcgtgttgaccaaaagttcctggtcatctatgctgaaataacaagacagtccttcctgtctactgaatagacagatggtgttacaatgttatactaactccctctattcttttctagttgtcaaggcttaccagtacacatctctgacaagcgttatgcttcttgattgctgggctattcctgctgtgatattccttacatggatgtttttgaagaccaactacagattcagaaaatatagtggtgtggcgatttgtgtctcaggacttgtgctagttgtattttctgatgtccatgcaggtgatagggcaggtaatagttcggtgattagtatttatatatgtctttgttgtttcatttcttcttcacttaccacaaaaaagtgcaataaaaccttttgtattgcagaccatttataattatggtaacaaaatgaaccttgagttcacattagcaaaaataactagtctgttttctgaagtaaggagtaaagactattccacagtttaatatgttgctagattaatggatttttttttaaaaaaatacagtactccagtcatgcttgacgaatatgtggagaataatttaagttttgcgtggaattttggaagtcatctttatgaccagttaaatcctaaatgaagtacaactgaaatgttcatggtcatgttgttctatgcagggggtacaagcccagttaaaggtgatatacttgtaattgctggtgctactctttatgccatcagtaacgttagtgaggtaaagcattgatctcaactgcacaggaaacacattattttgagatattatttttaatacatattaaaaaaactttgttaatagtctgtgccaaaagctattcatatttcacttctttattgtcaaaaaagactaatccaaagaaatggtgaaaatgactctcacgtatcacctgtttccatatgtttctcatccttcgggcttaataagtgcaagctttgtggtgtaaggtgtaaaactagcttcactaagagaccaaatccctcaatatatttatcttttgcatttcaggagttccttgtgaaagtcggtgatcgagttgagttgatggggatgctgggactatttggagctatcatcagtgcttgtcagatgtaaaatgatcctttgttttaaccatgtttaaacattttttgtttcataagcttattatcatagaatttttaagcaaatatcaaagttaaccccctaaaatgttgtggttgtcctgcttaacccctcaagtatgaaactaagtattctaccctcaaaaatatgaaaaccagttcaaataactgccggtagtggttttataagtggttggcttacgtggacactgtgacatggtgatgtattcagctaaatattttttaattcttgggacgtttggaaaagaagcacattagtgcttataagtgattcttgggcctgctgattggagagagaaaaagagcggttgggttggcttgagtaatatgccctattgtgcctgccacgtcatcttgtacacagtaaaatcactacaaaaccattccaagtggttatttcaaccagttttaaaacctttgaggggtgaatacccatacttaaggggattaagtaggcgaaccaatgtgctttaggcagttctttagaattctcttgtttccagaagagtttgttgctagtttgttaaaattgtactgtagcctttttacctcccgcaacgtgtttttattcattcaaaaagtttgtgagctttttttttctttatttgcttatgcagaagcatatttgaacgcaatgagataaaatctatacaatggagtgttggtgctgtaagtcctccctcttttattttccttctaaaaatcccctcattgtgacattggctttatctgtttttgtgacaccaaacacacctaatattactttcttgccacttctcaggtggtaccgtttattgggtttgcagtcgcaatgttcatgttttactctctagttccaattttactgaaggtatatcagcaaacaatgtttcctttgtgcaagtgtgtacctactaatttccttattcatgacttctcagttcttacatcccaagttcacttactgttccttgcccatctccttaaaaatggaaaaaaggaaaacccgacaaaagggatattgttgtactacgaaatggcactgccacattaagcacatggtttttgctctttaagtttctcatatctatattaacttgtgcagatcagtggttcaacaatgctaaacctttcattgctaacctcagacatgtgggctattctcatccgtttgtttgcctaccatgaaaaggtctgatcatcgggccctcaatctgcaattctgcatcaagcatactgcagtttattgtcttacatgtaaccagcaattgaatgcgctttcgctttccaggtcgactggatgtactatgtggcattcggtgcagttgcaattgggctggttatttactcagggtactcacctgttttactttctgttgtccttctccatgaaaaaactcaatactctagctttattagttgcaagacacaaggcattctgaagtttgacgttaatcattggaacattaattatatgtttttaatcaagctgtaattttgtaattagcggttattcgtcctgcaaactttataatgagcgactgaaaaataaggcaggaataaattccactatgtaaaaaaatccatcttccaaattacactatcacagctgttctttctgttcactaatgctgacatgttgatgcagcgattccaacagcgacgatggcagaagggggcaagttgctgaggccactgatgttgagggaaagctacctgatgaggaggaggctgctgttcatccaaaatgccagggtgcagcatcatctggcatccgaaaattcgatgatggtaaaactcctcccactattagacctaacgagccacatgctcaaacatgaaagtaactatggactacagaacatagtggaaacaaaaaagaaaatcgaacaaggagagattttgttaacgcggataattatgtttgtgttgaaggaaatggcccctatcatgccctcagcaacgaggagctgagctgagagttatctcgggaatgactagaaattaggattatagaatcatagtattggaataaacatgtgtggtaggtcagcatattcatgcaatttgctgtaatgtaattttgcaatgtattcttgtcttctctttggtgcttctaaaggaagttccagttagccagaaagtatttgagtgcaaaatgttgtattggggaaattctctgccatgtaactgggtaccgaagatttgatgtatcaggtgataaacaagcatattattatgatttttctcattttattttttcatacttgaagactgaaagcatagatgagcaaactgtttctttaacagccataactttagagggctgcataaccaaattgccacacatacgaaccttacataggggaagtgttcatttcctataaattttcttttttaaaaaaattgaccataaggttggcatttataaattgcagcatatcagcaacttaggggtttctcaatcgttgacaggaacatcatgtaatttgtggcatgacagattaattatctgtcagccagacaggtcacaatagcaacagggtaggaggtgattatcaacaccttgaactgaaattccaaacatcacacatgttttcagtaacacacaattgtgttgaacgaaacg

SEQ ID NO: 44532 - DNA, 2761 bp, Oryza sativa
tactagtaaatagagatcatagggagaccatctcttacaacaatattctaagtcatctcttattcagataaaatataaacaaataaaaaaggatgccagcactaatattagtcagaacacaacatcgatggtagtagcattagatatgtgacattttgatcagtgagggatcatttggagttgcactttcccattgctgcccttatttgcatagccattggcatcgccgacgtgtggcactacctccacacctgtaaacacggtaatttgttcatccccaaagtcactgttgctgcggaagaacctagcgatgcagaacctgcctgagccaaggttaacaagttgaggatccttgcattccctccattcctctggcaggttgagttccttccaagggcccactagctgtggctaggagtccatggcagagaggtcagccgcagccaagcgacgggcctcagcagagaggccaaaccagaggttgaactcaggcacataatcaatcctgccatggaacggcagtgtccacttgccaacttggctccatgtgtggcttgctgtctccaggcagtaggtgccgatgccattgacagataagcaaatgtgtgagccaccgccaagcacagcgtaggagctgatctctgggttgctgcagctgtgccagtgcttgggttcacggacaaaaggcgggggtgggagttgatggcagtgccaggcctttgtgtagttggatattgtaggcttgcggtatatgaaggcctcaaactgatcgctgttgaagcccaactccggtttgggaatcctctccatgacaaagaggctgctgccatagccatcatggtcatagtcattgtcagccttggcattggggacgaagacggccaagggcatcgacttgggcttgtgaagactgggcatggttcctacctggcacgcatcagcgtcgacgaggaacgcgcggccagactgatccatgcaaatcacctcgccgccagcaagcgggaaacagtccatcctcgattggccgttgacgttgagagctgaagctcggaaggtgaagcaggagaagggaagccccatgctgtccatcattgtgcccggcggtctaaacttttgccagaattcctcaaccttgtgtggcggtggaggtgttgccggatagaacagctgctggcgcatcaggtcgaagcaccatagcgatttgacaccaggggtgcggttgcccacgatcagattaagaaaccgccgcgagaaatcaatcgtcgacggagacatacttaaaatatcttcaaagctagggaaataattaaaaaaaaagcgggtggattatttgcagagcagaaggaaacgaggggatccgtttgtcgagaggcgatttaagcagtagtacataccaagatccaggagacaattgtgaggaaggaaggaagagtacctgcaaagtcgattgcgcgtcctgtcctgcgatgtaatcgatcttcagccttcaaatccaagagccaaagatggcatcagaaaaggctagcgaaataaattcacagataagcaaattggctttcgatcaaataggaagaagatgaggcagatcaacaagcggggaacctgagggaggcgcaaggtcggagaagggagaagagagggccagcgccggagcagcaagcagcagaactgcgcgcgggcaggagaggaggagcgtctagggtttaatgtaacggaaggaactggttatgctcatgggcccttgtgtttgggccttagccacacggccacctcttcttcttcctctcgcctcctccaacgcatctctcttcccatggtggatgctgcttctgctgctgctcgcatgacatgattggtgatggtgatggctagcgccggcgtcaacatgccgaggggcgacggggaccactccgcggccaccaagcaatgccgccgctgcggcttctccccgccgccgccgccgccgcggcgtccgaccagggggacaacaacaacgtcgctgcagccacagccggcggttcccgttcccgtcccggtcctcttcggcttcctccgatggcttgtccgaccgctacgaggaacaaataaaggcaccacattgtcaggaataaattccactatctaaaaaaatccatctagaatgcttgtcagatgtaaaatgctcctttgttttaaccgtgtttaaccatttttgtttctcttattataatagaattttgagtaaattccacattggactactttttcttacctaagtttcacattggaccatatctaacttaaagttttcacttagtaaaaagtacgaattacccctcgaactatcgcggtcgtatgaattaccccctgaaccacaaaaccggacatttttcatcccgaactatacaaaccggacgaattactcccctcgacccaatctgcggtggttttggtctacgtgacgtacatgtggcagtccagtcagcattctatatatataaaaaattgtggggcctacatgtcatacgctcttctctctcttctctctctcactctcctcactcttctcactcttcctctctctctcatggtcgggaagggcgggggcagcggctgagggcagtggcctcggcgcggaggcggcggcggcgagcggtggccggcgcggctggcggcgagcggcggtgtgcgggggccgagcaccgacaacgatgacgaggaggaggagggatccgaggcgagcttctccggcgaggaggagaaggggcggtgacgatagagg

SEQ ID NO: 44533 - DNA, 10166 bp, Oryza sativa
gagctgttcttttctccctgcacgcactcgctcttggtcatgatgcacgaagaacacctcccaagctttgcacccgacggcaggaccctgaatcttgcagaaactccatttttgcttgcggcaactccgactgggcaagacctccggtgttggagaagagaatcaaagtattgcttgcttgcatgaatgggccaaagccagcaaagcaccccaaatcgccaatcctagtccaaagtgcaatcaaatgtaaaaacatgtggtgttaagtgaaaaacttgagtgggacctggtccaatgtaaaacttgggtaaaaaaaacctagcccaatgtgaaatttactctagaatgtttaaggaaaaaatcaaagttaaccccctaaaatgttatggttgtcctgcaacccctcaagtatgaaactaggtattctaccctctaaaatatgaaaaccagttcaaataagtgcaaatagtggttttataaatggttggcttacatggacactgtgacatgccgatgtattcggttaaataacattttaattattgggacggttggaaaagaagcacattagtgcttataaagtgattcttgggcctgctgattggagagagaaaaggagtggttgggttgggttgggttgggtaattttgccctattgtgcttgccgtgtcatcttgtacacagcaaaatcactacaaaaccattccaagtggttatttcaaacaactttcatacctttgagggtgaatacccgtacttaaggggattaacagacggaccaaagtgctttaggcagtttagtagacttctcttgtttacataagagttttttgctattttgttaaaatcgtattgtggcctttttacctcctgcaacatgttcttattcattcaaacagttcataagctgttttttttctttatttgcttattcagaagcatatttgaacacaacgagaaaaaatctatacaatggagtgttggtgctgtaagtcctcctctgtcctcctcttttattttccttctaaaaatcccctcattgtgacattggtatccgttttttttacaccaaacacatctaatattactttcttaccacttgtcaggtggtaccatttattgggtttgcagtcgcaatgttcatgttttactctctagttccaattttactgaaggtatattagcaaacaatgtttcctttgtgcaagtgtgtatctactaatttccttagtcatgatttctcagttcttacatcccaagtttacctactgttccttgtccatctccttaaaaatggaaaaaaaaaagaaaaccgacaaaagggatattgttgtactacgaaatggcactgccacattaagcacatggtttttgctctttaagtttctcatatctatattaacttgtgcagatcagtggttcaacaatgctaaacctttcattgctagcctcagacatgtgggctattctcatccgtgtgtttgcctaccatgaaaaggtctgatcatcgggccctcaatctgcaattctgcataaagcatactgcagtttattgtcttacatgtaaccagcaattgaatgcactttcgctttccaggtcgactggatgtactatgtggcattcggtgtagttgcaattgggctggttatttactcagggtactcacctgttttactttctgttatccttctccatgaaaaaactcaatactctagctttattagttgcaagacaccattctgaagtttgacgttaatcattggaacattaattacatgtttttaatcaagctgtaattttgtaattagcggttattcgtcctgcaaactttataatgagcgactgaaaaataaaggcaggaataaattccactatctaaaaaaatccatcttctaaattagaccatcacagctgttctttctgttcactaatgctgacatgtcgatgcagcgattcgaacagcgacgatggcagaagtgggcaagttgctgaggccactgatgttgagggaaagctacctgatgaggaggaggctgctgttcatccaaaatgccagggtgcagcatcatctttttttagataatggaataaataaatatcccggcctttacttaaaagagctacagccaattattacatagaagcgtttgacgaacatagtgtagatctaattgaatagaacacaccgcaagcaacaataaagaatccagtctaacaaaggagattacaattattcaagtctatttgtaaatctccacccataattggcaaaaagttgcataaccgtagtctccagcttccgacatgcaactttcagaaactcttcatcatcttcacacctttatagttgtgcccaaaaccgaagccaatgggttgctctgaaaatgacctgcatataggaaaatgatggtgatttgtcaaaaactatattgttcctactcagccatattgcccaataaatggcagaagctccaacaagtatcagtttactcattttcttatcaactcccaaaagccacccatcaaaaatatgagatacgctaactggaagattaaatccaaaagaaaactgaactgctctccacagaaacttcgccaaatgacaatcgaaaaagagatgttgaatagactcattcttcaaacaaaacgaacacctcaagctaccattccaattacgccttgccaagttatccttagttaacacaacccctttaagcaagtaccacataaaaattttaatcttaagtggcatcttaagcttccaaatgcacttattcctgtcaatataaccattattaattaaagctaggtacatagacctcaccgagaacaacccattctgatggaaattccatctaaaagtatcagacgaatcattcaattgaatatgtactatagaggaacataactcatgccaacaatcaagattctgaccaactaaagctcttctgaaagaaacattaagtggaacagaacccattacagtagcaatagaagatgttttcctacgaacaattgcgtacaaagatggatacttgtccttaaaagcccagttacctagccacttgtcctcccaaaatctaatttgttccccattattgacaatccaagaacccatatttaagaaggtacttttgacattcataagaccagaccaaaaatgggaatcaccttgtttcttgtcaacttgggttatagacttattataaagatatttcctcttcaataagtcatgccaaatcccttcctcattaattaacttaaacaaccatttacttaaaagacatttattttgtacctccagattatgaatcccaagacccccctggtccttgggttgacagacaacatcccacctagtgagcctgtattttttcttatgatcatctccttgccaaaagaatcgcgatctataaaaatcaattttatgaagaacccctttcggcacctcaaaaaagatatcataaacatggctaaacttgaaagaactgaattaatcaacaccaatctacccccaaccgataaatgcttgcctttccaactactaagctttttctctattctctcttcaataagtttccaatctttattagaaagctttctaaaatgcatcggaattccaaggtatttaaaagggaaagcacctaacttacaaccaaaaatgtccgaatattgctcataacactccttagcctgaccaaaacaaaataattcactcttgtgaaaatttatttttaggccagatagcttttcaaagaccgataaaatcagtttcaaattctttgcctgttgtaagtcgtgctccaaaaagatgattgtatcgtctgcgtattgcaaaatggacaaaccatcatcaacaagatgcggaattaccccattcaaaagaccagcctctttagccctcttaatcaataaagtgagcatgtcagctactatattaaaaagaataggagataaagggtcccctttcctaagacctttgaaagtttgaaaacaattaccaatttgatcattaacttttataccaacatgcccaccttgaacaaaagatgctatccactcacaccatctaggagaaaagcctttcattctcaaagtttgttgtagaaaagaccatttaactttgtcataagctttctcaaaatcgatcttaaaaattacaccacttttatctttgcgatgtaattcatgcaaagtctcatgtaaaataaccactccttccataatattcctcccaggaatgaacgctgtttgagtaggactaattaccttttgagcaaaatccattaatctatttgtagcaactttggtaaaaatcttaaagctgacattaagtaggcatataggtctatactgttgaatcttcatggcctcagcacacttaggcaaaagaataatagtaccaaagttaagtgaatataaaggcaaactcccagaatgaaaatccttaaaaagttgtaaaaagtcaaatttaattacattccagaacacttggtaaaactcagcaggaaatccatctggacctggagttttgttatgttccatttggaaaatagcctccttaatctcattttcagaaaattccttagttaaagcttcattctccaaatgtgaaacttgaggaatgccagcaatataattatcatcaaactgaagatcagattcattaggagggccaaaaagacctttataataagtggtaatatgcgactttaaattggcatcacctcttattaattgatcaccatcctgtaattgataaattctagttttcctgtgttttccatttgccattaaatgaaaatactttgtattagagtcaccgtccataatatccttagtcttagcccgctgataccatttaatttcttcttcccttaagatcgcagataacctattccttaaaaaccatctaagatcaacctcctcttgagacaaaacaacagtctcagcctttttatctagcgcatccaacttatttaagatctgctttttctcttttttgcataaaccactagtgtgtttagcccagcccctaagatgttgtcttaagcggcgaatttttgcctgccaacgctccataggagtattgccttcatcaacccagaccaaacctcctttaccatatccacaaaaccatcacgtaacagccaaccaagttcaaactgaaaacaatgttgagcgtcactaaaagaggaagattttgtatttagaagcaaaggaacgtgatctgataaatctctgtttagagcaacaacagaagataaaggatacttttgctcccattccgttgatactaacactctatccaatttctcataggttgggtttgctagattatttgcccaagtaaagttcctaccagacaactgtatctccctaaggcacaacccatcaataacagcattaaacaaaaagggccatctatcatcataattgttattactcttatcattaggactacgaagaatattaaaatcaccaccaataagaattggtatagtctcatgactgcacatgttaactaattcttcaaggaattgatctttaagctcattctgtgcaggcccatacaccaaaactaaagcccatttaaaattatcagccttatttcgtaaatgaaatttgatataaaaatccccctcatcaatcaaaccaatgtcaaaatttagaagattaattcctaaaagaagaccaccagatctgcctctaggagatttacagtgccacaaaaaatctttactaacacaaagattattcagagcagatgtagaaaattccttcttaaccgtctcagataaaacaataaaatcaagttgatgttctttggttaaatcagaaacaaacttatgtttttttcgggtccttgaacccgtcacaattccaaaaaaacttctcccactattagacctaacgagccacatgctcaaacatgaaagtaactatggactacagaatatagaggaaacagaaaaaaatccaacaaggagagattttgttaacgcggataattatgtttgtcttttaggaaatggcccatatcatgccctcagcaacgaggagctgagctgagaattatctcgggaatgactaggaaataggattatagaatcatagtattggaataaacatgtgtggtaggtcagcatattcatgcaatttgctgtaatgtaattttgcgatgtattcttttatcttttctttgatgcttctaaaggaagctccagttagtcagagtatttgagtgcaaaatgttgtattggggaaattctctgccatgtaactgggtaccgaagatttgatgtatcaggtgataaacaagcatattattatgatttttctcattttatttcttcatacttgaagactgaaagcatagaagagcaaactgtttctttaacggccataactttagagggctgcataaccaaattgccacacatatgaaccttacataggtgaagtgttcatttcctataaattttctttttttaaaaaaatgaccataaggttggcatttataaattgcagcatgagcaaactagaggtttctcaatcgttgataggaacatcatgtaatttgtggcatgacagactaattatcggtcagccagacagatcgcaatagcaacagggtaggaggtgattatctccaccttgaactgaaattccaaacatcacacatgttttcagtaacacacaattgtgttgaacgaaaccgaacaagacttaaaaaagaaagattacaatatactacaataaattgttggatccaataaaattatgactggacagtacacttgctatcatccgtgtgcgtggtagcttgagaaggagctatggtgtgcatcgaaggcggacgatgaacaagagtgaagctttctcccacatcagccgacccatagatttttcgcttgatgtagactgctatcctactatggcctcggctgtatgggaattacttcacaaacatgcagatatcatgctcttgaatagctcatgtagttacagcatgattcacttgcagcatctccaggattagtcttccatatagttcatagatcatacaacctacaaggtttcaatgaatggaaatagttgaggtcaattaatgtataacatctacagaaactatggagaaatggaaaaaatatatatacatgaaacaaggatgtgcaaatgccaagaacaacctaggaactaggaaaaatgaaatgcagcattgtgcaaatgatgagacaggaaccagcaacaagaaaataatctcagaagttaatccagctgagtcaaataatctcacagtttggaatgcaaataagtaaatcaatttgcaacttaaagaaatatatcatttagaaatactatacattggaaacaagcatcacatcacgatgtataactgttaaaatgacaattcttatctgccaaacaaaatgctaccttgagtgtatggcattttacatcttataggaactaagcaagcagggaatcataacaaaaaattacaaataatgatgtatgatcatgggtttatacctcagatcttaatatgactccaccacagaagtgtttatacctcagatcttaatgatcttggcagccctgatcacaggattcgcgcgggcaatctcctccctgcccgcggttttataatcgaaggagcactcatgggtctcggaatgccggtggcgaggacagaagagctccccgcagcggcaccggaatccggtcaaaccgaccctcttgcggcacacgttgcaccggttaacaaacagcaccggagataatggctcggctaccgccgccacgaccacggcattagcatcggtggcggtggcttcggctagtttcctcttcttggaaacctctatgagaataccttcgcagttcttggctgagaattgaggagctgctgctgccgatgccgctgctgctgctgccggtggtgttggtggtgtcgattgcggaggcggtggttctgtcatttgtgctgttggtggcgatggggaggctgtggttggggaaggagaaggtgaggatgatgatgatggcttcaagatctcagcctcgtccttgttgagatcacagctctcctgcgccatcggatttaacgcggacgaacaaatcaagggaagtggaggcgaatcccaagcttggacaaccagatcaggacgaattgggcgtaggaacagcaagaaatggagtttgttgaggtaaataaaaggttcggaaatgggaaatcaatggctttttttttattccttgatcgaatcggtgcaggccttagacccaaaaccaaagaggaaaacgagatctacgcaggtagaaatcagagaaatattattcggaaaaaagaagggtaaaaattctagcttttcctgcaccaaatcaaacgtggaaatgaacagaccatcgggctgaaatgtttacagagtaggaattttcccccttgatttaaacgcaagaacaaaaacacaaaatctacaacacgcaatcgagccaggagaagagaacacgcgcagatcagggggaaaaaacccaaaaaaaaaaaggacgaccttttcagctcataccaaacgcaccgaaccacggatttctccccaccgcccaaataaacccaaatcgaaaccgcgggagatggatcgccgccgcgccgcgccgcgccggctaagctgccggcgagggatcgaatttcgaaggagagaccaaagaacaagaaccaaaggattggggaaggaagaatccgaagaagaagaaaagctccgaaacaaatcggcgggaggggggctcccccggcggccgcgtggaatcgacaccgaatccgggcagattcgacggatcgcgccgcgggagagcgccgaattggggacggaattgggcgaggaggcgagcgcaggagggaggaggaagggaaaggtgggagctttgggtggaggaggagagagaccgaggtgcgtctctgttgaggtcccgaaaggccaaagggaagggaggtagtggagaaaagtatttatttactcctcctctatacttatctatctatagtttattctttttttctattattttgttttattttatttttatttgtgtgaaagggttttgtgtgtgtggattttgggtgtcacacgacgccatctttttttattagttttttttttcttatggctcacctcacctgctgtttctccctagcttcttttaatgaccacatgtgttttactaccaacgagaatgggggatgtatactggtggtagtagtactagtctattgtagctgtatctttcattcttttctactcctagctggagaaaatctggtcaggctggctgctggtggagtttgtgctccttggagggaagtaacgcatataggattccaattaaaaaaatacttatcgcatttggagaatttggctcattttatagggaaagaaatcaggaattttgtaagagttagttcaatacctacgaaaatccctcaaaatcacgttattatatcaaagtattccggatgagtccatgggtcggacgcccgatcggtttagagaaaaatcgagcgctgatggcagcacgacatcagcgcccgatttacatgcaaaactattttaaactgatttttctcttaaattacttatccaaatcataatccgattgcaccattaaaattcgttgcaactaaatctttaaaacaagaccacacatgaatatattccgacgaaaatttttttagcttactattgaatttttttaaaatgttgcacgatgttccaccaggtatatcggaattgtttcactaagtagattaaaaatgtttcacttgtttaatcgggtgttgtttcaccttatataaaaacaatatttcagcaaatagcgaaagaatgtttcagttcactgcaacatttgatctatacatagtgaaacattataagtacactaggtgaaacatcttttatggaacaaggggagggacaagtaggtgggtccagcatggtgcgcgcgtggggggagggggagcgactgattttcccacctctccccggtcgaccgatagagagcattttcgtagtattcctctattgctcgaagaaggtatattaatattttagagagtattgttgttccatggtgtacctttcgaagtctacatgtttgcgctgttctt

SEQ ID NO: 44534 - DNA, 13351 bp, Oryza sativa
  unsure (1)..(13351): unsure at all n locations
atactagttttgcaaaagtctaaatgttttttttataaaatggttgtcatctgttccttgtgttttaaatagtctttttttctttcatttatgttgcttttagttatgttgtctttgtaacaaagaaaagaaatatgcattccacctattggattttcattttcttttagaaactgaagtattgtaaactgatgcaaatttcatataaaatatgacgcattaaaggcatttcacatgttttccctacctttctattgtttacattgttatcatgtttggacatgctgcatacattatgttctcctcataggctgcgttcgttagcatgggttgggaacacataaaacaaagcatctgtttaatgcatgattaattaagtattaggtaaaaaacttgaaaaggggattaatattattttttaaagcaactttttagattttttttttgcaaaaaaataccctttatcagtttaaaaagtgtgtgcgtggagcacgagggatgtgagttgggaaagttggggaaagaactcagccttaatattactcgaaaaattctggcggccaggattttttttcatctggacaaacactttgacttttcatttctcaaacaatcatggcctttttacgtttatcattgactttgctaggctatgttagggagctggagattacaagaagccgctataaacaagcatccaactagtggtaatatgttgaagctctaggttccctagcctctagctattagctcattactggatcctagaactatcgggtttcacaatctaaagagaggattcagattgttattttagggtagttgtagctactcaaaacaccctcccaaataaacatgcatcaacttggtgaccacaattccacaactgtagtcgtttccagtgacatgctctttcaacgatttcatacaaaatagttgcatatcgagtttggttcgttttgatcatcaaagagatctatctgtatgtttgagaaatgcacttggccaaaatggattttcaccatcataatatatcctgaaactcagcataatatattgcattgttttgaggttaaaatgtgatactaaataatttcaagttcacagtaccaaattatgatccattgctgtagagaatcatgtcctataggatagagagagtttaaagttaccaatatatcataagaataagaacaagaatataagaataacagagtaggttagttatgatgcttgtctctacttcagtgcgtcagtgcccatctaaaattgtccctaaatgagtgcttctagagatggccttttatacaaactaggaaggtagatttgaaaaacctataaaggtggtatagcagcgaaataatatctgcaacgtttcaaaattgtgttttttttcatgaattttcttcattagaattgcatgacgaattataaaattacctattagagattagggttgataacttacggtataaaaaatggtacctaagacatatgactcttgaggttccatagggaaagagagaaaacataagttataaaagacattacatatacaaccatatataattaatggctctacccattttttataaaaaatgataattaatttattatttgatggcaaacatcgattggtcatagctatggataattcttcataggaaattatgagtttcataggaaaagagagaaaacttaagttataaaagacattacatacacaacaatatataattaatggctctactgatttatattgaaaaattgataattaatttattaaacaaaatatatgaccctcaattttagaccattatttctaaccattggatatgtagatgatctaacatattgtgcagagtcaaactaaccaaattattcgtctttcctcaccacggacggtggacatgttaattcgtgcctccggcaacatgctcgcatcaccatacttagaagaaaaaaaagtgccctgcatgtatatgcataatacatgtaactatctcatgccccttttttcatctgagaaaaaatattatatacccatgcatgcacaccgggatgcaccagccagccctccaatttgttcactccatggacattatgttcctttgttctagtgattagataatttaataaggataataagtatctaaaatcaatttttattagtaaaatatccataaggacagctctgtagacaccatctctccttcttcttttcttggtgtattagttggatttgagcaacgtgatataggtattttgggctataagttaatgtccaacttccaagggattaaggtttcccaaccttcagcgccgaacacagcataagatcgttcatttatccttaaaaaaagatcatatcttttatcaaggcattgggattaagtaaatagcatccacataaacgttgagagatataattaagttggttatgagtcaataggtccattgatgctataattaaagttaaggttaatggtttataggttattttgattttattaaaaaaataaggtggatattttgatttttaatgataacttttaggatttttttttggtatggatgtgggtccaaaatataataattttataagcaattaaatatagttggtatagatattaaactattgatttaattaaaaaatacaatggttcaaacagatcataaattgaatatataatttaaaatttacagctattgaagattctttatttatttataaaaacataccaagatcaatatgtatgaggtatattatctatgtctatatttgcaagtgcatgcagtctttgaaagtgcgatgaaattaacttaattaccttggaaaaaaatgggtggcgagcgaggaaaaaatcacacagactcttatcatgcgtatggatggaaacatgtacgtgcgtgggtggactcgtaccgccagattgatcttaagtttgttactaaagataaatctaatgtatctgaggtatattataataataataataataataataataataataataatagtaatagtaataatagtaataatagtaatagtagtagtagtactaataataataataataataataataataataataataataataataataataataataataataataataataataataataataataagaggtatattattattattttcatatataataggtggttgtatatgagatataagtacgtacgtacgatctacagggctgggtggggttaggtttgggttgttaactttttctttaagataaatctagtggttgtaaataatgggtccatcaaatataatgaaaatcaacggttatttgttagagtggcatgtggcaacttaggaacatttctaggatgccacgtgacgacttacgagtgtttgtagaaagtttcgtggacttttaattaatacaaatctaataacgacgtaaaatattgtgttcatcgattttagtggaaaccaatgtttggatgtttctctaatttaagagtgccacacacgcgtttgatgtcttttgtgggggtattcttttcgataaagataagttcaattttaattgtgttggaaaaagaaaagaaaggaacaaagggaaaaaaaaagagaatggacagatggagtagtatgtgcgtactgcacggaggtggggccggtgggaggttttggttttgaagatagatctaacaatgtaaaataatggttccaccgatttaaatgaaaatcgatgattagatttctctattttattagagtgccatgtggcaatatgagagcgttttgagggagctacgtgacagcttgagagcttttatagggagtttaatgaacttttagtacataatagatagatagttttcttttactttctaggaaaggcaattcacttagacatgtctctatttttttttttgagaacgggggcattgtgttcctagtttatattaagaagaataaggaatcgacccagtttatgaagaaaaccggatatgaaactaaatagtcggcaaaaacacacatggaaagcaggaaaaaaaagagcctgtggcaacaccactactgagacccgacacaaattatcgttaccaagctcatcacaagacaagaagctctgacttcctttgacaaataactgtctcaaaaccacctagcacactaattattaagtaggaccttctaagcaaagcctccaaggaagaaaacaatgtcaaagacgttgccaacacccatcgagaactagactagggatgcctccaaggaggaaacgacgtccacaaacgtcgacattgccggcaatggtcatataccaagcatggctttcacccaaagctctcacatttgtcgaacacctctagtgttgccagaacaaaggtattgcgggttatcgttgctcagcttgccacccggcgcagtagctccgcctccacgacaactcaattgctctacagaagccatcagcaccactccacctaaaaaacccttgccacacagccagaacgaaaatagttgagagttatcgttgtcaagcttgccacatcggccaagcggctccgctttcgcccccaacacattaatgcatggttgctcaatcggaactgcttgcatcgccacctctctcatatgggagagaaaacccacacgggatccctcgctgccacaagcctcgtgaaagcaatatcagtgtcatagaccacctgtcctccaccacatggaaatcctctcagtctaacggtagtccccttacatccctcagtgcttcccacgatcgaagtttgaaagcaaactagccattagaggggaaggagcaccaagaagagggaggcagcctagctggccaaaagaggactagctcgctgtcatccatgccgccaaccgtactgatgaccgccatgtccaactgatcgagccaccaagcgatcgattagcctacaagtaacaccgtaggccatgagctccaacggcactgcatcaaaaccacaacaccaccgatgctgcttgtgttagtgcctcgccatcatccggcccatctaactgtctctaggggcggcctacaccaactgcaccacatctgcactgagcaaacaccctcaagtccatctcagacccaatgcaagaagcttcctcgaagtggcgcccaccccaacttcccaacggccacctcaccacaacttcttggctaccacccgctcaggcttcctaggttaagccggcctccgccgacctttcttccctagcagagcaactaactcgtagcatcacctcatgtttgcttgcccgcatcgttagtcggtccgtgctacctctcccgacctgaggcctggaccaaaaccctcctttgaccaagtgcttgctcgcctgcggccactgctgggtcgagtccatggccatctcctcaccaccccaaccaccatcatcaccatgggagggataacaggtcctagatacatgttgcagcgctagatctaggtgaggaaactccagatccaaccgctgtccatccgtcatcgtcgcatcttgtcgcaactcccactaccaccgtggtggacaccggctctcacattaagctgccccggtgtggtgcccccgcagctcgccatgcatcggctgcccactgtcacttgctcgaggaagaagaagaggccccgtcgttgctgtccttgcggccgtgtggttcctggaggcttgctccggcggcagcgagggaggggaagggagaaggatggcagccggtgggatggagcaccgcccgtgtcaccccgtaaggagcgacgcgggagaggagtttttagaattccagacatgtctctaatgatgtgctagtatattatattacaaatttaaattttttatcgtctcatgaaaattttctcaaaactctcaatccatcctttatcttccattatcataaacaaacaaagctccgttcattttcttcctctccttgtccttctctcctcatctcctctcacttagctcctctgctgtggttataagtggtgcgtgtattctatgatgacctagccatagcacatgtatatagtgtccagacttgtagtattaggttatatttaattcaatattagagccaaatttatttatcaaggttcccaaccttcactccctcgttttcagcacgtatatttcccaaactgctaaatgatacgtattttgcaaaaaaaaaaaagaatctataggaaagtcactttaaaagtcacattaatccaatttttaagttttttagctaatacttaattaatcatgtgttaatctaccactctatttttcatgcgtggggattagtttcgaaactacagtaaaaacaaagcttagaccgatatattttagaagcgagagagtagaaaagtaagataacccaataactaaatttgtactgatcataataaagttgtctagttttatatacttcattaaaaggagagccaccatgtggcatgaagaacaccaatagaaattaaaggtgatcggtggtgccatatcgtgtgcaaaggattaaacaagtactcgcttgtataattgcatagcactagttggaaattttggtagaagatgggatcaattttaagtaacaggacaagattcgaactacagtattgtgcgccttttttttttcatacatttagaaaaaaagttcaaggggatctgtggcaaatttgattttagtatataaatctatataatcaacatatatagttggaactatatttgattctgatgattgtcttgaccaaactagaaggctgttgacagcaaacaagaaagccgcatgacggaacgaacgatcgaatcgtcaaaagatgattgagaacaaagatagaggaaaatatgaatattttgactggtttttgttagctcgccagctggtgatctgggagaggatactgtaatgatgccatacaatatttttcatttatgttagtttgtcacctcaaactgtggcatgtcctagtaatgatgttacctatattttgtttactatcattacctatattatggccctggttagatctcatcccaaaactttacaccagatcacatcgaacatttaacacctacatcaagtattaaatataggtttaaaaataactaattatacagattgcgactaattgcgagacgaatcttttaagcctccatgatttgacaatgtggtgctacagtaaatatttactaataacggattaattaggcttaaattcgtctcgcagtttacttacggattctgtaattagtttttttattagtgcccgaacacctcatgtgataccctatataatacccgatgtgatacgccagaactttacacccttaaatctaaacacccctatattagtaatgatagtaagtcctatctcacatatcatagacggattcagtatcgatctagtacattagtactgcagaggtagctacgtgaaaatgagtctggcacattgtttaaatgcacacacatatataaatgtatcaaaggtatgtaatgcagggcttgtcactnngctactatncctaaccttacatttttttggcaaagttactaaaaaagtggctacacttagtttgttgctaaattttaataagtacatatgaaatcttgtcacaatttgacaaccttaccaaaatttaacaatgtaaaacttggaaaggttgaaaatggtagcaaagtgaacaagcccgtaattctaccgtgtgaaaaaaataaaattgtaactgtaacatcaagattgtagggatatgattatcctcgggcgaccgggtgggggaggaaaaatcgggcactcccccagccccccgcgcgtgtgcatgtctgcactccccctggcccaccacgtgtccacacacaaacaactctattgcaacaaaaaacccatatattttggaaacaatctattaagggaatttggtttattttttggtccaccaaaaatgtttcacctagtgtactcacaatgtttcactatgtatagatctaatgttgcagtgaacgaaacattccattgcaacaaaaaaacccacatattttagaaaccccctattaagggaattcggtttattttttgttccaccgaaaaatgtttcacctagtatacttacaatgtttcactatgtatagatctaatgttgcagtgaactgaaacattctttcgctatttgctaaaatattgtttttatataaggtgaaacaacatccgatttaaacgagtgaaacattttcgatttacttactgaaacaattccgatatacctggtggaacatcgtgcaacaatttaaaaataatacaataataagctaaattttttttcgtcggaatatatccacgtgtggtcttgttttgaagatttaattgcaatctgatcatgatttggataagtaatttaagagaaaaattagtttaaagtagttttacacgtaaattgggcgctgacgtcgtgcgcccgattttttgaagttttcgatcgggtccctagtcacctccagattgtagcagataacttgaaccatccatatcttagtcggatggttaatttgtaacctcagtatgtttcactacatcgtccacgtaagaccatggatacatttctgtcatagacatactacagcagaactaggttcttgtaacacagctatgtgctactacagcccttaaaacgtgtgtaggtaatttttttttatcttttgaattcatatatacgttcatgctgtgtttcagcatttgattgcccattgcttgcctaacaaaggcttatattagttaaaatgtttgctaaaaaatataacattttacatctaaaaaaacaaagtctgctctaaattgtatgatcagataatatctgtgcttcctttacttatccacagcaacactagagtatcagttggttaactggtcattcccttccatttctttttttatatactatagagtatgatcatgatctatgttggctcatatatcatacagatggaagttctacatttccgatggtcactctgcaatattctttttgtatggaagtcactctgtactgttgaccatattcacatgtctagattgacaacatggtacgttaagatttagttaaaaaaatactaggtaaactaaatcggttttgtatggagcatggtcatcgacttctagtgagtgataaatataatctcagttttttattgaactagtactgaccaaaaaggcatttaccatatgttagattaatttgtaatatgctctaataaaataaacactagttttgcatatacaagcgagcatgctctttgaaatatattctgcttgagaaccctgatcatgggtgattcttgggtttatgtttgttggtaagctggaatatttttggcctgcaggaccatggagatcaagcataatttggcttgcagacctttggagagttggggaactgttatacttgtgcatagtttggttctaactgcttgtaccagatgcatgtttttctcatgactataacaaatgtggaccaaggtgctttcagcagagcacaagatgtctcgaaactgccttatgtaatactggcactaaattggcccttggtgctatcaactacccacatgcttcaattaatcggtatttttcttacatgattgaaatgctcttcctacaaagcatttgatggtttctaccaatttgtacctcaactgtcaaagaaatacatatgtattttctattttgtgaaagcttcttattttccttaagagtagcagtttagatagatagataacactagcattaagtcccaatttgcattttgctaaaactgaaaacaagacctaccgaagaattagtccaagctgtaaattacattcttataaaatggtgatatgcctcaaacgcatcaattgaccatgcttaatatataacagcgaaagtgaacaaggtttagttcttgctttcatagataaatatattgatgaatatagtgcatcctaactatttttacattatactgattctggtatcctgaatttttaatagtgcttgtcgtggggctacccaaacttgcttctgattcactaatccattgatcataactaggttcactgtcaacgcctgtgctgtacaactctccagatgcaagcttatataagttgtgaagagatccttgcagcaaacaaaatgaggagaatgccacaagctttatttgtagcctgtgtatttgttctgtgcagatatgtggcacaagttttaatctacagatagtttcagaagattctttttttttcccaatatgagcacatttttgtattctatcatgggaactataggttatttcttaaactatttgttattcttagttagaaatttgtattttcacatgtatgcatttattttgttttgttttacatgaatgtcaagtgcgcaccacgttttaaaacttattgttattatatctcaaggtttaacatgctggagtaaatatttattggctctgacatatgcacgaatggtttagcctttcgatcttcataattgatataatgtgcctttgggacatatcctttgtaacatatattttgtgatcctactagtgcattcctggaaaaaaattttctttcttattccaatgtgttacagactactcttgtagcacatatgatgtgttactgtgatatttcctagcagcacatctattaatatgttacagggttatgttagtagtagtgacaatggtagtactagatgtattaatcttgcttagtactactaaagggaattgagggggcaaaccaggggttgtcagcagaagtaaaaacgaaagggattgtcggccgttcagaactggaacatttatagaaaattaagtcgcttttgtcgtcccatgtgaacctacagatccatcgtttgcttatagacttattggtgaaaaatttaaattctactaaaacttaactttacaattgattataagtttttttcatcgtagtttattttttatattggattttagatagcaaatgataagctagtgaaacttgaaactcctgattaatcggcgttagaaaacttgataaaaataaataaaacattggccttcttggatcatcagaaacaaaggctttatttagagaagtttagctgtagcttatttcaaaatcgttgatcattaaaatcttctctaaacaatttagattgttataccgattctgagaatccaaaattatagaatttagaaaataaactagaaaccagaaaagaaaaacccagctttttcacactttcactagctagcttattaccagctaattgactacttctcaaaatcttaaattctcttaacagggctaaagttgcccactccctcagctggattgcactagaaatcttgtttctttagttgggctcacctacgtattcggttaatgtttttgttttttgtttttattctgtggaaggcacctgggcgcaccaccacagtccacagagtcacacacatcaataagagcctcattttaaccgttaacacattcacgcttaatctttatcttcatcttgttgaaataataagcacataatgatttaatttatttcataaataaatcatgacattgcatatgtaaactagcatgaatgcatcattgcatctacacatataaactaagtaaaaaaatatgaacagatcaaatatgcgcataccgaggttgccgaaacatcggttgctcagcaggaattacttgcggttgcgggcgttgatgaaagtgcgcaacacgcgagcgaacaggaagacgagccgtcatgtacgaacagggagcagtcgcgtgaagcgcttcccaaaaaccttattgccttcttttctcggtgcaggatgtcgaaggcagaggttccggagacctgctttcccgatcgccggtgtacgccagcgagcgggatggagtagtctacgagcgatggcacggcatagagtaggaggcaaaccttagattgatttcgcgtatgttgcgtgaaggcggtggctcggtttatatagagaaaggtcacttgatcagggtgcccgcacgatctccactccacgtaaccgaaccggataagtcgcgcgtaacttatccggactccacgccgttttcacgcaacggatttttcggaatgtttccaaaacaaacaaatccgaatttcccgcagcaaaacaaaactgcaaaaggaggctacatcagcgcaaaggtgaggaaccaattttgcggaccatttgacgcgtacatcgtgcacgccctgccaggcaagggcgtgcgcgcgtgtgttccccctcttctctccacctcatttgcttcaagtggctaggagggcatcctcccttttaaggaggtcaccctctcctagaataagtaatgtggtactaaacttcctatgcatgctacctcataaggtgggtttttatgattttccaaagaattaatcttcgagtggcctaagacccatctattaattccaacacatcttcatctttaggagattcaaacaccacctaatacccagtgcctgtctttttgtcatttcaccggtttcttttttttttctattcacgatcttgctttttcaggctatctgcaacttggtgattttcaccaaagaaccaaatccaaattgctataaatcacactaaattctacaattaaagatcaagaaataaacatataggtgaattgagccatgcacgatagattgaatatcgcatgcctatggtacttcattgtccctctgttttgtgcatgaggatagatgacttctagcaatcgaaaatgaaatttataattttgaggatgcagacgggtctcattgtctactccttggtttatctgcggtaactaaaatttaattttagagttaatataggtatctttcatcataatctatttttcagcataaagttttatgcataaattttatattttgtatttgtcagtaatttttttatatctatatttttagcaatttaaaatctaatgttgccaacaacgatttgaaaaaaaaaactcaaaatcaaaattttcaaattaaatttaggccctatttagttcccaaaatctttttcccaaaaatgtcacatcgaatctttgacacacgcatggagtattatatatatagataaattaaaaaaataactacattgtttgcatggaaatggcgaaacgaatcatttgagcctaattagactatgattagccataaatgctacggtaacccacatgtgctaatgacggattaattaggctcaaaagattcttttcgcggttttcagggagttatgaaatttttcatttgtgtctgagaaccccttcagatatccggtcaaacatccgat

SEQ ID NO: 44535 - DNA, 11227 bp, Oryza sativa
acagaagatgaaagaagcacaagcagtcgctactagttcgctaccgcttgcgctggtggtgatggccgaaggaccagaaagaaatacgattcattcatgccaagccagtgttgaggccttgaggaggcccaaagagggcagttttgctgcgggttgggcttttgttgtagcggcgatgaaacgttctctgccttcgctttatttccttatgctgtggtttttgttgtagcggcgataaaacgtcctctgccttcgctttatttccttacgctgtgtttgagaggaggggaaagaaaaaaagattaaaaaaatacgtaaaatgagataaaccattaacgcatgattaattgagtattattaatttctttaaaaatagatcaatatgatttttaaagcaacttttttacatttttttttcaaaaacaccgtttagcactggcttacttgtagtggcgtatgtgtgggtggtttgcatgtgatgatgtgagtttatgcataaatttagatactacatagcttatacttgaagggctgatgcataaaaaaagagttttcatgatgtcattcagagttcaattttgatctcttctactccattgaaaaaaaagatcggttgcaatgcgacaggagagaggttttttagtggcgtgcatgtgattgggaggatgtttgctacagagccatccttagcattttggggtctgtgccaaatataaaggaagagccttatctttagaaaatactattatataatatattataattatatagtattatttataacacattgggttggatatctgcaactactgttattttgcttgatcgaatgcagtcaatggccttctaaccacggcaggaaagccgtcattaatctaacactactttctttagctatatcctattatcaaacaaacataaattgtttttaaccaattataactatagctatatcaaagaagttcactgatctatctatcatatagttaaataaatggttttactcattcatcgtgtgacatatccaatgatccaaaatcattctgtgagttgcatccgacatcacatagctcgccacgctccctccctcccttcgatctcattcccctgaaatcacgcaaaatcacgtctaactgttaacaaccaaatttggtaatccaagtatccgaaataaagataggatcgaagcagaatttgagatggaaattgttccggaaacagagtaaggattggctggagtccgaatcggctgcgactgggatcggcagagtccgaattggacaaagttagccgattgagccgaatccgacaatgtgacacggtacacgttgtcgggttgagttaacgtgcttcatgaggattgctacgcacggattgagtcctgagaaggcaattgtatctattaattaggatatttcatgtaatttccttagagatatgtttgggcaaaagtctgcgtatcttagagtttgttagagataagagttgtatccgacacggacatatattgtaatcttgggtataaatagaccccgagccccatgtaatacaacaatacacattcaatacaatctcagagcatcgccaccattttactttcgttttgtttcgacaagttctcgctttcgggttgagctacatcggtttcgatcttcaactagaggtaaaacttgttgtggcggcttgcgttctcgagattagtgcttccatctttacgatactctaatcttgtttatgtaattcatcgagttaccatatattctatataatctttgacaatattgttatctaacctctagtcggctaacatcttttgctagaaggcagccgattaggttgaataccaacgttgacttagattatatatgatatttaccactctatgaaacatccaacggcttaataccaacgttgacttagattatatatgatatttaccactctatgaaacatccaacggcttgattgtctagatattgttcttcttttcatacttatagctgcatcagttgagtttaaccttataagtcgtgattagaatctcaatctctagcctgcttttggttgccgattagtgtagcatcgggatttcagccgaccttacctgatttaactactttcatctcatatgcttgattgacatgttaaatctgccctttatattaagatcttgttgcatttaagtatattaggcttttgtttagtatattctacttgctttaatatcttaatatagagtagtatcggagtattagccgatacatgctagatctatctgatcggctatgctatgaatatatatagtctagttgttaatatatatttcgatctaagtgatttatactgtctcggcatggtgatcgatctatcccaatcacttgatgtaagtatatattgacataaggattatatattattaatatctatagccgatcgagtagatttagttctttcttattcattcatgattgccgatcgattcacatatgacatcggcctagagatagatgatatgtaatcggcaactagccgatcggctatcatttatggatttaaccgcggtctctttgtctttatttcttgttgattgcaggatcaaattaactggcacgctcacacatctaaaggaaagcttttggacctgcactgaagttaagcagatcccccaggcctcatgttttcacatgaacactaactgcaaaaatgatgccgccgtcaccaccactcggattcggtgcgccacctcgcccgtgagcccctccacacatcggcgcccccctctaccctagcgtcattgttccccttgtgctagcggaggcagtggccggttataggaccaaggtccaagtatgcggcagcggcatatgtgtaggatggattttgttcggtcaggcgggcggccgtgaagcggcgagagaaggatgcggtggtcgaaagggaggcgtccagttagcgttgacacgatccaggcaacaaggtaaccttgcctcgaccgcgtccacgccccgccgcgcgccagtcgctatctgtcatgaccacgttgcccccggtgtcctctctctcctacatcatctctgtctcccctccctctcgtgcatccatggcggcggcgagttcttcaagcacggcagcacatctgacaccctgagatcaattcaatcttacaagaggtaagcatataagaaccatacgattcaccattatcaatatcttgtccaagattcatgcttcatgcgggacgcggagggagtggaggaagaggtcagaggaggtagtctgttcggcacgaaaatctcaggaagtgcgggcaaggagaatggtccctggtgaatccaagtccgttgaggccttaagcagtaacgaaatccatctactactataattgcatctattgtttctgtattgcagtgtgcaacacagtgctgtttgtgtatgcacataacaagaatgaaattaaggttggaaacaaccaaaaagtgtggaacctctttcgttctaagctgacatccgctgaaggaaattgtggcctccttttttctgattccttttctattttgtgctatctttttcatgtaggggagcagctctggtgcgacggggaagttggcagcacatacgcatttcattgagcacatcttgagcgttttagatttcttgaatgttttatattgtgatcagaccaataaggtattcaactggcatacagttttctcatttgggcttaagtgattggattggtttattgtatcttgcaatttgttgtgttaaaaaaatgttatagttttattgctaaaagcaatctatcttttctgtcatccagatgaaagcaattacttgtggtatcttatgttagtaggcataattatggaagaactggattagcatggataattaatggactacattaattggcgatggtttttggtttagttgagttttctatgcacggtatcttctggtaacgatgattgaccttttccattttaaattaagtgaaatgaatcattagggctgctatggacacttgagtacatttgcatgaactatagcaacaaagcctgtgctttgcaagttgctggtatggacatccagtgtttcttcactcaaatcttgcggacacacaagagtccaatttttcacatatttatttttcttttttgtctcgatggacaaaaattacaattttaacaagtagtggggattgaatttgtgtaacacaagaattctccaaaatggcacactgcttgatgagatccacattgtctgaaacttgttctgcgtgatactcagtacgctaatatgaatactaggtttttgtagtgtcttggcttaactatttgtttgggtaaatctaaaaccactaatagtaattttgctttgttgatccatttggggaaataaatgagataggacagtacaatgatgccaggtacgtatcatcgccagaggctatataggattcttggtttcccacagttcgatatctatccaactattttgcagctccaacttcatcttcctaacatacagtatgtcacgtatgatgaggatggtaatatcgaggatgttgtcaatcgttcatcttcttatatggcattaaataatctcgaggatggtttaaatttaaatttgttggatgggcagtatgaacggtctatatgccctaaccttttgttacatattgggaaaaaaaagctatgtgtagagatcagatggacttttcctgtgcgaaactctggattatgattcatgttaggcactgatgaatcccctaatgatttttatcaaaatcattaagttaaggtagatacacatcttgtcatatgatcaaatggtttcgccaaaaatcaataatcagacaacaaaatgtgcgaactcgatattttacacgactctctttaccaattctgccccgaattacacttaaaacgactcaacagcttaacgttggcttgccacgccttacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatatccgtgagcaaaaacggcttatggtattgcgagcttcagtcgcactacacggtcgttctgttactctttatgagaaagcgttcccgctttcagagcaatgttcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattgtcaccacccgtcacctaaaatctactcagcgtcggcaaaggagccatggattctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatctctcagtgttaggcatgttttttaaggttaatatcacacatctctttttttttttgccttgtgtttgataaatagtttatttcagtattagtttgtattcatattaaaatggatattccattttaattttttttatgtataactcttcgaaccaataaatttatttgtctaatgcaaggtagctaactattcaaatttcttagtaccttgtcgggttgtatcatacatctctttatgcgtgccttgaaaattactttatattatttttatttattttataaataaatgcatttgtaggatattaataagctaaggcaacaatttttgctacatatacaaatgtaccaacaaaatgagtgcgaaagcaacattcctagcgatacatgagtgtcagggttacggataaggcataccttctatcctacgacttatggaatataccaataaggcataccttcacgtacatggattgtttccgtatacgtcgttaggaatttatcttaaattacggaaaatatccctatgagttaagaaactaccaaagtcctactcggagggggatagaatctctgttatatcgtatcagattacatacctccaggccttacttggggttcaagataatccacggtataaaaggggacccctagggggaggtgaaggacatcgaatatcatcgccaacacacccaccatagcttacgaagccggagtattcggagccaagtcaccgggagatctcgtcgaatccatcgactacgatctcgtcggtatcgtctgttccatctactctctttgtaatctgttctcatcgtcatcaatcttatataaactggactagggctattacctgttagggggcctgaaccagtataatccttgtcttctgtttgcttgatgttgtactacgtagaccctcgttccaatgtaccccaatactcaacttatccggtccacgagtatcactcgtcgacagtggcgcgccaggtagggggacttggtgctcaaggatctaccagtatgacttcaagacttcccgacaacagaaccatctccaacgtcaatcaaggagcttctacctcgacatcgttggtttggactcaagtcggatccattgtctttccggtctataccgttacgccaatctcggctggcccaatcatcatcgggaatgagaaaggcacggtaacgactcagagaaacgacgccccgccgataattcctcccactcaggtggagaatggaacatcgatggccccaacactcgggaggaatcctcaggcggctgaattttgtcccccatacaaaagatcagagccgacaaggatgaccaccctaagaccgagatcttggtgtcttgtgcataagacatccaagcatactcttgaggactgttcggtgatactccatgtgcaagctgaactctacgcctattgggaacgtgggattcagcgtacttcatcgacaggagccacctactgtccgaaacatagatccagatctcatgatctcacaagctgcagaatcttcctcaggaccctcaaaccaccgcatcatcgtgtccaacaaccacgagttcaaactccgtgcgttgccaaggaaccagatgcagccccaatcccgtatcggttcgtgggatacatcggtgataacgagccatctgttttacacctcttggaaggctacgaatcctcttcggagtcaacacgagatgtaaacgtggtcgacaacactgagacaagcgcgtccgcggcagagagaacgcccgctcaccagttgcgaaatctagacgcgatattgagggaaagtccttttgatccagcgacaaacccagacgccggccaatgggtagagcgactgcgagagaccgtgaccaacctcaatgccgcgtttgccgaagcagcaggtggcccagaaccgcgcaggtacgaagaacaacctaccgaggacgcggatggagaaaatatcgccagaggacgtctcaccggtgaccactcacctcggcaggaatgagatcctactccgccatgccgcgaaaatcgcgatctccgtgagcaggagggatcgtgacaacaacgactgccatcgacatcgctctccttctcgtcgtgagggcgacaccacgcatcgacaacaccgtcattgctctcctccgtggcaagaaaggaaagacggccgagggaacacccccaatgaagaccgagactgtcgactccacaatgaccgacgcaacaacgacaaccaccgagatcaggggaatgatcgccaaggccaagagcgggacggtgacaaccagcgagatcgaaactcccaatctccacacccgagtcaagattgaggacgcgatcatcactcgagaagccgagctcctgagccaagcagcccctcgtcctcatctttgtcatcttcttcatcagatcggcctcctcaacggcgtcgcaaccacgggccacccccccgtcccaggaagtggatgcagggcattcacgcccatgctccaaaacgtgcgatggcctgagaagttccgactgggagcgatggagaaatatgacagaagtacggacccagaagaatttctgcaagtctactccacaattcactacaccgctggcgcagacgacaacgcattggctaattatttgcgagccgcgttgaaaggctctgctcgttcatggcttgtccacctcccgccctgctcaatctcttcgtgggaagacttatggcaacagttcgtcaccaactttcaagggacatacaagcgccacgcgatcgaagacgacctgcacgctctaacttagaacccgagcgagtcattgagggactatattcgacgctttaacgagtgcaggaatacgatccccaagatcaccgatgcttctgtcattcgagcattcaaatcaggcgtccgagatcgatataccacaaagaagctgacgacgcgccgaattacgtctgccctaaagttgttcgagatcattgataggtgcgctcatgcagacaatgctctgaggcgcaaggagggaaaaagcaaagcgggagaggagaagaaatcgaccaataaggatgcaccagagtcaagcaaaaagagaaatcgcaagagtgggaagtgcaagtcctcaggagaggtcctcgccactgagcaaaaggaatcacctaggcgccctaacccccagaacgacgactcacgcaagacttggtgtccaatccacaagactagcaatcacaccatggaggattgttacgttatcaaaaaggagctcgcgagacaacatgcaatcgaaagggggaagcgagtacgtgttgttgaaacggcggaagaagccgccaccggtgactctgactccgccttcctagagtatgacctacatgtctcccacatcttcggcggttccacgttgtacacctcaaagagggagtacaaaaaagtggaacgcgaagtctgcttcacgtcgcagacgagtacaaccaagatgaagtggtctcaacacaagatcgaggtcttttggatcaccccaagatcgcgactacgcctgacagatatccaactgtggttgaacccactatacggaacatcaaagtggcgagagtcctcgttgacagcgggagctcaatcaacctactctttgccagcaccttagacgcgatgggaatacctcgaagcgaactgacgcccacagatcagcccttcaatggaattaccctggaatcatcgtataaaccattgggcaaaatcacgctacccgtcaccttcagacaagctgagaacttccgaacatagcagatcacctttgatgtcgcagaattcgacaccgcctataatgccatcattgggagaactgcgctcgcgaagtttatggtagcgtcacattatgctaaccaagtgctcaaaatgccgggaccaaaaggtacaatcgctatttaggagaacgccaagttggcggtatagtgagacaagcggagtctcaacatggtcgagcatactcccaacccgcccgccacaaccaattcggagtctcccatcacgattagtcgcttggcgccaagtgcacaaaggctacaaatgctctagccctgagttagccaaatatctcgccgaggttagaaaactggaacgcagattcgatgggatcgaagttcgacatgtctaccgaaaagacaacgtcgaaccagacgacctcgcacaacacgcttccaggcaagaaccgcttgagcctggaaagtttttggacgtcctaacaaaaccatccatcaaggacacggacaacgaaagcaccacaactgataccggcgtcccgcagggggctgcagaggtcacaaacgtcatcacaaatgcagagacgacaaacgactggcgcactccgctaatcagattcttggagtcagacgagctaccggacgacacagatgcagagaaactgtctcgtcaggccaagatatattgtatgatcggcaacgatctatacaaaaaggaaccaaacggaattctcctcaagtgcgtatcatccgacgacggaaaagctctcctcctcgacatccactaaggcatttgcggatcacacgccggcgcgcgtactctggtcggaaaagcttttagacaaggttttttctggccaataactctcaaagacgcctgtgaaatagtgcaacgatgtgaagcttgtcaattctttagcaaacacaccaagttgacagcacgagcgctccagactatccccttaacatgtctgttctcatgctgggggctcgatatactcgggccattcccacgaggacaagggggctacaaattcctgtttgtggcgatcgacaaattcaccaagtggattgaagcagagccgacaagagaaatcaaagtcgacaacgccataaaatttatcaagggaatattctgcagatatggattgcctcaccgcatcctcacagataacggttcccagttcaccagcggtgatctccaagattactgcatcaaactcagagtcaagatcagctttgcctcagtatctcatcctcagagcaatggacaagtcgaacgggctaacagaatagtactccaggggatcaaaactcacgtgtatgatagcttattggctacgacgcaaagtgggttgaagaactctcgtcggttctatgggccgtacgaact

SEQ ID NO: 44536 - DNA, 7813 bp, Oryza sativa
cccttaccacgataacacctactcttgaaatcgaacctactgaccctttacgctgtttcgacaagcttccgagaaacctacgagaatttcgactggggacgcccagagcagataaggtcttgtcagattctaagagccgaacgaccatgtaagacctagtcatgtaagagttctcaaaaggtgtattaactaagccgtgtaatcggaaattgatttttccaacttcacggctaggggctaggtaaattgcattttcagctaggcaggttacgggtcatcgagccttcccctccgagaacaggtttccccgaggacaaggcttagggctagggagagtacctcactcgacaacgggccaaaggcagcctgtaaaaagagtagtactcgctcacaacacaacctgtttaagcatttactagatagatttctactttgattacaagttcttaatagagataacaatgtattataaacccccttttagatatttttctatagggaatgaagcctaccacgacggccactgccagttcatggaagcgaaaacgtcctcggctaaaggagcaagggatcacgccaactggtcgatctcatccgccgataaccgagaacggcgaaaacccccgcgcaagaatctgaggtacatttgcgagcggcgatcttggatgcaggcgaggacgtgacctccggcgtaacggctggcgcggcgacactcctcttttaggctgatgtcgatccactgtccaatgccttcaagctgagcacactgttgatagtcgttatcaatcagtttcgaccgtcaatattaccaaaatagaggagaactagtgatggttgcaatgcatatgcttgttagaataataatattccactagtattaggtttactaaccttttgcagagaataacaataaagtgaaggagaatcgagatcaactccaatgataaatcaatcggacgatgtcgagaaccaaacttgtgtatgaatgggccaagaactcagaattgacacgacaaactgggccaaaattcacaagtctgcggagaagaacaacagaggaggctgccagccaaaccttgggcttattgggccggccccaggatcggccgaacctggtggttcggccgaacctggtggttcggccgaacccccctcttcgccgctggatgcagggtttcttctggacagtgtggattagctcccaatgacggttggagggtatttccgaccattccaaccgtcacaaccgtcattgggaggctatataaacccctcaccttctcacttcactcacacacctcaagcaagagctctctcgttcctctcaagtttagtttagtagtatatagctggtggaatagaattagaataggaatcaggagtccggaagccttcggaagagttcgggtatggctctagtagctttcctttcctcttttgtaagctttgtacttttattagaatactcttctaaatacatttctggtattgaaatactttccgagtatatgagtaccaactttacattatgttcttgttatactgaatatattgctagcttgtctgggagatgcatgctttggtgcgggtatagtgtttgcttatgcaattactctatgtcatgacgatgatattagagtagtatctggtagtttagacgtggtgtctagattacaggatatcattatttggggttatatattgcggatgagaggtgggcctctgatggtgacagctcagtacgggtattcctccacgcctatatataatcctaagttaatttcctggggagggtactcctccatatttagccccagttggatggtcatgacgagctgtcgtaaggaactaggcagtcaggggtggcttctcgaagtaccaggagggcatcggatagaaggtattagctagtatatcagttaactagaatgtatgtatactatgtatattaaaagtatagaaatagattctctttctcttttcttttcgcctagcttagattatttattatgagtagtaatgcatgtgtgtcactctacccttggattatcttaacccctacttagaatatgattatcacaagtattatataaattattagttgagttctctctacgtgatcttcccacgggataaaatgaatacgatacccttggaatactctcaggcgaaatgctacaatggtatatccatgcgcttgcggatgaactctgtaaccataatataccagaagtatttctgcgccattgctgggaattatatttctagtaatgtcgttaagaaataccaacacacacgcccccctcagctagaacaagtagcccgtcgtgttctcctcggggtccgcgcgatcgaccctcagctggtggtagatgtcggccatggcattacaacagctcttgaggtacgagttcatccagacctcgcgacctcggagagcctccacggccttgtcttttttcacgaccacgagcgatagcccaagttcggtgacctcaaactttgtcctccaagaagcgatgcgtttgtctcgttcggcgatgacaccttcgagatctgcgaaggacaaggatgtaggagatgttgcctccttaataagataataagctcaaagggacaatttctctatgacatcacacctgagttctcgcgagggagcccgactatgcccggactaaacgggccagaggccgcgcccacgcctccgagcacaaccgcatccgtaacgacatcgggagcaggcatatcgcccaaagagggcaagtcgatcatcgcgacatcgggacatccgcattgctggacatcctcggaatccacacagctatgaagaataaaagacgctacagattaacaagtgacgtgaagagaaggaagtcactccgcctaggagattaacagaagtacttgtacaaaaactacaatacaaggtaaaaaaaagtttactcctcataaagggggaggacgcactccccgagatccatcacactagagacatgtcctcgcgcgtggcatctgctgcccccttcgacaagatctccttgagatcggtgacagggagagccagcttcacgcacgcgaggacgtgacacgccctgtgtgaatcccgttggagatttccttcgagaccttggcagtatgccgcgacgggatgacctccatctcgcccgccagctccgacaacgccaacgtcaaggacgtctcgtcgaggtgcgtcgggatagaagacatcacaccacacgccaaggctagctggtgaaggcctatgaagctcttgcggagggagtcgcggagggagaagaggtggtcctgcaggtcgttcatcttcttctccaagccctggtgctgcatcttgttactggccacgatctccttcatcttttgaaggtcgtcgttggcgacttcgagttcaatctccagccgggccacctttccgtccgacgctgttgcacgggccaccgcgcgatccatctgggccgccacctcccgagaagtgttctcgaggaggcggcggcactcggccatcatatcggaccaagttgttagttcgggcgacgacgcggccacaggcgcgacggcaggcccggcggactcagtgacaacaggagcgacctccacgcaaggaatgacaacggcaggaaacccactggtcaccgcctagtccccgctttgcgcggagatcgccgaggctttcctgccaatgtcaggggacatcattagtaaaacttacagatgtgacgacgaaaggagtcaagagtttcacttacttgccggcgagcagctttagcacccttctcttcggaggaggagcgagactgctcgtatcctgagtaagatggcaaattatgacctcattctaacacttcaagaaagaagctaaaggacgacaatgatacgccttacctcggagccactagatttctgtcgagaaccggcgggagcgctcgacctcgcccaaggcttcctctgggtcccgctgcctcctgcgatggctggaacggaggggatgttggcgacttcgtcggcatccttgtccttcaacgaggcggaggcctggtggttgacaagggggccgataacgtccgtcaacggcagaacctacaggagttgaagtcactttgcgccttcagggaatagaaacatgaggaggtctggttctcatttacattgatagcagccgccttgtagactgccgacttgccgcaacgcggagccggtgtttcatcgaccgtagaggaaggactgatcaagacttccttgacccgctgcgccacgatgttggcggggagatctgaaataaatgaagatatgagaggatgagttaggctttggcctcgaaatcatcgtcgaaagcaggaagaagattacaacataaggacaaataccccgcgaagagattcgagttatatcctctgctcccgtgtagtcgaacacggggtgagcacgggcttgtagcggttggatccgaccgctgacaaagtccttaatgacttcatagccggtcaatccttgctctcgaaggtcgctcacagcgttgacaaaggcttggagagagggtgtcaacggaggtttagaagtccagttctcggaatgctccggctgaacctcgggtatgacaagaaccggttcaagttctttgagctctagatagaaccatctcgacctccattggctccgggatgtgtggcattggaaagagatgtatcttgccttcatgccatcacgaaggcgaaaccatcaacatcttgaaacccgattggcttccatccaccggagttcatagaaaaagcaaaaaagatctaagaaaggcactacctcgatgtaggcctcgcaaaggtgagcaaatatgctcaaaaaggcagtggagttggggtttagatgcaagagagaaaggccgtaaaagttcaagatcaataaaaggaatttagaaggaggaggcaaaaaaccacagcggacgaaatcctctagagctaccatgcgacctaggatgggggaaggatcaatacctcttgcttcccaagccatggtctgcttcagagggacggccccctcggtgtacagcttcttcagcgcgccgcatcggagaaagattggtcgaggtccgccatcggaagaagatcgtcggaacaagatcgccagtgggagacgtggaagattagggattttagggaaatggaaagtccgaggaagccgaggaacagtgagggttttttggcaaacagacttgaaatggatcccagaattccattaaataggcgcaccacctaacggttcgtattttgaggaaaggagagagattgccgccgaaaatttctaaggcccgttggaggtagttgttcagacttcaatttaaattcaaattttgcaccgttggactccctctagcgttgtcgatagctccatgtctctacggtcagtaaccgagatcgacctagcgagcacgacgagacgctattaggagaagtcgtgggcgacaacatgaattcatttaagttgaagtcgggggctactgtcagggttaccgataaggcataccttctatcctacgacttatggaatataccaataaggcataccttcacgtacatggattgtttccctatacgtcgttaggaatttgtcttaaattacggaaaatatccctacgagttaaagaaactaccaaagtcctactcggaggggatagaatctctgttatattgtatcatattacatacctccaggccttacttgcgggtcaagataatccacggtataaaagtggacccctagggggaggtgaaggacatctaatatcatcgccaacacacccaccatagcttacgaagccagagtattcggagccaagtcgccgggagatctcgtcgaatccatcaactacgatctcgtcggtatcgtctgttccatctactctctttgtactctgttatcatcgtcatcaatctcatataaactagactaaggctattacgtgttagggggcctgatccagtataatccttgtcttctatttgcttgatgtcgtactacgtagaccctctttcaaacataccccaatactcaacttatccggtccacgagcatcacttgtcgacaatgagaatttcttaagtgtatcctaaatgataaacattagggtagttatttatctacggggtatattctatatatgtatcaaatgctttatttttgtacttgtttatacccataactatttaatggaataactctatacttttaacatttttttagaactttaacatattttcaaacgtatatcgccctcgtatattgtatattgaagtgattatatgttactaattcttgccaagatttattctacccacacaatatcatattattataatttgcgtgaaatatatttgatatacgacataaaattaattaaaactcaattgcacagatcatataaaatactttttgctaacatgaaattttaaaagttattaaagataatagaatgcacagtagtgtttagcatgggcatattactagtatatgtaaatgactaaatgttatggctatttggctaaatagaagaaaaaatgttgcaacaatatatacagttttcagtactacatatgaaaatggagtccttattacctagaaggtatgtttacattatcacgagatatagtttttttatatatattcatgactgccatcgaatacttaccatagtagataaaagaagtagctccttctagctgacttagtggagaaaaagaattaaattttaaaaaacaaaaccaagagattctaaatatatcggaacgaattagcttaaattaatacacacgtgaccagggacgggctgttcggtggctcctttttttatttttgaggaagacctagtattcggtatttcgttatatttcattatagatatgtactatttttaaagcttcgattagactaatatgagtgctcattcatacgatggaccgggctgtgactgtgcgcactgctctgggtggagagcatatatattgatcgatcttatttatttttcatgagaaaatataacatttatttatggcaagacgttattcacgtcaactatggctgtgttagggagtagcactctaaacaaagccgcatttagcgcataattaattaagtattaactaaaataatttttaaaaatgattaatatgttttttaaaacaactttaatatagatttttataaaaaatacactatttaacggtttgaaaaacatatgcgtgaaaatcgaggaaagtgagttgggaaagtagagataagaatttaagcatatatctatcagtcaatgtggtactccctccgtcccaaaaaaacaaaccaaaccatgtgttttcgtgtccaacgtttgaccgtccgtcttatttgaaaaaattatgaaaaaaattaaaaaaacaagtcacacataaaatatcaatcatattttatcatctaacaataataaaaatactaattataaaaaaaattcatataagagagagagtcaaacattggatacggagactcagcgtttatttttttttttttatggagggagtatatagtagtacaacaatgcaacagccaatttccagttcgatcaggcgtgtgcgtgccgttgcgtccagctaaactccacgacttagatgtcggctcgtgtgtcaaatgcaaaattctcaagaatctgccgcagccgatcgatttcatcggattcttcgtggtttgcgtactcgtgcgttgtactatcgcgtgagtgctaacgagcgcacatcccaaaaatagaaagtgatgcagttctcccgtacgcgtcttt

SEQ ID NO: 44537 - DNA, 2743 bp, Oryza sativa
ggacggtcaaacgttggatacggaatcccaggtgtggagattatgggtaccacatacccacacggcatggttatccgactggttataggggataacttatatctatgaaatatgtaacagatcatgacttgggtattacgttttcccgtatattatggaatggcctaaagtcctggtttgataagattgtaaagtagatttaggaaaccgataccgtattgattaaggtttctatcttgtaatcctgcccccatcctatataaggtgggtaggaggccctctagggagcatgagatacaactagatcgtcagatctatactacacccggcggattcaaatccccaaacaggagtagggtattacctctcattgagagggcctaaacctgtctaaatcctttgtctccgcatccatccacttttaggtctcgtgcgctaccccttttattattgcctaattcatgtttcgacagttggcgcggcaggtaggggtgcgtcgaattacccatcgaaaagtgcaatggaatcaactgcagaagaaacggcgagatcaatctcaccgacgtcgatggctcaactcttcaaccgggtttgtcgtttcaatctatctagtgttttttaacaatgtctatgacagattgatttcctggtgtactattattattgtagtactactgtcgacgagatcgtcgatagcatatggagccacctgggagtatacacggcatgctgcaacccctgtcctcagaacaggcgtagtgtgcggttgccggttggttgcgaatgttttggcccggccgactgctttgattgccaaagtaacagtctagcacgcttctcctcgcggcgacgtaatcaggggcaccggaacagctgcgttgatcgcatgcatctactgatcaccgccatatatgcaagtatacatgctggccaataggccaaccaatcaggagtcctgcgtttataggctgctaccaacatgcacaggcttgaatccaattattcaataagcagctatcgacacatatgagtcaattaatatataggagtgtatgtagttgtatgcatgcatcttcttttgtttactaatctgatttgactcgtatttacatgtacttccatggatcgatggccatggccctgagatatcgttctgatccaacaagccggtaaagcaatccttctactattactgggtgggttgtcttcatcaccggccacacattggagcagctgcctacaatttaccagatggtgatcatatgacaaatatcgtcatgcccgcaactggcgccgtcaactcatcgagttttatctcttccaacttattattctatattattagattgatttctaatttcagattaatctcttgctatttttgttgttgtttgcatataattacacggcactactgaggcgattggcgttggtcatggactcgaggtgtctcgctatgcgattagttggccatgagtctactccaccggcttgccttcaccactgccgttgctaatggcaacaacgtcttcaccgccggcctgcctccgtcgccgccgactggtgtcctcgcctatacgattggttggtcacaccaccgttcatggacgtctacgtcttcatcgaccggctggcctttgccgccgccgactggtgtttccgcctgcacggccggcctattatgccgccgttgttgggcgtcaacgtcttcaccgccggcctgcctccgtcgccgccgactggtgtcctcgcctatacggttggttggtcacaccaccgttcatgggcgtccacgttttcaccgaccggctggccttcaccaccgctgactggtgtttccgcctgcacagccggcctattatgccgccgttgttgggcgtctacgacttcaccgccggcctacctccgtcgccgccgactggtgtccttgcctatacagttggttggtcacaccaccgttcatgggcatccacgtcttcaccgaccggcgtgccttcgccgtcgccgactggtgtctctgcctacacggctggcctattatgctgcatttggtgggcatcttcgctttcaccatcgaccaccttcgtcgctgccgactggtgtctttactgttattgatggacgactttgttcccacattggccacctctgccatcaccaaggggaatattacaaagctaagtcatcattaattttctttatatgatattttccttttcctctgcctcactacatcaactggttcgccgttgactagtgagtcgggggactatagatgtcatatcatattttttaacaatttttcataatatttatcttgattgcttgcgaaataatccgagtaacaataaagttcctatcgagttatggagttctattttcctatgctttccatttggtttgtcgatggatagttgcctttgggccgattcctagcacccgggggctcgttggatggaccgagtaacgcaaggtcctaagtattattcggaataaatcaaaagcatagagataagataaatttattttctgctcttacaattgcaaaagtacccgagtagtaaattttgattcgtgaaactttgttccattaatgacgaactcatgtcactcatatgcatgtttgggaagtgcctaaaccaactcccgatgcttgggggctatgactagtcgggcagagtgtttaaacgtacggagtcatctgctcggggaaatcaaaattgacaagaggagaaatacatat

SEQ ID NO: 44538 - DNA, 981 bp, Oryza sativa
ttatcgtcttcaccgccggtcgtctcgtctgctgggattcgagcccaggtctccacgaccacaacgtggaattctcaccactaaactactgccgactggtttgttcgcctccatggctgcgcgtcttcgtcatcattaactggcgtcatcatcgccggtttgccttcgccgccgtccatagtgttttcactttaatagctggcctattttgccaccgttcatggacatcttcgttttcatcatcatactacttcttccgtcgccgactggttatgtcgccgctgactggtgtgtttatcttcacaactacacgccttcgctaccgttcgcaagatttgctacttcaccaatcacgacatctacaagagcttcgacatctcgacatgcgtcaccaaatatgatgccttattattttactatagcaagtggtgttctaatcatcaatatttctactcggacatcttcaacacgtatcttcactcaagcaatggctactcgacgacaagctagagttctcgactctatgttcagttgttttccaactaaccaaagagtcgggggctacacaaatacaaggctcaaaatttgacatgttttttgtcaaaatgaagcaatcaatgaatcaacaagtaaattttgggagttattatcttggtcttcgcttcagagccgacattttacttcagcgactctagttatttcgtcgattcaacgagttggacaacatcatctatttttcttcaagtgaagcatcttctacagctacaacaccaagttctactgtcatcttcataaatcaagaggcgttgcatcaatctacattacgcgcactctagcgtcaacgaaattactcgagcttcgatatcttctcaacagtttgatggattattgtcactgacctcattaccaacgcctctactttatcggccctgacgtctacgccattgctaatgggtgactacgtcttcgccttcggttgct

SEQ ID NO: 44539 - DNA, 934 bp, Oryza sativa
aaacgaatcattcgagcctaattagactatgattagccataaatgctacggtaacccacatgtgctaatgacggattaattaggctcaaaagattcttttcgcggttttcagggagtttgaaatttttcatttgtgtctgagaaccccttcagatatccggtcaaacatccgatgtgacattcaaaaattttcttttcacgaactaaacaagaccttatatttcaaatttctaacagcggtttataagatgaaatacaaatgatcgttcttttgttattccaatgggatttcaaaagactcattaagtcccaaagtatataaaaaatattcctagaattcacagccgacataaattttaaaaacatttttttccagaagaaaccctacaactgaaatatctcaacgaaaatgggagtactccgtctaaaaaaataaaacataagacatgatataacacatctagccctataaatctaaaaaactcccctgttcaaaaatcataatagtactcttttcgttcaaatataaaaattttgagctaaagatatctagctttgagaataattagagtttcaaacatgacattagtacaagtaaaccccagggcctcaaaatcctttctccgccgccgatgtgaggagaccgaggaacgggcggaaataaaaccccgcacgtgctgctgcagtgagccagtcggtcagccgtcagccagcgccgcctgccgcagcgccaccccggcggtacaagcgggtagtatatccagggaaaagcagcagcagcaaaaaataaagaaaaataaaagtgacagggaccggtgaaaaggcagtgggacgctggaaaaaagagctcctcgcaaaaatgctctcgtgtcctcgtccgtccgtcctcccctgctgagcctgcagccttttgtggaccaccccgccccgcgca

SEQ ID NO: 44540 - DNA, 783 bp, Oryza sativa
ttgtcacatggttttagaacaattgacaaaatatctcctgtttgttaggaggagccaaaagaagaaactataaagaacacagatgaagcagtgcttttgaaaactgaaggagcagctgttgctattgaggaagataagaatggcatttctcaacaaaaggatgtgaaagaagtaaagaatgcagacacaaatggtatgaattatattgctaaacatgcttcgtcatagccttttaaacagattactttagaacattttgcatgatctcctgcactgtttatttcctgtaatgcgaaggaaaataagctgatcattgttattaattttgttctcaactatgaactatggcaacatcagaaaagaagcatggaggtttccttaggactaatcctttcatggtagacaaaaaggtaatctattggaagctggatgactattgtaataacacaacaatgatgctccaaggtttgttggaaagcgttattcaacatccttccactaatttcagttctgcattataaaattggagacgattaacatctgtctgtatcagaggttgatgctgatgatttaatggggaacaaagacaagtggtttatgcttaatgaagatgaaaagaaaatagttgaaaactatttatccacaaggtaaggatttctccatatcaatttatttggatttatttttatctattataaatcaggaatgcatgctgattggtatgctggataagtcaccaaaatattttggtagaaacactatttgatattttatctgcaaaca

SEQ ID NO: 44541 - DNA, 1288 bp, Oryza sativa
tcatcaactgctattgactggatcaccgacttgtcatcttcatcaccatcctgtcaagcttcttcgacatagcctactctactactatcgatgggcaacttcgtcatcatagtcgatcatgtctgttgctgctaatcgtcattaccgtcggttgcatttgccgtcgccgactattttcttcatcttcatgattgatggatttcgccattgccattgatgagcgtctacgttttcaccaccggcttgcctccgccgccgcccatggtgtcttcgctttcacggctggcttattatgcctttactgatgggcgtctttgtcttcttcaccggctgtctcgtctgtctccgactaattatttcgtcaccatggctacaaaactccgtcgctattgctgggtgccttcatcttaattgttagttgatctgtctgccgccgactggtttcttcgcctccatggctatgcgacttcattacctttgattggtatcattgtctttaccaccaccaacatcttcgtcagctttgatgggtgatatcatcttcatgttagtcatttcgtctccatgtcgactgcatcagctattgccaatggacaattttgactatgacagaaggacaagctatatattctcaggggcttatcaactcaaacactaggatcataccttcaagttggattttgttctgagattattttctatgctcgaagactgaaccaatcattattctccgtaagggctatcaaccgaatacttgcgccagtcgggattcaatttttatatctattttggagtatcccataagggataatcactcagatcagaagctattcatatgagctacacttggtctatattacccggaagatttattactcgggagcatgttatatgcgtcatcctttaaagggtgtcgaaggcatttttttttggcctaggcctaatatgtttgcagcccatattttcatgtgtggcctgtcacgttcttttagggacttaggcactttttgcttaggccaaagtgtgcgtgatcaagtgcccaatatcttaaaatccttttataccgcagttactcaactttttaggagttggtacaatgcatcttaaaaggtgtcaaacagtaaagctttatatagctgttccgctgacttttttatataagtcaaggtgttgtttgggtttttaagcaatcgattggatacaatatcattgctttttgccacgtaagtgtgcgtttttattgaccaatattatggcttaggctgattatatatcttggtcattttcc

SEQ ID NO: 44542 - DNA, 11990 bp, Oryza sativa
  unsure (1)..(11990): unsure at all n locations
catcctttaaagggtgtcgaaggcatttttttttggcctaggcctaatatgtttgcagcccatattttcatgtgtggcctgtcacgttcttttagggacttaggcactttttgcttaggccaaagtgtgcgtgatcaagtgcccaatatcttaaaatccttttataccgcagttactcaactttttaggagttggtacaatgcatcttaaaaggtgtcaaacagtaaagctttatatagctgttccgctgacttttttatataagtcaaggtgttgtttgggtttttaagcaatcgattggatacaatatcattgctttttgccacgtaagtgtgcgtttttattgaccaatattatggcttaggctgattatatatcttggtcattttccaggcggttggtaaatcctttatgagtttatttactcggattttacaccacatatgccgtatatttccgggtgtggtgaaaccatgtgtcttttagggacttaagcacatctgttaaagcagtgtgcgcatggcgtatgcccaatactttggaaatttctttattcacaacattcaagcttttttatagctgttttgctatgtgtattttcaatgatgtagtcaactttaggttgctctcatcaatttttacaaagcaatcggtatatcacttggatcatgttattcggggattcacaccgcatatgctatatatcaagtcatttggttgattacaattatcaaaaccactcggttggttggattatttattccttgactatacgcttagtttgttcagctaaccacatagtcggaggctacacctattaggtgcatctagtcgatgcacctaactttattttccaaccctccacagtctagtcgaagattatcttttcgactatgaaggtctcaagggctactatggagattatgggtaccccatacccacacggcgtggttatccgactggttataggggataacttatatctatgaaatatgtaacagatcatgacttgggtattacgtttccctgtatattatggaacggcctaaagtcctggtttgataagattgtaaagtagatttaggaaaccgataccgtattggttaaggtttctatcttgtaatcctgccccccatcctatataaggtggacaggaggccctctagggggcatgagacacaactagatcgtcatatctatactacacccggcggattcaaatcctcaaacaggagtagggtattacctctcattgagaggacctgaacctgtctaaatcctttgtctccgcatccatccacttttagatctcgtgcgctacccccttttattattgcataattcatgtttcgacaccagagtttgtcttttttttttggaatggagggagtgttcagattcattgtactagtcacattatagtactagggcctcgtttagttccccaatttttttcccaaaaacattacatcgaatctttgacacatgcatggaacattaattatagattattttaaaaaaactaattgcacagttagaggggaaatcgcgagacgaatcttttgagcctaattagtctatgattagccataagtgctacagtaacctacatgtgctacagtaacccacatgtgctaatgatggattaattaggctcaaaagattcgtctcgcagttttcaagcgagttatgaaattagtactttcattcctgtccgaaaactccttccgacatccggtcaaacattcgatgtgatatctaaaaattttctttgcgcgaactaaacaggccctagttgtctattttttttgggacggaggaagtacttgcttgtgagcctttttgttgctatagcccaaattaccccgtgtccgtggcccatgaaaaccagtcgcttccgtcctcctctgtgtgtcgggcatcatgtaggaagtctaggaacgtatttacacggtgcacaaaacactcatcaattctaattagtgcacacattgtttaacaaaaaagatatagcatatcttgtcatcaatacaacgaatctagacaacgggtagtctagattcgttattctaagaggggtcgtatccccttagagattgagttttctttagaacggaggaaataggtggcagtagaaggccaaaaagaagagggaggtggttcagcccatccattgaagcccatgtttgtcagccaccaaatctatgaagccaagagtaaaagattattatctgtcttatagtccatgcattcctccataaaaccaatatatgattcatatattgatcataattcctcgttactagtaattcgctagtacagttgaatgcaaaatatattgctgtccactgctataaggaagtaagctaagtattgaaaggaatacgaattaaaagtaaagagagaaaaacgataggaaattcaaacatagatccggcgagttttctctgaggtataagagattcggcaatctccactaatactcgttggagcactctacacaaagagtacactgtctctgatagtcacgaagtccattggcgctctcatcatggtggttcttctccgctctgaaaggtgaaccccgaaacctccacaaccacaccggctctcccacaatcttcttgacagatcaccgggttgccttcgagactggctaggcatgccaagatgccaatagttaacaggaagagagccactcctcctgttaagaacaggattcttgttggtgcacactaagccactcttttttgacgtgaaacagtaggaaaatataatttacagggagggtggcaagcaccagaaaaaagcatactctcaactcaaactagcactaaattagtgaagaaaattatcacaattagctcaatgatgctcttagactctcccatcaattgctcagctcaatagggttccaaaggacaccggggagtcaagccaagggatgtataaagccccaatcaagctccctagcggtttgcagccatcgtaaagaagcagccaaaactgcaaatcgtcaaacagtatggcaccgacccgaactattctgcccttcatacttttctgattgtaactgggcaagtagttgttgggccataaagcataggacaatccaacatctcctagattgcccaggacccctttgtccacacggtgtcggacaatccgcaatgttcaaaaaccaatgaccagtaacaatcgaatgaacatgccagattaaccgacgtcgtgtcgaactgtccgctagttgccaaattaactaggcatcagacaattcgagagctgccggacagtctagccagttcatttccactatctagtcaacatggtcagacaatgaactggctgaggatgtttcttttgttgcgtacatatgattgtaaggatgttcagtgcagggttgtccctagtaatttggggcctcgtgcctaatataaaataaggccttacctttagaaaatactattatataatagattagaattatatattatttataatacattaggtgggtatgccctctcacagctcatgagtcatgaggagaaagagcggatgatgggtcccaatcatatgattctcacaactagcataccccctcatctactctaaacgaacctttggctgcctattgcattcttaaagtaagaaacaacaataacaaacaccttccctgaatcgagtggacctagtagccagagtcttagatggtacaaagaagcccatgatgaggaggaggtagtccaatccctgtattgaaacctatgttattagtttttttttaaaaaaaaggaagaaacatatgctattaactattagatgtactcacctattttacctttgtattaatatatttgccgtatagttgacgcatttcaatgtaaaccagcgattcaaatattgatttttttgaaagatccaaatatacaaacgttactaccaatctgtcgttgaagataagtcaaaaacaaattcccatccacctatttaagaaggtggacaagtggatggttggtaggcccaccaacgtgccccctcacacctcctgagtcacaaggataaagagcgaacgatggagcctactcatacacttctcacaccttgcacacacaacacaacccatctgttttagccggacctttggccgctgcactattaaaatgtagaagtagtgcaacccctattaaaacccatgttattaaatactatgtctattcaaccacattaatgttgtatttatatttttctctatagtcgttgtattctaaagtaaacgagtgattcataaattgaatataatttttcaatagatccaaatataaagtctaacaataatttgtcactacatatgaatccaaaacaaaattttcatccacccatttaaggtggaaaagcggatggctggttgccccaccaacatggccttcacacctcatgagtcaatgaggaagagtggatggtggatcccagtcatatgactccgacaactaacatacccactcatgtagtttagataaacctttggctgcctagcaatatcaaaataaagaaacaatgttaacaaatacattccctgaatagagtggacctagtagccaaatacttattaggtggtataaggaagtccatggtaagaaagaggtagaccaattcctctagtcaaacctatgttattcactattaggtatattcatgtatcttatctttgtgttaatttttttataattgatgaaagtaaaccaacgattcactaacagattttttttgaaagatccaaatatataaaggatactagtaatttgttgctaaagattagtccaaaattaatcacctatttaagaagttgaaaaagtggacggttggtaggcccaccgacacacccctcgaacctcatgaattatggttgtgtttagttcacaccaaaattggaagtttgattgaaattgggacgatgtgacagaaaaattggaagtttatgtgtgtaggaaagttttgatgtgatggaaaagttggaagtttgaagaaaaattttgcaactaaatacggcctatgattaggaagagtgaacggtggggcccactcatatgcttctcataccctgcacacccgcccatatgttttagccggactttttggctgttctgctattaaaagaaagagtaaatcttccacgacgtgtcataagcaggatggcatgtactaatcatatgcctattataactagcatacacacttatctagtctagaaaaacctttggctgcctattacattctaaattaagaaataagtaacaatagtaaacaacttcccttgaagacctagcgtattaataaggaggtagtccaacccctctcgttgaaacctatgttatttaacaattagatatactcacctactttacctttgtattaatatctttactgtataattgatgcaatcatcacatattgtatatatatatttttcaaaaggtcccaatatataaagacaacaatccgtcactaaagataagtcccaaaagaaatttctatctacctaactaaaaggggtaattgcacattgactctcttttgaaagctaactatcaatttgaccctcttttatcaactttaattatttaacccttttcttaaaaattgaagatatggtatgaccctattctattaagggcatctaacgatgttaactgaagcacaaaatgtcccttctgcccttactcatttgaccctattacatgtgggacccacgcgtcagttctctcttgtcctctcctccacagctccacacgcagggagaaggccgcgagcagcgagagggcgagccagcgccgaccagcagctgtggagcaccgcctccactcctcgtcaccgccgagccgtcgttgcccctcccttgccggatccagccatcacagctccatcgctgggttcgccaccttcctttcttagtgcatgccggtggcgcctcctcttccctccgcgcgctgaccgccgctgctacctccctccttccgtgcgcctgccgctgccgccgcggcctcctccctccttcagcacgcctatcaccgccaccgccaggcccggctcccctccctcccttcgccgcgcgccggcctctgcctccctcctcgctgcacgcgccgccgcctcacccgacggtgcgcgcagctccactgcatgctgccgccaccaccgcaggggaactgtcgccgccgtcgcaaaggctcggcgcagccgctcccttcctccgcaagccgacgccggtgcagatccctccatacgtttcccaccaccgccgctctttcccttcacaagcgtgtgcaagcgaggatcccctccacgcgcttcccatcaccgcggcccctgcctccacgagcgggcgccgccgcggatcccctccgcgtgcttcccgccggcgccgcccccttcctcccttcagacaccgagtgccaccaccgcaactcgctggcaggagagagagagatacacatgtggatagggttagggatggatatggtttcctcaagggtattttggcattacgaattttatttatatttctttgtttttttaaatcaaatcttaacggtgtagtggaaacagggtcaagcggaaggttcgtttttgaaaaacatggtcaaataagcaaactaaaaaagtagggttaaattggtagttagacttcaaaatgggataaaataagcaattgtccctattttaaaagataaacaagtagacagttgataggtccactgatgcacgccccctcacacgtcatgagtcatgatgaggaaatgcaaacgctgggacccactcatatgcctctcgcaccccgcacacccacccatccactttagctggacctttggccgctctaccctctatcaaagtaggaaataacagcagcaacaacagctcacagccgtaaaagctcacacacctcctcctcctcctcttccacgcgcgtcagtgggccgcgctgcaccgcgcattgcttcacctctgcacacctgaaaccgaaaaactcaatttggagtgaagcagggagagagagagagagagagagagaggagagaggtgtcgtggagggaagtttttgaacaaaaaatttccccaacccgttgggcacgatgccgtcatgatccccccttacctcactgccaaaaaaatttcaatatctcacccacattaatcaccttcctcacgagtctaacgagcaaaaatcccatttcatcatcattcatatcaatcctctcgatttcttccacgtccccggattctgtttcctcctcctcccccgtctcgatccctcctcctctttccctcgctccagcgcgctcgccgtcgcccgccgcccgccaaccatggaagcagctggactggaggaggaggaggaggaggaggaggcgatgccatggtggtgttgccgcagcaggaggaggcggcgtccgtcgaatccaagggagtccacgtcatcggcagccgaatctatgatccggagaacctacaggtggtggcaactagagcctacaggcggggtaagctctactgcgataagtagggacgatcttggcaggggcttggtttgatggaggggttggcggcggtgtaggaaggtgactgggtaagggggtgtgactgtggaacggtgaacttgagctggcacacggctggctcaggctcaacaacacgagcaccgctccatgcacacgaactcccagtctaccacaaacgccacactccctaacgacattaccgattgggagggtgagggagagatgagaaagaggctaacatgtggccctatcctcgtcttggatccagatcaagtccatgagggatccatgtggcatatgcccacgttgtctcatggagcggatcaggggctagtttttgaccagtgatgatgcacagtatacaactcatacttgaagggttgatgcataaaaaaataattttcatgatgtcattcagagttcaattttgatcccttctactccaatgaaaaaaaaagatcggttgaaatgggacaggagagacatgttttttttgtggcgtacatatgattgtaaggatgttcggtgcagggccgtccctagcaatttggggcctgtgccaaatataaattaagaccttatctttagaaaatactattatataatagattagaattatatattatttataatacattggggtgggtatctaataccacttcttttttcttgatctgcattgcaatcaatggccttctatccacatcaagaaagctagctttaatctaatgctactttctttagctatatccacaataagcatgaattgtttttaaccaatgataactatatctatgtcaaagaagttcaccaacctacatctgtaaatgttatggcaatccggctaaatagaagaagaatttatgggatctgaaagtgcattttgagaattcagggacttcgatgacatatacgaacaagtttagggactagtcgtgtactttactaaaaaatactagtaatttggtactacagctgcgtccaatacaaatttccatccaccctacttaagaaggtggacaattggacggtttggaggccctcacacacctcgtgtatcatgaggaggaagagcaaacggtgggatctactaataagcctctcacatcctacatgcccatctgctctaaactgatctttggctgcctaccaccttgtcaaagtaagaaatatgcatcaacaacaaaagggatgtttagatccaggggtgtaaagttttggcgtgtcacatcaggtattatatagtgtgttgcatggagtgtttgggcactaacaaaaaaataataattacagaatccgtcagtaaaccgcgagaagaatttattaaacctaattaatctgtcattagcaaatgtttactgtagaaccacattgtcaaatcatagagcaattaggcttaaaagattcatctcgcaaattagccgcaatctatgtaattagttattttttagcctatatttaatacttcatgcatgtgtttaaacgtttgatgtgacagggtgaaaaattttgaggtgggatctaaacagggccaaaaacacattcccaaaatcgaggaaacctagtggctagggcctaaggtagcatatttacattaattattgattaggtggtacaatgaagacaatagcaaaagggagaggcagtacaactccctattaaactcatgttaatatctattcgactaacttagtaatatctttgttctatagtcgatgcatcctaaagtaaaccagtgattcatatattgaatatatttttttagttgattcaaatataaagtctctactagtaatttgaaactacatatgaatccaaaataatttttcatctaatcatttaagaaagggcgaaaagtggatggctgattggttatgccccctcatagctcatgagtcatgaggaggaagagcggatggtgggtcccaatcatatgattctcacaactagcataccccctcatctactctaaacgaacctttggctgcctattgcattcttaaagtaagaaacaacaataacaaacaccttgccttgaattgagtggacctagtagccagagccttaggtggtacaaagaagcccatgatgaggaggtagtccaatccctatattgaacctatggcccgtttggttggagggagtttttaggagggattgggagtttagagggatgaggctattaagtgttttgtttggttggaagacatgtgaattttgatgggatggagatgggtaattgaggaaggaactccctccttttcaatacctgggtaggggcaggtaattgggagggaattcctcctttactttgtctaagcaaatatcagccatccgtttttattaatgacataatctccaactaaactccctatcaatttccatcacctctaccaaacaagatattgggattaaaaatcaaattcccatcttaatctcatcatcaattccctcgtgtaaactcccaatccccttccctcgagttaccaaacaagttgctatgttattagttttttttaaagaaaggaagaaacatatgctattaactattagatgtactcacctattttacctttgtattaatatatttgccgtatagttgacgcatttcaatgtaaaccagcgattcaaatattgatttttttttgaaagatccaaatatataaacgttactaccaatctgtcgttgaagataagtcaaaaacaaattcccatccacctatttaagaaggcggacaagtggacggttggtaggctcatcgatgtgcccccctcacacctcatgagacatgatgataaagagcgaacgatggggcccactcgtatgcctctcgcaccctgcactcccacccatctgttttagctggacctttggccgctatactattaaaatggagaagtagtgcaacccctattataacccatgttattaaatactatatctattcaaccacattaatgttgtattatatttttctctatagtcgttgtattccaaagtaaacgcgtgattcttatattgaatataattaaacgcgtgattcttatattgaatataatttttcaatagatcaaaatataaagtctaacaataatttttcactacatatgaatccaaaacaaaatttccatccacccatttaaggtgggaaagcggatggctggttgtcccaccaatatagcccttcacacctcatgagtcaatgaggaagagtggacggttgatcccagtcatatgcctctgacaactaattacccactcatgtagtctagacaaacctttggctgcctagcaatctcaaataaagaaacaatgttaacaaacactttccccgaatagagtagcccgagacttatgtggtataaggaagtccatggtaagaagtagttcaattcctttattcaaacctatggtatattcatatatcttattctttgtgttaattttttttatagttaattctaaagtaaaccaactattcactaacagaattttttaaagatccaaatatataaaggttactagcaatttgtttctaaagattagtccaaaattcatttctatccacctacttaagaaggtgaaaaagtggacgattggtaggaccaccgatgcacccctcaaacctcatgaatcagagcgaacggtggggtccactcatatgcttctcacaccctgcacacccgccccgtatgttttagccggaatttttgtcattctgctattaaaagaaatagtaaatattccatgacgtgtcatgagcaggatatcatgtcttgatcatatgcctattataactagcatacccacttatctagtctagaaaaacctttggctgcctaatatattctaaattaagaaataacaatactccctccgtcccaaaaaaagtgcagttttgtactattcatctccaacgtttgaccgttcgtcttatttgaaaaaaacttatgattactatttttattgttattagatgataaaacatgaatagtactttatgtgtgactaattttttaaaaaaaatttataaatttttcaaataagacggatggtcaaacgttggacacggattttcacggctgcacttattttgtgacggaggtagtagtaaaggggatcccctgaatagagtcgacctgcaggcatgcaagagggagtagtctatactctctcgttgaaacctatgttatttaacaattagatatactcatctactttatctttgtattaatatctttgctgtataattgatgcaatatcttcacaattatatatatatattttttcaaatggtcccgggaagggaagactcacacatgcattaagttataattatgtttagattctcacatggcagtcctaccgatggcgacannnnnnnnnnnnnnnnnnnnnnnnnnnnnnnnnnnnnnnnnnnnnnnnnnnnnnnn

SEQ ID NO: 44543 - DNA, 3197 bp, Oryza sativa; identical to SEQ ID NO: 41787

SEQ ID NO: 44544 - DNA, 1591 bp, Oryza sativa
cgatgcaatgcgagcagagttgagcgaacagtctgtcatgtaagagtacctgtatctgagcacaaactaaccatgggcgcgtcatgcttatatctaggatgtactcaataatttacaaccccaagtgtatcgttttacggtctgatctcgtgcatatatcgtgcatatgctctctttttgcttctatgtaaactccttgtttcaataataataatacaaggataacgcagtaattaatttattgagattgctgtgggcgttggttttgaactattcttttttctgctattttgttttacatatataaagcatgcatttattttctggtgtacttaacaatttgagaaaatagtcacagtttgctgctagcattacaggctttttaattgaatcagatattttaaaacaatatcttgtttccttagttaatatactaatctgctctacatgctcacatggtacattgagattatattttgtattgcaaatggaataacatactgatttttccccacagattttccaagtacgcaagggtcaaccagaaagaatccttcgggacatagctggaggtcgtggacttcgagtggtgtcctcagtcatcgctgacttccacataactttgttatccatcatccaagaaggccgaggaatcaagtaagtagatcccaaaccgagccttttttttttctaaatgcagttgataaaattataattatgttgttttcttctcaggcctatcacatattcaagagataatgatgcatggattgttgatactggaaaatgcataagcgagtcaatctttgtcccagagggacttccccttgactccctaagtcagggggtatcgggatataaaaatctgagcccttcttgtaagctcagtgttctgaactttttgtgtgatgaaagtctttctactgagtaagtattgcctacacatttgttaatacttcccttcgctattgtgatgttgttatttctgattttttaaattactcttaacattgttcaggaagttgaggagctgcatattatctgaaacaaaaaacccctccagagaaaaagctcattctgcaaaagagaaggttttgatcttggcttgcctttcccaccttgtcacatggttctagaacaattgacaaaatatctcctgtttgttaggaggagccaaaagaagaaactataaagaacacagatgaagcagtgcttttgaaaactgaaggagcagctgttgctattgaggaagataagaatggcatttctcaacaaaaggatgtgaaagaagtaaagaatgcagacacaaatggtatgaattatattgctaaacatgcttcgtcatagccttttaaacagattactttagaacattttgcatgatctcctgcactgtttatttcctgtaatgcgaaggaaaataagctgatcattgttattaattttgttctcaactatgaactatggcaacatcagaaaagaagcatggaggtttccttaggactaatcctttcatggtagacaaaaaggtaatctattggaagctggatgactattgtaataacacaacaatgatgctccaaggtttgtt

SEQ ID NO: 44545 - DNA, 9208 bp, Oryza sativa
  unsure (1)..(9208): unsure at all n locations
aaaggggtccactgtcatacaccgaagaatgtcggtggccaatggcggtgtgcctggttcggctgatccaaggttggcgcccccagccccctccttgcgcgtggcgcccccttattggttggngatgncggttgtgggngcnccnacatccacaaccgccatttcaagcgtcatatgaaggctataaaaggaggagttcaactcacttccgaaacacacatctcaagtggagtacaactcactttcatattttaggcatctctttagtgtgtggaattaggtaaagagtgaggtaaagctccggaaggagtgccccaaatatcggagttcttcttccactggagtttcggagaagtgatggagttatcggccttcttctctcgtttgtatcttaacggatgcttcttaagtaagtatttgagatctccttatggtatttaatttagttgcttgaatgacatatattcccatcgttgcgggttcgtcgcttagttgaattattaagtgctctagtactaggattctagataaagaaggaagttcctgcgtggggctagagtagtaatcaataacttaggtgtggtgtttaggttagcggttacctttttttgttgtgtgctccatagaaagtgaggtaggcggaaggtggtgatagccttgtccatcctttgtatccctccatgttcaggtacatcatagagccgtaggctggattcagcttggcagaccagcggagggctagtgccagaagcaatcgatagggttttacctttaactcaagtctagtaaattaatccataggaatcctctttagccttagcctaccattagttgttgtccttggatagaattatgttcctagatatatgcacatgttttctgtgattcgatacccttggaatactctgaggtgaagtgctacagcggtattcgtgcgcttgcggatttatctgtgaccgtatcaaataccaacagcgagctcaaagagatcgtgatgcaccaacaacttcatcaacatcatcctatgtaatgtcacatccacgaaaaccttcaactggttcatgtaaggaattatcccactcattgttccaatcaaactcctcaatgacttaaggatctggccttttcctgctttctcacgcctaagctgaaacctagtttccatcttccagttataggcaacaaaaacaacatcattcaatctcttgtgtactaactggttcattttctttgtatggatctgcagggatgcaaataacaagggaagaaaaaaaaggataaataacttgctgatatagtaaagaaatttaaagcaaaactacagataaactgactcgcaaatccaaatgttctccaattgagctcacaactggataaaaaagctcaattggaatgcatgctgattggtatgctggataaaaaagctcaatttatttggatttatttttatctattataaatcaggaatgcatgctgattggtatgctggataagtcaccaaaatattttggtagaaacactatttgatattttatctgcaaacaaaattcgtgtttttaataaaattttccaatgattgaaccacctgtacattgtgatgtacttgatgggtatatcctttgaaggagcatcctaagtaatatgcactggggatattatttcctgaaaatgtagtgtattgtgattccacaaagctcaaatatctcaactgaatcattccaatatgcttagttatgatcaagaaactttagtagcataaaatggtcggtgaagcactttgtccagacatctgactaactgaagtgatgtactgcattaaataaagtttattttatatatcatacttgcattttcaatgttccatggccatattactggatatggatgaatatatctgtgtttttgtgtacctcactactataacttgcactgtccacacattttcctagctgaagtgatgcaccacattaattaattatagcttgcattgtccacatattttcctagctgaagtgatgcaccgcattagttaagagtttattttgcatatcaagctagtggttccttattttctacttgactgaaacttttgtataatacagggtttagtatgataattgataatgaagtgagatattgagatgtaacatctttgttccccactagttttatgttgtaatttcaggaaatattttaaaaaaataatcaaaatttgacatcagaagtttagacgagtatgcagagaattactgccaagattggatgaccatcactggcttaactattaaggaattagtttatttattactatcataataatgcaatcagttatctttttaataacagaatccaaactatcagttctgatgttttcactgttgatctaaaggtgctatacaaatgtttcaagaatcaagattatataggttacaaaaaaattgccatgtatgttgacatgctgaagtttcatcttgtccttgtgatgaatgcaatgatacttgttgctcattgattaaaactaacgtattagcatattctacttccaacttctgaaatagcatatcagtaacttgttatcgctttcctcaattggcaatgttttaatacctaatattgctttcaataactttctctctttactcttatatcagatcacacaagctaactaagttcactttgtttttgtcaactccatgaatagtagaaattgtctttgtcgacacagtttgtcactgatctgacatgtgattttaactggtaatacaggcctaaacgcagggggagaaaagctgcacaatagtctactgatcatactctctaggttcctcacctggctgaaggtacccttttaattcagcacaccccttttcatttctttagtttattattaccattttgagtttagttttgtatgggtcctgcatctagactacgctaggagttcccatatcattttgtttatgtgacactgcctacatcaatcttcttacttttacatgttatcaatcggatagttgtatttttgttgatttaattttgagtagataatttggaatgcgatacatgctatgatctatgatttggtattttgctactttttacggaatttgtagcctgctagatgttcttacaaagatatgagaatccatgtgaggacatgccctcatggatactcaactaattaacatgagtttagttgcggttattaatatgatcattttttaaccagtcataacaattgataaatgtaccatgagcttgttattgtgttgaagtggtatcactattttgttaggacttgaaactgtgaaataatatttctgttcttttttggcaggtgggtggactatgctagttgagataaggcaacctctgttgaggccagaagggccattttttgctacagaaaatttgcgcaattacagaagaaccaagaattgttggatcattcacagaaattgaatcagaagcttgaacaagttttgtccagatggcaaagccggcaacttttgtaacacctttgcagtttcctagatgatactgacggaaaatgtttcagtatgatcgcgttatactgaaatgttgcactatagcaagagtttgctatagtcagtcaacccccgttaccgtggtgtggttaaagttaaactgttgtgtgtaacatgtgactgtcgataatgactatccatccattcagttcagtgctttagatgcctttgatttttccccccttcagggctttactgggttatctgtgttagctcacttgcagcacgggtgactttcacaaacaagtgacaatggcaattccttgccttgtcacaattggagaaattgacatgattttccagatggtccggatattattatgctccaattattcttgattggtttagtgatttgccctttccagattgcggactaggggttaggattacatgagtactcataggaaaaagtaaggggcaaaacctacgtgaagtctagcgtcagcttggtatagtttggttctgataatttgttgttggtcactatggtctctacagatagtattctactgtagaaaagtaccattggtttatgtatttgattagtagaaaattccactgccatatttgaggtagtagtagtatggatagatatagcctattggacgaggaaagatagaaagtctagacttaataaattttggtccaaaactttcttctgtattaggtaaggcatcttccatcattttggttttgtgtttttttttatgaagcacacaaactatgtttgttttaactctctaggattccatgaacatgtggtccaaagattctatcatacttttgtcaagtcaaaaaaagttgctagttttgtagcggcctgcaccacacctccacagtgtggccaaagaagaaaaatctatggacaaactcctattatcttcacccataggatgtactaaatcaccccctaagaatgcctttagagtctagggggtcactagtaaacacctacatactggtggatcgaaatgggcatcacttctagtttggaaccagtggtgagaaagaaatagtgatgttttacggtaataaaattgaaggaaaaaaaatagcacctaggccagctccagttcatactctgagttaccttctagttccttgcacgacaccttgtgcgcacggtggccccttgaggtgcttgcgggtcccgtcttcattggaccctatttgtcgttgtcaaccccatatcttacaagaactgactagatctagtagcctcaagtttggagcaaccaaatctgacactacaatgcctctcgctttgccactcatccttgtcacccaagaccatggttgttttgttgcttgttcctaggccaatcgccatcatcaccatcacctgcgctcagagcacccagatctggcaattagatctagcagccgtaatattgcaacaatcaaatcaatcaacccggagctctggctagatagatttgattgttcaagggcaagtgtgggtggagagaaagagagggggcggagggtaggggagggagatcaagggcgagtgtggatggagagaaagagagggggcggcgggcagggaagagaggggatgtgaatcagtaagggttgagggagactaggtatttaacgatagtgtaggaaagtggctcaatttggccttactcggctgttactatcacttcttgtttctatcttgaacatgtggtgataaattttgttattagtggatcaaaatgaattaatacttatagaaggttaggctatgtgtttgctcacaagtgggtcatagatcaatctattgttatgccaaccataacattctaaggtatggtgacaaaagtgctagcagactgagcttttaagaaccaaagtagacggacacacatccttttgttatactacgagcacctttaatttgtaggaaaatataggaattttggaggattataatcctattggaaaatttccaattcctctctcatccaattatatctctttcatccaatttctacgtttttccagcggtctaatcaaacagtcattcttatattttttctacgttttacaatcctctgtttgtttgcacttgtattcctattagaattctgtgttttttctattctttcgttttttccattcctatgattcaaaaatgcccgacatatgcataaggtgtcattgatagatggatcccacttgctctaggaccatatgtcagtaacacatactgcatatgcagtacaagcaaaggatctcatttaaggccttgtttagttcgcgaaaagaaaatttttgtgtcacatcggacgtttgaccggatgtcggaaggagttttcggacacgaatgaaaaaactaatttcataactcgcctggaaaccacgagatgaatttattaagcctaattaatccatcattagtacatgtgggttactgtagcacttatggctaatcatggactaattaggctcaaaagattcgtctcacgatttccatgcaaactgtgcaagtaaatttttttgtttatctatatttaatacttcatgcatgcgtccaaagattcgatataacgtttttgagaaaaaaaatttggaaactaaacaaggcctaaattagatctggtagtagcagaccctagtgcaaaagtgcacccaataacatgtatcagtagtactcacggttatgtgctaaaaggtagaatttcactgattgtgtattttgccacatgttacaaatttccgttttttcttgttatttttcttgcaaatgcaggtgcatactgtcaatattgtaatttattaaagaatttttcataacttctaatgtggggtttctgggcatgggaccaccgatagtaatgtttacctagtacgtactcccttcgtcccaaaatataaaggattttgaatggatgaatatttcctagtattacgaatctggataggctaggaaatatccaatccgtccaaaatcccttatattttgggacggagggagtatattatgggccatataattgacaataaggatacattacttttgagctaggcaggtgaagagggagatgagaccaagaagagagagaatattattttaaacaacatgtgttgtaggcctacggatttgtgcatggaattaacgaatatgcaatactacacaaatggcttttgttaaaaccacctcatcacaaggtctggatcatcctgcctattgagtgttgaactggtaattatagtttttttaataaaaaagttagataatttttcatataaagtcagataaaaataaactttatatccataagtattgttgtagaacttaagaatatttacaatctatagttgacaacctttatatttaagatcattcatatgtctgtatacgtgttagaaggtctagagactattttgttgaggccaaaatttgactttactacacggctttgtatggtgattggagacaaactttatatcatggtttttaaggtggtaaggtgaccccggactaccttacaggtaaggcttaaggcgagatgacgtcttaggcacatcaaagctgcattttaagagcagtacgacacacatatataccttgttcttggcaactcttaagcccatgtagcatccaatacctacatggcagcatccacccccttagaagcatcaccattttttgtgttatgaagataataatagatgcataattgtaaacaatagttaataaattgcttccatttacttgagtagcataccttgttgatgacctgaaagcagcaaggcacattattgatgagcaagatgataatataaagccataaattcaaagacaacaaagtaagcatttgagcacgagtaaattgcatattggaccactatattttacaactctatcagcttggactattggtagatctacatttccctattggactgggtaaatttacaaaggtttcagtttggggctgttcttgtacctgtagctccctctctcctctctttgtgtactctctctctctctcgcctctctctctctctctcttcctttgtgggcaagaaaagaaccactgggtgggctcaagactgtagcatggagctgccggccgagctcaacttaagtgcaatgccggagctgttggggctaaggccgagagctgagctggctgctgactgggctcaaggctgagcatgacactgagccaccaatgactctcgaggccgagcatggtgtaagccctgacagggctcgaggtcatggtcaagtgcgtagtctgcttcgagcggatgccaacagtggacgtgctactagtggagaggggtggaggggctaccataggttgttgcttcgctaaagcatggctactacagggaaatcatcatcatcatgggtggtgttatccaatttgccacaacaacttgcgtgatggctctcaccgtggtcagcggcgctcggcctcttgcctccacttgccaacgcatggcatgaagtacgtctctgacatgtcacagtccacacaacaaacaaaccaaattatacaatcggtatgcactgacggactaaccatccatttattcgcctcggccacattgatctccacattgttgggtaaaggaccggcttgctggtcatcttcgtgatggagagggtcagaccatttactagcggtcaccaggttcatcaccttcttgatggggtggtgtagttcggtgatggctctgagatatggagaagagggaggagcgctagaggttgaagaactagcccaagctgaagcaactggtaaagataaagtggtctaaagtgaaaaagtttgtttgtccttagtccaatttgcaacaatggtaaaaaagagcggctcaaggtgcaatttactctaaacataataaactatcaagcaggctaacctagcaggcaagtaaacataataacaaagcaaaatagtgggagctatcatatacctaatggcgtataaagataatagtggtccataactccacactccacactccacactctaaacaaatatactataagtccaactccttgtctcttagtattcatcatcaaactcatcgaaattgccattggcatccaaattctcttagccatcttcaatacctgcgtgagcttcatcacaattgctcacatttgcatcattaggtggatcttcctccttatcttcttcttggtcagattgcatatcttcctcatcttcttcaaacattgttgtattccttgggtgcctttgaaaggttattggaacaacaaggttgtgaactctccttagaacatgcgattgttgtcggtagataagtgcaaactttcaccgtcaactcctgcataaaagaatacaaaatataatatcaaacttagtggtaggggtttattactaaccatttccactagtctttgtaaatattggtatgcaggtgatttttgaaagaaaatgcactcgccatgagactaaatgtacctccgaccaaccatacgcaagcacaaggatcggagagcccacatgtcagtcaaaactaactgaatttgagctaatccaccgtcaactgccaaaggggtccactgtcatacaccggagaatgtcggtggccaatggcggtgtgcctggttcggctgatccaaggttggcgcccccagccacctccttgcacgtggcgaccccctattggttggtgatggcggt

SEQ ID NO: 44546 - DNA, 4809 bp, Oryza sativa
ttcgtgcgcttgcggatttatctgtgaccgtatcaaataccaacagcgagctcaaagagatcgtgatgcaccaacaacttcatcaacatcatcctatgtatgtcacatccacgaaaaccttcaactggttcatgtaaggaattatcccactcattgttccaatcaaactcctcaatgacttaaggatctggccttttcctgctttctcacgcctaagctgaaacctagtttccatcttccagttataggcaacaaaaacaacatcattcaatctcttgtgtactaactggttcattttctttgtatggatctgcagggatgcaaataacaagggaagaaaaaaaaggataaataacttgctgatatagtaaagaaatttaaagcaaaactacagataaactgactcgcaaatccaaatgttctccaattgagctcacaactggataaaaaagctcaattggatcttctctttggcatgcgtcattagtcttgaaacctctagcatagcgggcttctcatcgccatcaacaactcttagcacaataagtaatggggttgaagctctgatacaatcttcaatagaggaccaaaatttcttagagagaacaatgccagtcacttatattattgcctttgtttttgctaatttgatcccagtccattgttcactcacaaataggcttctcaattcatctctttggctataattgctcttcaaagtaagataagttgtggcaaatcgagtgacagctggtcttaaaagattctttccacttgtcttctccctcattgcactaagaagcctcccatgtctataaatgaaagtggtgacacgcttagcacgggcaatggggtttttaaattccttcagtttccctatgtccttcaacataagatccaaacaatgtgcagcacaaggagtcctatacaatgtgagaattctctccattagaagcttatctgttgcatgtattagcaccattatcagtgacaacttgaacaaccttctcctttccaatgatctcaattctcttctctagcaaattagctaacatagttgcattatgtgtttgtaacattctgaaaattcctaataataaaaatcactaaaatttcgaactttttaaaaacttttgcatcatgctgggtgttatggttgtcattgcttgccaaatataaattgtaacaatggagaatcaaattaatggcgtacacctgaacaataaatatatacattagtgcgcaagaaagcaagccaaataaaatattaatttctattataaatcatagatcaaatattaaatattcgaaccatgttgatagctcgatgtcatgtttaactaatgggattgtaagattaaatctaatgtatttggatccaatctcacatgaagtattataaatccacatgaaatgatgattactactataatgatcctattaacaaatgagaatttcatgggaatatatatacattaatatttgaacacttgataaagtcactcatataaaataatggtcatataattaaattaagctttataaaattatgtgagtttttaattaaacaattagattaatattgtgccgagtctcaatttactatttatagaataaatagattgaacccatccgtgcaaaatatattgctatacaactaaactcgaccaatctgctaatgtattaatcatgacaagtcgttatattaaattcaatattaccccaaagtcttcaaaaatatataagttcaccttagggtcaataacccaaattaatctaaaaagaattcatttgtgcgataaataaataaatatgggtggtaataatttggataaattttcatgaggatttagtacttaaatttagttaacatttaactaagtaaaattagagtttgtaggattaaaattgtataggagataggctaaaatagggtttaattagggatagcactattcattgcacatgaggtgtttgatggagttcctagccaccttagccctcttcctccccactgccgcgcctagccctgcccctgccctgccgcgccgcgcctagccctgccgcgccgctgccttgcgccccgcgtcgccgtcgccgtcgccgctgtcgtgccgcgccaccgtcgccatcgcgtcccatcgccgcgcgccgtcgccgtcgcatcccatcgccacgcgccgtcccatcgccacctcgcgcccgcgccgctgccgcgccacgtcgccgtcgcgtcgcctgtcaccatcgcgccgagccccgcgccgcgccgcccgcccgtcgcgtcgccgctctgagctgcgcgccgccgctgccgcgccgtcgccgtcgccatcccgctgccgcgccgcgcatgccgccgtcgcctcgagccccgtctcgccgtcgcgtcgcccgtcccgttgccgcgcgcccgtcccctcgccgcttcgagccccgtgccgccgatgccgcgccgcgtcgccactcccgctgccgcgccgcgtgccgtcccgtcgcgtcgccgctgccgcgccgcgtgccgtcgccgtcgcgtctcgtcactgctgtcacgccgcgcgccatcgccgtcgcgcctcgagccccacgcgccgcccgtcgcgtcgccgttagggtcatccaacccctcccccgcgctctataaaaccccggccccctccccttctccacccacacccattcccctccgtttccccttcctcctccacacgccgtcgcctttgtgccgccgcgccgccgccttcgttccgccgcgccgttgccttgaagccgccgcactgcgccgagtgccgcgctgagcgtcgccgccttgcgccgccgccgccgccgtcggtaagccgccccccctcgcgtccggtcgccgtcgccgcccaggtaggccgtgagccgagagagagagggaggaagaaagaagccagggggagaaaggaaaaagaaaggaaaaagaaaggaaaagaaaagaaagaaaagagagagagaaggaaaaagaaaggaaaagaaaagaaagaaaagagagagaaggaaaaagagagaaaaaggaaagaaaaggaaccctgggtcccacctgtcggtcactagggttatggattagatttcggattaaaaataaatcatttatgaacagtagctttttacaatttctcgggttaattcaaatttgaatctttacactagcataacttattcattttagctccgatttgagtgaatcttgaacctaaattcatctaaattcataagctttccaatggtatatagttcactatttaataaaatatatttataattattaaataattaataccacgatgatgcataatagtcaacttaaaaatgtgctaataaataaaattgatattgtactataaagtagatgtcaaataattgtccttaacatgctttctcactgtaaaacctatgtaaactaattagcagcattgtttcaaattaattaaagcataggaaatactagtgtcaattattaatatatgtcaatatataattatactcatgacgtccgaattgtataaataatgtttagcctcatactttgtgactaaaagttgaacacacgtagatgagtctttaacttgtttatgagagataataacagagctagtgtgactaaaatcacccgcacgaaattaattaacggcatttcctgtacagtagtatatgtttaggttggaaatcgacccttaagttgtatagacggtaactcactcataaatccacttaaaatcacatgtactgtgtagctcgtagtaaatagcaactattcaaataaatgattcaatattaagatattgtgcacacacctatactgtacatcccattatagctatacggtatagtattaatttgcttgttgcatatattaaattagagggactatatgataaacaggaatattagataaatactagttataaatcttgatctcatataattatagttcaattgtaaattaggattattcattgtaaaattatgtgatgggataatttgtaaccataatatgattaacctaaacaactctaacatacaaagcacggataattattaaccttttctaatttattgtgacaagtaaaatatgttgataatcaaagtaaagcttccatcaataaaataataatacaaatgattcactgtaattatttgattgatcctaaatccatctgacaacataatctctaggatatgaccattttatttagatagatgcatgtgtaaccataatccttccatagccattagctagactaaaccaccatgacaacagaaagactaagaaactttagctcttaccttgattagaatccattagcaagcgcgaataatatgagcaaccctaggttcgacctcaacaaatatattttgtttgtgcatatttgattgttgcttgaatattggtttttctcgcgtattatagaaattgtgtatcggtcagtcgtgaggcaacgtctgcaacttccaggaggtgaaggttgatcaagattgtatcaagaataaggactattctgagcaggcaagtcatcactattccttgaacatgttgatcccaattgcgaaattgttttgtttacaaataaaattgcatgcaatgatgaacatcctacttgtgattatgccatgcttgattattgtttacccttaagatccttgtaaccatgattacgtataagtccctagtcaattatgacaattgcttagaaatgctattctagaatcatgcatactcatatttatcaaatgctatatgcttgggcaattacctttgggaagataattgagtgatgaagtact

SEQ ID NO: 44547 - DNA, 3887 bp, Oryza sativa
acatgatttgtgaaaggagaaatgaaactaaacaactgtttttgactggggcggacggaggatttgggtggtatctggaaaaggctagtaccgtccccggtcaattaaggaccgagtcatgaagttaagcatgaaacgaaccccgtacaaccgcacttctcgtatgggtatagacctagcggagtagatagctgagcggaggcagtatccatgcatagtggtttcttgatgtgtgaggcaggggctctacggtggggcagccattggtaggaccacgaggcgggtgtctacagtggtgtcgccatcggtaggactgccatgtgagaatctaaacataattataacttaatgcatgtgtgagtcttcccttcccgggtgcgctagaactcctctcactgctagaaaccgtgtatgcctagagtgcatgaggatgtaaagttcatggagcggatactgccaatgcgaggttatcgaaaagctttgtcgtgacgcgtctcatgtgttgggatgaggctcatgtgttgggcagtcgcagagtgcgggtaaagtgtacatccactgcagtgtgagtaaaccaaatctattcgaatagccgtgctcgcggttattgagcaccgggacgtgtattacacttggctagactctaaattcttaacttgtgtgggatgggatattgcatgatgatttttatgctgttggagccacttcctgagaggagggaaggtggacgtcctcagaaaaccatgaggattcaatggcgggaagctatcattgggatcacaatggatggtggacagaaccgtcgttgtttaatgtgaacactggaactaaaatttgatcagtctatgctaggtcttaggcttgtaaaaatatttgcaaaacgcagctttacgcaaaagaacctgaagccattccttgaataccctttatcatatgcattgctgttgtggtggtttgctgagtacggttggtactcacccttgctatttatatatcttttaggagagcgctgaagagaagcccttgttagtacgcttgcgtatccaacaagatgatcggagtgcggtcttgttctaggtctcgttccccagtcgactgcctgtggcatgttaaccgggcccttatattattttgtcttccgctgttgctctctgatagttgttagcctacctggccctaatgtaagtattaactctcttagcctgaattcattcgtgatatgttgtgatccaactatgaatgtgtgtaccaactactgatccagggattggtacggataaacacagaagatttccgatttccaaaatcgggggtctacagtgtttcacttgatgcatcaaaagactccaagaagtaagcccacagcatgcaagttaattaggtggcgcccctcctatctatccatcgatctgacataaaggtggagccatactacttccatgctagctctgtagctcatgatcaacctttattttacctttattttacttgtgtcttggacatagtcctaaatcaaggtctcccttaacatgtgcttactcataggcttgtaacccgaaccatattatgcggtggcctcacaagcaatctcaaactgccttgaggttgcaacattgaatggtatgccatactcatagaaccacaataccccttgcatatccacataatgcttatcttcctttctctttgtactctccatggtgctttggaaccaatcaaagcgcgtccatctacaatcttttcaactgtttttctaaccgtagcaataattgtcttggtctcctttggcttggctttttttttttactattggagctctgaaatcgtaggttgctcttcttctttttgctgttatcccactagaaggtacaactggcatagaaaaggatgttgttacattttgatctagcagaacctccacatttccccctttcttcatctcccaagaatattgtccgttttttttttgttcttgtgcaaccgattttgcatttgtttcatgagttctttatcaattttgatacaaactaaaacatctccatagccacctgctagatgctgcttcagccttgtagcccctccatttgtcacctccccacaaagattacatgtcactaagtttgtgtttctaattactatcaaatagccgcacttccaagctggatcctttgcatggtggcctccgttttggatcagttataggatcatacccagcctcaggggcagcagcaatagttgttatcgtggttgctgcataaaagattgcactttgataaaatatacaaattgatgagcaacagttgagggatgggctccagtgtcactctgaaggatttctggagcctgtctccataggaaagatccctcccttttgcgctagatggggccccacccctccatttcgaagaagcggaggcctctagccagtttccactggcgcgcataaccccgtgctccagttggggggcatgatcaagactactccgaggcttcagctcatgagccattaaagacgagacaaggcaggaggcagttaatgcccacctactagccgctttgctccaacaagtcgtgcagcgggaggcaatcgagatccttgcgacttgggcccatcatgacacatcagatcttaggatccacaggatccatgtcggcccatgcaacatcttgggccacccacgacggtgtctggtgtagttacgggtgtgctcctaggtggagcccacttgttagtaggaagttcccgggcctacttgtaggaggcctacatgatcaatgatgtaatttcccatgtacatatgctaagcatataaatgtgcgatgtcgccttagtgaaggcaggattctcatcaatctcataagtctcactcttctagtagttcacacaacttgtacactcccatagctattggatttggttccaacaacaactagcaaccaacaactagctagcagatcaaggcagcaagtattaacaatttatacatatgcatacttgaatatactaatctgccacttgcaaaaggaaactttgcaatagcataaaccctagagatcagccactagatgggtataataatcagataaccagaaaaaaaataataaccaaaagaaggtacaagtgtatacaacaacaggggatttaacggagggaggggcggggggggggggggagcaaagatgaagcaagcgatcagcagtggaagaaaaattttggaacagagacacacatctgctaatttggaactctatcaaggagatccaagaatgttgcccaggaaaacaattgctgaacacatcactttatccagcactagcactgaagcaaattttgtcaactattcatggatgggatgaaaatattccgaaaaggtcaaaatcgttagcatcttttcagaaatgatgttcggtcagttagtaattcaccatatttatcaatttaactgttccgtgtcaacatcaatacaacgctgaaagaaatgagaacaaaaattcaacatttatatatttctaaaaagggaaacaatcagaaatagtatgacttatatggaaatgacgctcggtcggttgggaattttcatgaccattttcatcctagcaaggtatatctgttcagtggaatctgtttgaaagaacaatggaaaaaaaactcccaacactagataaatcggtttcttttatttgcaataatcaacagatccttaattaaataacaagtaattgaaggcagaaatttagtaaaataagaaggatgctagagtggatagcgtccaagccaggacactactagaaacattatctggataaggacactatcaaaaacatcatccacaatctgggtcagcccaatccacacatttgtctattgctggccaccttaggccccc

SEQ ID NO: 44548 - DNA, 705 bp, Oryza sativa
ttctactgcagggccgtgtatttggccacctttccggccagagccaactcggcctgctgtttgttgccccagaggaggacaacagggagacgatcgtcgcgcaggatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaagctacatccgtatctgaaagatggagggaattccaatagagaataagatgatgctgggcgataaggt

SEQ ID NO: 44549 - DNA, 2841 bp, Oryza sativa
ccaccgtacgatggtgaagaatttgttgctgacccaaatttgaagattaaaacaagagggaagaggagatcgaaatggactcgggtctgggtggttctggaaggaaaccaccttcatgcgttcaacttgatgctgcgccggtacaaaatagatgctcgttgtgtcaccaggagggtcacaagaaaactaatgtcctaagcgtccaaaaaagaagaagtccaaaaaaaatataagtgttagggaggtaaatattttgttttcctactcatgttctcgcattcattttctgttaatatgtcacattggtaactaacggtgaatttattactttttcatgtaggatggccgaggagagacaaccgccgacttacccagccttggaggcgtactacgaggcccgtcatcgcggggctgcgatcgaggcggggagggtatgaatcggcattgattcacttgtgcataagtatctgtagcgtgtatttgacattatattaactaattgatttacaattgctaatgcaggtacttcaaccgctccgagtcagagctcatgcccccccagtgttcgacgataggtacatcccatacctaagggcagccgggttgctcggggtggccttggtcgtgagcagaggaatgccagtgttcaacgctcctgcgttgacagcaattgtggacagatggaggccggagacacacagcttccacctccctagtggtgagatgaccatcactctacaggatgtggctatgatcttggccctcccattacgggggcatgccgtgacgggcaggacagagactcctggatggcgtgcacaagtggagcagctgtttggcattccactgaacattgagcaggggcaaggggggaagaagaagcagaatggaatacccctgtcttggctgagtcagaacttctcacatcttgacgacgacgctgagccatggcgtgttgagtgttatgcccgtgcatacatcttgcacttgttaggaggggttctgtttcctgatgctgggggtgacattgcttcggcgatatggattcctttggtcaccaaccttggtgatctaggccgtttcagttggtgctcagcagtgttggcgtggacatgtagacagctctgtgaggcctgttgtcgtcaggcaccatcatccaacatgagtggttgtgtgctattgattcagctgtggatatggttaagactaccggttggaaggcctaagtggaggcaaagcttcattccttggccctacaatgagccagacatggagaagacagtggcctacctttttgagagtactgccactgcacatgctcaccgggatgtggcatacaagcattatgtcaatgagatggactgcttacagcctcaacatgtaagtacttccaatatcacttctagttagacatttacttctttaattgagatactaaccaacgacatctcttcaacttttgcagattgaatggttacccataccacacaaatgaggcttcaagcctgaccctgaactcgatgtgcaatcgagactctgactatttcatgtaccagtgcccattgatttgtttctgggcagttgagtaccaccttccgcaccgtgtcatgcgatagttcgggaagaaacaagactggccggttgaggacatctcaactggagttgaattacacaagtaaatatttcttatctttgtttgctttcattgtcaatgttcaattttgtaccatttaacccttgtcgatgctcactattgtttcatcaccttctacttgtctaggtatgacagggtgagaacaaagaaggtgaaagactgggggctagagcataatagatacattgatgaatggaggacagccggaaggaacgacaggtacatagagactatacaccaaaatcatcttttctcagagtaccttcgttggctgcataggacatatagactgttcctccaccctacttggacggaagccgacatagatgatgaccgcgactccgatgagggacggaatccctatgatgtccggactagagttggatatcaaatggagcacgccccacttagagacagagtcgtaagttttcttgcatttgtcaaagttatttccatttgcaccctagaccctaacatatatcttctcacgctttcagtcgagagagctcctcaggagtgtgaatgaaatggggcatgccctccaagctccgaggggtggtgaggacacggagaacacactccgcaatgttttagaggtaaaatttatttagcactttgcattacttgagttatgcctaacaaacttcttttttttttgaaatgcagaaagttcgtcaaaggtgccggaaacttgcagcaagattaggttgcaagtcggttggattggacgacgtgtaccaaccgcggagactaccaccactactacctcactccgcacgtccaagtaccgctcgacactgatagaagagcgtgaagaaattggtggctcgttgtcgtcacgcattccgcaagggaggggaaaggggaaggcgccggctccacctagcgacgacgatgacgacgacgacgaggaggatgaggactacgtcgcaccagacgctgaggagatagacatgtcgcagcttcccgacgcgcctcaggggacgcaacccacgcaatacaacttgcgatccactcgggcagcgaaaaagaggtaaaatgagcttaccattctcaaatgttatttgatttccctcattttgtttttaaaatgttttaaacattggattttcaaatgtaggtacactccgggctcgcaagctattcgacgccaacggaagaagtgatttgtatgaagttaatctatt

SEQ ID NO: 44550 - DNA, 1206 bp, Oryza sativa
ttaagttttttcaggggtctatttgtaaaataagttttcaaaaaggaccaaaatgtaaaaattgcaggcgtagcgcggcaggcgtggtggggatgggccggtttggcaggcccggtacgatgctctggcactttctcgctggcccagcgaaggagctcctccgggccgagaacggatagcaattggacctgctagtttcggcgaactacggcctgtcaccgactcaccgtgcggtgcggacgcgactcgatgagctactaaatgcaactggatatgtcccccagttccaaattaagtttacgcacgtaaaacaatctgttcagattgtagctaaaataaacccaatttagcaatattgtcaagttttggcaggatttcttattagtttggtaagaaactaaatggatgcatatatttagcaacttttttaaaaaatggtatggtttgaaataacgtcaatcttacaaaatagcataattcgtatagacgaaaaagtaccattatagcctactaaatcgatggctcatatagtttttacaagtagtataatattatctatgtagagagtacagtagtactaatagcactctttgcggttacccttcgttagatcttcaatgaatcgacaactctaccaccacgagagaaatgttcatagtgtccaatcaacaagtccttgcccttgattcccctgtaccgtgctgattgttgcttcagccccagcagctcagccaccggctctatctccttctcgccatccacagcgtagaacatggccaccgacattctctccctctctgcatttgtcaccaccctatgcaatggagccctgaaggtcccattggtcattatctgcaacaaaaacaatgggcaaacacaaattaaccatgaacatatttgaccacatcacacatctttttttcatcaaaaatgcaaagtgagaattttgcttaggtgttcatgtatgtaatatgggtaattttatcatccttaaaaaaattccgggatgtattataccttctagtataaaatttggtatctctaggtaaaaaaaaaatctcgaggtacttttccgaggatcataaaatttctcatgtaatatagttacctccagtgtaacaccaatgttaatcagaagagagtaatctcgcacagctggaacactgtaccatgttccatctctaagaacttgcaggccaccgactt

SEQ ID NO: 44551 - DNA, 31849 bp, Oryza sativa
atactcgagatgatttacctaaaagatttgggatgtgtgggccaaaaggctagatttctgtcacactctggctcaaccttgagatgcagccgatcagaccaatccaggatctgatctttggtttgcacaggatcatttccatacccttctatctgaaaacgcttgccatcaatcaggttgctcagtttcttcttctcttcaactggctgccgaaaaaattccctcgcagcctcgatcacagcatcgatcagtgaggtctcaacgccatggttagaaacctaatcacacagactgttaattactttttttcgccgggtcggcaaacagccgacagagtatattaagatggaagagactgttaattactcgtcacaaaaagaataagagcttattccgtttataggattttgaataagatgtcacatgcactccattccttaggaattttttctcgagatctcacctcatgctaaaaattccatggaattaacttgtaagactacaatccttaggaatatggtagaatccattcctataaaacgaaagatgaatatagggaaaaaaatttctaaggattcgattcctacaataatcttatgaaaatattctaaaccgaatgagccctaaggtgcaagtgcaagttttttttaacccatcactagttcaaaatcatcatatactccgacaaaaaaataggtttaggctgtgtttagttcagcgtaaagtttgaattttggttaaaattagagatgatatgactgaaaagttatgtatgtatgacaggttgatgtgatgaaaaaggactgaagtttggatccaaactttggatctaaacacagccttagaatgaaagatgagaagctcaccaggaagaggccccagttctgcagagccgaccgcagcttggcagcctcgtcggcaccgtccgatcctgacagccggccgagatcgatggtcgggatgggctccggtatctcggcgccggcgagctggtcaccgccggcgaggtcttgcaggtaccggctcggtggctcctgcacgccggcggccagttcttgcactatgtttggcagcctccatggctcgtcagccattggaacttgttcgatcggttttgcttgctcacttgatggagcgaggtgatttcttgaattttggctttgcacgcttgcactaggcaagatggatagattgaaacagctagattttgaagtgtatatatatgtatagatgggattgtttcgtcattgtgtacatgatcatctatgaatagaccagctaccaaccacctgcactaacagaaaatatagtaaaagacaaatgcacatgatgagaaaatatattctttgacgaatcctttaaaggtcaacatattttggatgcaatggcttttttttttggtttttattcatatcgtaacactctgaattttcgtttcaaccaataaaatgacatcaaaatatagttataaaacattatagaaaatatctagtaccacggaagacattcgctagtcattactccgtaaaatttcacatcagaatttgatacacgaattaagggaaaaaagggataaattcaactgaaaaaatttctcagaaagacatgcaaaagaaaaggcaaaccgtttgcaaaattttttggagctacgcttgactcctagtggtgtgtgtggagtccacctcaagatcccgtttttgactcctagtcacgcacacacttattaattactccttctgtttttttaataagtgacaccattaacttatacatgtttaaccattcgtcttatttaaaaaatttatgtaaatgtataagatataaatcatgcttaaagtattttgagtggtaaaacaactaaaaaaataaattataattacgtattttttttaaataagacgaattgtcaaacatgtatccaaaagtcaacaacattgcctcttaaaaaacggagggagtagttaatgttttaagattaaaaaaatcaactaatgttttggcccattcaagctgattcttttcggcctaataggttttgggcctagaattttacacattttttaagcgaaaactaggcttccgcttccctccgaaagaaagagtagcccatttggtaaagctataacacctaaatttaactctaaactcatttatacctctcaagttcattttgtgagagcgctctagccagctccatatcttttttggtggtgttgaaaccgtttggttgggctccaactctaagagaggtggagctggaattggagctgtgccaaacagatccttaaaaaactatattccaaatcaaaacatgtttaaacataccaagttccattaccccttctttctataaagttaaaacccaaagctgcctcctcaattcgccacatcatcaacattatattagctgttcgatcaatatgtaaatcagatttacaccattggatccctcatctttttgcccagcatgcatggtaatcaccttgctccttccccttcccctcccttaatcacatgcattaatttacagcagaaaccgccaaatcaattgggacatgaggtgcgatggttaatacgattcatgtgcctcttgcgattctcttccaaaccttttaataagcccctttacaatccccactataaccaagtctcttcccctttgcatgaatcttttcatcatacgttcgattttatttggtaagcctgaatttaacagttattttgaccggattctatttgagtatacattatgattaatttgaaccaagcaggagcactatgaaagttttgtcaattggtttctctaaacttgaagaaagaatcactatcctatacatttactgttgtcttagtttcttaagaaaagattcatcatgcttgcagccaatacttatatgtcatatcactttaatttatttgaacaattaggaatgatacaaaggattgctatatagctgtcctgacatagcgagaagcagcttaacttgctcggtatgtattttgtttttaggttcaaacaatacaatctaattgttcatactaatatgcatatttacatatgttctcaaatgtgcccgcaacgaagctcggggtttcatctagttattagaaagctatattccaccgatccaacaccgttacgacaacaatctcattctgacatcttgacagtgtcgatgactcgtgtccctcttgcaaaagtctcgtagaagccacttaagtagtccttgatcttcatcttggcatactgcctcggcctcttctcatcgtccaccagctccggcgccggctccagctccttctccggatccagcgcgtagaacatcaccaccgacactcgctccctctcggcgttcgtcaccaccctatgcaccgggctctttaacaacccattgctcattatctgcatcccagaataggtgtctgttagtcatatctttttagataatggaaatgatttacatctccgacctctgctacttagtcggactaattccctaaaagatcaaatataatcagacgtgtaaatgatgatgtactcaaaattgaagctttacaggtctactttacgtgcaattcagattgttgttcagatctcccaaatctctgatccctccaaagatttcttcaggagaagataaaaggaatcatgatatactttaggaatcatggtagaatacttttggaacaccgtaatattttggtttgggttacatgggtgcagtatccttggataaacaaccactaacaagtactccctccgtttcacaatgtaagactttctagcattgcccacatacatatagatgttaatgaatctaaatacatacatatgtctagatatatgtgcgcaatgctagaaagttttacattgtgaaacggatggagtaaatgtatatatacctccattccatcccccatgttgatgagcagagcattggggacgacgggcacatcgtaccagacgccttgcctcagcacctgaagcccactgacggtgtcgtcgacggagacgacggtgatcaccgagccgtcggagtgtggcttcaggcccaacacatcctccggcctcaggcagcgagggtagtagttgaacctcgcgtacgtcgtggcgtcctcgtcgaacatgtcgacgaagtagccctctcgcaggccgagcagcctggccaatctggcgagcacaaggctggtgatctccctgcacctcatagtgtactcatgcagaacatctctgtataaaagaaacaggaaatttcagacaaatgtactggcagaacttgacagattttaagttcttaatcatgcgtgtagattgcagagtgaacaatggattaatcaaggttaggaagattcagtgcctgaaagaaggaggctgtgttggccagaggctatgggctatccgggactcaggctcaacgatgtggtagaaccggtcgcaccagttcaggatctgtttctctgacacgaccatgtcgttgccgtacccttcgatcctgaaatccttgccgttcaccaggttggagtacttctgcttctcttccagtgggagcttgtagaatcctcttgtcacattgatcatctcactgagaatgctcccctccattatagtaccaaataaccctgcaccttatagtaccataggtacccaaaaaaaaaaagtaatactcaatccgtttcagattataagtcattttgactttggttaaagaaaaacgtactccaaattaaactaaatttgtagaaaaaaatagtaatatattcaacacaagataactatattataaaaatatattcaattatagatttaatgaaaataatttgatgttataatattaccaaaattgtctataaatttaatcaaatttggaacagtttgactttaactaaagtcaaaataacttataatatgaaacgaatgcagtggtacttttatttaccaggaagaggccccagtcctctaaggcggagcgtagcttggcaagctcgccggcgctgtcttcaccattggaggcagacagccggctgaggtcgacgacggggatgggctcaggcatgtcggagccggcgatggcagggcggtctttctcgccgaccatgtactggctcggcggctcatggacgccggcggcgagctcctgcacaatcggcggtatcttgacaatgttccagtggtggccgtcagccatggttgtctgaacgcgcagtgcttctgttcagtcaggtgattcctagccagccggtttttatcttatttcggcattgttttgtggccatggatgatgacagagtgaaattggtcagggtttagtcaagatgaaagattttatgtaaacaagttggtaggtcagggatgtgggaagacatggtagtgccactcattagtcagagaggatcaaacacacggtccttgtcatgatagacacaggaacggacccatcgaataagcgaaacggtatatttgcaaacgaatagtaatttgtgaataaaacttttatatatgtatttttaacaatctaaaataaaagcaaaggttgaaaaataaacttcaataaaaaacctcaaaatcaactccaatttaagattgaaaaatttaaaatttggctaataagcataagcataagcataagaaaaagacactccggcagtaatatggtatgggtcgttgagctttacatcactgtcaaatgtttgtctgccgagcccattggccttgttcggcagccagttttgctgcagctgctgtggctgcagcagttgaaaatcgctgtagcgtgctgcgtgcagccgtagctgctgccaaaaaatctctttcgaacacacccattataaaaatctctttcgaacacacccattatcagcggggagattttgcagagacatgcaacaattactcccccctcccaattttattttacttactacctccgtcctaaattagtagtcgctttaacttttttttttgcaacgtttgactattcgtcttatttgaaaaattagtgcaaatgtaaaacatgataagtcattaaagtacttttgataataaagcaagtcacaaacaaaataaataataattccataatttttttgaataagacgaatgatcaaacattacaacaaaaactcaaagctaaactaggaatcacggcaaaatacattgctaccctcattatttacattctaattatctttcttaaagcaagcattaaaattttcttgtgagagtactggtactaatatggctatatcgataaaagtaggaaaaaaaacatatccaatgtagttaatagtgtaattacattacaattatacaataattacaatataataacactataatattaataatgtctaattacaataccattaataatattatagttacatttgaaagttttttgttaaaaaaaacttgcgacatgcttttagcaattccctcaaggaaaaaaacatatttattttcccaggaatacttgctactgaaagctgctgagcttgcaacaatcatgctactagtacaaatcagatcttcagggagtcgatgtatctctctcgtcgagagaattttccaatgatcccagccctgaactctccgacgctcactttcctgtatcttgcaggccgattctcatccagcaaaccagccgccggcccaatatctttctcatcattcacactgtaaaacatggccagtgagatcctctccctctcggcgtttgtcaccaccctgtgcactgggctcctgaagatgccattgcacaatacctgcacataaattttgcatccaaatatgcatcaggattcagaaacctgggtttatcatcatattacagatgtctctgcagattcagagagaaagtgttttggatgctagatgccaattacctccatggtgtcacctaagttgatcagcaatgtgttgggagtgacctgaacattgtaccacttgccatccctctgaatttgcaggccaccgacatcttcgtcgacgagaagaatcgtaaagagggagccgtcggagtgaggcctgacgccgaacacaaggtcaggccttggacagggagggtagtagttgaatcttgcaagtgcaggagctttgttgagtcggtcgaagaagtaatcctcatcaagcccaagaagcttggacatagcctgaacgatatcgtctcttattcttttggttcttgatgcgtactcgttcagaacatccctgcagaagaaaaggctctctaatagctcagtaaaaccatttctcgatacatcgtcaagttattctttctgaattcagacaacaattcttgttactttgttagtaatacatgaacaataaaaacaccatcttttgcaccaaaaaaaaagagtaggaagaaattcagacgtgtgtaaactggaaagtaaaacatcgatcactgtaaggtgagtaggtgacctgaaagattcaggatggtcaggccagaaggcaagatttcgctcctccttgggttcaactctgagaaacagccgatcagaccagtccaggatctgatcttgggttaccacccggtcagttccatacccttccacctggaagttcttgccgtcgatcaagttgctgaattttcgcttccgttcgatcggttggttgaagaactctcttgccaagttcaacacatcatccatcagagaggtttctactccatggttggtaagctggatcacacacagccaggaaaattggagaaattgatacaaagtagcaagttttttattaagcaaagtaggatcactgcgttagtagctgaccaggaagaagccccaattctgcagagccgccctgagcttggcagcctcgtcggcgccggctagccggctgagatcaacgacggggatgggctccggcagctcggcggcgaccagctcgtcagaacggtctttctccccaagcacgtaccgactcggtggctcctcgacgccggccgccgccagctcttgcactatcgccggcgtcctccatgactcgtcagccattagtgttcttgttcttggatctttctttgcttaattttcttcttgcctgaaaagaaaaaggagatctttcaactcatttatagcctgcaaatatgttgaattggatatacttggatgaaaatggattgacaaattaggcacgtgaatggaatctgcttctcagctactattcaacagtagaagaaaggatgcacaatgtacatggtggaaataaaagacacgttgtagataagatgtagatgtagattgagctgaataaagggataggtattcaaactgtttgacatcgtggaatcgagcacaagaaagggaaccttcaaattcattttttgaaattaaaccgaaggtattcaaactgtttaacattgtggaattgggcagaagaaagggactggtatttcaagtagtttgacattgtggaagtgagctagtcctgactcctgagttctgaatgcctgaatgggggaaaacaagttccattgcttaccttttcttatctccttctagatatttcaactggtgtaatatggtgacacaagatctgcaccagatcaactatctctcggtttctatcaatggttagtaacaggagtagtaacctggagagagctgctattctgctcgaaatcaacacaaagtcaattagtcactcatatcaatagacagaacacaattcctatcgaacaaaagaagatcaaacataataaaagaagataaagatgtattattttctaaaagaaaaaaaaaagatcaagatgtgtagatcaagggaaaaattgaaaaactctgaagctgtcaaatgattatgcttgccttttagatggtccaactgaagtactagaattcacaaggctcagctaaatgattcttgccttcactttcttgctgccttgcaaagtggtggatgcttctcaaatatcaagtactagcagtcttgtgtctggctcagtttctttccaaggatctagaaacaagcaaagaaaaaaagttagttgattagtcacaacccataacactgaccaactgtacttcaatgagttatcttccacaaggttagaattttaacctagcatgcagagctcatcaaactgtttggagtagtacaagtacaaaactcatcattcatcctcagcaaacacaaaatgaaacctcacaataatatttttcttttctgataaacgctacagatctggatggcataattacatgagtatgcgaccatgtgactcatactctacaatagttctttttttctgataaactttacagagtacatatcacaatcactatttattttaactggcatagtgactcagatcttcactgtgtcaatcactcttgtcccttgcaagaaatgttcaaagagccctgcaaggtagtccataatcttcaccctcttgtatcttgccgggtgcctttcatcgatcagctcaagtgctggctcaatctctttctcaagattcataaaataaaacaacaccactgatattctctccttttcaggatttgtcataaccctatgcaccgagctcttaaaaatcccattgctcattatctgtacaaaaaagaatgtgtagttcagtgaatcaagaacttggagatgcatcatggcacaacttgaacatactggtagagacaagctcacagtaagtttttttttttgccgggaaggccgaaggaggccaaccgagtatattaagaaggaataaaagttacaagagaaaaaacatcaaaatgcaccaaggtgcattgccacacaccacacactaccacccaagcacaaaccgctgagggtgaaacctagcaccaaacgacccccgctaaatgtggccgaacgccgctaggcctacggcaacaccacagagacgaggctccgaaaacgatgccaccatggtggtcacgacatccaggatgccgccatcgcccatctaaaaagatgtggttttcacccagagaagctcgccaagaaagggagagggtaaccctcgacaacgctccaaggaaattacgacgcccgaagacgtagccgctgtcggcccggtgaaccaccggactaggctttcgcttgggaccctacaaccttgactgcagatcgccgtccaccaactcagaaccaccacacagacaaatggcagcacgtggcatccaccacaccgcaccgacgcccctccatcggccgacttcaacgaaccaccacccctgagagctggcccaggactcctccgttccaccacccgccggccgcctcgccagatttggccgaaggagaacccgggactaggtggcattgcttcggcagcctgagcttcccccactgacaagctaccgcctcaatccaaactataaactccccgcaaagaaagggaggagctccatgaaggccgagggtgccgaccggcaacgaggaagacgacccaccgccgccagctccctttgcactgccatctggccgccggtggtgctgctgctccggaccggcaccacccgccggcgcccccgaagtccggccgccgcgcctcacctggccaccgcggcggcatcccggctgcccggccaccaagctgagccgccaccgaggcctggacgacccaccgcgccatgggctggcgccgagcggccaggccgagcgagtgagcgggggcgccgctgccgctccgggcaggctgcgctgcccgccgcctccgcgaccgggccggccacgacgagccgcagccatccgccgcgcgcgcccgccgctgacgagccgcctccgcgcgcctccacgccgagcctcagccgtccaccgcctccgcgcccgtgctgggccggcctagccgtagccggccgccacctcgccgccttgccgctggccgccatcacgaccgcatgccgtcgcgccgccccaggcctcctcgcgccgccgccgcgcagatccaggcaagggagggccggatccggccatgggggctccgaatccgctgtctcctccccacctcgccgccgtagctgccacggaccacgccggtggagagcttcgtcgtcttcgtccttcgcgccgaggagggagacgctacgaagagaagaaggcctcgctaccgccttccctgcccgctgccggattcgccgccggcgggctccagcgacagcgaggtggggggagggagggagagaaggcgcgggcggctagggtttttcgcccccgagccacccgacgcgaaagcgacgcggggggcttttttgctttttaactcccctcttccgctcacagtaagttcacccacacacaaaaaagggggaagctcacagtgagacagtgagttttagcaagagctaagatagcatgatgcaatggtgacaagaaaaacagcattcgtggacagatatatttacctccatgtgatctcctaagttgatcagcaaggtgtgaggtttagttgggacatcataccagacaccatctttaagaacttgtagcccaccaacgtcgttatcaaccataagaattgtaagaatggttgcatcagaatgaggcttcatgccatagacaagatcaggccttggacactgagggtagtagttgaatcgagcaatagtggtaggcctgtcagagaattgtctgacaaagtaatcctcgttgagtttcaagagctttgccattgatggaaggagactgtttttaactccatcacattttatgagaaactcatccagaacatccctacataagagtcaattcgcataatggattggtactggcgaaagtgttttattgacataatttgaactataaattttgggacagagggagtactaaatttttgtgacacgttgcaaccataaactaggccttataagttgtttaccatcgccgtaaacaaatcgtaaaacatctctgacactgtgtttgtgatattacctgaaagattcaggatgcttgggccaaacggaaagatttctctcgtctgctggatctactttcagatacaatcgatccaaccaatccaggatttgggtatcagatttcacctggtcatttccatacccttctagctggaaatgcttgccgtcaatcaagttggtgtatttttgcttctctccaagatgctgttgaaaaaactctcttgacacattcatcacgttatccatcagagcatcttctatgccatggttagttacctgagaacacaattgcagatatagaatataagccacgacatcatgttatttaaagaagccaaggcagttcaacaaaaatctatcaaaggtacactgactacttattaccatgaaaaggccccaagactccatcgcctgccggagtttcaccgcctcattggcatcaccatctggttgggacaggcgaccaaggtcaacaatggggaatgatgcagtggctgcaatggtcggttggtcttcttgttgcacaatgtactgtcttggcacagatttgcttctcatgccggcaagctcctgcacaagtagtgttgatctcacatcctccatgctcccttccatacggatgtagctcaggtactgtctcaggacttaggttgttcaatgctgttgagttgatacggagaagttactatatatgagtctgagaccatgtacgaaaaaagagtaaaaatactgccattgttgcacaagtggtcatgtaatgaaaacaatttatacctggtataaaaaaatgctgtaagttgcaaccaaattgctgaattaaccaaaaaaaaaaggcaatttgacatttatggagcagagttaggaactgcccaatagtggctgacaattaagatttaaattcaagctcaacatctgattccctaacttcaatataagcacctagagcgcagctgtgtactagcctggagttggcaggctgtttgttctatccttaggtagttgggctaatttctggtggcacagcaaccttgtttgtttatttattacttgtaacctctccttggtcttaatttgggcggcatacttttgccggacaatgaaaaatataagcacctagaagaataaagattcaatataccatgtgaatcagaaaaccactccatgtgttacacaacatacaacatgccaacttcaacttgagaggttgagcaaccgatgatgcacagcacaggcccttaaatttaagcttgtgataacgtcctttccagaataacttaacatcttgaaggagcatattaactgaacctggcaatatcgcttcttttttatttggaagtggcgtatttcacatcaaattctatgacatcttgtttctttttaatttgaaagtggtgtacttcatgacaatattgtttcttttttatttgaaagtggtatagttcatggcaatcttgttcatcttctactactttgaaagtggcatgcttcatatcaaattctatgcaaggaaccctaataccgtgtgctgttttttttttaaaaaaaaacgaacgattcttgttcctacgggatttttcttcctgttttttggattgcacaaaatcaatcctgaaaacattgcacattcgcacagtactaatcccaaataaatttcccccaaacttttcaaagaacaaaaaatttaaccgaagctgctttggcacaaacctatccgccccgattccctatctgcgtaagaagatgggatcgaggcaacccgcaggaagtagcctcgtcgcgcctcctcctccggtcaccgccgccattgccgcgaaatggaatcggttgctcgccgccgccgccgccgccgcctccatagtcccacacggccaccacctgccgccgccgccgaagccccccgacccgacctccatctccgacgaagctcctcattgccatcgcgcggcccaactgccgccgcggcgagcccgcgagagcccaataagtggtgggcttagatgggccgggccggaccatcagtggcggccttggaacgtgtggcccatgatcaaaactaggcctttttcacttttcagttcgatctctcccgttcttcaccggctccggtgagctttgatccaaccaaacctgaaattttccatctcgagtaagattttcatcaccatttgatattttgaattttgattgattgatttctctgctctgcaaagggacaaacaggagaagttgcagcatcaataatgaggcgtttgtacgcatccaatccacaacgatatatcttaatatctatatcccggctatgatgcatataagggagatcgagagagatcgatagcgatgcatagcttgtgatccatcacaacaaagagtggcggcggcggcgcactgatggacggacacggcggctcgccggacgaggacgtacgccggcgacgcgtcagtattggagcccctgctcatctgcaagctaggctggctcggcacgattctcttatattttaaactccttccgtattttgtattttaatgtatgatgttgttgactttttaaccaacatttaaacattcgtcttattttaaaattatgtgtaaatataaaactatttatataatacttaaaaacatttgatgataactcaagtcataataaaaataataataataatatatattttaaataagacgaatagtcaaacgttggtaaaaataaatgacgtcatatattaaaatacggagaaaatattaataatcatatataagaacaaaagatatggttttcacatcaaatgcggaatttagctttagcccaaacggcatgcatgattggagctcgaattttttaaattatttttgaggactcaagtgcgcgtgcgatatttgcttttggctcctcaaacaccactcaattaattataaaaaaaatccgaaaagatattacagtacaacattgatacagttgatctacacacaacgagaaaaaacaggaggacaaattcagttacaaatagtactataaccaaatttatgacttcaggttttcaaatattgcatattataacatatgtttagaaacattttgatgatatatatgcaaagcaaaaatatatatatatactccctccatttcaaaatatttgacaccgctgactttttagtacatgtttgaccattcgtcttattcaaaaaatttaagtaattatttattttttttcatatcatttgattcattgttaaatttactttcacgtacatacatagttttacatatttcataatttttttaataagacgaatggtcaaacatgtgctaaaaagttaacggtgtcaaacattttaaaacggagggagtactactttggttgtaaattgatttccccttcatgtggagagtaaaagatcgatctatttcttcacaccaaagtgaactttatttttcatcatcaacacagttcatgacacagtcgatacaacacattattgataattcatccgtttcacaatgtaagtcattctaacattttccacatttatattgatgctaatgaatctaaataagtatatatgtttagatttattagcatcaatatgaatatgagaaatgctagatgacttacattgtaaaacggagggagtagtagattattagactcacgtaatacgtctcaaccaacctagtaaacaccaacgtgaacatctatcattctatctattattccacatatttttttagtttaagcatgcaggccacgcgattaattagctagattcctccatcacatcacgcgctggtcgagacggccgccgccgccgccgcctccggctgctgctgctggtgctcgaccttgaccttgaggaagtcgatggtgcgctcgccggcggcgaatgcgtcccagaagccgtcgccgaaggccttggccttgagcttctagtacatcgccggccgctcctcgccgacgagctcctccgacggcgccagctccttgtgcggctccggctggtagaacatcaccaccgacatcctctccctctcgctcgtcaccaccctgtgcaccggcgccatgaacacttgctcatgatctgcaacaccaagcaatgcaaacaacttaaatttttattcaagcagatctatttttttactcaaatagctataaaaaattaagaaaatagtaatatcaaatgggatgacataaatttatagaaagactaaatttaatctagaactagaaaagagaaacaataaaatcagctagtaaatgtagatcgaatttaaacttccatgtttacgcatggagcctcactgtagggctatctactggtagtagaaatcaatttaaagtgttaatttcatttgattgaagagctcagatctatttatactaccagcctagttagcggtggtagaaacgtggaggagtattagaaaaaatagatgcgagggcataaacgttatttagcaatgactaaaccttttttttcttctctttttttttctttttcgatgaaatataagcgatgccaacacaatcaatgaatgatcatatatctatttagacaaggaaaacataaataacaaagtaacttttaatcattataatagtaaattactaattatcctttataatactgatggtataataccaccaatagaaagcaccgaagtatcactcttatgtattattattatcataatctatcttaccaactttttataactattacctcaatctcgtcgccggcgacgacgaggagctcgttggtgagcaccggaatgtcgagccagcggccgtccttgagcagctggaggccgccgacgtgcttgtcgaggaggaggacggtgaggacggagttgtccgtgtggggcttgaggccgtacacgagctccggccgcgggcatggcgggtagtaggtgaaccgcgcgtacgtcgtcaccttctcgccgaccttgtcgccgaagaactcctccccgaaccccagcgacctcgccgtggcggcgagcacccgccggaacacctgctcgctccgccgcgtgtactcctcgaggagtccccggagcgccgccgggtgctccggccagaactccagccgccgctcctcctccggctgcacctggaggtagagccggtcgcaccagtcgaggatctgctcgtcggtgtccacgcggtcgatgccgtagccctcgggctggaacctctcgccgccggcgccgacgccgtcggcgtcggcggcggcgaccacgttgctgtacctctccttctcctccggcgggaggtggaagaactcccgcgtcgcggcgaggatctcgtcgaggaacggctccggcatgccgtggccggtcaccgcgaagagcccccacgactggagcgccgaccggagcttggccgcctcgccgccgtcgtcgacgacgtcgtcaccgctctcggcggccagtcggctcacgtctatggtggggatggcggcgagctcccgctgcgccgcctgcacggcgccggccgccgccaccgggcggtccttctcccgcagcacgtacctgctcggcggcgccccgagctcgccgccggcggcgaggtcttgcaccatctggccctgagctgggtgcaccatggtctgtgactgtgtgtgtgtttgcttcactgtcagtagcctctactcattaagtatttaaatagtctggatttaactccgttatactacctccgtcacaaaatataaactacctccgttacaaaatataaacttctagctatgaatctagatagttatatatccatattcattgctagaaatgcttatattctggagggagtatagattttttttatttgacgcaatcgttaacatgcggtgtagacattggacaacaccacactgtatcttttataaaatcgagtgtggaaccatatgatattttgttaggaaaaaagcttatcatcagttcatcacccgtcaacttggtgatcatgcagattgtttcagctattttctagtgtagaataattgctaggtgatccgtgccatgatctattctgatcgtgatcgtcttgaataatttcaatggagcaaaggaaacatgtgcccaggatcgcattgtagtgactgaatcgtcagtctactttgggcttcaaatcaggatggattcggggatatacttgaacttcgggagttcatctacaaccccgaactttagttttaacaaatacatcaaattaaccatgagcttcaccgacaaataagctccatttttatagtttcaacaaggtggaatccatttggatttattagatttggaatccatatgtaaatgtgcttcattggatctcgcggatttgtcaatttgtttatggcctgcaccgctcacgttgatttctttctttaatatggtacgatgagattagcttgttaaaaaggttgagtgtggcctggtaattaagtaggactgatgatcaacttgttaaacacatgtaggttaggaatggatctgttggacaagcttactgtgagactccacttcaatggatagtttttgacgatggaacgatgttgcattgagaaagacccggaggtcttcaactgtcatatttttaaccggaaggatattctaaaaagttttattatcccatttcaggcgacttgtttaccctgcaaattgtttccgtcattttctagtctaaaaaatttgctgggcgatctgccatgatctgtatcgatagtgatcgtcttaaatcatttcaatggaaaggttgcacatgctgggattgtatttcagggacagtaaagcatctactttggctgcagcagacgcagcctgccctccatttgtttgccactgcccaagaatctaagatgacatgcattaaacttatgggttgaagtgacaaatggtgaaatggaggcctcaactcagggctggatttgaagatgttaatgagaaaaaaagttggagaagagaaggccagtatatcccctaaacttcgaacagaagttcatctatcaccctgaatttggtttcgactttcgacaaatatgtcaaacaggaagctccaccaaaaataagctcagcgcttttatagtttttgtcaactagttcccctacacttgtatttaagtatactgatcggataaagcagcgtttgaaatgatgtatctatttttcattccagaagccgcttggtgtatacaaaatggcaaaatatacagcgtcacctcttcatcaggacaccaccgtcataaccatgcgtgctgctaactcatgcgtgggaacatactttctctgcatacggcagcagaattacagcattagcatagaagtaccgccatgaattgtccagggtaggataatggattcaggaggcgagcttttaccttgtctagaactgccgcagcacaaacggtcgtcatcaacataagtagtattcagccccatcatccatgaacctactgatatgtcatcatgggcatagctctgtagcgatgcactgcatatcgaagagaaacaaattgctcaaatttcggtcaaattttgactgcatatactcctatattgactagagatatcaattggttactgttgtattattgattattgacaaagaacatctggacagtgttcctgcatcatcaagaccatcaaatagatggcagatggctaacatttatatatcagttagtcagaacagcatttcagtggccggttattaattcataaatgctaaagacagtattagtaacttatatgaaatccagcgaatatagcctgttttctgtaaatcacatatacaggagaagactcatgtaacaaaaaactaatttgtcgtttgaccaccaagaaaacatcatcctaattgcaacatttattctgtattaattgaactgatgcactgcaattgctcagaggggcctggttggtcaccaaaactggtttagcttagcatgactcaaagataaaacaggtggatgcgcaccacttacctgtttatgttaatgtagcgtgccaaattgttagagaggataaacaaagcaccggaagcatggcgaaaatacctgagaattaaaaatcacagtgaacggaaaaaaagtgatatactagaaagttgaaggagccagagaatgaaaacgctgaagaaacagcagagaacacttctcatagatactagtatcacccaggaaacacatctatttaaactaggcgtattccttcaccaaacaaatagaaattacaagcacaatgcaaattaagtctaaatataaaacagatgggcttcaccagatctttaagactcgtaaaccatttgtgaatcaaggagaaaccgctattagcatgaaaaagtagttataatgacatcatccgctgcaagccatgcaaggttatacgagtagttggtaatatgaaaaaaaaaatcattcttaggtttgcattgaaggctgaaactcactatcaggaggttgaaatgtttgtagcctcaatgtagcattagactcagaaatccaaatactaagaaagaacatgagatcggtgcttcattaataatgcccataaaacatgtaagaacaccactagacacagaattattgctaatcacccaacactaagatgaatattaggataatagacaaatggcaaggaccttgaatatgttagtttactcacgtttttgaatctccaaacttccaccattcaggttcataccattgttgacccctgaaattgaagttggtatcaagtggcttcaatgacgggttaacaaagggcaaagcaatccaatgtactgaatgaaatattatccctgaatatataaatgatgcaatgcaattaagagtgtgcaaggtacatgttttctcgatatcaagcaatggtagcacctaaggtaaataatgggactaagcaattcaaaagctatgattccttgattggaccaaacgtttcagatgctcaatgcattccactacatttacatagctttcaaagatggaaggatgtcagcatggaagcatcactgctaaatggatccgcaaggaaaacaaatggtacctcttatgaaatggatggtctagttggtgttaacatatgccatgcatgttgtctaaaatctaaataaataaaaacctactgatgatgggaatgaaagcacatactcttcacttacaacacctcctgatttcatgcaacccatgtacagtccttggctacctcgacgggcttcaagcatctcaattaatccagctaatatatagattgtaatgagtcaaaacattaagccgaaataagccataggtgtaatgtttcaacagaaaaggaattacccaggtcaaggttaatgttgtcatcgactttcacatagaactctgcgtcccaagcttcaattgctgcactgaagaaaaacttaactttgcttggtaactcctctgcagcttcctcatgactttcctgtgtgacaatttattgactatttatgtcacattctgttctccataaagtgcaagcagtttgttcaagatttgacaatgtcacaaaaatggttttgatctaagctgtatatccaaatgtcaaattaaaaaccgacatttagatgaatcaggacagtgagataacttaaaataggtactgaattgaaggcccaatacggacgagaatgtaagatagtcttccatgccagaaaacaaccaagcaaagccaaaagtcttctgcatgtactacagtactaattttttgtgaaggacaaattggaaaaatgatattaaatgttattagatccttacaagaatcaagaaatctttcgtccgacgattttcatcatcgatgttgcggtccaagctatcacctcgatttgcactgaaggaccaaacagaacaatttcagtaggaaaactaaacatgaagaaaagcctgagaatgatatggggcgaatgattgtctaaggtgctagagatgctacatataagagatatggatccagaataaaacctccgaccaatgacaaaacgaatgaccacacccttctcctcaagcttcttcagagcatcacctgaaatttacagtgaggtaaaagaacaattatactcctgtagttgaaaccttataagtaacatagtttgcatcagcaatagctattagaaaaaaaaatgaagctgcattccaaccaaatgttatcagggcgcacacattttatcgccgtaaactggaaactaaaagagcaagaacagcgaacctctcggcatccatgagccacggaaggtgttcctcttgagccgggaaccaaaaccagtgtaaactccaataacagcaaggagcttcttcttgtcagaactaccagtagcagttccattcccccacagatacccctcgctcttcgcctttgtaaggtccatttctgcctccgcaatcttcctcccaattccactgccaccaaacaacccatttcaaatcagcaactaaaattctgaattctgaattcctcttcagagagagagaggggggaattacatgcatcctagattcctcagcttgtcctccaccgacagcaccttcggaagctgcaatttaggcgataccatcacacgaactgacaaatcaagcggaaaaaaaaaacgagaagtgggtggagagggggagagatccgcacattgccggagctcttctcgaggagaccagacaggatcatccgcgtctgcgcgtcctgccacagcctgcaaaaaaaaaatccaatcaacgaaacaatcagaaaactccacggaaattccccccggatctgagcgcgcgggcgcgcgtacgtaccggccggcgacgtagagccacgcgaggcaggagaggaaggccatgacgagggggaccctccccgaggagagggcggcggaggcggaggcggaggaggaggaggggggcttgaagcggcggttctcccgccgcatggcgctcgccagcgtctccatggcgatctggtggcgatctcctcctccctaccagccgccgctgccgctggtagagaagaaaagcttcggacacactgcagctcgcctccaccactcgtaggccgacaagaagacgacgaattcggcccaaattcaactccatttttgcgaaggagataaaaacgggccgaattcagccccaaatcccacgccatacgcaaaattgggccgaaatcagagaaaattggagtaagtctaatttgtctccctgtcatgcttttgagtgaatcaccctcctcaaccgcaaaaccgggtataatgtctccgcttcaaaagccggtgcacatcaacataaaccacttcctaaacccccaaaatagtcaatttgcactggttttcgaagatgggagagacgttatcagacaaaaatagacttatccgcaaaagaatcgacttgcactggtttagatggaatagatgttatatccggttttgtagtcaaaaggacaaaatagacttattgtcaaaattctacgctgttcgctaatttgggccgaattaagccgaagcctgcgccgtttgggctagcccgttgaggcccaactcgccgaatgccctacgaaaccaaccacacgaagcccgcgagttttccgtcaccttctcagttcactcgacctcgccgccggcaatggcgctcctcctcctccgccgccgcatccaccgcggccacaaaaccctcctcccgcgcgccttctcctcttcctccggcgagggtatgttcccgcctccgacgtccgaccccgcatccgccgatcagcgcaccaccaagctctcctcccacttcgccgaaatccgcggccacctcaacgccacccctccctcctccccgccgcgccgcatccccgaatcaccgccgcccgacgatgtccgccgcagcctccacctcttccgcaacccccatccctcatccggcgcgacctccgccgccgccgcgaaccccagcccctccttcgccgacgtcttccgcgccaggcccgcccctccgaccagccgcgccaccggagcggacgcctttcccttcagcgcgctccgcgagagcttgaacaagaacctgggaacgagccccacggcgtcggcggtgcccctccccggcgccaccgccagttcgccggactggagctccatcctctcctcgcggcagagacacgacgggaagccgctgccggagtcggtgttcgggagggaaacgaggggggaggcgaggagaggccgtgacggcaaagtggaggagcagcagttcatccggttgtacagcgacaatgagctcggcaagaagctcagtgaactgcggccaccggtgggtaaggatgggaaggagtggttctccgtggaggagctgagccggcgactcaagaagctgcgagagatggacagggaggaaagggctctgcagtccgggctgggcaccgacgtgctgcgggatgcgatcgtgacgctgcagaccaaagatctgaagacgaacaactgtaatgatacatcgtgattttgctgttcttgtttagtcgccattggtgaatgcctgatgaaactgatggataacctttttgttactgatgatgctgtggttacatttggtttgctagtggctgcagcacagagtatgtcggctttgatggcctttggctctcaggccacaccggcgtacttgctggggaaaccgcaacaggagttggtggagagggtgagctggaagtgttgtgcatttgatgcattttgttgtttagattggatgatgtggtgttgagaattgtcagttggatctttgcagtacttccatcccgatcatatgtcatcagcggagaagatgaagcaggagctccagagtgtaagggatgagttcaaaatgtctgagaatgactgtggttctgcacgggttcaaggtattttttgtttcttctgtaaccatagagttgtgagaaactgacatcttagttatgaggagctttatatgtgatcatgttcaggtctttatggtcttacgtgagaatttgttctcatatcaaacactcacttgctatctattaaaattcattacttaaaaggtacacggtaaagcactgatatgtgttaactggtgcaaatttatgagtaagtttcttttgacatgtattgcactcatatgtgttgactgctgcaagtttatgagtaagtttcttttgacgtgtatttgttccccatgagaaatgacaacgtggtgtatacttttacagtaggggtagttttaaggctcaattttgtgtattgaagatgtcgtgcaataagagttatttgttaatactgatatttaggccatttctgtttgacaatttttgaactttttgttgcaaacttctgctgccatttatttagtcaccatctaagtcatgttccacgcttgggtatgttatgttgagtgttgagtgtgtgaataagctatgtaatatgcacgtcacgttttaaaaccctgaacccagtggtttagttattacgagtttagttaagatttggctttatatccaaactagctaatcttgtcctctaaatttgaagttctcttttccaagcttctttttagctcccaatctgtaatatagtttttcttgattcaaagaaagttcaggttcatgattttttatgatgcttccataatagatagatttgctcggtaattgcatgtgactttgaggtgtttacattggcttgaaaagttcaggcatacgaccaaagcaacacactaggacaattgcatctctttaagatttcacattccttctcttttttacccagaaaaacttcctttgttgtaattggtttcagaaaaagggaaactctgtcagcaaggctttagatgagcttttatctccatgcatgtttatgactttatgtaaaatttcctcttcccttccacctttctggcttgtaagtacatattttaggcttgtatatctgcaattgatgcccgtctatgttttgcagtggcacaacttaccacaaaaatcaagcatttgtcaactactctgcataagaaggtgatcttacatgaccattttcatacagcatcacggtttaccttgccatagaatttgccgggctcgcctgattttcttctggtgaagtgaaagtaatatgtgaacttgacgtgtaattcaggacaagcattccagaaagggacttcaagagatggtgcaaaggaggaagaaatacctcaaatacttgcgcagaaccgactgggattcatactgccttgttttgtcaaaactgggacttcgtgatgtgccggagtacaagcctccagattacaagagcaagagaagcagcagcggcaagaccaaagccaagagaaagatgaagagaaaaatgaaggcataagatctaatggtagatttttcttcccgttgatttggatttcgtgaccagaaaccgatagatagattagaagcccaggataagtgtagattggtctcctggtcactgggagtaactgtgttttattttggagctgagcaaataataccaacaatcaaggttgcgttttacggatcatattttatagaagaaaaatgtttgaaatactaagaatgctcctgatctactgacgatgattcgtgatctcaaatactaattttttgttgattcactcgtgtactttacttctactcacctttttgtctcatggtaacttatcaagggccatcaatgtagagagcttgtttattttgttaccaattctaacattaccaaattttgacaatatcaaattttggtaagttttacattgctaaattttagtagctggatgtatttagcttgatgtcttccaaattttgttagtgtttttgtttgaggaaagtttcagaactaccatattttagtacgatggaattggtaaggtgatggttagtttgttaacatatcaaaatttggtagtgaatttgttaggcaaggtttgggtggagaaactcccaggggtctttcggctagctccacgaggtgtggtgggctagacgacttgggttcgaagcttcaccccttctaattatttgatattatgtcattctctaatatttgtgtcttttttaggcaaggtttgggtgaaagaattgggtgaacaatctagttacttgcaacttaaacccaacatcctgtgagtcacctgcttccctgctaacttcatcccgcttgctgaaccgcatatgctatgcacgccgccttgatccggtatccttgtcgagctccgccgcggcgccgccggcgccgtgcatcctcggcggcgatcgacggagatggcgcctcggctcagcgtgaagaagtgcctgatcatcctcgccctcgccgccgccgcggccatcgccggcttcttgtccgtcgccggcgcgggtcgcggccgttcttcctcctcttctccggcgcgtcggctgtcgaatggtctcgccgcggtgcgtgtggttttcgtgtacgccatggtggagagtacgttagtgtgatgagctttgtgcttgtcttttttttttcgtgtgtcatcaggagagggcccggatggcgatggcgagggcggcgtcgccgaccgtggagcgggagctcgacgcggcgcgagcagcgatacgccgggcggcgcggcggcgtcgacatggtgatctcgccggcggcgagggacgaagcagcagcaacgtcagctcggcgaagtggctgagcttcttcggcgacgcggaccacgctcgcctggagcgcgtctaccgcaacccggcggcgttctacaggtagtacataactgaaatctgtccgtacgccggcgacggcgactcgctgacatgtacgccgccgtgttctctccggtgagggggaagcaggagctacgtggagatggagaggcggttcaaggtgtacgtgtacgaggaaggcgagccgccgatcgcgcacgagggcccgtgcaagaacatctacgccgtcgagggccgcttcatcgaggagctcgagctcatggcgccgccgctcggcggcgtacggacgtgggacccggcgcgcgcgcacgccttattcctgccgctgagcgtgtcgcagatggtgcagctcgcgtaccggccgctgtcgtacgacctctcgccgctccgcgccatcgtcgccgactacgtcgccgtcgtcgcctcccgccaccgcttctggaaccgatccgccggcgccgaccacttcatgctctcctgccacgactgggcaagtacaaatcatttttttcccttattttttcagagaaaaatattttcccaacaccaaatgatttccatacaaatttcgaaacgagtgcaaataataaattcagtacatactccctccgttcaacgagactcaatttctgggtttccgactttccgcgtccaacgtttgatcgtccgttttatatgaaatttttttattagtatttttattattgttagataataaaacatgaataatattttattcatgacttatctttttaattttttaatatttttttaaataaaacggacggtcaaacgttagacatggaaacccaaaaattgagtttttttcgaacggagggagtagtgtggaaagaaaaatagaatgaaatgagggggcatcgaaagatccgaaattctggaaattttcatccgtgaacatttcaaatttgaaaaaaagatctgccaagttcaaaaataaaagaacttccctcgaaataatgtcatatcgggggcacaaaattctccgaatttcgaaattttcaaaccgaattttatgttgcacgtgcgtgcgtagggtccgcacgcgtcgagggggcacccggagctgtacgcgaacgccatccgcgcgctgtgcaacgccaacacgtcggagggattccggccggacaaggacgtcagcatcccggagatcaacctctacgacggcgacatgccgccggagctcctgtccccggcgccgccgccgccacggccgttcctggcattcttcgccggcggccggcacggccacgtccgcgacctcctcctccgccactggaaaggccgcgacccggccgtcttccccgtctacgagtacgacctcccctccatccccgtctccgtctccggcgacggcgacaccgacgccggcggcgagggcggcaacccgtactactggtacatgcggcggagcaggttctgcctgtgcccgagcgggcacgaggtggcgagcccgcgggtggtggaggcgatccacgccgggtgcgtgccggtggtagtcgccgacgggtacgcgccgccgttcgccgacgtgctgcggtgggaggcgttctcggtggcggtggcggtcgccgatgtgccgaggctgagggagctgctggagcggatcccggcaccggaggtggagcgcctccgcgacggcgtgcggctggtgaagcgccatttcatgctgcaccagccgccggagaggctcgacatgttccacatgatcctgcactctgtctggctcaggaggctcaaccttaggctgaacagtcactaacaatctcatgatcagtaaccaaagtaaaaatgccatgaaaaaatataggtctagaattatcagttgcattagcactccatttttactgaatacaacttcattaactagttcttaacatgtttcttggctttcacatctcagagttcagaagaaaaaaacttggtatactcctgtaaatcattttgaccacgaagtgtctgaaaacttccacaaaccatattggtaacccccttactggtagaaatataagagggagtagataaaagagtataagatgtacaaaaacacaagattatgttgaacttgacagaatgtaacacggctcaaaagaggttcatcagtaagcatctcctataccaaatgcaaatgtcttcagttatcattgtagggaatgtaccaaatcagaaaggagccaaggatggttagcgcaaaccacagtaacagcacatataatgtataaaaggtattgaaatcaggaaattccatcaaacacaaggggaaactcctcttgtcctgaaatctgcaagttccagtctttttgccttctcatccgatcccccaaacatctgttctcggagggattgtgtggtcatcttatgctgtgaaataggacatgacggttctagccttctagcctaactatgatacccagattcacagtattgacaaggctgactttgctaatctgaagaactagatagatggtgctggaagattgcttgctatttcagcagctcaccaccttctcatctctccataatagtgttcttgattcactgggttaccggatggaaaaccagtggcagctaatacagtaagcccaacaatttggccagtcaattcaaacctataaatcttcagcctattgtgatatagacaattctacaaaacaacaatcatctttttctaggtaatctaaatgctgaatatgatatatcaatggtagttcgacacttccactgtataacagttgcaggttatcttgctaatactagatagaaaaattacacggcaatttgggttgattctcaaattgaaccatggttggaaaccactgtcagcaattctgccaaactataatggtgaactctatcaggatcacaactcgaaccaataaattctagggatagagaaatacaccatatcccaatacacaaagattagccatttgtgtttctgtcaaaagctgcatactgaattggatatgtccaaggtatttgggctctataaatatactcaatataaccatataatcactaagaagggttcttgctgataagaaataggacgataacacacaacaatctggattgatttcaaaccatagctgatggcaactcttaaaagaaaatttatactaaattcatcaactgtttaccatcacatggattaaacaccaaccgaattgcgagaacaagaagcaaaccatctcagtagatcaagcctcaggcgccggctgcgagaggccggccttggcgagcagcttccccatcgcctcaggcgagcacacctggtactgcacctccccggtgccgggctgcaagaacacctcggcgagctccagcttctcggcggtcaagctggtcgaatccatggtcttgctaagcaccttgagggcgagggcgacggcctcctcccgtgtcatcccgtcgcggtagtcctgcttgagcatggactgcgccgcctggctgttggccccgacggcggcggccttccagccgctgtagttgccggaggggtcgctcatgtagagctggaagccatggtgcttgtcccagccggcgaagaggaaggagacgccgaaggggcggaggccgccgaactgggtgtacccctgcttggtgtcgcagagggattggacgagctgctcgacggggatgggctcctggtaggagagggcgtagcgctgggcgtggaggcgcgccgtgttgaggaggatgttggcgtccgacatgatcccggcgacggcgcaggcgaggtgggagtcgatcttgtacatcttctcggcggagcgcgaggtctggaggagcttggaggtgaccttcttctcgccgacgaggaccacgccgtcggccgccaggacgcccagggccgaccctgcgttcccgatcgcctccatcgcgtactccacctggtagagccgcccctccggcgagaagatcgtcgtgcggctgtcgtaccggcgagacatcgcggcggcgggttgttgctggggattccggcggcggaggcggaggcggcgacggcgagagatctactattactaattcagttgagatgtgaggaggttgtaggttgcaaaggttaaaaaatgatttcttcaggggtccaagtagaaaaacgacagcccagatgggccgtctgactctgaaaatgggccaggcccagagattgtaccatgccagcagggcctgccaaatcggcccattatcgtgagggccaagagaaggaataagttcatctaaggtctcttaacttgtcaacgaatccgattttcgtccttcaaccgcaaaactagatacaacagg

SEQ ID NO: 44552 - DNA, 2075 bp, Oryza sativa
  unsure (1)..(2075): unsure at all n locations
atggggaaagaggaggaataagaggggagagaatgacatgtggagcccacgtgggcccccccattttttttaatttctatgtgaaactgacatgtgggtcccacgagctttatatttttccggatcgaattgccacgtaagcgccacgtcagatcaagaccccacgtaggtgccatgtcagccaaaaccgccttcaaaaccgccgagggacctaatctgcaccggttttgatagttgagggacccgttgtatctggttttgtggttgaaggacgaaaatcggattcgttgccaagttaagggactttagatgaacttattccccaagagaataaacgaggcagcaacagaaatttccccatgatgaagataacgaagctccagcctccaggagagatcaagcagatggacaaaaaaaaaatgatgtttgttttaagataaactagtgacgagatttgacacaccaaaagcacattaaccgcacgtgaaatgcaaaaatgaacctcacaccgagacctgaaaacagagcgaacaactctagaattgctcagcgaatcaattgttcctcatagaaagctatttcctgacataaacaaatataacttttcctaactttgataatgagatggcagcagatatgttgtgcacctaacagatgagtcaaacatccggataaacagttaatttgctttattaaacaattgcttcagtgacagggaatgccaccatatgtagcaagccgcaaaaataagtttgcaagtcatacatactggagatgcatggaacgatggaaaacagtacatggacaactataactgaaccaaaaatgttatatcattcttggataattttagatcataaaaattccaaaagttgtggcaatctctgcatgcttcacatttagtatctgtgggatagcttctcctgctccttgtagtacattgcgtacctgcatagccatcaaaatagaccaggttatattgtttgtgatgctgtcaagaaaactgatagtcatcaatgtcaaggaaacagtgttactgcacacaaagaaacacaaaaggaagtcatcaattgtttacaacgtgaaccagcagtatacacactccaccatgttcctccatccttggattgaaaagaaggcctacttgcatttccctcacgaaaggcaaaaagagtgaatgctgtcagcgactcagtgttctaaaagttagcaggcgccaggtagccaccgtgtttagcaattagatggtgcaataggcggctagagtgctcttgtgttactattttagtgctatattgtttagcatgtaatatgttgctaatctcttggagtacctaggcagcactaggaacttaagaggccagccctgccaacccaactcctcttttcaattcaagttctcaaaaaacatttcaatcgttaggctcattgttttcaataattcacaatccgaggtgagggtttcctgatattaggaaaaacaagcatgcctataactgccaggcaaaaaaaaaaaaaaggtaactcatcagtactaagaaccatggagactatatgataagctgcatcaatggtcaaaacatagcatattgcatctacttaagacaacttcccaaaaatcctatggtacaaggtaaacaaacaacattcagatggtatttcttcaggcttcgacacatagtgagctcacaacgccaacaagctgtaacatgcagtttaacaagttcacataaagctaaatcactgaaaaatccatgttggaaaaaaatagtataataggctaactgatcattcaggcattcatccgaagacataatctagttttgcatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 44553 - DNA, 20649 bp, Oryza sativa; identical to SEQ ID NO: 41833

SEQ ID NO: 44554 - DNA, 31733 bp, Oryza sativa
  unsure (1)..(31733): unsure at all n locations
ggaacggcggcaggaagatggcgctgctgaggcacctcagcaagcccatgctcaccaaccactccagcggcggcggcggcggcgggaagaggacgaggacgacaaacggcgcggcgacgacctacaaggccgccgcccccgccgccgcgtcggcggcggcggcggcgataaccggctgcttcgccgcaaaccccgacgcctacagctacagcgacgacgaattcgatctatacgacgacggcgaggacatgcgatgggagtccatgttccaagatctcaagcccacataaacagagctagcttagctgcatgcgtagtgtcgtccattcatggcgagctccaagcatgcaacaatggctgctcgatcgatctgtgtccggaggaagaagaagaagacaaggtgcgtacatgtaaatccacatccactgtggtcactggctcactgtcactactccactacttactgtttgtatgctctgtattttgtaactgtacatgtgtagagatcgagagaagatgaagcttttatgtgtgttttgtaaccgtttttaccatgttctttctttgtctgtggagctggaaattataattgattctggtaacattttcttcttcgtcttgtttggttcatgcattgtttggtacattcaggcccagcgacaaccaatcaaaccatgtctttttcagcagtgcatcttcattttcaggttcggattatacgtatagccatgcacacatcactgttcactgtattattgttttgtgcatgtgccatgatatgacatgagttcagaactaataaataccgtataaaatttagtatctcaaacaattaagtgcagctagatactaaggacaaagcttacttttgagggccttggcagtcgtagcacatgctgacagtttcacaattcagatcagaaacgaaacaagctagggtgatagtagcatatgccaaagttgttttttttttccagatccgaactgctagtgtgacattgttgtgagtggtaggaataacagcctcttcggccattcaaaaaggcaggagaggacgtttttgtgcagggtttagatctgtcggctttcagtgcagtgtagctggccaaccttggcgctgctcaaatctgaactgccatctgcctgttgaaaattcagcctgctgatgaggcttcaggaggattcttgctgcctgccatgtcatggaatcttgatccacacaaagtaaacagaaatttgttattacaaattacagcagagtcagatagtgacatgccgacatgcatttgattggtggtagtaattggtaaattggccacatgggcacatggtttgggttcagtgttcacagttcagaactgagaggcagataaattatggagattaaggtacaggaggttgtagttacctcgtttgatgccacgttcagtgctgggacaatgtcaaaatggacaagtagctagctagcttcagtaaccatacctctgaagaaatggccaataggttagtctgttgagatgctcaatgcatgaaatattttctttatcagaacatgagaacacctgaatatcacacagcttgtgtgcctaagtataatcataaatttctattatacaaaagcagcaatttctgttattacattctcgttttcttgctttagctcatcagcctaatactagcagcaccagcatcgcattacaaactcaacaaaaagcacctctctcattcctgaacctcatagctgaaataacagtgtagagcaccaatactcataactgaatacagtggatccaagaatatcatcaaacaagatctcgatctcatgctacatcaatgtgaattccggaaaagcctttctcagtgagcagagctcctcggctggctgaaggatccaccagcatagagcatctgatatactggtcggattctcactgtcaaaacaatgctcagcaatgtacccaagctagccactccagctagaacgcaaaatgtaagtctgaaacaattagggccatggcatgcaatgtcagtgtccattgttgtggcatgctgtctctccacttcctggtcgtaaacataccccgcgagactgttaaacaagagtgcgccaagtgggttccccaaggagatgaaattgaaaatctttccgaagtgcttcaatccaaacaactcagatgaagttgacaccatcactgagaactgggcaccataacaaataccaagtaaagcaacagagacatgaagtgtggcatggtggcccaatgcaaagagcaggtatataattatcatcatgacttgggtgcatgtaatcaatgttgtccgtggaagggtccttgacctgcgaaagaagatcagtgaactaactcagaatggtcatttagaaaatttagaacttaaaaacaagcacttcagtgatgaacccaaaagaaaatattttgatacagcatttatacaatggtaatggggaccatacctactgtttcttctattaaaaaaggagagaaattacggtcggttcattatctaattactgaaaaattaaaactggattgggggcttgatggttagatcaggaaatagatgaccaatgaacaatggtagagtataacatgcttgctcccctaaaagtaaaatctatgggttggctagctaccaggtcctaaacagtagccacaatctccaagaaacttgacaggatgactaactagtacttggagactagttgatgaaactatcctattgaaattctcatttcaaaacaaacacaattatgcaggacaagaaattccattacctgacaagatactcagaaacagcaccacctcctaaacggccaaagaaattgccgaaactgaagagggcgagtgatatggttgtatccgcaacacctgctgcaattccaacttgtgctagattattaagaacagtgactccagatccaaccccaataaaatacactgcaaataaaagccagaaatcagccttcagcagtgcttcacgaaatctaaagtcctctcccctttttggtcttcttctcttctgctttatagccccttctccctcagctaagagaatatcaatatccatggaatcatcatcttctatattaccaagatttgatgctgatgaagaaggaagtaatgattctgtatgatcatgatcagcagaagaagaagagcactctgatgaatcggattgcccttttcttcggttgcttggaaacaatgtcattttcaagggtactgtaagtggaacaaagaggacaaggaccatgatgacaagcagaacatagttcacagcatcagtaagagttacgaaatggtccaatatcgtggctgcaacaagataaacccctagaagaacactggagagttgtgtgaacagaaaatgcacttgctccgaagagttctccacaagggagggttcacaaggccgcacgaagtacattgtcacaaggcacacaacaggaactcccagggtgacaaaaagcagaaagtttgaagctgaatcatgaagtactccggtgtatattacagtgtacacagcagcacttaaaccagcgtaccctttaaggatgccagcgacggcacctctactgagtgggaaattcctcatattggttaccaaaacagcggtccccaaccatgcaccactgtttgcagcaaggcataaggcaaaccatatctgaaatacaacagtacggtcactagtcagtttaagctgtcctacgaaattaaatctcggcgtctcaccatcagaagaagctagcagcctagcaaagtaagctaaccccagaaacctgccccagaacaagcttccagtaaaaatccccaatatgtgcatcttgctggcgtgtgaagccaaatgtcgcatttttttccaacccaaatgtgaatgtgacccatacttgttcgctagttagtgtttggtacaacaattcttattttgtagtttactttttgttgctgggatctttgaaaatgactccttttgttcccgggaacaggttccttgctatatctaactcaaaaagtcgttacttgcaccgcccaaaagtggccacttggcgtaaaagaagcgcactaccaatacactagagcaattcgactccaatttcacaacctaacgaaaatgcaccactaatgcgcatccaaatgcaattttctaaaactaaaattacaagaaaaaaaatacagtgcgaatcgatctcagaagtggacacctagcaacaacagatccaagaaaagaaaaaaggtaaaaaaaaaaaaggaaattacagagcaaagagaagggtagagagagatgaccagccactatgggagcgcggggccggaggcggagacggcgagccaggtggagccgtagttgaggaggcatgcggcggtgcagacgagcagcagcagggcggggtggaggcggttgcataggacgcccgggaggaggccgaggttctccctgacgtcgcaggcgaccccgagcagcgcgaggcggcgctggtcggcggcgagcgcgaccttgagggcgtgggagtagagcgcgaaggtggagctggctccgcccgccacctgcacccacaccgccgcccctagccccacccacggcggcctgctccccgccttcaccgccaccgcccccctcatcctcccctcctccttccctggtcggatcgagaagcggggtttgatcagcagcagcgaagcgtggtgggagcgagagcaggttgggttgggggatgaggtgttaaaaagggagagcggattgggacctgtccgacggacggggactgtgccggggcggccacggtggccacggggttggagtagtagaccagtaatccctccggtttcattttaattaacattttggacaatgatacgatatattttttaaaaaatatttgaccgttcgtcttatttaaaaaatttaagtaattattaattctttttctatcatttgatttattgttaaatatacttttatgtatacatatagttttacacatttcacaaaaaattttgaataagacgaacggtcaaatatattttaaaaagtcaacggtgtcaaacatttagggaaggaaggagtacaagatatatctttgatcttatttttttattataatatatataataaataaatgcatgtttatttttattataatgctttaaaaaactaaatatttttaaagttattaatggtcaaagttataaaagtttgatctcaactttattcaaaacgtcaattaatatggaacagagggaggagggtagtacctggatttggtgcgggaaaagcggaaaagcgatggattctccactgggacaggcgcgacgcggtgggctgggccggaaggaacagaggaggaggaggagggggaataaactccgattaggtccctcatccttaacgtcgaatatgaatctcgtctttgaattgaaccgttatcctatatacttcaagtcattctagcattttacacattcatattgatactatatatatctagattcattagcatcaatataaatatgagaaatgctagaatgacttacattgtaaaacggagggagtagtacttagggaaagtactataagccccttcatgttgcctctaaatttaccacataagattaggtgatgagttggaggagagaagttaggagagaaagaatgagccacccctcatacaagaggcaacatccatacaatctccaataaaaatataagatgagaatgagccacccctcatgcaagtggcaatctcccacacaatctccaataaaaatataagatgatgtgggagtaaactaatattggggtttgtgtactagaggtgacatgttgtacttgttacctcttaattaatgagaagataacatggtttaaattagatgtggcactcacctccactataaaacttgcccttatatagttcatcgccactaagtgtagttaatgctatttctctcttctctcattaagccacatcaccctaattatttctagcctttaaatgatagatctatggttcaaattgtcacttctttattctctcataaaaccatgcaatctcaattatttttagactcaaaattgtactatcaatttgttttagttttgataatcatattatatcttatttgtacatattatgcaacttaattttccgcagcaacgcggcggggtattcatctagtatcaggtataacacgtccctcgatctacaccatcggtgtactcgtggttatagacaatatagtcattggttttggctgatgtgacggctaaggctctgttcttttggttgagttgggaacccatccctccggtacggaaaacgaagcagtccattagcacgtgattaattaattatttgctatttttttttcaaaaatggatcaatataattttttaagcaactttcgtatataaactttttgcaaaaaacacaccgtttagcagtttgaaaaacgtgcgcacggaaaatgagatgggggagttgggaactccaggaaacgaacagagcctaagtcatcatgacctcacatgtcaacttcctcctcttctctctctcatctcccaactttcttcttcattctccgtcccaccgccgtgccgggcatagcccggatcctactccctctccgcctcctccctgacatgacaacccatcctccgcgccagtagcccaacatcgccaaggctcgacctctcctaccccaggcacctctccgtctcgcgaaagtgccgccttgggcctacctcgccaccttctactctatcccaagacaatgcaacgccgggctcgccccgtcacctcctacttcatcccacgacaacgctgtgttgggcccgtcccaccacctcttcggcggattggtatgcgaggttttgagattggtggtgcttgtctggtcatgcatcaaaagctgccgccgcggcgtgacaaggagcgggatggcttgctgggatgagagatgagcaggacgaaggttattaccattagcaatctagatccgatggaggagttcccgctggtgacaccgacgctcagtttttgggagttctagcatcttggcacgttccggggagtgagccccttctccccgctgttcgacaccgatagcagcgtcactaccttcactccccctcgcgcctgccgacgaggacaacatagatggggtggagatgcccaatcgtggcggtggcctcgagttgagccccatgcaccgcgactagtgcacctctctccctgtatcccattggcccgccgcccaggaggctgagaagagaggagagggggaaagaggaaaagaaagctaggaggggagagagaggggagaggaggatgatgctaacatgtggggcccacgatgatttagccagcatgttagccagcctatgacctcgggtacatcgttattgtaagttgagagacatgctatatttggtattgcagtttaaagatgaaattcaaattcgaggttaagacgagggacctaaagagaacttatttcgtgggagggctggaagtgaagaagactcgtgtggatgatgggctgatgggccggccaaatggatggaacatttgggtaggggggcattttcgttcaaagtttatatttgtaaaagaaaaacctctagtccctcgaaggggtgaaaaatggaaaataaatccagtttatgagtttaatccatttccatatgagaaatgaaaaggacaaattcagacatgaatagtagcaatactattcatttgctgatcttttttaagtagtttacgtatatgctatgaatgttgtcaatttttttagaatttttaacaactatttggatgaacagtgttatctttaaatgatgagggaaatataggttaactttctccattgcagtgttgaccacaggtactatttcactgctaatgttaggtggcatgacagcatcagaagggacttgaataatggcatgatcattgcgaatgaccatccaaccctaatttcttggaccaaaaaaacagctaatttagcgcccacatgtagataaacaaaagcttaaccgggccacaaactactcactgccaacgctcatgctgcacgcttaatgtattatagccatgcgaagaagtttcagtcgatcagaaacactcaagtgggcatattcagattcttcagcaatccatctgtaaattcattcaaaaaaccaaatcaatgtcctttccagtctggtcttgtgtttgaattaatgtcatgctctgatcatatcatgcaaccccatatatggatggatcgatcgggagctcgtagtaatcatgcgtgatctgatgaatattttatggatgcaatgcataatttgccgttttgttcagcaacagtgtcacactgtcactgtccttggctagatccagactccagcgttgcttgctgcaagctgctcctcttgaatgtgagagtgagagttcgtcagaagatgacagaattcggggttaatttcagttggtttttactgacgacgtgctacggccgagtttagttccaaaatttttcttcaaacttccaacttttccatcacatcaaaactttcctacacacacaaacttctaacttttccattgtgtcgttccaatttcaactaaacttctaattttggcatgaactaaacacaccaattgatctaccaatgctgattcttagtacagttcagtgttaatcatgtgcaaagtaaaggaatttggccaattttgttccgtgtttgaaacatttttctgatcaatctgcatctctctggggctggtgagcatgcgaaaaacgaagagacatgcatggcccagagtgacagaacaagtttcaactttgcgaaccaaactaattttccttttctttttgagcaattctaaaccttttctttttaatttccacgttcttatcgccatcgactctaccttattagttcaattatgcatggaaaatcatggctgcacttaaaatggaacggagggagtactttattagttcaatttttaattgaatttacacaccatttaatctattcatgaatcatgataggtttcactatatattactgccaaagtggatcagactgacaagcaacaagcagctgcagcttaactcgcacgtgtggaattagggagctagctagagctcgagctgatcggcaatggcgggctccgaccaccaccccggcggccgggacggcgcgccgctggtgttcgacgagctccggtgggtgatccagatccggcgctccctccaggaggacggcggcgacgacgacgacgacaacggcatcccggtgtccgtgttcaacgtgcccaagcagctgcaggcgcacaagccggaggcgtacgtgccgcagttcatcgcgctggggccgtaccaccattggcggccggagctgtacgagatggagcgatacaagctcgccgccgcgcggcgcgcccagaggcacctccgcgagggcgtcaagctcgagcacctcgtcgaacagttcgcgcgcgcggagcgcaaggtcagggcgcactaccaccgctacctcgacttcagcggcgagacgctggcgtggatgatggtcgtcgacggcgcgttcctgctcgagttcttgcagatcttcgccgccgcggaggccgccgccagcggcggcggagggaagccggagctgaggagggtgtcgtcgaggatggcgcacctggtggacttcgccgggaggaagtcggcgcacaacctcatcctccgcgacatgctcatgctcgagaaccagatcccgctcttcctcctccgcaagctcctcgagccgcagtgctcgtcggcggaggaggccagcgagctgctcgggcggatggtcaccggcctcatgaaggagctctgccccttcaagatgatggacaacttcccggccatcgacgtcgccaagcacgcccacctcctcgagctcctctaccacctgctcgtcccgaagccatccgacgacgccgccgccgccgccgacggccacgacgagggctacgacatcgaggagcagccggtggacggcggcggcggcggcggcgaggagaagcagcaatccgccgggtgcgagtacgtgaagcagctgctcgccgcggtgtggggcatcgtgtcgagcctcaagagcgggccgatgcagtacgtggcgaagccgatctcgttcgccgtcaaggcgccatggaagatgctcaccgtggtcccgggcttctcggcgatgaagcacccagtggagtccttcttcatgtccggcggcggcggcgacccgtcgtcgtcgtcgacggcggcggggcaggaccaccaccacgcgatcagccggccaccgctgatcgaggagatcatgatcccgtcagtcaccgagctcgccgccgccggcgtccagttcgcgccgacgaacggcgacgccaccacggtctcgttcgacgccaagacggcgacgctgcacctccccgtggtgacgcttgacggcagcacgacggaggtggtgctccgcaacctggtcgcctacgaggcgtcggcggcgacggggccgctggtgctcgcccggtacacggagctgatgaacggcatcatcgacaccggcgaggacgtggcggcgctgcggcggcgaggggtggtgctgaaccggatgaagagcgacggcgaggcggcgaggctgtggaacgggatgagcaggtcggtgaggctgacgaaggtggcggccatggacgcggcggtggagggggtgaaccggtaccacggcgcgcggtggcgggtgaaggcgaggcggttcatgcggcgctacgtgttcggctcgtggcagctgctcaccttcctcgccgccgtcctcatgctgctgctcaccacgctgcaggccttctgctcggtctacacctgctcgcggtggttcggcgccgtcgccgtcgcgccgccgccgtagcgcggcggcgactgcgagcgatcgacgtggttggttggtttgttttttttggatttgattgcatgcgtttgggttttgggattttgctgctatacaagtgtacatgtgcgatttggattttgtgtgtatttaatgattttttttgttttgttttggggattaatttatacttgtatatttgtactttggttgtacttggatagatacaatgcaagtttggtgagaagtaattttgtgattaattccgcacctatagaaaatcatgatatagggaaggtttttgtccaattatttcatggtggcatcctaaattttatttctaacaattagggcccctttgaatcgcagggtagaaaaaatggaggaataggaaaaacataggattctgacaggaattgaagtgtaaaacagaggattgcaaaacacaggaatggtcgtttgattggagcgcaggaaaaacgcaggaatcagatgagagagatagactcaaaggaaattttccaagaggttggagctcttgctaaatttcctccaaaatctacatgcaatgtgtcattccataggaatttcataggatttggaaagcttcaatcctttgaatcaaagggccaaataggaaaatttcctataggatttgaatcttatgaaattcctacataaatcctttgattcaaaggggcccttagtagcaaggaggaactcacctatgtacgtattcactatatccaaaacttcagttaaagaaaaactatatccaaaaccaaactagtgatggaaaggggttaatccaaaaataatacctccgtcggtccgtcccataataattgtatttctaatattcaaatttgtcctaaaatagttgtcacaatatagtaccaattgttccattaatcacttttgatttgaattcctctctattctatcctcaaccaccaccacacacttacctatacactatttaatgagaagcacaatagtctttattctcaaatcttaatatatactaaacaatctagaattacaattattttgggacagagatattactctttttcacagcacaagtggaactgacacatccacacacaccacacttgtgctcacacatacaaaaccatgtggatgtgtcctggcacattttaagttaaagagattggaggcaagtactattattttaagtattatctactgagattaaatcacaaggaaatgtgaacacatatcttaagtccgaaacttaaaacttagggccccttttaatcgcaagaatggaaaaaaaggaggaatagaaaaaatacaagattctgataggaatgcaagtgtaaaacagaggattggaaaatataggaaaaacacaggaatgaccgtttgattggaccacaggaaaaacacaggaaccggatgagagagatagactcaaatgaattttaaaggataggatatgattcaatcctttgtttcaaagactttcgtaggattgaaatcatccaaagttcctacacttttcctacaaatcaaagtattgacgtagtacgcttctcaaatcctacgggaataaaaaaatacaggaaaaacaataagaattatttgatagtgccatgggaaaaataaagggaagtttacaaagagatcatacctcttgctagttttcctatgtaatgtgaagcataggaatacaatcatatggaaagtttcatttctttcttctgaatcaaaaggatatatgggaaaaaattcataggaatttgaatcctataaaaatcctttaccaatcctatgaatcaaaggggctaatcttactagccgagttatgctcaattcattacccaaagatgctctttgttcactttagctcaacctaaacggtctaaaatttcacctacgagttgggctgtgggcgccataaccaaaatcacatctatagcttgagtcaactgcagtttagtctttatttattgttaataatactataatgtccctcagctagtttacttataactaggatcaatgtcacaatcactttttatgaggagtatcactataacgtgttaatgaagataatctgcgtaagattatgaattcattttctttattaatagttacatgattacgatcgatatatatatagacaaattgatccagcaactgttgacttatcatttatcaatttaaatttccatcctacattctattgtctccgattaggccagggaagatatggcaattaaacaacaattcattttgttttttttaaatgttcgagttgctcaaccgaatttgcagtaaacaataatgtcctgatcagttagcatggaattttcgcttgcccatacttcagtccatagttcatgaataaaatatgataaaagaaggcaatacaatgacatgacatgaacttgtctgatccaagtggaagacattttacttgcaatattttgaagctaaaatataagaaaatcctttacacgctagcaatccatcatgacatggacatttgattatgaagaaaaaaatgttgcagctgtcatacccccttctgccccacatggactgcaacttaattggctaacataattctttcttcatgggctcatggcctatgctcccaaggggaaaaaacatccactacataaagaagcagcagaaaaaatcacaaattcctactaataatggcgctgagcaatcaaatgcaatgactattccctctagtttttttagataatgccctctagttgtaaatgctaaagtattggtatgtttcctacacattttatacttaaaagattaaattagctactccatcattattagcttagaaaaattattgaccttgtcttctgtcaaactatttgatgacataaataagaaaaccaggagaagagaactgctgcacatcaggagatgctcaaccatacgtgagactgacacctaaagctgaggatgatatgttggattaggcacacacacactgacacacagctaagcattctgcatccattttgtgagtttcttgattgaaactttgtttttaaaaaaacaacatttagaagcgtaccgattcacgaagttgcattttcttgattgaaaatctgaaatgctgtcatcaagtttcagtttcttgattgaaatgttgtcaagaagttagtacatcaatggtgtttctcaccctcttcaacagggggggaagaagatgaagaagggaaaaataaatgaaattagaaattacaccttggatcttgctatagcagggttgccttctcaagtgtgtgtgtctcactagttgagcacagattatctaaagaaagaatgaaacatagaagaagaagaagaagaagaagaagaagaagaagaagaagaagaagaagaagaaaaaatgttcagtgatgtctagggttatggccccttggaccatagtaatctacatggatctcaggcagctcatgtcctactctgctcttctcttcagaaatggctttctccatttcaccagatggctcaccatcagtctttgctactactactgctactacgttatcgccagatgtctgcaaaccaagaatgagcatcagttagcaacttggaatcaacatatacattcattgatcaatctttatcagaaaacttaaatgacagtgataaaacacttacgttattgacagtctgtttgctgaatgctgaatgactctctgcatccaaccgaatgctctgaactgttgcagccatcaggaacagagccaggacagcagcaaccaatggcaaggaggtcttcatttcgatcttctgtgtaagtaagaatcctgagaaaagttcagagactggaatactagcacttcagctcagatggaacagtgaggagctatgaagttaggttgctgcaaccctttgacccagagatgatatatatacatcatttgcttcagaagcaaagccatggtcccatctagtgattgctgcactcatgtctgcaatggaggtgtaatctgaagtacagatgcaaaatttgggcataatttatgttatctctgctacactttagagaagtatgtctgcccaaagtatgggccatgtttaggccattggtccctggattaggtgccaatgccacacttggaagtaccaaatgtaattaagaattttgtcaagtactgtatttggtctcaagtgtgatatacatctgctcctagaaagttgcatccatgtctctgaaggaatgtacagagttgcgtatatttgcttgtgcattcctccaggaaaagtgtacaaacttgattagttaattgggttgaatactggcgtacgagaaagctttgattttttaatggaagattaggactaatcagacgaaaatgatcagtgcccgtgcaatttggcatgcatcattcctgcactttgaaggcattattttggtcttttgtgtttgtctccgtgttttttgtatcaagaaaccaaacaactgaaaaaacatgagacaaaaccatggaaaagatgagccaattggcggcaatttcactcaatgggggtatcttttacatggtcaacgttcaattacccaggagttgagtagctgacatttttatttacagacaagaataggagaaaaatatgacactgtgagcttgggcactcacttctttcttcacagagctcaacttgttacagccgcttagaatttctcacaatttgagagctcagaactcatgttcgttggcttaattaccaacaagaataatagctggtgtcatcacaacaatggtggtaacatctaacaacaatgaggtgccgagatcactacatacaattaacactcggcaatgcaacatactagagaaattgcagcaagaatgcaaagaagatggccatcattggtttctcaggagtgtcctcaagctgttcagcccctcagccgaaatgctgcgcgccaccctaccgggtcggctcactctgacctggggaggagcctccaggtggaaggagaccaacaccgcggttaagttgtcggtggcgcctcgctttattgcctcctcaacgatctccctgcagcaggacttcacatcgttgtgttcttggaggcgcctccgtgcaaagtccaccacgttttggtttgagaagacgtcccagatcccgtcgctgccaattatcaagaactcgtcgtcctttgtcagtgtgatcatctttagctctggttcagcactaagtggacctcctggattgccagcttctttcatgccctcaagatgccagtcaccgagtgctctagtgactcctaacaaaccgttgaggtaaccatcgtcgacatagccaccaagtgattctacacgcagtttttcgctgaggctgcaaggcctgtggtccactgacatttcaattgcagtgccgcaccgtgaaagaaccgccctacaatctccagcatttgcaatcagaagagtcctgcagtagacatgaagatatcagtatccatcataagtgtttgcgaacaagtgacaggtataaaaacgtagcaaaaagtttacagaaagacatgatatggatgtttgccacttcatgcttttagaattatatctaggaattaataaagcaatgaaatctatagcacgtgataaagattcaaaaacaggcatgatcttatagcttaacataattggaaaacacatctgctagtagatctaagtatctaaccaagcccaaagtaaaattgaatagcaataaggaaaccaagattgtcgcaggtatttagttcatgtctcatggtactgataactgattcttataagcatactattcaaagatgggaaaaccacagtttaatgtgtcataaaagcaccttccgaaaatcattgctgtaagtgctgttgtgccagaagacagtgttgtctttgcaaactgattatctgcatgaacaaaggatcttcttactactttctcaagctcaagaggaaaatcagcatcttccacaatgatccttggtaaattatcacgaacaaaatgggcagcatcttttccaccatgcccatcaaagacctgatagtggaaatggagcaaagacttaattcacataaacgtgctatgattagtagttttatcaaaatacagaagcagaagaataagaaaaattataaagccacttattgaacattaaataaaaactgagccccaaaaatgtgatagtagagtaactttactgagatatctcgatttcattaaaattgaaacagtgaagaataagatcaagttctgtaggtgtgagtatggaggatgtttggatatgattggttggatagtccttaagaatgcatacaaatttgttagtaattgtactcctgttacactacacaaataagctgggtcaaaaaatgcagatggcatgtttattttctactatgcgcactacacaaatatgttactactggactagcgtactggtctactggatgctattgatatgttactactgaactggaagaacatatatctagttctgaacaaatctgacaaaagtttctactttcattcatgacatgctagtctctttttagctgtaagtttatgcacaaaaaaaggtaggtactcatttggtcagtcagaatcggggaaacatacaaatgagcgggaaagtgcttaccccataaaaggaaatagcttcattatccaccgattgataaccaaagttcttagctaggtcagtaatacacacatgggtatcttccatgtattgacgacctccaatatccgaccaatccccagatcgaatatttgggacaaaattaccagacttattttgcttgaaatcagcagctgtagtgttctcacaaactctttccatctgtccaaacaaaaggattaatgctagatcaattaatttgtactggaaattcagagctggagcaattaataggaaacaacaactctaatgaaaagaggaggcaatactttgctacaaagttacattctttaaaatgcttctttagaaacgtggctagacaagttatttcaaaccccaattgaacattttatttatttattagatgatttactagctaacgagtaatgaatgaattattcattgagtgtcaacggccgataaatgtaactccagataacaaaacagaagattaagcacttggggtaacatcacataagaaaagatcccatagctgctactgcctggtgtttgctagatgcaacaaatatatcatcaaaaactacacgcttcagcactctccatagcaaaaaattaatgccgcaacacttatgatccaacaatctcactagccatagataattaaagccaagcagtttctacaactgatatgaagaaaaaagaacacttcaaagttagcaaaccacatggatcacttcaggaaaaatgtgcccttgggtgagagagaagcacaagaaccactcttttttcctcatttcagtcaagagagggaaataaagtaccatgtacactttgcaggtactacctctttcctgttctaaagcacgtgatgattgtttttgccctgtttggtaggtacaacagtctgaaattagggcctgtttgggaaacagggacttattttaagtccctgtcacatcggatgtttatacactaatttagagtattaaacatacactaattataaaacctattctataaccttggactaattcgcgagacgaatcttttgagtctaattacaccatgatttgacaatgtgatgctacagtaaacttttcataattatggattaattaggcttaaaaaattcgtcccgcagattagctttcatttatgaaattagtttttttattagtctatgtttaatactccaaattagcgtcaaacattcgatgtgacacggactaaaaagttttagccccatctaaacacccccttagtactccacaatgaacaagccagagattggaagctgcgactataattatatatattcagtacaaaatcaaagtaccaatgaacaatgcaatgaacaggtgaccaataacgtagtattagtagtagtatcatcacacattggcaagaagaacacctaccaggccaccaaacttcgcagctaacaaatgcagaaaacttaactcctccacacacacgatcagtctaggcacaatcagtactagctagcagtaataattaaacaagaaaaaagaatcacaatcacttctaataatactccatgtgtttcaagaaacggaagaggcgtgtgcacaaagcaagcacccagaagggcatgctttgcttccttccttccttccttccttcccaatctcatcatcatcgtccttccttccttcacgccatgaagggaaatcaaacgaacctaacgaagaagaaacgccccaagacaaagaatcgaatctctcgttgcggaagagagagaaaaccaagtagtaccctactcacccgaggcgaggggagttcgtcggggctcttgctcttgctcttcccggcgtcggcggcggcggcggcgggctccccaaaatccagcctctccgcgccctccgactcctccacgcacataccggcgcgccgtacagggcgttcttggcaccacggagctcgatcgatcgatcgcgcaactgggcgccctgctgctagtggtatattgcagctaggagagacagggaagagagagaatcggagcaaagcaagcacaagctactactctgtaggaggagagagagaggggaatccgaggaggaggaggagattcttggggaatatctgcggagaaggaaagaaatgggagggaaatggaggtgggtgtgtggtgtggtgtgggggcgagagagggaaaagctttgcggtggtggtggttagttggattgatggaggtggattgcggcggcggcctggaatggggggttagggttagaactgcacgaatcttaaagctaatccaacggtctagggactctatcgtttcggcatattttgtaaatgggaaataattactacctccgtttcatatcataaggcgttttgactgcttcaactttgtagaaacaaaacattttcaacccaaaataattttatcataaaaatatatttatttattgatttaataaaattaatttgatattataaatattatatatttatctataaacttagtcaaacttgaacgaccatgaccaaagttaaaacgtcttataacctaataaataaaacttttatatgcgtgttcttagtgatctaaaagcaaagactggaaaataaactacaatgaaaaaaccctaaaattaactctaaatttaaggttgagattttaatttttgatttataagcatgagtcaaaagacgaggctgtagaatttgaatttatgaggtatttttctgtcaaacgccatctagacatttatttattttttatgatgatggtgagaggaagagaagcacgtgggcgtagaaacgtcacatctgacgtggttgggctttgggccttccattgtggacctcgaatccgacgacaatgccacaatgctgccgtaggagagcgagaggaattaaatttaaaaaatatatttatcttttttttagaaatatgcggatgtaattttttttttcacaaatacaacgtcgtcactgtatggaaatgtaaaatcaacacaatattgctgaactattgtgcgaaaataacgatggtgtaacaatgcggacggtctcgtagactgaggaagcgagactgcgcgtggacagtgcgagaccgagcaacagccatttgggcatgcccaaaaagcaacagcattttgggaaatgattaattagtgagttgattatcctgattaatcactaataatgctaattaaaataattaattaattgctaatgatgctaattaatctattaatcatgctaatacggatacaaagtcacggtctcgcgcctcgccctgcgagaccgtgacgcggcaccgtcgtgcgacgacggtatacttctgcaaatttcttctaagcgtgtatatttatgtaaaaaacatacatattcatttttttccaagcgagagggtgtttattttgttcggtggctaatgtgccattttaaatcacacgaatgaaaaaaaaagaagaaatagaaaaatatatgattctaatataaatagaagtataaaacagagaattgcaaagacataagaaagattatttgattgggccttacgaaaaatataggattttgataagagatatagacttaaaggaaatgtttcaagaggtcagagctcttgctaagttttctacaaaatctctgtatgattgtctattccataggaatttcaaatgataggataattcaatcctctctttcaacagtctttataggaaatttttttttaggattgaatcctctaaaatttctatgttttttcaataaaccaagagagtacatgtatatatgtcggcatatttttaaggaaaaattagtcaatatttcatttgatatatgaatggtagtaattcataatcaactggtgaacaattaacttgcatatcatttaaaagttgtcgtttacccactcttttcctagtttagcacttacatgctagttacattgtaattaagatgtaattgagatataactataatataattagaatgtaaccattaaatatgcaatgtaatttgtttgttgccattcacttcatgttaagaaaatcggatcaactgaattcactgcattaggcagtgagaaacaagtactaacattcattgcaagaatagatcaattaatttgtaccacatgcccaagatcaccacacatgttgttccaatttaattgctagtgttccagcagaatcggttcatatctgcgttgctcctgcacggatcgcagagaatcaagtggctcaaaatcaactataattagggcaaatatctgtcgacataaatttatgtccactacggcatatttgcaaacgaaaaaaaatttgtaaataaaactttatatacattttcttagtgatctaaaagcaaatgatgaaaaataaacttcgataaacccccccctctaaaatcaacttcaaatttaaggttgagaattcaaattttgactgataagcatacacataagtgaaaagatggagctgttaacgaaacctttatcaaagagtgtcatggttatgaataccacatacctaatagtagttgactaaatctcggcaggacccaccacataccatgtcttatacggaaactgaccttgagggagttccggataaggaaagacaaccagagttctacatggaaacgacaaggactactcggattgtatccatattggttttcctagttctacttgaacaatgggacacctatgggtataaatacaagcccccctaggaggacagggggacaaccatgatgagacgatcaacacgatcaacgacaaccatgatgagacgatcaacacgatcaacacccaccatgacgagacaatcaacacaatacacgggacaacatacaagccaacatacgtcaagacaagccgccggatatcgacatcagagatacgcctggatcgaccctatccggtaccttcagaggccggccgtagggatctagcactgtctctgattccgtcgggcgcgagttcgaggaggaaggctaccctgttgtcgactacaagtcagaccttcagaccgccatgtcgacaacagttagataggctacctcacatattgtactggtgtgattatggtgaataaaaagcaacatcggctccggccaacaggatgtaggggtattacctgatcgcccctaatcaccatcctacatccaactatacattaggagtatttatgaaagggtattatgggttttttcttctaactttaatacatgctaaacattttagaacgacaagtccacaagtttggacagaggaagtacttccatctcatctcaacgtgcgcagtccgtatgtgaaaactgaaaagtaatcattgtccctccctaactatttgcatctttgcctgttggcccgttaatgtacgggctcccaggctattaattatataggctaacttgtacaacatactagtactacctcctccatcctaaatacttctccatcctaaatacttgtcgttttcagttttcgtttgtaatgtttgaccattcgtattatttaaaatattatagaattattatttattttttttaacttgatttattatcaaaagtaagtatgacttatcttttttatatttacactaattttttaaataagacgaatggtcaaacgttacaagtaaaaagtcaaaacgacatcatcagttcaaaacgacatcaccagtctgtaatgtttaagcaaagattgaattgcacagactctgaacaaacaccagatcaaaatattctgagaaaatgggtttatcttatcactgtaaatatgctgacactaaaatgcagacaagaaaacaaccacccagcattatcacaagctgttggccacaacatgatcataaaacactagtatgtgcctcgcgcgttgccgcgggacataatgaaaattggttattataagcatggagtgaagcacggaaacaaaaggtattcatgtagattttgaaatataaatccaacgtcaaagctgatatgattagaaactgcagtgtcgttaatataaatgtgaatacatatatttttaatatttcacatgacaacaaaaatattactggaagtttacttactaaagcatataatatatgtaagatatgttatttcatcggacaaaaagaactgatgacggtagtcagttggcaattaaaatagttatattatttacatggcaggcatacaagtgagtgagacaaataatttatctcgtagaacactcttgcaagccaaaaggtacataatagggcatagaggtgcattgatatattttctagcagaacacctgctgatggaaaaatgaaatttataatgatcattgagatggctggatgcttggttcttcgtatgatggcagctgcattatagtatgattatgagcatcagccataatcaagactggtagcatagtgaataacagattaatttttaagtaaaataggtatgtgtgtgaaacatccatatacagttgttgaagtggctaatcacattgaaacagggaaaataatatcatgtgacagttgatgagatgacaaatgaagtggtaagacatgttatgaaacatatatatggatggaaaacttgatgaattatagcatactatgaacttgtaccaagactaaattaataggaataggtgtgtgatcaaatatgatagactacttaaaagcattagctgtgagagaatctagatttggtgtggaagattttttttttcttttggcaattaatgcaggaatgcaaggatcttcaaatttatataggtaacctgtaaaatgctgtaaacttcttttcacattgaacttgtttagtggtcagaatgcaaaatataaaaagaggaaaacaaacttacgaagaaaccatggataccagaaggcatatattagaggaaagttgagtgtgaagatcacataaaatagacaggaaagaactgaactattgtaataataccaactgcgtgctgctttgacaaggcagaggtttcagataaagaatcctgcaaacaatgaagataggtaaatttgacattatcaaaacacaaagaatataatcaggtcaagttagtaggtctgagaaaaaagaacctaggactcacattgggggcaaggcaaccaaacacaacaaattaccaataggtagaacacgtatgcttgacttacctgtaatcatgtatgcattccttgttgatccagatcgttaaatatttctttgtaaacaacattgtgagtgctggtcacatgctcagttggactattctcaattagaatacgaagaccatcaggcgatgttacacgtgagagtgcgacataaagttgtccatgtgaaaagacagggctaggtaagtagacacacttggtttggaaccatcccttcgaacatgtttcccttaagcaatagtattcgtaactctggaaaagtttcatctatacatcttgggattgcaccactgaattggttatatcgcagatccattgtcttcaaattagcaccgaatggccagacaaggggaaatgttccattcagttcattctcacttaagtggagatatgtcaaattgggcaaagaaggcaaggggccagacagatggtttttggacagatcaagaaattgaagattcaaaaggctggatagacctgttggaattgatccagttaaatgattccctcttagattgaggataaaaaatagatgatttgaagctatgcaatttggaatggatccagtcaacttgttattgctaaaatcaaccacaccaagattcacgttggtgcaaatgctagtaggaatctcccctgagatattattatcgtttagcactagatgattcatcgacatagttgtaggaaaactagcagttatttcacccgatatgttgttgtaagataaatctaaagttgaaagattctccaagtgactaacggctgaaggaaatatgccttgaaaaaaattcttcgataagtttaggtagctcaaattagggaatgtgatgttgatgtccacaggaaggtccccgcttagcctgttataagatgcatctaaccatgataagttctgatttactgtggaaggaagaatgagtgatccaacaaatgagttatgtttcacactcaagtatgatagatatatattattctccagtaaccacgtcgggaaatgaccacttagattattgttcgaaacatcaattaggtataatccgtgctggtgtgataagaaacttggtacaacaccagaattggcattcaggttgcagtttgatagttcaagaacctgaagctgactagatatatttgcttctggattctcagtttgcacttggaagctggcactgttgcttgatagtctcaggtatttcagttggagatgatttgaaaaagagtttaggagtagcagaccttcaagctggttatgggaaagggaaagttgctcaagtaacgtcatgtttgcgaacgaaatagtggggaaccttgccgttaagagattatttgacagatcaagtactctgagaaaagttagatttctgatacatgatgggagcaccccaaagaaaaaatttccgtttagatgcaattctcgaagacttgtcatattgcaaacagctgtaaatgaaatgaactgtgtgatgtcagtacatgattcctacacatagctgctcctaattctaggctatgtttgcgagtactcactccgtcccacaatatagcaacctagtactagacgggatatcacctagtactacgtatctggacagggggcttgtccacatacgtagtactacgttgctatattatgaggtggaggaagtacatactaatcattgggaactgggaagtcatactaatgtttcaaaatagcataaagagcagagttaagtaagatttctttgacatgactatttgaaagaatactcccacaaggcagcaattaaaagtttttgcccttgggacttgggagcttctggttctaaactactgaagttaagcacactgtggtttggagttggtgtatctactttgtgatcacactaaatttgaattattttatcgattgaaggagaacaagatatattactaccataataatcatgtacttaaatttggtgccccaatgtaaagtgtaaagttattcacttttccaccacactcacatcggtgttcaaagtttgaacttcaaactgcatgccattaatttgtaagcgtggctgagattattttgaacaacgtagaaacagttgtaaaatattggaaccatgacacggtcatttactcatttactattgcacctttatgctttcacaaaaactttaaatgagatgccatacctcttgatatgttcccgaaaattccattccaacttagatcaagaatatccagcttcattttgcttaatcctataacatacaataaataaaccaaaataagagataaattccgaaataaaaaatcttttgtcaggaaaaaaactaatattgaaaatacaagcatgtgtgatgcttactttggacagtaaagtcattctttatggcgttcccaccgaggaatggggaacgcagagatgcaagtccaaccaagggcatgatactactatcattcaactcattttcagatagatcgaggatttccagttggcgtaaattagaccatacttcaaaacctgcagcgaatgatgaaaaacactataaatatgaaaattagtaaaaataaagactaatgcaacaggagttatccgactgcgtgcatacgtatgcacctacctagagaaggtccaacaaaaggacaccaaggtgaccattttacctaagcatcacacaccctagggagctccctgatcccttcctcggtgggtcacagggacaaggtgtttacatctagcaagacaaccttggtgtggtgaaatccaagttattctgaacagagacttcttagttgctacaacttgcggcccaacgattggtaaatccgtaaatgagtgattttaaagtcgttgagaaggtaccgaaagataccgtattttctactgtaaaattttgtacctctcagtaccggaggtacggaggtaccaaatttgcactaaaaattgtggtacctctcaaggattgtaaaatttctcttggtaaatatataatatcaatgttcctaaatgccttcttcgatatgtgaaacagcttgagggaggagaaggaaggaagacctgctgacctgcaccaggcatgcatcccgcgatgccggcatttcccaaggacaaattctgcagctcacggaatggaaggaacatactgcagttgagtaggccataccacgacggataagctgcatcaagatcaagggccgtgacacgccctgtgatggagctgcaggtcaccctctcccaccggcagcaatctctgctactccagtcaggcggattgccagccggccaaaggaacgcatcgcaaatgtccataagatgtttcctctcttcgtgcaaacaactgtcgcagaccaccaaggtcagcagaaccaagcaacaccaaatgcaggggttcctcatggccaccacaattcccaatcctcaaatacgctagctctcaagaaatttaacccacaggcaccgattttatactgatggtctcggtgcatcacactcaattaccactaccagcagattccacactccccatggtggcatcaagcaggtcgctgatttcgacggtaatgactgcctacctgaaatgaaaagaaatcggtgtcagcatcggcctcgtgactcggcgtcaaccgtgaagctagccagcccgcgcacattatctcttagtagaagaaaagcctgagatttctttattccagcaagcgagtggggcttggacttggagtcttggataagtggactgccggcatgcttgctccatggtagcaatgactaaatccacgagaaaataataataataataataataataataataataataataataataataataataataatataaaaaaacaaagtagtttcctcggagatggatcggtcctggtcatctgcagactgctcacttttggacccaaaacctcgcattggggaatagcaatcagtctggtcatccaccttcataaaaaaaaaaaaagtctggtcatccactcaaccagcccgttcttgggggcaacctgcaggaccttgcatcatcagtaggtcgaagttgctgtgaacggattaatggggaatacagagcttactgcgtcgacgccatcgtggaaggaattgaagaaatcggcgccaacggggagggttgaggccggccaggggcaccgcggggcccccgccgccggcagccaggaattggccttcgatgccatcgaggaaggaattgaagaagttggcgccgacggggaggggtcgcggtcgatgccgccgccgccggcaaccagggcagcatcggcatcggcgtcggcgtcggcgtcggcgtaggggtggcgttgtgaaggcccatcgtgtagaggcctaatattgaataagtctattttgactccttcaactcttgccattgctcgaatctcatcactcaatggcaaaatcggttattaaccaaacctcttcccccacttaaagggactaatgcaaattgactccttcaatagtttgggaaacggtttttattggtgtcaaattgactgacacggcagcctagtcattaggacattcacaatgtagtgaaaaaggtgagtattagacattaaaatattcttactactaagtaagatacattgtgaaagtagtaaatagctacgactaaaccataagcttactaccaagttataagtattttgtggtgggacctacctattttttaattgtggcatgactcatgtttgttttttttttaaatgggctccaccttattacccactttacacatatatatacattgtggtgtatcttcaatctactactacacttgtattgagatggagagagtattaccatcaattcatcaaacataggcccaccttactacctacttttgtaataaacattgttaatgcccttaaagaatttaaaatagaagtgggttccatgtgcaagtgacaagggtaaatattaaaaaaatgcaggttccacttgtcagcacttctccttcctccggcagaaattcatcaagaacctgtagaacattttgattgtgtgccgtgatattggacaattgttggcccgcccaaaaaatattggggaaattttgtacaaaaatgattccatcaaatgtttgcttgccaagcatataaccgacgatgtataatccaggtctccaggattaaagattgacagtcctcaaagaaatggcgtatttctatcatctacaactcttcctaaccatctacagtcctcaaaaatcagaaaaatacaaagactaatgcctcgcactgatcttgctaacaatctcatcttttgccagccgtatcaaaaacaccagggcaagtgatatggaaacaatcagcatgaaaaatacgctgttccatcctcttgttgaaatatacccagttaacaagggtcccaaagccgccccaacagaacccgtgccatcgattatcgcagacactgtagccaaagctctcgagtttcccttgattgcatcctgagtaccaagatcagtagcaacagctgtggtgatgagtgagtatgggccattcacaaagtagccggcgaggaacatgagcccaatgttgtggtgcatggatatgcttccatatgtccggtaaaggataagcgcggggattgaaagaaaaaggaacagagctgatgttacagcacgagcacctattttgtctgagagcaaaccagccgaaatgcctcccaaaactcctccaatatcgaaaacaacagacaaaattcctgaagccttgtgtgataagaactgacctgccacagctgcaaaatcaaacataggatgttgagtaaatagaacatgctcttatgtttgctctaaaatgatagatatcttactccagacaacgagaacagaaataatgctaccagaaattcacaaaatcctacagatagaagacaaactttcatttcatcatagaagggcatagttatgcttaataagctagattagccacttgcatcaaattctattagttctttcatgcctctagctggaaagctaggttggtaatgcatagtattttcaatcaacaactaaatggtgcttccacatgcaaagatccagtatcctctagataccctgttcttttcagcttattcactggattattgaagcggattatttgcttcacgcttcaaaaagtaagttctcacgaaaacttattctactgcattgcttagagcacttgttttaagctatttgataaatttatttctcaaaatatttaatttatccctataatcaagtagataatgcacaataataattcactcactaatctaaatcaaacaggggaacataaaccacggtctcataaatagaacttttgttttttgaattcaattgatgtattgatgatgctacataactatctaatcatccaacaaatttgaatcaggcctaaaacccagcatcttgaaacttctggcatcaacataattccaagcctctagagtttgacagcaaagttagggctcaggatgcaaggttaacaaacttgcagcgcagatagttgagttaaacccattgctagagtgctagacagtagatactatcagtcttcattcggttaacggtgattataaaaaactagcatcaagcaataagatcatactctactgattctcaactgaaaaattaagaaatagaatgtacttgaagcatataggacataccattgtgccggatatagaacggcaaccagtaaaggaaggtataagccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 44555 - DNA, 790 bp, Oryza sativa
  unsure (1)..(790): unsure at all n locations
atggggcaaaggtgaaagctgaaccaagcaaagaacccanccatgcgcagtatatgagcaaaccgaacaagagcataatgcgattcatatatctgacacaaagcaaggatcttcagaaatcagtttcgagtggtacagaacagaccaccacctggtgttcataaaagacacgagtcataagagactgtggcaccagattacatgagttaatacaaaggcctctctactgggagagcatggatcttgactaggagaaccatcagctcctgcaggtttatgcaccatcagattggaaggggttggcaatctcgtccgttccatcggttggcgatacaagcatcaccgctgtacccctacagacctgcaacaaacagtcgttggagctgaggtgtcaggatgatgaaaccagccaaaaagaaatcaaatggcagaaacaaactagtagtttgcaagaaaccaagctcttgattttgagattatttttgtttaatcactgttttgttgtaaatctgatcgaatcaacatttccagaaaaaaaaaaaactagtgcagatttcagcaaagtgcaaaataatcgtatagcatggaaataaaaactctcagagcttccttctcttaatgaaatgatacacacatctcgtgtattagagaaaagaactatcagaactacaatcggcaagcaatataaataatataggacaaagataagtcctggatattgaaannnnnnnnnnnnnnnnnnnnnnnnnnnnnnnnnnnnnnnnnnnnnnnnnnnnnnnnnnnnnnnnnn

SEQ ID NO: 44556 - DNA, 11895 bp, Oryza sativa
  unsure (1)..(11895): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttttgtgaatgtagatgaagttgtcagggaccttcatgctcggataagtcaagaaactgttcccatggtgacatcttagggccttcctgcggcggcatcccagcaaaaagcttctgttgttggtccgcctttcctcctcccttggctcaaacccatcaaggcacttgcatgctgggacagcatctgtgttgtcgcagtaactgttgggaccgcaatagccgtagatattgcagtcatgcacaggctccgagtacagggttgtccatgctgagatgttgctctgccaacctaacatatttaccttgcctaggtaggttattttcatcctgatcagcacactgaaggggccagttggcatgccaaaggacatgtacacctcatcgctgtcatggtttatcgccatgtaaatcgtggaattgaggttgttcatgtatttaccaatgaggaggtagttgttccacacagggcttcgccggtgcggcaccgagccatgccagatgaagcgctgaagcaggttgttggggtctgcaccgtaggagaagggaccaggggatgggtctcgtatgtctttccaagaaatgaggcgctgcagtgggtgtgtattgtggctgagcctgaggttcatgccaggcaggagagtgtcggtcgggtggtcgaagctctgccatatgatggcattgtcagccaatgaccggagaatgaggtttccggtgttgtctagcatggcttctgttgagatgtttttggtgtttcggggggagctgatgctgattctgcttttggccattgtcgtccaaaggacatggccattgccatcagacaaggtgaggttggagctcctggtcaaggtgaacactgcagatgaaggaacagtgattggcgcggcacggttcgctacccacacaacggtgaacttggggatgttattgtaccatatgccaacataatagtgtttcttggggttggatggggagaaaaaacccagggcaaatgttccatcatcagagataatggtgctaccaggagagattggcttaccagggacaaggcggttgtcggatgcacagagatgaattgaactgaatatccaataaagaagaaaaatcatggtagaggcatgaagggaacacattggcattcttggtgccctgcttgtaatgaaatgggttatgcaaccatggatgctaatgggatatagaagcaatcaaagggtcaagttgccttaaaagccagaaccaaggaacaaaagggaagttaagctgttctaaaattggtactggctcctattgtcaactgttttctggaaatgatactaatcatgatgtgacattctgaatgctctactcatcccctcaattttaagttaaatgcaaaaagaaaaatcatttcaagcaaaaaattcacaccagaaagaagacaagttattccttgtagccttgtaggtcacttaaagttttttaataccacggaattagggaaatatctggagggaaaggtcttaacgtattttctctgaaagttaaaaagattcaggtttcgtagtcaataatttccaggtttcaggtggtaaggttcatttaatcatcattcctagtcaataatttccagatttccttctctactacatattcacatgatggaactaaaggtatatgaagagattaaaacttgtgtgtgttaagtagaatccaattcagataaactaacaagtttctactaggcaacttgtaggaaatgagaacaagacaggtttcatttaatagcatattaaatttataatatttaataggctaaacatctggtttattttacagcaaagcaacttacccatgcgaaagccatccaggttcagatccatcttcggtgctaagctgggaacaattgacatatttatattttagcaagttcagaaaaaggttagaaaactagaatatgaacaattgatattatccccgcaaaaaaaaagaacaattgatattatactgctgatgtaagttctctattggtcgagaatttgggttgtcctgaacacacaaaagccccagatggatacaccgtgaaatttcatcaagtgagcaactccctgagattgacgagtcgactaaatcctttgtgttctgatctttccatgaactccatgcctgaataaataaaaaaaaggatataattcttaagggtgtgtttggcaaatgggatatgggaggtgggattagaaaatggaaatggatgaatggctaggattaaatgaggtgtgaagaatggatggttaggatgcaatattgccctttagagggtgagatattatttcccaatcccatttgccaaacaaagcctaattgcacaaaagttaaaataaattttgagactttgaacattttgcagaacttacgaaagctatgagattgagaaagtctgtgattcggtgtggatggctgatctttaagccagaaacaattttcaaaagtaacacaccgaagctaatataggacttcaccgaacaagtgccttccaatgcatattcaggtgacatgtaaccactgtttgatgaatcatttcccagaaagaaacacaattgatttagttttcagtgaagattattaaacttaagtacaatttacgtatgaaattactcactatgttccaactaatcggttagtatttgcttgttgttgggcactaccaaaaatcattgccatgccaaaatctgataccttggggctcatgtcagcatccagcaatttgttgctagctttgagatccctgtgaactactgttaatcttgaatcttggtggagataaagaagtcctttggctactccctttattgtcttaaaccttgttggccaatcaagcattgattttcttgcatctgcgtttgagaattttcttgcatcatctaccaaggatagaaatcaataaaaaaaacataatcagccatgcatgttacttaactaattatttattgaaaagaattttatgcattccaaaaggagatgattacgtaagtttaaagaaattaagcagtaagtaggtaacaaagtgggtggtttgctttaataaaagttctttagaatctctataacttttttacaggagtttattttagagaagaccttatcgtctgatctatctttgccatcataatcaccagaacatactgaaacggaaggcatctaagcttttgttgggcaagtattcataaatcaatattttttcttctccgcgagtacagcaaccaagaagcttaactaggtttctgtgttgcaacttggcaattagaatcacttcattctgaactcctctaatccttggccagaactcttgcttagccttttcactgcaatctcagtaccaccttccaatgttccctgccaagttgcatatcatttaaacaaataaaatgggcataagttaatagagcaagtatatcctacaaactttctaccaatataagaattatcattaccttgtaaaaattgccaaaacctcctcgcccgagaatattggaatcagcaaaatattgggttgcaacagtaatttctctaaagcttataacaggaaattctacctttgtttcccccaagtccttctgaaacactcaaagctctttgcatttgtctttttgaaatctcctagttttcttgtttgcctgataagaatagtttgcaatgccttaaaaaaaacttgtgaattcacaaggacaacatgagtacatgactgttaaaaagtgaagtggctaatgcaactgcagttagacaacatggagagaaaaaaaaaggataagcggatcagaatataactaaaaactccgcttcacctttgcagttgcagatccatacaagccatagacataagagcatcagcaagcttgacacaacaggcagtactatttccattatcctccatttgctctttccgaaattaattcctggtgagaatcaggatttcaaaatatttttttaaaaggatttcaaaatatctactatgagaaaatttaaacatcaagaatttttatttattaacataataaacatttaccatgaaaaatatattattccaatttccatcctctggcaattgcttgtgggggttcgaattaaagtcaagaggacacaaatgttaattaataagtaatatccacatagtttcttttgtatgtcttcatgagaacagaccttggtttcagaataaacaacttgatcatgcctttttttctctcttcctgcaggccatttagtgatatgcccgaagtgaccaacatcaaggtagaggagaacatccaatacaaatttcacacaccaactacattttatcctacctacaactggactggcaagccggagatataaattctcaccattttcaccaagctttgctgtgtcaataagctctcccatccatagcaagcactggggtggaagtaaacttgttgaattggtgtaagcataagctgtgcacgaacagttcctactgcataacactgtgcactcctcaaagcttataccactgatgtacacgaacttatctggcaatttcatgccaggcaacagcaagaaatgctcatgatcaccacatcgcagctcctcctttctcgacagccttgtgaggagttaccggagacaggttcaaatccatcaaggcacttgcatgtatggacgcctgtcaagtcgcaatgaccatatgggccacatgagccatagcgaccgcaaccttgaacagataagatgtactgtactgcccacagtgagtgaccagggtcccagctcagaaactgcactttgccggagctgtccagtacaaagcgcacacttgttgaactgtacgatgtagagatcatcaggtatgagtaattcttatccctgataggagccaaatacaacaaaaagctttttgagtaaaggtccattccacgttgagcctgatccacgccaacagggattaaatccatgccgcacaaagagctgagggtatggcttcaagccactaccaagggagaagtcaccattggaagggtcatcggggctcttccaagaaatgaaagggctcaacggcaatatgatcatcacggagcaaccagattttcatgccaggtaggaaagtgtcagttgggcgatcaaagttctcccacatgatggttccatcgaatgaccggatgaccaggttccccgtgttaagcaacaccgtcgcggatgatctagtacctccaccagcaatgttcttgctgctgttcatcttccatagagtgccacctaatgaatcagacgcaactatctcgccctggtcggtcagtgacagcatcgcggacgattgattcatgatggggctgtttcgattggcaacccagacgacggtgcggttggggatgtttattgtaccaaatgccaacatacaaccttgcgcttttgaattttttttctcccttcaattaaaattccggcaggtcttctgtcgtcgttctcctaaaaaaaacaaccttgtgcttgagttgctgctgcctaaggggaagaaaccttgccaggaactcatatgagcctccccagcaggaggaaatcaagcccaatcactccccctcaattctctgatcctgaaacaaaaaaaaaagtctcaatctctactgctcactatgcagcacgaatgaggcatacatacaagaatcaagaacggacgcatcggctagtcagagaaaaaggaaaaaaaatcgttaaaatttggttaggtgatgtgtagggaggaccaattagagataagcagagaaggagaaaacattgatgttcacactccacagccggacgaatctttttgtacaaaaaaaaataagggtaaagttatcccaaaaggaatcattgctgcacacacagaagtgagaggggggggggaccttggaggtcggagtggtcgggaatggtggtgcggtggtggccggcgacctgagggttgaggcggcgaaaccacgcgaggtcggccgcacagcggcggcggcggcggcggtggtggttgcattgttcgaaatggagaaggacgaaacggaaccgcggtaaggcacggccatggtagtgctcatccggtggcgcgcgcccggggtggggtggggtggagggcggcgccgccgccggagcagcagcacggtgacgaagacgacgaggcgtttcggccggcttgggtacggacagatgttgggccgaccaaattgttgttgggctgagctgcctactatgccaaattagcagggctcgcgactgctatttggcgcgcgcacaaaaagtctactacaggtccctccaatttttggtctagtttcattcgtgtccccaaccacaaaaaaaaaagtataaagggtactccaacttctaaaaccaaggtaaatctagttccacgagagtatagatagtcaattttggttgataaggtgtctacgtgaaaagttaacccggtttttattcgaacggatgaatgtggcactctaatctaaaaatatatatatatggtgggtcccacatatcagtgagacatgtcatcttccgtctatatcttctcacacgggaggacgaatggacaaagtcaaggagctcactggtcgacacgggcacttgtgtaggacctcgctggcccacacgctaacatgtccaagtatcacgtgcggaggcactaatgtgtccgttgacctcaacgagagaggttgttgcggaagaaatagcaacctaatggtagtcgagctgctacaaagggcagcggcgtgcgatgatggatcacggcgaccgaagcatggcagctcactcctccttccatttaaccttcaccactctaattcaatcatcgtcgctacctcgctcctccttcgtgagcttcattgctgctgcagctcgcctcatgcctagggagggcgacgaggcgatggaaaagcagtggtgcgcctgaggggagtgtcactgtcgacacagctccgtgcataacctcttagactgtggtagtggagacagaggagatctacaagttcgtgccccatcggtcccgtcctctgagattgccacagatccactgtataacaacctgtcctccaaaattaaaccgcactgcctaacccatctgatgagtggccccacttacacagcacaaactaatatggttgaagcgacaaactcttataaactcgttataccctgctaaactagcaacacggtactaaacatgtgcatacagctcttaagttgattctacccttgctaaacgcggtactaaagttgtgctactcgtcattgtatcaacaacaaatcaagaaaaactcttgattcagtaattcagaaaccaattgtttcttgtctttcaatggagggatcattttatagcgcaaaacgcatgcaggcagctgttgcagctactctcatccactcagaaaatgtcactctgatttaccacagcatgagcagacggttaccgggaatgcagattgcacgatgaaatgctccatatatatcctgatgctcagcattgggttgttgctaattaatctgatcctgctttttggaccaaacttgcataatctcatctgcaggagattccgttttggggttgggatggacagagatcccatctcatgtcagaggataagttcttcaggataagttggttggtgtgcgtgtgtgtctgcaggacagatcaccattcaccaaccaaaagggccagtggctagcagtagcagaagcaagcaacagatcgatgcctttctgacggaatcgagatctgctgacttggtactagtactactgaattcatcaggaattgatttttttttcctttcttttggtgtagaaacaatcttgctgtgtttgcagccttgcaggggtcacaacaaatgcattggattaagtgattatggaggagatttagttaaccttttgcgcaggagaaagacttataataaactatgtaaaacccagtacattatcgtgggagttccgtatgataatagtagaaataacgtgtaatatagctagctagacaacgtaaggtaatagaatttgtattttttttaatcgatcattggaaaagagtataaaccacttgagttgatatggtttttgataatttaaatagtaaatagattgataatccaaaagtaaggtgatgtggctttacgagagaagaaaataaggggaataatttggactatgattaatcatctagaggatagaaacaattgagatttaatgagagaagatagaaaacattagctaggatgaagtatataaggatattgtagaaaatgatggagagatatacgttaaaatattatgtaaattatgtgcgatgatgatttaacatgttgtattttataactttaaaatataactaaatataaatgatatagcatgtttgtatgaggattaacatgtaataaaagctaatgaatgataacgtaacatctttgcatgttaatctttagaatgtaataggttgtaactctatagataatggcttcgttcggcaacactgtatgccgcatatgatagttgggtttcaactggttgtggcaaccatggcttccgaagaggcccaatatagatctaagggtctatttgggagggcttctagcagctacagcttatcctgtaatcagaaaaccccccttccaaacagtttaatttttcgtctagattctgagaagctgcaattatgtataatttagaaactaaactagagaccagaaactaaaaaaaactagctttcctaaattctcagaagctagctataaaccagctgttttttagaaatcttaagctcccctaagtacgtgaggatgcgatcgagcaagatgatacatccaactctttgcagcacccatctccacactaaggctacgttcatttgtgccgatggaacctcccctccggcagaaaaaacggagtagctcattagcgcagtgagtaattaactattagctaaaattaacttgataaatggcttaggaacttttctatagaactttatttttgcaaaaaaaacaccgtttagtagtttaaaaagcatgcgtacgaaaaatgagagataaaagtttaaaacattagatataatttattgaaagaaaaatactcctttctcttttttcattttaatatgtcattggttaattcatgaaagaaaatggaggagtacattagactttgagaagtgaatgtaatttaactagctagtttccttgtggcgaaacaaatccgctcgggttcaaattctagactcgcattatggctatttaatctttcaatggtaggtgatgtacccattaacaacgagatgcttatggtgatttcatcaatcttaatatatatcggctttatttgttgaaaatgctcataaggataaggtatacgagtgtacattcgtagaaatgatcgtattcgtattgtgagtgtatgcataactgtgtttatatcgtgcttttagaaataaagtatagtactccgatcccttcgtcctaaaagtggggatttgacaccatctaaaacgataaatatgaaaaatcatttctttagattccttgctttagacggtgtaaaatcatcaacttatgttgtctttttttttaatgaaggagggagtatactttagaagtactgtcatgggagctagcttgtgcggtgcaactccataattttattttaggtggtgaatctttttcgggcctgttcttgcgggcgggcccacctcgcagctgcgcaaagcaatccggcccacgccgccttgacgtggcctcccctggcgggcccacctcgtcgcgaccccccacagccacaaaaattcatcttccctttcttcttcttcttctctttcctttatctatctatcaatccctatctgatctactagtattgacacttgtgtgcacatacagtgtcagacagctctactctgcttcactcggtgtgtgtgtggccaatgcttctctctttgagtcactgtcatttcaccctcatgtgctaattaattactcttctatatgttcttttaacttgtcgtttgggatatcgacagtttttagtatgcatattttagcattgtatttccatgtcaagtgtgtttggcgaagattattaaaaaaacaaatgtttaaaatatgttttacgatagatcatctatcaatgtcatttttaccgatcggattatatttttaccattgttttcggaaatttgtgagttactataattttaaggtttgactgcgtgcatccgaaagcagcagtaatcgagaattactatcataaaaacttattactatggatgaaaaatcttctccaagccatatcttggatagatatgcatgcatgcatggaatagaaccatcttcatagctgctgtgcgtcactgtgctgatcttgacatatagatgtagattggccgttgatttaattagattagatagtgtttaatataataattggaacgtgtcgatcgatcgagtgggtagtggtggtagctagctgcttactgcagccgagcaatctacatcaaccgttgcctgtcaatgttgctagctactggtactactagagggttggttgttggccatacatgcggtttttatttctctccatgggctgatcgatcgattcagaggaggagaggaggacaaaacggaatcaatttcatggccgtaattgtccacacgtacatattcatttgtgctctattggcacgtgtgcggaacacgtttacgattcaacttcagttcttagtatattattgtgaggccaagagttaaaatcagagaaacagaaagagagcgtatgagctattatatatactatatattgatgcgaacaacgaaataaatatattcataaggtgatgttaagtaacgagttagatatttacaacaaacctaagatgcaagctatatttaattatttaattacttcctccatttcataatgtaagtcattttagcattactacattcagatgttaattttttattcattaacatttatatgaatgtgacaatacttgaatgacttacattataaaatggagggagtaacaaagaagccaccgaaaaatagattaagaaaagataaacctttagatcaagcaagaaaacttaaaccaaaaatagataaaaaagcagcattaagctttaaccaaagacatgatccagtcagttaaccaagtcggtggggtcgttcggctggattagtagtattatttggcgggggaacaggtgagaaacggcgggagaaagaaacaaccaacggaggtggggcccaccaggcagtgaccccacgcggccgaagcggtgggcccgagcacctcggggaacatgcggccgcggttgggctccgtcacgtgggccgtgggccccacgcgatccgctccatccacagccacccgtcccccgcctcgcctcctcggccactagttgcaccggacgccatcccagccgtccgatcttgatcgcacggtcaggaggagctcctccccgcggcgccaacgtgtggccaccggcgaaaccaaccaacggtgggaaggggagctctcgagcagaccaaatcatggtgctcccttttgctccgttttttctttttccttttgataaaaaggaaataaagaaagaat

SEQ ID NO: 44557 - DNA, 35363 bp, Oryza sativa
cgttagattcgtctcgcaaaatagcctagggtttatggaattgattttgtcagtaatctacgtttaatactcataaatagcaagattccggagggctatttaataacccgaaggatccaaacaagaccaatgtgtgaaaatgaaaattagatagagcagaactctcaatttatagaaggcgatctaagtaaaaactcagagatatggatgaatttctctctaatatgttttttggagtaattaatactcatgttatgtaagtaatgtgtttgagtgttgggtttgtatcgaaattaaaatgctataaaagggttgtttgataatcatgggagacacacatatttgttcaaaatcaagcaaagtggatcaagtggttgagaacttgagactagtggctggcatgggtgtagtatgttaggatgaatgtattgatgttgtcttgcctcctttcacttttcctcctcactcttgatgagagtacatacatgtgtatatgtgattagttgtgcagtgctcaaaagttgcttccttttttcttatcatgccaaagctagctctaaaaaaaggattcaagaataatttagctttgtagttcaaatgatgcatgtgttgttttcaacagtttggattgtccgcttgaaaatcgacacaatggactaatgctgagttcaattctacaactcagctaaactattttttccatttactgtaagcgtgtttcccaaactgctaaatattactttttcaaaaaaaatataagtctttttaaatcaaataaatgttttttaaatttttaatatttaatactcaattaacaattctttaatagctttttccgtattacatgccactgaaaatatttgacaaggaacacaccctaagagggtgaaggggaaaggggtgaagatattctccatggatggtaagggaaacttcacttgagactgatgtgaaccagctatctgatattcctgataaggtcaaatggtccatggctttgagaatgacatgttcaaagataagtaatttgaccatgagtcggcttttcagagaagccggggaaagaatagttattagctttagttggaacaaatgagtggcttcaagctagctcccttcaaaaaccatgtgtagatcaaaatttgatagtgttatcgctttaaggttcataaacatcatccatccattgtacaagagtaatataatcctgtggctgaaatttataaaactatgcatggcaaaatgatgtgcctcctttggccatttgttcgtcctcatcttctttcacttctcatatcctcttttcgggatctatacatcgtgatcttctagcgtcgttagaacttttcgccctcactagcagaccattcacattttggtcttcttgtctctatgcaattgcctcaacagtgccaccccagtcatgctgccgtactatcatctctttggactcgggaaactattctaatccctcaagaggatgttccctcgtttgctcaaaaaccatctaaacggttatgaaaaattctggaaaaatttaacaacattcatacaacacatatatacaatttcacaaaatcttaagtccaaactcaactcacacgtcgagatataaaaaagacaaattcagcgtatgaatagtagcgtattgtttatatctaaatttgtctttttttttctcgatgtatagatcgaatttgaacatgaattttggtggactagtaggtatcattatactctacattgtcaattttttttagaatttttcataattattagcatcgaatttggaagaaaaaggtatacgaggggatactgttagtgatatgccctagaggcaatcataaagatgattgtatcacatactatgtttacatatttatccgactttgttccttgaaatagataaactcattattggttaataaatatgtgattatttcatgagactctttatgttatgtgtcgctatttctaaaggatccctgatcaaatatcatgtgtggaataaatatgtttatatgatcagcacatgtattaattgatgatcatatctcatggatcatggtatagagataccaaattaataatgtggacacatgttggtgaacatattgttggatagacccaacataagacactgcaagagccatgtgtgttgtgtcatcaatgatctcatttagtgttagtgttgaatccttagacctgagattatcatggttcccaacatgtgtagtagcttacttagggactgctaaacgctgctccgtaattgggtagttataaaagtagttttcgggtatgctatgaaacatgtagtgggatatgaataatcaagatgggatttgcccctcctatggagagatatctctgggcccctcgatgttgtagattatagaagtgcatggccatgccaaaggtgattgaggagtcaatcgcaagttatataatctatcaacagattcgagtgaatgattgagctataagaggatggcacaaatctagccttgagcttaatcgatatcgtgaggcaaaggggttcatacaagtatacactagaggttcagccgatatgatctttatgtatgcccggtgggtcaatacgttctactaggggccgctgttgacgcgtggaccgaaaaggagttttcgggttacagccgagtatatatgaacttatagggtcgcacgcttaatgggccggaataaggggattggatagagatccaatatgagcttaattcagatagagatccgaataggagtcctacgggccttggaggcccgagtgatggatcctatatattcgtgaggggtgtgaccggcggaggtattgcatcacgtgagaaaccctagccgtcaattccctccccgagcaaaaccctagccgcgcgcgagtgctagcacatttgtgcgtggcgttccgtccctgtacgtgtggataccggtagaggcgccgttggtttgcggtgctgatcggcgtggaagtacggcgaggagtacgcacaaggaggagaaggtcgagccggtgcgatcgactacttcctttacatcgacgcgtgctacttcgcgagagttccttcgacttttcagcgtcttcttccgctgcgcagcgcgtcgagtggtaacgatctatgatctaatacttgcatggttcctggtttacgcgatagaaatttttgatttatgctatcgtagcctacgcgaccaatagatatcccctcgagggattagaatccactcccctttggactgcctctaggctgagttcttatctccgtttttccaactcacctcccttgttttccacgcgcatgcttttcaaaatgctaaacggtgtgtttttttaaaaaaattctatatgaaagttactttttaaaaaaatcatattaattcatttttcaaatttattttagctaatacttgattaattatgagataaacgctgctttgttttatgtgctagggagtgaggttcccaaccctcactcccgaacacagcctaagtgttatgttttaaatttagaactttattttgagagttttttttggtggggtggccggtgggggaggggttgctatatattttgtcacccaactttatctttgtatagagaaggtataaatatcaaagtttatctttgttttacaaacatgtgaaatttaacacctgaatacttggtacaatcgatagaatttattaacgcactactccgtacaatatacaacactatattattaatgcagtccaatcgatataatttaaataagattaggtatataccgttggttttttgtctttttcagtgtgttgggagacgtattgatagtgtgtgagagactgggtttggtgtttcatatgtagcagtgtgtacgggtttgtccgccatataataaaaataaagtagtgcaatcagatatactactcctatgacgccgttgagtttttgaaaaacgtttgacctttcgtcttattcaaaaatttatgtaattataatttattttattgtgacttgatttatcatcaaatattctttaagcgtgacataagtatttttatatttgcataaattttttaaataagacgagcggttaaacgttggttaaaaagtcaacggcgtcatacattgaaatatgaaatatgcagtactaaaataaaaaaggaatgcccgaaatttttatttgctaggagaatgcggatgtacggatcggaataaaatagattcctagcccaagtgctgtactccacacagcttgcagaaaatccagatcagggtggatcaaatcgtaggagaagattagtactccctacgagaagattagggcacgtacagcgggtctttttgccccgtctttgtgatgccttttatgcaaaaaaacccctggttgagtcaagcgacgggagctgcgtcctctcgcgaggcgacggcgacgacccgtgctccgaggcggaagaggcaagctcagcaccgttgtacgagctcgtcgtcccgaggcgacggcgcggcaggatcccgcgcggagagcgcgagcgcgggaaatttccccgcaaaatccaggttcgtccaactcccctcccactcccccaatccgggaaatttgcccgcgaaatccaggaaatttgctccagcatatagcgcagcaatctctcccaatctccaactcccctcgcttgatttgggtgctgctgagatgtccacggcggctgcaggtaggaagaagaagggaggcacacctgaggcctcagatgcggcggcggcagccccagcccgtaccctaggttgtggtgttgggtcggcgacggcggctctccccttcagtcgtggcggccgcggtgtcgggttagcaccgccgccccgctctctcggccgtggtggcgggccagcagtggcagcaatccctccaggcggcttccccagttattcagcgtccatggatggatttcccttccctccaccttttgatggatcctacagaggtggattccccagctcttcagcttggttggatgcgtccggtggtgatgaatcttctcctggatcatggtaatcttttattcttgttctctgttctagcagaatatgcttgtgtgatttgtttccttgtggatgtttgattcatgaactgctaatgattcttgtgggttaaaaattgccccttacatcacaagagaacatagaatatgcttgttttttcccatctgaatgcctactatgttctgtgttagaactaattttagtgttacaaagtcataaaaatcaggctttattgtacatcccctgccatgtgatgagcttctctgcattctgcaacttaaccattcacagtttacttaaatgtttataactgctaatttagtactgattggaaaaggcattctacaatttaattacttgactctggaattttttgcatcatgtagcatgttatcctaatgttattgaggttatattcaacttttgagagaaataaaaatctgatggttgtttatattatgaatttcttgtggattggatgaagctatctctagatgttactttgtttatactacctgattagtaatgtcagtaatcccttcctttgttatatggtcacagtagttagctagaaccctgtaactgaaatgaactagctgccatgagataattcgcaaaagcgagccaaactcaaatgcagagattatccctgtgatctaagatattatccaatttatttgcctcaaatatatgctattatcctgcagtgataaagatgtacatccacgtggtggtttcatgagctattttggaaatcatgcacaaaactctcatttggttggtgcgcctatttacattgctgatgctagttcaccaccagaggtggaaattttacaaggcaatgatgatggaaatggcaatggcaatgttaggactgagaagaggatactgtggacagaggaagaggatatcagattgatgagtgcttggatagagcattcaactgactctacatgtggagcagataagggaggtggccaatattggggtgaagttgttgaatcgtacaacaagactaccccacctctcagaaaaagaaatctgaagcaatgcaaggatagatggcacaagattaataggtggacggatctctttgagtgtgcttatgtaaaggctcgtagaatttttacaagtggatattctaatcaaatgtggattgatgcagcacacaaattttatgtggatgacaataaagaggcaaagctaggaccctttgtgctaatggaggtttggaaaatatgccgagaagtctcaaagtggaaaacatacaatgaaaacatgaggaatgcacgtaaaaggaaatcatttcacttggaaggagactctgaggaagctgatgacacttttgatgagatgccaaagcgaccaatgggtcagaaggccgctaaaaaggcagctctagatgcaaaaatcaagtcaaatggtttgggcagtagtgatgatggtcactcaaaggagtctcctattcagttagacaaatttgatagatatagcaaattccaggaggaaaacaatgacaagcgcatgaaactattggacagacaggaaaaaatatcttctgagaagctagaggccacaaaaattgcccaccttacagcacaagagtacaaagaaggaaggaagcttgagaaagagtcaaagatgatggagacttataacagcctcatctcacaagatacaagttcaatgtctgctgaggaaaaggcgcagcgagttagtatgatgaagtgtcttatgaaaactcttttccctgaatctgattgaacaggtaaacaattatgcaatatctgaaacttacatgttattgccacaaatatgtgtgattacaagtgtcttaggcagtcccttcagtgtctaatatgaaccttactgttattgatacagatatgtcaattttgcaagtggaggctactatctttggctatctggtgaatgccaaattatcttgctgttttttctatcctaaaccaacttttccactttttctatcctaaactctggctattggcaagttatgtttaatctttcagcaggttcagtgtatgtctcagtttatataatttttgttcatgctcaatccactaagcctattttggtgcttgttcagtgatacactatactactaatatggagtatatataatctagggaaaaagatgggcatattagccttttattgcattccttttctttttgtactctctctatatacatatgcagttatgtttaatctttcagcaggttcagtgtatgtctctatacatatacatcctgtgaggtcagttggagtgccgagaggtctcattcagtttcagtttctgaattaatgtgaatgtgatttgtaaatgcgaatgtgcacttcagtttctgttggaatgtgaatgtgcatgcttcagtttcagtttctgttggagtgccgagaggacttatttgcttatgtgaatgtgaatgtacccttcagtttctttctggaatgtgaatgtgcatgcttcagttacaggcattatgtatatgtgctcctttatgtgaatgcttcagttatgtgcatgcccgtttctgtgaatgtgaacgtgaattcaagcctcacttttatactataaaatttgctgaaggggtgattgaaaagtttggcgacgaaattagactaaaggcattgtaatataattattatatttatggttcctaaaaattattgtaatcatgtatcttattcatgcttgatagtattatttcaaatatatagccacacaatggtatacacaaacgtatttgcaattgatcaaagctacatgcaaaagcattaaacagcttacagacagatcctctgtctatgggctgtatgagctgtctttatatctgtctggatgataacttcgaggttcttggagacgaacccctatctgtgggttgtacatgcccttagtactccctcggtaaaaaaagacaaaccatggtttccgtgtccaacgtgtccgtcttatttaaaaaaattatgaaaaaaataaaaagacaagttacgcataaaatattaatcatgttttatcatctaacaataataaaaatacgaattataaaaaaatttatataagacggacaatcaaagttgaacacgaaaaactaatgtttgcctttttttttttttaaacagagagagtagggtataaataatagtactactaaacagatttgacacggaatctgatggatcagtcatcgaatcaggtaaactaagatccaaccgcgtaacaatgtcgcaagtgtataatgggtcagtagtaaggccaaaattggtccaaattaaggaattgaaagcagtctcaaaacataaaaatgaggccacatatataattatgctgttgcagggttagttttatcgcatgaatttctctaaatttgttgttgaaactggatatggtattctatttttaatacttccatcccaccattcacagtttcatcataattttatttttatgagtcacccgtatttgaaaacaaattgtaatcgtacaccctagaaaattgaattaattttaaaaattcaaataagcttgtgcttaaaagcgaaagctatatcgagcattcatttgagctaattttgaaatttacagtctgatatcagggtatgaaaagaagaaaaacggtttgatgaaataactcatggaaataatcctaaatcaaatttgaaaaattcaaatttagccatgccaagtagagatgctgcgatccccactctctctctcaaaaaaaaaaggaaagtagatactcacgatgtaaccaaggttttttgcagtcatgtttgcagtcagtgaatttcgttcgatatttatagaaattaattccaggggttagtggtcgtgaggaccaaccttttagccgaaattagaatgaaaaattatgtgccctggatgtgactctgcagaaaaaatagagaaaatgagaaggaatttaggacggagaaaagaagaacttcgaagtgaacgcaataaaccagaggacatcctccatcctaaaatttttttactaatagctatgaacatggacggagctagtggtgagtaccgggagtttttttttaacgacttgcactagatgctaagttcatattgttatagcagaaaaaaattacaatattacgatcttgtgaggtcatagctaggaaaataaagaaaaaaataaccaccacccacgcaccaacaacgccaacacactgacccaagagaaggctagcactagaccagtcatcactaaacgtgaccggttgcaactaggtcaacaaaggaactacaattgagatcgcccaaaactcaacccttacagctgacaccaaacttcactctaaacacatctttggaattgagagggagagggtgaggcactcagacgtggccaatttacataagttagaacaccggcataacagaacaagagtttagagcgagcttgcactagatgtttggaaggtttcgtaccgagagtttaatttgtgcctcctttaatttcctcaatacgaaaaggatgtagatgcaggagaatgctccactacgcagccactatcgtgggcagctaactaaacgagattaaatcacgattagtacttgtagcaggcctaataaaagaattagcaacttggttagcgagagagaaagcagattaatcaaggcaggccagggtgatgtagtggtggtaggcagcttgtaggcggagagatatgggagatgagagagtcgaaaaatatctggaggaaggggaggggggcgtggggaacgaggaatacgaggtggtcgtcacgtgggccacccccaccacctcagcgtccgccgcaccttgtggttgtggccttcctcgctcgccgcctctctcccctcttgctagcctcatgtccacggcttccaccagtcttcttccttttccttttttcttctttttttaatttctttcttcccaccatctacgactgctagcagcctactcctttcattccaataaatataaatacgtagtactacaacttaacacgtaataaaatatcttagaactattattttagtcataacggttcgaattcatagtcgtaagatatatcacatatatacttattatgcttatattgaaatgaaagagtaatacattcgtcataaaatatatcaatgaaattagtactcatcagtaaactagatgcacacaacacttaaaagagttgtttttttttatttatttattgtgaaaacaggaacgtgttctgttcgtactaccctggagtattttatttcataattttagctaacctttttttaaaaaaatatttgattttcatgagaaaaatatcaaggagtgccatttcgcaccgacaattcattagattttccaatgtcctgtttttttccttggttttatcttttgaaaaagaaattaaggtattgttttgtacatcataaaataaaacctgcaaaggtacatgttgactgtctacgcctcatactaatattaggaggcaactgcaaacaatagtgggtcaactgatattccgttcaacatatggataactctttgtttattccaaaagtataagatcacttaaatataaaagataattgagtaacatagattacattatgttaatttgctctatttcacactaaatgttttaggttttaatacatttatgtatgaatatatatgtgtccaaatttatataaatattagtgaatttggagaaatcaagaggtcaaaacattatataaatgtggaactgagggagtacaatactacctactcgataggagagctcatgaacataatacaagaattaggttaactgtaattttcagacccaaggttaaatgccctacgctgcaaccgttggcgatccccttgaaattctatctgattagaacagctgaaatactgtaacttataacaaatactcctactatccataatcaacttttgtttggagtttatgagttgtttagttgtcagccacagttaaatacaactaaggttacgcaagttgtagtatataaaagtatgatgaataaattgctagcagcaaaagttagtaaaaaattaaatcaataatatatgggacatgttattgaaaaagtatgataaaccacacaaccaaatataaaaagagttcctttgaaacacatgattgataaaacggagcaataaaaaaaggattatgcaagaatcaacgtgcaaaacatatgattatgaaacacaaaaaataaagaaatgatcgcttaattggatcgaaaaaaagatgtaggaattgtataggacagatgaactcataaaactactttttatgagattggacctcgtattaaaaatcctaaaaaatttatatgaatcgagacattcctcagaaatttcatagaattcaattagttttcaattcttcgtttcaaattatccaataggaaaaacatcctatacaaaattttaatatttttgttcaaatccacataagagaagcatgaccataaaccaaacaatcacttataaacctttaatagatcctctactgcttatgggaaagcaagttagattttgcagtgaaactgactgtgtttagttcagatcaacattgaaagtttgtttgaaattagaatgatatgacgaaaaaaattggaagtttacgtgtatagaaaagttttgatatgatagaaaagttagaagtttaaagaaatatttggaatctaaacacggcgtgaacaaggggccaaaaattgaccgaggaacaacagcaagcaaagcatataggaaagggaagggaaagacagagagagaaaaataaaagaaagcagggggaagggagggaatgtccacctggagcctccaccgccagtagtgcccgtccccagcgcatccgcagacgatcctcccttccaggctcaaaaccacaccacccccaccctagagagagaaacaaacagaccaacaatcaaacatactagtacaagtcgaggtagagagagaaagctcgagacaagctaaactagctagagagagatcatgtcggtggcggcggaggggaaggagaagggggttggtggtgggggtggtggtgcgggtgcgggggcgtgcgagctgtgcggggcggcggcgagggtgtactgcggggcggacgaggcgacgctgtgctgggggtgcgacgcgcaggtgcacggggccaacttcctggtggcgcggcacgcgcgggcgctgctgtgccgcgggtgcgcgaggcccacgccgtggcgcgccgcggggcccaggctgggccccaccgcgtcgctctgcgagcgctgcgtccgccgcggcggtggtggccgtggtggtggaggaggtggaggcgctgctggtggtggaggccgtggtggtgggggagacgaggagatgggcggcgagggcgatgaggaggaggaggacgaggacgaggaggtggtcgtcgaggaggaggaggacgaggatgatgaagacgaggagggggagggggagggggagaaccaggtggtgccgtgggcggaggaggcggaggccacgccgccgcccgtcgcgagctccacgtcgagcagcagccgggaggccgccgccaacggcgcgaacgccgccgaccgcgtcaaggtgccctcacttctccttctccctcttcctttgatttggcttcttctgatcttgcaaacctggatcactctcgccaatttgggctacacaatcacggcacggcactattcggatcgatcgatcggttgatcatttcttccgatttcggaggcaaagatcacgcgttcttgcataaggttttgatgcttcgtgtctgatgcaaatgccgatcgatgtgtctcttgcaggaggaccagccgtgctcgacgtcgcagccgagcttgtgccggtacgcgtcctcggctcaccatggcggtggtggccggagcgacgaggccacctcctcccggaacggcggtggcgtcggcggccgattccttgcctcccggcataggaagagatcgccctcggatttccgccggtcggggttggcgcagtcggtgagcggcgtgcaggggaggaattgctccaatgcggtcgttggtcgaaatgagtgagttcacaatcctactattcccaagaattcctaagcttagcaaccataatttcataaaagcaagagaaaaaaaaattcaacttatcgaacaatggcacgatgatgtagtgttcttgcaagcatgatgtgaaaatatcaagattttttttatggaccagtgcaagcatgatgtgaaaatatcaagaagtgagcaagaaagggaaaaaaaaagggtgagtaaatttttgatgtaaaagttgtagtgagaggttgataacaacctctaggtttactgtcatgaagttgctactgctgaaaaagatggctatatgcctacatcataaggagatagctttgcttgccttgcttgctgaacgccatcatatgatgcttggagtgctctgcaatcccactactgttgtagttgattgatagcaaactagcttttagattccaagagcattgcaaatctacttttccttcatccagtttgagtatattgccatgtacatggcaggtgagccagtgcggtgtcgaagtggcatcggatcgtgtcgaacattgtagtcctgtttttagtgcttatctttccaaccttttaacttgaaagggtctatgcatgtatctgtattaagattggcactaggtcgaaagatttccatgttctcctttttgcggcaaaaattgggcaaccttgatcagttagtgagtgctgttttattttaacaaggtagtaactgatgttatcctttttgttatgcagcttttcctgaggcaactgaaacaatgatgtagatgctgatgctaactacattagaaggtcacttttggtgtatccaggcatttggggggagatgtggatcactgcaaagatcaaacctccaccgagcacacacatcttcacatcttttccgtcgacaacttgcagagtcgacttatcacgcggccatcccagaactcggtagtattcataatcgcgacggcttgctggagcttgtatatgtgcccccactactttcatgtgtttaaatccctttttgtccttttggatgaggcgttctggctaacttaagaaatgatataggtttgcatttgcagtgccattcttccatggtttcactgtctgaatgcttccattgtgccctatgttcagtctcaaacttgttcagaaatcacaatcttggctgaaatgtgttgaaatctgtaaattcgatggctgtcgaatttctgtagttctcatggttactggagccagaaagagaatacacgttacccacaatttgcacaaaatgccacatgtatattctactgaacttatctctaattccaggtaggctttgtgggattaggatgggattcttgttaggatatttatgtggtcgatttcagtgtgttcttaaatggaaaaatcctgcttggtggaagaaatggataagtaacctcttctgaaaaactttgcccaaggttgaaactcttatgaggtcagtgaaagcaacacacaagtgctaataacattgaggctaagtctccttttccttttccttgttcagggcatcaaattcttcatcctgatcttcccccatcacccatgtcattatcacacatccctcaccacagaaaaaaaggacaataaaaattatataaagaaagatgcattgcatgcttgctttgtggtgtgaaagtagtagagatccattggcgtttggtaagggggacatcatgcatgccacatgcttgatgaaactgatctggagattagaatttgcttggaaatgatccacttggagaataagataagtgggtttgggtcaataggagctcaggaccgtgcaagaaggaaaaggggataataggtcctatcatttgaccctcttctcattttaaaagacctctcatttcacatggctaacctctcgtctcattttaaaagcatgtataattaatttgatacacagttatgtattttgagaaattttccacgaattacacccttcctgtttattggtgtacgtttacacgccatactatttccacagatttttcaagtcatgtcattcttaaattacacgcttttattattactagtagcatgtccatgtgttagaaccaatcatgtccatataattagggatatactataagggtgattgatgaatattagatccagtggttatgcaagcgaagacgcactgagcacggtgggagaaggggatggaaagaggacgactttgcttttacagtaatagtgaaatttgatatagacttgtttgttttttaaaaaaattacatgaattataatacctccctattattggagatctaaaaacaaaattaaaccagaccaaccgattcgtagaaagagaatagtacgcgactaaactgatccgtacaaagggaatagcgtgcgcctctagattgatcctcaaaaagagacggcccaatcacgggttactcgatcatgtggttctaaggggttgtactctgcctaaggacagtccttgcaaaaaaattggtccctctccattgctgccaaccataggagggaggatgcattgaattgaattgaagggaaagaagaagggtgggagggccatccatggccatggaatggagaggaggggaacatttgccacaacctttgctgctgcagggcagaaatcctagggaatgtggaccatgcaaaatatatgaaccatatcagttgccgatctgaaaagatctttgcacaagggaacagggaaatgtaggccactagatatccaccgcacggcatgagctcttgacagagtgagtttgttctttgacgtctactcccaccggcataaaaataaatcgtgctgggcatcaataggaatttaaaattgtaatattgacgcggttgattttataagaaatatgttttgactatacgctttaataataataataataataataataataataatttattttattgtgatttgtttttttaacaaagtttactttaagtatgattttattgtttatattttcacaaaaaattaaataagatgaatgataaatgtatgtcaaaatttagaggcatcatgtattagggcattcccaacccaatgactaggatggtgtccatagcattaaataagctgtcacttagaatgaaaaatgatgtggcaattgaataaatgaggaaaaagaaggaaatcatatcttgcatgagacatagtttctacgcaacatccaagacatcatctgagataagtaacattaaatttaagtatggaatattggtgtttgcattggaagagtagtgtctagtactagtttcttaatgatgtggagtttatggaaaccatgtttagtgtcttgggttgggaatgtccttataaaatagagggaatgctacttccttggaggcgaatctgtacggaattttcatacatcaaccccctataaatatattgatgtcatggttttagaatttttaacttcgagacatgtcaaaacgacatcagtatatttttgagaacaggagtagaagaccacaagagacctgctacaaatctgcagctcattttgcaacttaagtgcgcatgtagatatctcatgtaaatagccatgattttttaagaaaaatatcgataacatagattataatgttataagccactccactaacatgcactactaagttcaatctgcgcactgaaaaacaaatttgggcatgattggtatggtacaattcaagtattcataaccagatttgggcttaacattttgcaatatggtacatgcctattgtataaatgttgtttgcatttgaattgtaaaaatatagctccaattattgttgcttgattcccttggtttaggggtttaggcccttttagggagtaaacaaaggagctggtgagggaaaatagagataagaaatccaaagaataaaattaaaataattggtctgttttgatcataggtagactttgtcttggtgaacttggcaatcttattgggctcaccggtggttgccctggcccaagaggatctaaatcggcctagtcgaaggaggcactccatgaacctatttaaattggggacatttaagtatttaccacttttaagatgtgttaattaaggaacttttttaggcacataagtagtaactttgtatacttgggtgtttgtaattatgaaaactatactttaaatcccagtaggtggatctatacactataaatttaccatggtaccttaaaaaagggctttccttatttgaaagtgtattattaaataaacaaaagaataatacgatattaacgacatttgaaagtgtattatctaagtactagttacattaacgacatgtcatattcataacaaacatacggtggcatgctttggctgcataactgttacacataacttagttttgaaatgtactaatttcgagacaagtagaaatacaagttgcggagatgtggtttgcaaaagtaatagatgtaatatatatagtcttctctatagctactagaaattacatcgatagcagcataatcaattatttttcaattacaaacttagctaaccatcaaagatagatgattctcaacgaaaggcaggtagaattagctaaaacagagaggttatggatttttaaaaagttacttatgtgcctatatgcattctgttggttttttatatatctgtattttatcttgtcacctaagtatccctaagaaaatagaaaggttatgtttgtttccgttggttctcaggtaagatttgttcgtctaatccctaagatagagggattgaagagtattgagaaggaataatttcacatcacaatacgtgtggattaaattcccttcaaatccccctcgatttctctatgggagggattaaacaaacaagacaatatgattttgaaatacagtggtaaactggtaattaacatctcataccgacgatggcaaaagtacatcacaaattttgacaatttgactctttgcaaaaactatttttacaaatgaaccgctgtctaaacttatttcaaatctgacccttttgctcaatgccaaatcatgtggcgctgaacttagacacctcagcgccacgtcagctggcgctgaatgccgtgccacggtgaatgggagactaagtcagcgtgccaacgtacattcagcgccatgctatttggcgctgaggtgtctaagtttagcgccacacgatttggcgttgagcaaaatggtcagatttgaaataagttttggcaacggttcatttgtaaaaatagtttttgcaaagggtcaaattgtcaaaatttataaaagtacatagtatcaaagtcaaaactataagcctgtttagattggtgtcattttaaaccataccatctcttttgataaaattgatagatacatggatgcatttagtttgttactaaaatactggtaatgactaaagatttttaacaacaacatatttagcctatcctacaaaaatttgataatattattaacgtaccgaaattgtgaaaatgttcattttgatagttacatgaatagaccctacgtgaaacttctagaataaaatatgaaccacactatgaagctgtcaaagtttcagcctgattagacaaagtttgacctttcaaaatgatcaacctactgtacaagagacaagaccatacgtgcaatgcgtccatgtatctaaattaccctatttgctgtggactactccctccgtctcataatattaggattttgaatttttatttatagagtttgaccactcgtcttattaaaaaaatttcataatataagggattttgagtttttacctatagagtttgaccactcgtcttattcaaaaaatttatgaaaatataaaaaataaaaagttgtgcttcaaatactttggataataaagtaagtcaaaaaaaaataaataataattctaaaattttttgaataagacgagcggtcaaacagtgcaaacaaaaactcaaaatcctatattatggtacggagggagttctatagttacctgcctagaacacactgtctagaccatcaatgtaccagatacatccccaatcttagagacaaaagtagctagatttgtacaattaattaagtgaactactactttgcactactccagcagaataattagcaaaattctatcttccaatcaacttcgcttcagatgcgaaaaggcgacagcctttaagcctcattcaactattcaagccacttgacattctcataacagcacatacccatctgatgtgacattatgcaataaataaatttataattttatcatcaatactgtttcagatagcaatatctgtaccaaattgctatatgattctaagtccagcccagacttgggttgacccaacatgtgccgtccatccacggatttagccactaatccgcgcaatccaacggcccatatttcgtctcatatctggccagcaattgcagcaaataatttcatcctccctctgttttatattatataagtagcttgatttttctactaagtatatttttaagtttaattagatttataaaaagtatagcgatattttcgacagaaaacaaatctattattcaaatatattaattgttggttttaatggtattaattcttgaaatttgacttaaaaaaatcaaaacgaactattctaattaaatgggtttagttaattagtacttccttcatctcattttgattatcctacaagaattttgagttattctcaaattgatcatatctaagcagtgtgtctattcgcttactaggagcaattgctatggttgcatgtctattcggttatttgtacttgatcaaacttcttttaagtttgactttaaaagaatcaaaacgattaacactaattacaagggtttaattgagtactattagattaacactaattacatgggttgcctctaattattaatcactcgcgcctcatcctgcggagaagagcgaacacttctccttctctctcttcttcttccctcatccccgcgcggcctcccgcctccgcctctgctcgcgagccacccatttcccggcgacagcggcctccctccgccgccgccggcgatctgacactggcgcccgcgccaccggccgagaaaggtagttccttttccagtcctgggtaacgatccaaaggcggtttctttttttatcttctcttgtggatgataagttcgaatttttccctttcatccatggcctcctgcgatttatgatctgttgcgagacaaatcgacacgggtgtttgtgggtttggtgtgttggattcgactgtttcttggcctgaatcatctcaggagaaggaattgaatttgtggtggtggcatttgttgtggtgttctttttaggggaattgaagtgtcataatcgatttgcaggagcaggatggaaggggagatggatactgtggtgggttcatcatccaagccatgcgggccgctgacggattaccgcattccggattacatcctgaggccggatgcgcagcgggtgcttcttgatcatgcgcccccgtgccccgtgctggtgttcatcaattctggatctggtggtcagctcgggagcagcctgatcaaaacctaccgtgaacttctcggtgaagcgcaggtatatcgtctgcgtgtttggaaatgtgatttcctttcttgccttgtggcgtcaggaaaggaatgtggcttttgttatatcagttgttgatggctgctgtgttcttttcaggttttcgatgtctccgaagaggctccggataaagtgttgcaccgtttgaatgtcaaccttgagaagctcaagatggatggagacattcttgctgttcaaatttggagaactctcagaataattgtgagtgatgatgctttgaggttatattatgcagatttgcagagtaggaagtctctttggctttccatttccatttctgttgacttaaaagaggtttcaattaggttgcaggtggcgatggtacggcaagctggctgcttggggtagtcagtgatctcaagctttcacaccctcctccaattgctactgtgcctctgggaaccggaaacaaccttccattttcatttggatgggtaagtggtcagaaattaatgtgtacttaacaaatcatcttcttgtgtcaattagtttttgaagggaggtggcaaaagtgatgtacttaaactagagtccattatgtataagttgttctgtgttaaatgatcttttaaatgattcttgcctgaactttaacctgttcctgatcatggtcttgtatacttttgctgaattaaacatcgcagggaaagaagaatccttgtactgaccaagagtcagtaaaatcattccttgggctagtgaggcatgcaaaagagatgaaaattgataggtaatgccataaagatatcactttactttaagctttgacttttgccttgatcctgctcataagggttaagcggctgattaacttatttaatatttgccataaacccccaaacttgcaatcaatcaatactgaactcttttaatgaaccttaagtagttgaataattacctcttcaaatctgtttgtccttcctcccagtctaaaacatgatttcccttttatacctcattcaaacacaacagaagactacaatgtaatgtgcacatgaatgtttcagctggcatatcatgttgaggatgcgagctacaaaggaaggtccatgtgatccaatcgcccccttagagttgcctcattcattacatgcatttcaccgtgtgtcaagtagtgattccctcaatatggtaagacaatctgtccagtttttctaagttactatgtttcttgttgacgaaaattgttatatgtcaagacccaagtggcattgaatttaattcatttcctcaattggtctttttttttccccttcaggaaggttaccacacattccgtggaggattttggaattactttagtatgggtaaggctttgtctgttcatggccacttccagttatggaccctaaacagtctgatggtttggtttctagtttaccgtggaacttgatgttgcatgctagtttgtgctatgaagatgcaggcacctgctggttccatgtacggcaagtactgtgggactcatgatcactactgtcgtagtttattatatttggaaaaaagatcccaagtttcttcaagaacctagagcatatattgattcaatgactcagaaattcaaattttcatacgtgatgatctttgcaggtatggatgcagaaatttcttacggatttcattctgaaaggaagaaaaatccagagaaattcaaaaaccagctgacaaatcaggtatattatattcttattattgtgcattgtgatgatttcttttgtactgtttcgctgtgctgcagattctgaattactcgtaagtttaaaattgttccaactgaactgcctctttatttggcaggcagagacttgagacgtacaattgaccttatttagattctctatgtgctcaacacccatttcttatgtcttcctgtgggatcttactatacagaacttttatgagctatgagaagtgaggaagtgtcgaatgggaccaatacccattgcatgttactggaattcttaactgtagttgttacaaaatattgcacttacatctctagttctgtcaaattgattcctaaatatgtaatccttgatagctaatatacctgtaaatatgtgaaatttacttctatattgatttagataaatgtccctctagtcaatttcaatctggctgaatgacttaactttgccaggtgttaatccatttaatctatacagggtacatatgctaaggttggacttaaacaaggatggttttgtgcttctttaagtcatccatcttcaaggtagcttgttgatttatcattaacatatttcatggtatacctgttgtgctagttgtatacttgtattgtgttatctttgcagtcaaggtgtctctaatttaatattataccacctaactcctataaatatctgtgagtaatgtggagagagaagttatagggagtatacccactccagcatttttgggggtgttcaatgtacattgcatttacaaactacaccaatcaattcatttgtgcccttttttgttccttcatattagcaccatccttgcagtttatagattcagtccacaaaatttattgtcaaagcttaaacctgtacttggcaatgttaaatttgaaatttggtgtaatcaatttgtgtgcgttcaagttgtttccttcttttcgttttggttgtaaggttgagtgcttcatttccaggaatattgctcaacttgcaagtgtgaaaatcatgaaaagagccggtagccactggcaagaacttaacattcaccacaggtaaacattgttcattccttttgttgtactatgaattattttttcccccgtgtactgttatttgagcctactagtatgatatgatacaagaaagcttctcatttgcacttggaatattttgcttatactgtttcttttttgggatacgcaaaaggcttgcgtatcttttctattaagattggaagcagtatacattactttgaaagctgtaaaaagaactgaatcgaaaagaaaagaaaacagaagagaagaaaaactcggatatactgtttcagttttgcttccttgcaagttacaatatgttccttggatttcttgcttgcacatgttggcaacatttctgatttatgttctgcttgttgatggaggatgctaccataatctatgagcaaagttgtgacctgtgtactactgcctcttgcagcattcgatcaatcgtctgtctcaacctgcctagtttctctggaggtctgaatccttggggcacacctggcacaaggaaagtagaagaggtgagtttacatgcactacgcttgtcattcaacacgtgaatttcgcattgtagctattcacagattatttactggaaatcttcagaggaactaataatcaaacctctgtcttgaaaaaacaaaatctacagagggagctgacggcaccttttgtcgatgatagacttattgaggttgttggattccgtgatgcctggcacggacttgtcttgctggccccaaatggacatggtacccgccttgcgcaggtatgaagtatatgtaaaagtgcttccattttgtccatttgacatcccagaactgaaaaccacttcttccccattgtgccgtagtcataattttctacgtcaagaactagaactagtatagtcctctccattcaagcttatgtggacatccttcaaaatcaggcccaaaggatccgtttcgagttccacaaaggcgcagcagagcacaccttcatgaggatcgatggggagccatggaagcagcccctcccaaaagatgacgacaccgttgttgtggagatctcccaccttggtcaggtcaccatgcttgccaacgagccctgcaagtcgaagagcgtccatgacgaccaatcctcccacgcacaacacagcggccatggcaacaacgacgacgacaaggacagcatggaggacgaagatgagtgggaggatggcaggaggaagtttggtgccgcagatacattcaagatccctgacgaggttgacattgctcacctcagctgaactcagaattggtatcttttctaggttgcattcttgatgttcataatcttcttcagtaaagtgatttttgtcttcgattccttcaacattataagagtggaatttagtaattcgttcactgcaaaatttggaatgtatagaccataggtttggaacatctatagtagaacccaagttggtaacatttctgatttcttgtttattgttcagcagaaatttgtgttattttgggaagaaaataaagttattaaactgttgatatttatttttctagattgtatatttgtgtaccatttgaaatgtgttcaaattcaaatgtggtgagaagataatgactcatgcttatgtttatatccccccccccccggttccaatgtataaggcctatatttttttacacgatattcagtaacatactttgacaatccatttatttcatgttatgtttttaacaaatatgaagttactatcacatgaaagtacattgaaatgtgaatttagtgatataacacgcataatacttagcatatatatggtttatattattattagtaaaaaaattactgagtttaattttccataaaaagatgacgccctataatttgggatggagggagtaagttataagccaaaatttaaattttagaactcaattttgaattttgttttttgttttttcattgtagtttattttacactatctgcttttaattgctaataacatatataaagaaactttactcagaaatgattttttttatttgatattaagcgattcgaatattaatcatacgagtaagagaaacaagaatttttttgggaaatattattattttaatgaaaaatcgcaaaaatggtggtcatcgaagatttttcactaaaataggggcctgtcgaactgcggtagtttttattgttctttgctagttgtagtttttatttgtttcttaaaatatttggattaatgaggtattgtttatatacaaattctttattattttcattgccatttttggtttcatggctttgccgcaacttcgtgctcctttattctcctatccctacttgcgttttagcttcagttactcttccgccatcatacgtcgggttgaccatgtcgatctacaaagtgaatccacacatccttgggttctcctgaggaataaatcaaattatagaatgggatatgtattgcattatggaaacgcgagcaaaaatgaaaataaaaaattaagcaatgacatacaactaagttgttgtctatgttgggacagacggaatatcaccttccaaatgtctcttgtgaaaaggatgtagcaatttggcagcgatctctacaaccgcattttggatgctcaaaccattcaggtagacataatggattggatctccagtgtaagtttgactacacttggcgctcatactccatcaatgcttgaataattgtgtggtcatctcaggttgtgttatccttgcaccaatggaagttactctcgccgtatcgatccactttacgaagccacatttcgaaagcccactgtgggcccagtcgaattcccgtggttaaattggttctgtcaacctcccgccgttcgagagcacccgcctgttgctacacggccgttcgatagggtcctgtcgaactaccgcacttcgataggcccctattttgaaaaagagtaaattgcacccacggtgtatcaacttggcaggtgggtgcaatttggtgcaagaactagagaaacgagcgttctagtgcatcaacttcgcaggtatgtgcagtttagctaaaaaaactttataagtgattgcataaatgcaacaacttgcaagatatgtacgattttgatacaataagttaagaagttatgcgacaacttaattatttggagcacttttttatgcatattcaatttttaagttcttattttgataatatactagcgtggatttgtatataagcatatttatatttttattctaataactaataactaaaagtcaattaaactagatgtagaaattattatatttcggttgagatttaggaatgtgaagaaaacaaaaattcttaaaggtaattggttataaattggatatgcagtataattcttaaagataaaattcaatattacaaggtaatatccgtatgattgctatgtaatggcatattgatatcgtgagaaaaactcacctagcatatgcttagcttagttgatgcaccaaaatactaaattgtcaagttcttttactaaaatgcacctacttgtgaagtgttgcattcgtacgtttaattctcaagttcttgcactatatcgcactcacctaccaagttgttgtactgtgggtgcaatttactctttgaaaaatctccaacggccaccatttttgcgattttccattaagatagtaatatttcaaaaaaattcagccaaacaatgagggtgacaatttccagaaaatctgggccattcatttgggccacgtcagctagcggcgtggggagaaaaccgcgggcaggtttgagctttggcccgccgtttcgccggcgtaaccagcggcgccgcccaccgcaccgcgccgcctacaagtacggcaaccgcggccccttcctctcccttcacttcaccgagaaatgcgaagagcttagcggcggcggcgatgagcgtgaggttggcgggtcgcgtgggcggcgctcgggtggctccatcgccggcgccggcgccggcagggaaaacgcgagacggaggcgccgccacgacgtggaacgcgaaggatagggcggcggctgcggcggggggctcgctgtcgtcgaggcaggcgatgagggcggcgaatgcggcggaggaggaggaggatgatcggaggaggaggaggaagagggaggaggagtcgctgcgggcgttcatgttcatctccttctggggcccaaactcctgaggccacatccatttccatgtccattttcttgggctttgcttgtgatttttgttttcttgatttctttcttcctgccttcctcgatctccatggatcaaagacgtgaatatttttgccaacggaaaaagcatgtgatgtgaaggtttttagttttttcatctccagttcttgcctgaaaatatgatgtgtttcattgacaaattttgcgaaactcagaacctgagtttgatgtgcttgaactgtggcgcgcttttaacttttcaaacgacaaaagaagtttcaaggatcttttattcgaaatcatagatcgactaatggctgtatccaatgtttcaaggatctacctttcttcagaaactgcagcacaagtgcatatgcacaagcagaagcagaactgaacattcttcagggctctccagactccactagcttggccagcatgcatacatacatttcaccaaaaattctagtaggatttacatacatttcaccaaaagctgtggtaggatttacaggaacagaagtccaaaaaatgcggattgtggcttgccagaacaactatgctgctttgaaactgagtttgctcagcttgaagccttgaagtgcagcatgttataacctgacaataaaatatatgtagtattgatcagtaaaatgtaagatcagggaatagcagtcaacacatcacatttgcgagttgcgactaaagattgccttgttttaaatactaaatctcggattatttttgcagccaatctttcaagaatctaccttctgcttgaactggacaagtgcatatgcagaactgtctgaacattcttcagatctctgcactaatctggccaacagcccaacatatatacatgtaattaaacaaaattcccaggatctacataaacacagtctaaaactaatcctggtcttcctggccacaaccaagctctgtagtttttaatcgcagaggcaagaaaaggaaaattgatcttcagaaactgcatatgcagaaataactgaaactaagcattcttcaggttttgcactagcttggtccccagcagacgagatgcatcaccttctcgtccttctccgccctcctcctcaacctcctcgccttctcctccgccaccgacttcgccgccggcgccacctcggccggcgatccaccgccggaggagggaggtggcggccgcccggcgtgcggcggccggcggcgcgtcgtggccggctgctccgcccgcacggcggcctgcaccgccctggcgcacagcctgctcacgtaggccaggctcatcccgctctgtatctgggagattgattgctgatcagatattcagagatttatgctgcttgctcacctcgccaaatctatcttctcctgcttccactgcatctgaaagactgaaacttttttagtttctgatctgaaaggctgaatcttcttttttcctgtgttttttgagctgaaacactgaaacttttttggtttttgatctgaaaggctgaatattttttgttttttgagtgtttgatctgaaaggctgaatctttttttttcctgtgttttttgagctgaaagattagaggggaggagtagaagatcgagcagcaaaatgatcagaggacttactgaatttttattctgagatggattcaccactccaatgtgtaatgtttttggatggtgatacaaaaaaaaaatctctgaattgaaggtcatggtgatttatgcagtcgatcgcatcctgcaacttgctggacaagaatatgtataaatggaagaaatgcttattgctcaagaaatcattaaacgagataatcagtgctatgtttcctattaaataaagggactagctatatttatggcgtcatatttttcacaaaatatagtcggcatgtgtttacattgtaagtcactaaattacatatgtaattttagtgtatttacaatgtaagccccaaaattatatatgtaagtcttaaaattacatatgtaaatcctaaaattacatatgtaaatagtgtattagtgaggtgtaactattatgtaaatttatataaatatataatttacaacaacaacaaagtttaaaaagcatatcagtatgcatctacgccgtgtcagaaccaatacagcaaagcgtgtgtgctgatgccccgtgagcacgaatcttcatgccaatcctaaggttgaaaattcgactgcgtttgtggaaaaaatctatcgccataattatggccgatccattaaataaatgcattttactactttgaaagactgaaacgagacggagcagccgataaaattcttttggataatgaggtggtataaacaagaggctttaatttggatacttactttgtagtaagtggcaaaatattttttttttaatatgcaaaagtattgctatctttatattaagagtaagtggcaaaatattgtagtagaaacttaaatgttactctcttcgtttcataatgtaagtcattctaacatttctcacatttatattgatattaatgaatctagacataaatatatatatatatatatagattcattaacatcaatataaatatagaaaaatactagaatgacttacattgtaaaacggaggaagtatttattactatctcctaacaaaacaaatttttctttcaaatgccgttccaccattctcatttcgacccaagcagagatcacagtttaaatatgccaaaaaaaaaaaacagcagtagttttggagatttaacgcttctctcatctcagcaaggatatatactaaattaaaattcacgacatgagaggaatatttttttttgtttcctttcaatttgcgactcaatttatcatcatcatcatcatcatcgtggaacatttacagacacgaatcacttaatcagcatcttgatgcttgcaaagccagcttcagattcccaagtaatcaaaagttcaaaactacctacgaaatcaagcagcaaaagaagcaggatagtatcaatctaaatgacaatcttagctagggccccagcagcagctgaggtacatcaccctcctcatcccctcctcctccggcctctccgccgccatcgccgccgccggcgaggaggcgccggcgccgccatgcacctgcagcatcagggtgtccatggcggcgccgtgcagcgaccggagcgcgtagttccagcggcagaggcccgactggtccttgagcccctccaccgcgcccacgctcatcgccgccgtccaccacgccttcgccgccaccgccgccgccgcgctcgccattgctaatttgcaatgcctctctgaatcaacctctcgaacttgatctatagctgttgatgcttcgacgattcgatgaagcagtagtagctgaggagatgatcgagatggaattggattgagaagtgcaagaagagtggagtttatatagagttttcgtgggcgaaacaggaggcggggaggcgatggtttttgccgtttttctgaagaaactggaggctggagatatctgcttatgtcactcatctcatctgctaaatttggcgctatgcttctgtttttttgtttgtttttcaggtgcacaaatcataaacagggcataccaattttaaatttcagtatttgattgattgtataattattttctgagttttttttctccccttacgtttttttctatagagaacggcatttttcgccccttttgtcactgaaacacttcaccggattatttactccacgtctttaaaaatatattttctcaaaaaaaaagtttcttataccgtattgcttaaatctattgttataagttattttgctaatgctgaaaatgtaagccttacactatattttgttttcttcgagttagacaacatctggacaataaatcgtagaaatattttgtatccttttccatttttaccagttaactccgtattgtactgtcaccctagagtctggactgctaaaaggactcacggatcagacataaatcgcctgttatgctaatgaaatgattggtccacgagacagagccaccgaccgacacttggttaactgcagccgtccaaaattagttttactaatctatgttgttggacttaaaccacatgctgtcaaacactaaagattccatggccggcgccgcgtgggtgccatcctgccctgctttcatcctgcacaacggtcacaggttcagagtaggaatgtgcaatgctttctagatttgggtataagagatttatcaaatcttataagtatattataggtaaggaggcagtaatacttcttcagttttataataaagatattgggcactattcacttttgatcaacacgcgttcctccttgtctgaccccttcccttccatcttcagcgactttccggtcgtcagtgaggtgggagggggtccaactctcatccactagtagggttagttttagattttatcgggttcatcttgttttcaggttaatcctttagtttcccttttcatgatcagctcgaggtcgtcgtcaagccatcgatgaacctcttccttcggacctctttgggcgatgttggtggtggtcttcgctactattgttattctccaacaagacctaaaggtgagcttaaataagaggcttgttagctcaaacaaggcatatgggaatgagtcagttcaactcctgcgtcagccacctgttccttctccggcgaccctcctgctctagcgacggtcttcttcctcgactacgacgatggtttaaaagggcaactgaagtgtatctctacttgtctaggttgctttaacctccatccttcggaggtcccatttgggttcgcaactgggtttcatcttttgccgcttgccatggtttttctgctcctatcgttgttatctgagttctggctgttgcagttgcaagagatgcaaagtcaaggacctgattgctttttcttctcgttgttgaatcctttgcatttttcagaacttatgtgtaatttgctcattctcaagggacctctctgtaaaactggatgtattcccactttgcttatatactatatgctgatttgctgaggtagtatctcagtttatgttttaaaatcagtttatgtttttttttaaaaaaaaatactattcacttttaaatttttaagtacttcaaatactggaaatgataccatgttcttaaagtgggtatgcccaaaatataaatataaaacttttcttcactttgatctaacaatataagggcagttaatggtcaaatttcacatggagaagttaaaattgtcagttattaagaatctgagtgagtaatgaactataagaaatcgcctgatatgatgcatgcatcctggaaacttgttgcatgttggctttcttaattagttcccagccacatggttggaataaccatgaccctttttttaatcaatgattcagactcctggattggattaattgagtggataaggagcaaagttgtgggagactggcaggcctgtatgtagctatgataaaaccagtggctgcaggccatggtttccaggataccaggggcaatttgttggttgcatgattaatgcgcgtccgtttctaacacaaacggtttaattaccttcaattgctgttctttacagattgtttggctttgtttgcatccagagaagtcattgtggtggttacaaatatgcttcaacattttccacattgtctttgccaaatttgtgtatttgccgtctgcttgactgcaaaagctgaccagaagaatgcaggccatccacaatcaggttaatgaaaactgtatctctgtaattaaacatgactagaaacatatttcagaactattttttctataaaagatcagcttctaattccgagtaaagatgttcatcgatgttacaaaatgtttttaagagtggcaaagagaaaaatgccaaaaagatttcaaccaatgcacaacaagtttgattctacatttgagttttcaagcacgctgtgctacgccgagaggccgtgcttccttccttccaagcattttacagtatactacttcgtttaacaaggcacacaagctaccttggcttctttgaagaacagctatgctcacatatctgcgacagaccaaaggtaggcctcttgctccgttgcttgcttctcgttcttcagcttaaacatatccttctcaaatcctgtgaaatcacgggaatgctttgtaagtgataagagaccagactacaagatgcaaaacaaacttctaatggacacaatctgatgcctgaaccactaatattggccagaaagttgcacaagttgtccaaattcatgtatagtaccaatctaccagagaacatagtgaaactgcgaggacatgatggaccaagaaaagagaacgtgaacatgtttcaagtttctattcccttgcgcagccttcccccctattataaaaccaggtccacccaatcgtttgcagacacaaccctctggttttgaatattagggtagagaaaaatatatcttgcttgaaattggataatggacattctgctgggtctattcaataagataaaaaaagagaccgtaacaaacagcttcactgttaatccgcattatttcaacagttttttatcaggttgtcactgcagttgttgacttatccattgtgtgatactccctccattccaaattgatctacatatagtttttttttagattattcctaattgatcatcatatttgtgttcattcattaaatctattcgttatttgtgcattggagtaaatggacattgatgcatgcatctatgcacataagtatttataacccacatgcaatatcttgatttactattggctaggaaatagtggggatggtacatgcatcgagtttgttgctagagtaaatatagtatgagtgagttattagtttttcttggtcttggtgtacctatgaaatatgtagatcaatttggaatggagggagtaaacggtaagctaatctttttgtcattccaagcaacatgatgttaaataacaagaaaagaaaattgggaatgaatttggaaagcacataccattgctgcgatccactccgtcccaatgacgaccaggctttatgccgtagcggtttggaggaggatctacaccacgcttcagccagctgtgactaggtatattttggggaacaatgaagccagattctttcatcttttcatcatctcccaagtcctccagaaggaggtctgtatcattcctctgcaacatatgtacacataaatcagcaattagccaggtgaaggtgttcaagggttcaactgaaccactcaaaatcaaaagtggcagctaccttgacaagatgagccataggatcaccccaccggattctgttttttagcatggtgtcgagctcaggatcatccctacatgcaaaacaagttcaaattataaatatttgcaatgaatgtttccacaccttcacagttgacaaagaaataaacatatttaataaacacacacacacacacacacacacacacacagagatacagtgaggagagggagggagattttcaactcaacatcactagtttgttcaaggcaattaagcaagaacaacgctatcgagtaggcaaaatctgaatat

SEQ ID NO: 44558 - DNA, 3105 bp, Oryza sativa
aaggagtcatgaagaaggaataattcaatcatcatttgatgcaatctgttccatgctacttctgcaaaaagtgatctgattctgataaaaataatcatatatttctcccaagtccaactattatctttcatggatttgtctggacaagcttgcagtatgaatcaaatgcccatagagaacaccccccccccccacccccacccccaaaaaaaaaaaaaaaaacttcccattttctatggtaatcttttaaccctgctgataacaaaattgtaaagacaaatttaaatagagcattcttttggatagaagacagtgacaaccagtgagaaagtttaatggcagtaataaggcattctttgctgtaatgtttattagtacttggtggtagctgttgatatttcttagctcctgtatctttagggaccccacacgttgtaaatcttctattctgacagctccatggtaaaacttgtgcatagaacatagcgacaaaaggaacaaatgttgtttcttatccaaaaaaaaatgcatatgaggtgctcgaaaatgtaggaaacaacaggtcccttagagaataatttctatagttttgcaacaaaattctcccgatcaaagcaatgtctgggtaaataatttgcacaaaacatgtccgctaatctatatctgttgattctgttcaacccgaagcatatttgaacttccatgagccatagaacatttaaacagaaaacaattgaattctcataattcaaaagcatttatttacctttggtttcgtgtcttcctttgccttcctcatatcttcttcacttattcgttttcctggaaagcatcagaaagtgctgttagcacaaaaagtagcatgggtatataagtaaataactgaaaaaacagcagaaataagctgtgtgtagtgcataccttgtttatctcggaatactgcttttgcccctttcccaatcactgagggatcctgtgcagcaaacctatccagatgaaacataaacattattacaaatctgaccaaaaggagtaagcatctttgctgcaagatgtgaagtactactcacttgagcctctcatcctccttaatcttcctgatgtcctctttaacttcctctgctgtcatcaacccagctttcctcacctccttcggagccacttccttcctacccttccttggaggtgaaatgtccccatcacccaaagcctgccttttcagtggtggcaatttgtccttgggttcatgagagtcgtgccgcgtccgtctgcgtgggggagagaggtcttcgggctcttctgaatcatgtctcgtgcgcctccgtggtggcgagaggtctttgggttcctcagaatcatgcctcacgcgcctccatggtggcaagaggtctttgggttcttcagaatcatgccgccccttccggcgtggtggagagaggtcctgtggctcctctgagtcatgcctggtacgccttcgtggtggtgaaatgtcctgggattccttggagtcatggcgagagagcctgcgtggaggagaggggtctcgttgctgcctagacttccgcggtggtgacaaatcatcatgccccccagctacctcactaccctttggtgacggcgtgtcttgccgccttcgcctctgcctcggcggcgacagatccttacccgcagcatctctcgggtccggcgagggcgtatcctgccgctgcctccgccgcggaggagacagatccttccttccagcacccccgcgctccggtgagggcgtgtcatttctgcggcggcgaccggttaaaccaccatcggagtcctcgggggcggccacggtgacccacccgcttccgtcctcagcgatagcattgtacggccgcgccgcgcgaatcgcctccaggcggcgcatccgcttgacctcgatgtcctcgtccaccaacggtctctcatcccctgcaaccaaccaatcacaattccaatcaaatccagcacgctgcacgccagatcgaagaacaagaccaaaccacggggggaaatcaaagctagggtttgaaggctatcgcgtaccggacgacgcgggctcctcctcgatctggacgggcttgtgccacgtggggtcctcgtcgacgataagcacacctccgcccacggcggccgcgggcttgggcttcttcttcttcttcttcttggccttgccctgcgcgtcgtcggattggtacctcttgaggtactccttcatggacatggccgcgccggacgtcgaagcgtcctgctgcttcgtcgccatggccggcttctcgccgcctccgccgccgccgccgccggtgagggaaacctactggaagctacgaggtgaacaagggttagaggcggaatcggtcgcgcaccaaattcaaaattgctcgcaaaaaccgtagtgcacaagccgagaaacgattcgatctagatcccaaatccagacgaatcccaaggctaaaagggcaagccgaacgatcgagcacgaggtagcttacctgcttgttgcgtgtgcctactccggcggccgccttctctcctgcgactggaagcttggagggggggggatggatgcggcacggggagcgttgccggtggtggagtagccgagccgagcgggagagcccgtatggatggcggcggtggcggtgatggaggaggagatggaggtggacgccggcgggtggaggcggcgggggggaggatggcggtggtgggggagtggaattgctggactgggccggttggctggacgagatgatggttgatggcccatgcggcccgtctcgttttcgcatttttattacagatttgctaataactgtgtcgtcatatttttcattgaaaatttgtagtatgtgtttacttaagtcactaaattagttgtatttattatgatataaatttctaaattacatatatagttttaaagtatttataatataagttcctaaattacagatgtaattacactagttatatatatatatatatactaaatttatactataattaccatttgacatatttttatcaaaaatcagatagaccatttatatatgtgcgtacgttacagttgtataacgggatctaagagat

SEQ ID NO: 44559 - DNA, 51345 bp, Oryza sativa
  unsure (1)..(51345): unsure at all n locations
gtcaccgagaatgtcacgggggaatgtcaccgaatcccaatccatttttgaaggagggaaccatatcctctgacatttacacagtaatgttacggtgtgacattccttcaatccacaccatccattataaatcaacggccgtagattatttgacatgcaatcaaccaaactaattagtagattgtgtagtgtccctagatcagatattgcattttcaagaggcaaacatcgttgaccgatggaagaatcgacatatgatgataattatgtttcacttacttgttagatgtagcgattagcacattatcctggaggaagtgaatccctgtgcatcaattttgtgctgccatcctccgtcaaaacggggcaattctgaatcttcaaagatgaagagactgctttagtgctaacaaaaaaaaatccttcccacctattaagtacatatacctacatgatctgctagttattttgattagttagatgccaattagtctgtggccgttgatttagaatggatggtgtggatcgaaggaatgtcacgcggtgacattgctgtgtaatgtcagaggatacggttccttgaagaagagggagcggttttttagaaggagagcaactatgtttgtttttaaagtagttaataagatatttttacccttttttcatggttaaactcctacaaagtttgaccaaatctatggagaaattaagcaacacttataacatcaaattagtttcattaaacttaacatttaatatattttcatagtatatttgtttggtattaaaaacgctgctatgttttcttataaagttgcttaacttaaataaatttgactatggaaaaacatcaaagcatattgtaatataaaactgagggcgaggaaataaatatttaatggcttgtctgattcttggtagagatggaactgggtttgtggactgttatattcttctttttttttaaaaaaaaagaagaatgtgggctaggtgagtgggaattatcaaaatttggaaaaagatcctcccaaataaaattaataagtccttgaaaaaacagaacataaagaaaaaaaatagggagtgtttgtttcactacttctcaaatctttggtattagtaggatagctaatgaaatgaactgcttaagtattgtgttttaccttttttgcaagggaggaatttatcattctttttacaattggactaacttgttaaaaaatcatgtaaaattcatgaattcggatggaacacctaagtatttttcaaaataaatctactctacataatatagggcatgtttgacacaactccagctctcagccaaacagtttcagcttcacctaaaatgagagcggagttgggtggagtgctctcacaaaatgaactagagatgtgtagctaggtttagggcctgtttggcacagctccaactccaactccacctctcttggagctgaagcccagccaaacagttttagctccacctaatataagagtggagctgggtggtgcgctatcacaaaatgaattaaagaggtggagctagatttagacagcttcatataactccactcagattcaacccctgaagctaaatttaggagttgaagctctaccaaacagacccaactcctaaagttaaatttaggagttggagctctatcaaacgggttattcaggagttgcgcctggagtggagttgtggagcagtctaaacccagctccacatctctagtttcattttgtgatagcactccgcctagctccactcccattttatgtagagttgaaactgtttggcttggctccagctcaactccaagagatgtggagctagaactggagttgtgccaagcatgcctttagccttgattagaacatattgacacttttagcttttaaaaagtttgtccaaaataatatgtatttcaatggaagttaccataatatataccacaaggaatgctcactgaaatttatttttcaaaaaaataaaataaaaaacttcaaaccgagtagctagtgtctgtttatcccaactcatgttacctactactcaaatcctaggactaacaaatatttgcgcaggtgtaactctgttttttaaaagaggccacggcagcggcgccggtggcggcaaacgtggagagaaaggaagtgatggacgcctaacaataccacgaacaagagaaggagatgcagaaggatatgggagcgatggtggtggctggttgtcatcggaggtacgacgaggcccggcacaatgccctctagctacagtcgaggatctcaccgacaagaactacatgtgagttctgagggatggctggggcagaagaagaaggcaaagtttgttgttttttttttctcttggagttcagcgataattgcaatccattatttgcttttgtttcaccaggttgtggtataatgcttcattgtattttttttattggatattccacgtattgttttctttgtgttgcaataagtagttttcaagtgttgcatctatagttaaaactgtttaacccgatcgatgaaacatttctcaagagtaacgaaacattttttattttcaagatacacataactgatacatttttgttgaaacattttttattggttagagaaacagtactctacatgcgcggcaacaccatgcgatatttgtagcgctctccaaagaatttactacataagaatttcataaaaagaaaacacctataaaattcaaaatctatacaacaaataccctgaaattaacctgccccgaccaaattctaaagctcccccctccccgaattaattaattaattaaaaacctgtcccttgaaattaattggtttaattaattcttgcattacctaattacacaacctacccattaattctctctctctcgcgtaactcgtaaacggtaatagtatatgtaagagctagacgttgtggcttctgcggtttcctcctcctccggcgccggcgccggcgacgtcgtgggcggtgacgtagctgccccagaaccagtgccggctccagacgtggttcatctcctcgatgggcacccccttcgtctccggcaggaagagcgcgacgaaggtggtcatgaccagcatccacccggcgaagaagtagaagaggccgaacttgaggtggcacagcatggtgaggaacgcctgcccgatgacgaacgtcagcatcatgttgacgcacaccgcgatgctctgccccgccgacctgatctccagcgcgaacacctcgctcggcaccagccaccccaggggcccccacgaccacgcgaacccggccacgtacatgcagatgaacagcacgagcaagatggcgtacgaccgcgacatctcgccgacgcccgcgacgccgaactggagcgcgatcagcgtcccgaccaccacctgggagatgaacatctgcgtgccgccctggaggaacagcacgcggcggccgaggcggtccacggagatgatcgagacgacggtggcgaacatgttgacgaggcccgtgatcacggcggacatgagcgacgcgtcgccggcgaagccgatggtgaggaagagcaccggcgcgtagaacatgatcacgttgatgccggtgagctgttggaagcacgggatgaggatggcgatggtgagctgcgggcggtacttgcgatggaggatgttccgccatgggtgctcgatcgaggcggcttcttcgcttgccgctaccatgtcgtcgtactcgtcgtggacgtcgtccgtgccgcggatcttgacgaggacgcgcttggcgtcgccggcgtagccgcgggcgatgagggagtttggggtgtccgggaggacgagcgcgccgagcgtgatgatgagcgcgggcacgccggcgaggccgaggccgatgcgccacccccacccgccctcgatgctcgacgtcgcgtagttgatgaggttggcggagaggatgccgatggtggtcatgagctggaagccgatgttgagcatcccgcggaggttcgccggcgccatctccgacaggtagagcggcacggactggttggcgaagccgacgccgatgccgaggaggatgcggccgaggatgagcatcatgacgtcggtggcggcgccgttgagcgccgagccggcgaggaaggtgacgccgccgcagaacatggaccacttccggccgaacacccgggtgacccacgccgccacgaacgacgtcgccagcgccgccaggtacagcgacgaggtgaagagcgtcagcagctggctgtcgaacttgcagtactggttggtgtccttgctcgccttcgcctgcgcgtacaccgacgggaagaactcgctgaggaaggagtccatggaggtgacgccgccggagatgccgatgtcgtagccgaagatgaggccgccggaggaggcgacgaggcaggtgaagaacacgaacgcggtcatcttccccgggtacgtcttgccacccaccgtctggaccatcgcgccgcccgccattgccgccgccgatcagctcagctcagctcaagctcagccaagctccggcgaggagggaggaggaggaagagtaggagggggggtgtggggttcaattccttttatgggcagagaaagcagcgtcgcaatgctgtccaatggctgcactgatggatgagactgttctttctatttctgttcttgtagtttgtgtcctgacaagttgctaaatttaggagcatttgttcagagacagttctctcttggtttgttcttacagttggtttatttacccatcttttaccccctacccatgtgatgctgtgggttaagattgattaattgtaatgccagtcttatccttttcaatccatttttagacttttactatttctttcttggcctttccacaattactgcataattacaattatacctctccacaaatattttttcctagacaatattacccttccacgattctactaccgttatatgagatggtagtagaaatagatctaaacccttggatccattgagatcaacggtttagattattttctacttccagtaaaaagcaccggagtgaaggtttttttttttccaacgaggacgtctgtgctttttaattttaagtaattaaaaaaaatcaagtgacaaatagtgccccattttgcgattgtttcttgcaggtttacatcacaaaaatgcttttctgtttttgttttctgaagttatcaaatcttatttcagatattgaggaaacataattcagcgcctatatgccctaacaaatcgcaactttattatgagcaaagttgatgaaaggaggcatgtacaagagcccaagtgaagtggaagatgatgtttctgtacacaaactattctggataggatagctaatgttctgctcgtcagaaagatacacgagctgggcaattatcaaaaaccaaagccacccaaccagaaattggacatgaaagagcatatattcagcattacaaaatcacatacaaactcgaaaaacattctattccatctcagcttttactagtagaatcatatagacatggtcattggaagaattttctgacccgttggttgcggtttaatttcccacgaagccttttcatcagactcttcagggagaatgaaaggcaatgaaatctccttgatcatcagatcgccgcagaaggggcactcgctcgctacagcatcatccagctgggacctcaactgtcacaagaaacatgcatggcattagtacaagaaatgcagatctcgggatttcgtagtttggatgtgaccaaaccttgtcaattggtgtcgcactgataatagattcaccattcatgtttccgccattttcctttgctgctttcctgtccattaggctaagccgcttttggaggtccagtattttttcagcctacaggtaaatgaattcatccgtaactaattggtacaagagattgaactatcaaaataaggaaatgaacaattgaaatgttgcatagggacttacttgtgtttggctgctattacaacgagttacatgtgcgatcaaacaattcgcatgaaaggcatgtccacaaggaaacacataaaagggggccatgtgtccggtagatgtgtagcttcttcctacctggtgcagtcctccagcagtcaatattttgcgcttgcacacctgttaatgcacagtgaggagttaacaccatgatatagcagcgaagacagttagtacataagttcataaaaccatctgaatcaaaatggaaaaaataattttaagtgtacttgagaaaacaagcaataccaagaacacaaatattaaacaatatagcgtgggggtcatctttcctctttgttgcatatttgcatctttacttatttgaaacgaaaacaaggaaactcatgtaacaccatataaagaaaagaacaggcacaacattagttaaactacaccattttgggtatcgtgagcagtttcttaccccacattcctcctcacgatcaattacagtgtatctctgagcaagggcaccaatatcacttctgatgttgtctgccccacgagtagcatcatccatctcctgtttcagctgatcgatttggctgtcatagtccttgagagatttgcatatttcctcctgtttagacaatatttttcactgttaatgctgagaaaagaggtaatgcagaaaatgtggactagtaataattaacaacgaaatttattcattcagataacttttttgttaataagaaaattgcagttgtggatcttcaacagagaaatggacattaggaggaatttttctgtaaagcagctgactgcctggacttatatcttactttaaagtcatcgatcaatacgaagtctgggaaaaatggcaggatatcctcaatcttcaacaagttgttagtctctgataggaattctatagctttctttatgttctccctcttgactcccttctcttgctcaatgacatgctttgcaaccttaagccacagcttctttctaagttcttcatcatcttcaactttatctgcttctgcttttgcaagctctaagtccacctagcaaggaccaaattgagtaaaggaataagaaagcctcataaaaataagaacacttcaaaatcctacaccatcaatatgcgaaagcgcaagggatgcttattgaatggaattagtagactcttaaagaaatgatgagacttagtgaggaatgaggtttaccgttaatgcaagtgcaacagcttcttcatgcatggacatcatgctgtaaatacgaacacaagcacgcattctcttctcttgaagacatagacgcagagcatatttggggtcgtaaaagaactcagggccatttgtctgtcctttaccaaacttagtgtccaagaattgcaaaagctgagactcatcgtcctgcacatgaataaaccagagtacacatacaaaatcattagttatatgtgttgacaaatatacgcttgactggtatggcattgacaacctcataagaaccaccagaaacatgaatgatgaattgagtgcaaagtaagcaattactgctattacagtttaatgtttccaacacataaaaaagaaacatacacaacaaaattaattacatgatatttttcctactttgtaagaatataaagtgtaatttcacacacagcaagagcaacaaataatgcactactggaagagctaccttcttggcatacagtgagagcaacaaattatgcactccaggatcctcattgttcaaatcttttacacagaattccaagtacttgataacttcatgtgtttcattcctgcaagagttgaattcatcacatcatcctgattatggaaatcaagttggctacatagaattgcagtttgttccagagcttctgaacatagggagtttaggcattcttaggtttgattcgaattatcactatctgatatgggatttaagtgtaacagatctaaattcacttccaccagtagcaaaattcgtttcaatagtaacaatgtttttatatatagcattcagagttccctggtgtgataaaagacggtaaggctgtcaactgttaagatatcacataatattaaaggattcatatagtattatagcaataggggaataggaacgtataagaagccattagcatatcatacttggcatgtggttcgctcacataacgcatcattgccggtataagcttccctggattcaacttatttcttgccatcatccatgattcaacagtttcataagcatctaacatgattaaatctggagcaaatttatactgcacaaaaacaagttaaagagcaacggctagaattaaaaaatattaaatgtgtaattttgtgtaaaacagaaaatgtaaccttgttgtggtagaatcaataataaacttattttgagttctatactgcagcattcaaagaataaatgtaaagccattatgtaccacaaggtctactagaacattatgtcgctgaagaacttccaatgcctttcttgcttctccttgctgacaaagtaaatagaaaatgcataaggacttgacatctcagctaatgccaatgggttccaagtgcaaaaggtacctcatataataagtaaaaaacttgtattttcaagataactgaatgcaatgattttgaagcaattggcttcaaagaaagatgtgcaacgaactccagtaatattataaatgtttcctttccaactattctacaaagaagaatgatatagaaactacagttgctcaagagaacagatagaagggaaatttgatgttagactatggtaagaatgcaagatcatgctggcattgagcctgctcaaagcatagcctagcctgaaatatctggctggcacaagccccatcccagcacatgttacatgaactgttctataaaataatcaattagtttgtggcataaacaagctcttatcacccattataggccgataatcaaggtatgcatatctttgcttgctcaaacatattagcaaacataatgttaatactagctagcacttggcagattatactatttactattgttatgctcgacacaaattagtatttaacacctttagatgataaatgcctgacactgacctgaatgtaatgatgaaccacaatttcatgttgctcctttaaaccagcaaaataaaccagctcatccactctcccataactgcaaaaggtttcaaggtaccagttggggaacacatataatcagcaacacaacaaatggagagaacacaccgccatcttattcatgacaagtcaacagaattgcataaactaaataatgaaatattttatagtctatccattgatgcagtttgcagtcttgctgcatttccccttttaaataaatgagctattgaaggctcaaagatgatatccttcttaatagaacaaatcctactggttgtacacaaagccctgagtttaaagcaaatggacattaaatcaggtcctttgtttggcaaatgttcaacaattttaaatatagtattaatgtatggaatattaaaattatgcaggttctatccaaagatatgtaagttacctgtacaatacatatatgagaatttaaacaacctaaaataccagtgaagcatattgtgcaacaatggtaccacatacctttccaacagtctcattgttgttgcctcatctaatacatctttgctatcacttagaaaagcacggaattcatttactattgaacgatattccgagtctttagaatctgctacagcatttgacgtggctcctgtgccatcttccaacaggaggcgattaatctacaaatattgcaccaaatatactggataagcccccgcaataatcacaagtacaagtatactgaaaccaagactgaagaaagatttccaatagcaatggaacatatcttgtattacccagggccggtcctggggttttgggggcccagggcaaaaacttatatggaggcccctacatatatacataaactaatttatatatttatatagtctgataaacacataccatttaatattcgatgtgacaaaattatctatatataacattttaaaactccaatgagaaataaatagcagtagcgagcagagaagtcgaccggcggacgattgacacgagcgtggttactggcgagtcgcgatttgccaacttgctgttttcgtttgcgagacgccgagaagtcaccgagagcgcaggagcagcgtgacgtgatcgaggcggcatgacgtgagtggcgtgatgtgatcaaggcaaagcgacaggagtcaaatgaagattgcttcggcttcgttaaaacaggcctaacgatggactaaatttcattttctgtattaggctattcagctatctaacttaatatagatccatggcacgtggactagaattatacaatacatagtatatatactgtatgtgcatagggggcccctagattttgggggcctcgggtggccgcacggcctgaccccccctagggccggccctggtattacctttttctcaacaatacagaggactgtgtatctttgtattaagagcaggaaaaaaaggatacgtacaaacaatgaaaataggacaccagccttcttgtcatgaagactgttatattagtttagaaggttgaaaaacaaacaattggtaccttgtccaagtacagctcagtagcccaagttgagatcattgtaatctgcattctgtcatctttcgttaggttatcaagccttctcaacaagaaagtcctgagagcatcctgtcaagttgaggaagataattatttcataaataaaatcacaatattctcatgtatcatgtaaatagttacactagaatgaatcttagattgtaccaaagcatgacagaacatttcctctatgttttcacaatgttaacggcattatattatatttcaaattatcaatcttggaactagcaacacttgaactttgcatcagtgacaaagatcagggaaaaaaaaaacaattgaatacatcaataagcaaagatatctcagagaagctcttgacaatatcaaatggcagatgagtattttagaaagatagatcttacacaaacatgcaataatataccatattagaaagttcagactcctcacaaaaaaaaagaaaaaagaaaaaaagaagttcagactaaactacctgctcaccaacagatataaattttaagctgatctcctcaaatgataggatataattcatctgaaaccaagagaatatattttttagtatcaacgtgaacaggacaacaaaatctttttttttaaaaaaataaggaacagaattaaacagtgtgggtttaacctttgcatagaaggaagctgctatatagtactcttttgtattgaatgcagtatcagcctacaaaagagaagatatttatacaataacagaagtcattgatcatcacaaaacaaaaaaggtccagcttatcatagaggggaaaataataaaggagaaaaaagtagtgcatgggatcgaagtgcaaataaacatcacctgcactagatagacttggtccctctggaaggagttacgacaatgtgacagtgccgtagcatattctttcatgtccaggtatacttgccacatatcacgaccctcatcagatgatgaaatctaaatatatagcttcatcagcaacacaattctggactctgaaggcaattattacatcaaagcaagaatcagatagtctctaacctggaatatagaattttcatcgtatgcatagaaaagcccagttgatgcatcactacaaagtccaattattccttttgtaacttctggtgaactatcgactataagttcctccactatttgctggctgattctgttcactacctaaaaatcacaggttatgcttttgctttgtaaaggaatacataaaacaacagggaagacaaaatagtgacagaaagcaaaatgaatcacagtgaaaacagtatagattttttaaaaagaattgtaccttaatcttgtccctgatgagaagcagaaaatggaattcagacaatgcaaatgaccttggcttgataccagattctcccaattttgagtagtcaaaaaaacctttattttcgacaaagttctcatccccacttgtagagctgcaaaactaaatttagtttaacaaattactatagaaaatacagaaaaaagtaattatatggttattattatagaatgggagacaaactaataaaagaagtgctgcaagttatcccaaaggaaagaaaaaacagtgtcatattgagatcctaagagttcatggagccgaacttcataaaactgtaaaagtagttcttttatatataatcatcaaaatacacttaagtaagaaggtgcacacatgcagtgtgccagtgccaacacctggctcagtgagattggcatgcatgtctctaaagagaagctcaaacagctagcagagaattatcaagtttgaagtgcataaggtttgcaatatataaaaccctgaacattcattagatataatcttctaaggtactcatgtagtcctatagttctgttcatagataatatccagtgacatgattgacatcaagttcttgaaggcataacattgatcattaattcttgtatgactatcatcattctaccacactttatatttatattattagtaagatgacaatttgattatcttgatgagaaaactattattgtttttcctgaggccaaagtagctactttacatttccctaaagaacttatgtttaggagtgggggattacattacttgccacatttcttataaggtcaaaaggcacaccaaggctcagtctattagaaaaatatgcccactaagagaatgctagcagcttagcagttcaatgacatttggattagataacaaagaaaacataagttaataatccacttcagttacatgttacatgatggaatcaacttaaatccaaaaactacagttcacctgtgttgagctccaaaattcagttcaccatggtaaattccagctccagaaagccatccaaaatgcttagcccttctttgcttgataaagaaatgtaattcactggattccatgcaatggatacattgtcataagctcactaaaagaaagtattctagtgggtggcacaaactgtagttaccactgtatagtactgtataaatcacataaagttagggcaagtactataatgacccatatgttgcccctaagaatgccacattggattgagtgatgatgtgaaggaaagaagtgaggagagagatgatgagccacccctaaatcaagaggcaacctccacacaaatttcaagaaggatgtgagagtattagatatattggtatttgtgtactagaggtgatacattgtatggattgcctcttagtttatgagtgaataaaatagataaatttggaggtggtagtcacatctaccatagcacttgcccttatactcacctatttggaatatctcctgggagctccataaagtgtatcgcacgatcagaatagctagcaaaaacagtctgtgcaatatagttgttattagatattacatcaagagaaaatgagtaaacaaataaatcttgtagggctgaaattctggaaaccaagagaaaatcttctatagaaactgttggcatgcaatgctgctctctaaaatggcaaaaggcatcacaagctgttctaatcacgcatatctctctgtaagaaaagaggcatactgacttcgcgtagtatagcactttcgaggttactgagtcacgttattaaatcaagaaacaccgtccatgaggactttgatatccgaagtgaaaaatctgggtctttcttttcactaaattcgatctagattgctcccattacattctataatggtgtatgtctccgaaatttggagctgataaaattgagcaattgtacttacttctaatgaaccgatgcccgtgaatgagtacaaccgtgttggtgtgacagccatcacatagaaccttgtggcgttcccaaccacggcggtttccatctgcacaaccaaattcctccatcacgctcattccaaccaaataacaccaacacaacacaagtacagaaccgcagccctcgatggcctctggcaacaaactcgaacctgcaggcccttgatgccctcctgcagctcagagagcgtaaagagcgacttcacatacttctccttcttgtcggcctcgtctactgcaatctcgaagatctgcccatcctctgtccccaggatcacctccttggtcgacgctacagcaccgaaaccacaaacaactccacaatcaagaacaaatacacagcacggactgccggaatcgagacacaattcgatcgaggaacagtatatgcagtagtattagctcaccttcggtgatggtttggcggttccacgcgacggcattgacgaggacgttgcggaggcgggggagcagcttggggcgcggccacctggcgtggtggtagtacgtctcggcgccccccgggtggaccaccgtggcgacgcagtgcttcccgccggggtcgaggaagacgcggtgcacggagtgctcgccggagcggccggtcccgaggtcgagatctgcagcagcagaggagcgatcagcggaagcgcgaggcggcggcgaagatggcggctgcgagggcgaggaggggaggacgtgccatgggcgtcctcgaaggagaagtcgtggcggacgagccatccgcgggaggtgccgaggacgatgacgtcgctgccggcagccatggaggtgaccacgccatggcccctcgccgcgtgccgctcgaggggatcgacggagaagagctgcccgccgggggcgaaggcggcggcggcggcgtccatggtcgtcggagtcgcagtcgcctcgccggccggccgccgcgagctcgtcggaggcgatgcgattgcggagaggagacggctcagcccgtgggctaaacggaggagaggttttacgagccacgccttcatgggccgtggcccaatttcagaagcccaatactctggcccattattgtaagagaattcaataaacaacgagtgcccaattccaataaataccatcaataaacgtgagttctatcaatgtcatcgtacgactttatcctaaaaatatcgttgttgttagagttttgtccctttccattaaatacattgttaatcctatagcacttaacagagggatggcaataaaaccctaacgacaatagtatttttggacaaagttgtttgtacaaatgatatatcctgactaatgaaaagtgaaacccaacatacaactaaaatataccatatctgatgaatattagtcattggattcactaaataaaaaaaagctataatcaattttggccatacgatgaaacttaagtagaaaaaaacatagggtgttctgaacccttctagcaggtaagaagaactacatacgatagaaatgtacaccactgaaaaaccgatcttttgctcgatcggcgaaaattacaaatatctcggttttcttaagaaccggtgctaaagaaggtatttagcatcggttaaaatgtctaacggcacattgctattgttagtaccgatactaaagattatttgtattctcggttcaatttttgtcggaccttgtattttgtgaaactagcattcaccgatggtattttttgacttggatgtttgtcaagtacatttcttgatttttctctcaatgtaaacgggccgaaatatagttcgaatttccggcccaatagggcggcccaaatcgacccgacacgaagcccagcaaaggcaagcattccaaagtggaagtggaaccctactccgccgccggggccaccatttttttccccccgacgacacgccggccgccggtcgccggaatcgattgcggcgcgctccccaagcagcagcagcaacgcgggaggagagccgggccgccgccggggagggagcaaggtggtaagctccatccccctgactgggtttcaccctggcagctacccaatgaggagttgcgcttcttctctctgtggaatttctagagtggcttggaggaggcacgcggtggccggaggagctctgagccagcaccaccaccaccagcagcgtcacctggtgctcaggccacccgcgccgccgcccattggccttgccctcgagcgcttcttctccgcttcatcccggcgctccgccaagagatccgccgccgccgcgaagcagagcagccagccaccgccgccgccgtcgatggacggaggtgagccgttctatgtcgtccgcaagggtgacgtcatcggcatctacaagagcctcagcgattgccaggctcaagtcagcaactcggtaaaggcgacgccgtcctctttgactgctcattctagcattatgtttatgtgcattcaccatctctcctcacaaatacagaagtacaggaatcaaacacttgctctcctgtcgcatttcatttgctatgaatgtcacaccataagcagacatttgcacttcattgtagctcagctgtattccttgaacgaaaagatgggctactgctttatagtacgcattatgcagctttgttcatgcgtttcgcaggatactaaaattattgttgtggtagtgggtagagaagtaaagattaggagataagagtgatgagtgtcattgatgcaaaatttaaccttctcttgctggtaacacaacgacattaacgggtacctgtagtcaagagccatttcttatgtgaagtatatcttactaggtatgtgatccttctgtgacggtgtacaaaggctattctttgcgtaaagagacagaagaatacctcgctgcgcgcggtttaagaaatcctctttactccattaatgcagcagatgcaagagatgaattatttgatgacctagttccatgccctttccaggtaaagacgatgtatgtttgtgatttcagctttttttcagaaatatgcctctgcacttgccaatgttgcatagatatgttaacgtgtttcctattaaaggatcattctctgtgcccccatagtgtattgtgcaatgctaatttgttgatgtacagcaatttcagcctagacatttataatggatcttacctttccagttaccaagcaccacttccttaattatgttcgcattttctatatatttgtttgaccttattaccatttcactccatttcattatctgtttgaacttcaatcatgctacacattatattagaaagacatatatgatcatcatcagagtataatggcatgattaatatagtatacttaaatactgaatgccaaactgcccccaattctcagggtcttagtttttctcacatgtagtttctcataccttgaatgttgagttgatcattaagttatatccaccaaggttgttgcgttactatttgattctgtgtttgcccataacatactgtgtgccgctttttgtttcagcaacctgatggaactgggacttctactttaaaaaggccactagagatggtgagtatcgatcattttcaagctaagtgttaagatgtgtttgtgttaaaaagtgcccgctgtagaaaatgtgttgcctacatatcacattctctcaccaacaatcatttgctgaaggaaactggaccgtcaaagaaacagcccaaagtctccgaacaagaaccattacctaatagttctgtgagtatgaacaatggaatgtgctagctataaatgcttctgccttcttgcttggttatttgtcctagatattcagtactaacatttgtacttggggacttgtcttcactacaacgaaatgctgacttgttctcaccagtggacttcatcttatacagctctcttgtcttcttgaatttgatggtgcttctaaaggaaatcctgggaaagcaggtgctggagcagtaataaggcgactagatggaactgtggtatgtacacagtacacctacagtactatactggggtgctttcttaatcttcaattatcatgactaactggtgatgtgtttttactgtttgactggagattgctcaactacgggagggtttgggtattgcaaccaacaatgctgctgaataccgtgcattgatcctagggctaacatatgctgccaagaagggattcaagtatatacgtgctcaaggagattctaagcttgtttgtaaccaggtttgtgttttggttgaaccttcactacttctatttttcatgctttagcctagaatcatcaggagataactgaatgttgtactgcagtttgttgtgactatgcacagtctatcattctattcaaacattaaatttccaacaaatagaattttttaaaagcaaaatttttaatctgtgctttacttgatctgtcatgttcttcagttttcctcaccaaagaatttttttatcaaattatctgtgctgcatccatcaacataagtgcaagttgaggcatcagtacatattttgaatcaaggccttgattatcaatgcctcaatggataacaaactctgttggaactaatcactacagctcgttgaagagcttttctagcaggtggcagctctatcaattttaacgtttcttaacataagtaacatgttgactttctggagcaggtctcagatgtatggcgtgctaggcatgatactatggctgacttgtgcaaaagggttaaggaaattaagggaagatttcatacatttcaaatcaaccatgttttgagggtaggtgttccatatatttgctgtcttccacgcttgctgtattttattttatatcagctatcattccggtatggcatatgaattttggcaccacattacattatattgaattaactctttattttccattggaaattggcaactcccttatttgcccctctgaaactgcctctccaatgggcaatcatcacacttcttcatgtactattaaaatttttaaaaatcactccaaactactggaagcgagaacttcaatcactgtaccactcacgtttgcttattattatgtaggaatttaacacggatgctgatgctcaagctaacttagccgttgaacttcctggtgagaaattgctttcagaattcactttgcatgctgttacagtgacttagtgttgcacctgatatcttcctttctacagttggcgaagttcaagagcaggcgaacttcctatgacctagtgattgcgatcgagagtaatttgtgcattgcaccaacttttatcggagtgaagctatgtggcaacattctatttccagttgattcagatggtcagacccaacgactcgaatgtggggcaagtttcaccaagtttacagttagccagcatgtttgctagcttgaactgcaatgctgacatggtaatttcagtgggaggagatagtctctaaatttctgtgtaatggcgtagggatgaatgattagaactggaggctagcaattatgctcgttcccagtagcaatactacagaactgttaactatttttgagccaatatgaggtgatgcagcgagtagatccgtgtaacgaggtacagattgagattggcagtataacaaaatacaaagggatactgcagctatttctgttgcctgttcaatttatgaattgaaaggagaaaataacacgggctatgttgtttgcagtgccaaaaaaaaagtaaataaagattgtcattgctaaggatttgaagatagctacaaaaaaagggtaacaaagttgtgtcgggagtggaacaaaattgtttgagtggactttattgtgaattaaaaggagaaattaacaggggcatttttgtttgcattgtgaaaaaagtaaataaaatggaaggattggaaaatagcttaggaaaaataaaatggtaaaaaaacattatgttgagagtgggatttgaacccacgccctttcggaccagaaccttaatctggcgccttagaccaactcggccatctcaacttgttagtacgttcgtgtataatatttatttaactctgtaactcttccttgcttattgttttgttgattcaggattccaggggaatccggtttgaatttcgcgaagtacagactttccagaccgtgtcgaaaacacaaaccacttgtttttcggtcaagttcaaaaattttcaaactgaattttttttttgacaatttatttggatttcaccagtttgtatgtttagtaacagattccatgaaatctgatggtatcgctcgtgagcagattttgatgatccggtaacagattcctgtcactactgtcgattgaataatacacaatccgaacaggaactcattctaaacagggcagaagaatatgcaatctatgaagcttcacatggctgcttaaggtaatgatctgaatcacctgatgcaggaacagccaccaaacggaaggtcactcaaatgcctaaattaactctgttcttttccatgtctttttccgactgttgcaaacgcagtttatgcagaagagactgcaagcaagctcacagtcacagatggggcaaaggtgaaagctgaaccaagcaaagaaaccaaccatgcacagtatatgaacaaaccgaacaagagcataatgcgattcatatatctgacacaaagcaaggatcttcagaaatcagtttcgagtggtacagaacagaccaccacctggtgttcataagagacacgagtcataagagactgtggcaccagattacatgagttaatacaaaggcctctctactgggagagcatggatcttgactaggagaaccatcagctcctgcaggtttatgcaccatcagattggaaggggttggcaatctcgtccgttccatcggttggcgatacaagcatcaccgctgtacccctacagacctgcaacaaacagtcgttggagctgaggtgtcaggatgatgaaaccagccaaaaagaaatcaaatggcagaaacaaactagtagtttgcaagaaaccaagctcttgattttgagattatttttgtttaatcactgttttgttgtaaatctgatcgaatcaacatttccagaaaaaaaaaaaactagtgcagatttcagcaaagtgcaaaataatcgtatagcatggaaataaaaactctcagagcttccttctcttaatgaaatgatacacacatctcgtgtattagagaaaagaactatcagaactacaatcggcaagcaatataaataatataggacaaagataagtcctggatattgaaatcaatacagtcctggatattgaaatcaatactgcaaagaaacttacaataagaccaagctgtctggttttccctgatagtttcaatggatcatcttgctctacaaaatgagaaagtatgtatgagagcttcactaaactttgcaggaaaagatttaataaggcatttgttatctacaactgtaccacacctacattagcaagtagtactccctccagtcatgattgtttgacaatgggaaaactaaaatttagtctatgtgtaattattatgctgtattccagcccaatcttctttgtacataacagtagattagcaccacataaacatacaagatgcatgaaggatggaaatttcttcttagttaagattccaaatacatagatttgtgatttatactcaaaactccaaaccaatggggatcaaacaaaacaatgcaatgtatcaacatatgcagcagtacctctttcaaattcaaccgcttcatcaagcaccaagtttagaagctggtcatagcccttcaaagtccctgtaactgcagatgtagaaataccaaagttatggcctgtgatgtggtattagtgtattataacaaactgcaggataacaaaaacgagttttctggaaattgaaacagttctactgtcattttttagtctattttcaatctttatcttaatatcaatgctaatggctaacctccttgcaactactataaacaatgtcaaaacttaagatattacataaggggccgctcatctgcttgacggagtttctatttcaatatacagttagcatatgatattttaccactctgtccgtaaaatgatactgaaaaaagaaaaaaaataaaggtgaaaagtcatcatatagttatcaggatagccaaccatgagagtgccttcactatctagatgaggttagctacaaacagaatacaaggtgtaattcaaaaatatgcaatcacagaatctggtatctgtgagcatacagattgaaagtaaaaaactggaagagaaggcggtaagcttctagtagggccaaatcctctccacatgcacatattggtgttgctgaaattctgaatgaatgcaagtggaatgctggtttatatgtggtatcatacagaacactggaatcaatgtttaagggattgagcggagctcatttccagacttattcattatgaaagaatattaaggaattaggaagtgtcaattgataaagttgctactcgttaattttaactgggtggcggatggcccttggacagcaggatccatcacaagaaatgctaaaagatgaccaatttgtgacaaaaccttaatttaccaaccaccatgcttgaaaactcacaattatgtgctataagcattcagaggacatgttaaaactagccacatggatgctgcgctcgacatctcagatcattactgtggactggagctgatgcgcacagtgaattttactgaaataattagtagcttcttccaaccccatcatttagccttcagcttataagcgtaagtgaaaatttgaattttaaaactattatagagttgattttggtgatttttcatcgtagtttcttttgttcagcatttgcttttaaatcaccaagaactcatatataaaagttttacccataaattatatttttaatcgctaattaaaccgtttcacttataatgaggctgttcgagctggctataccctactctacaattttgctgcagacctaggatttcctgcccctgccactgaggtttcttggcacaaaactatacccacatctacgagtattcaagaatccagacctaaactggtgatgaaaccaaccaaccttgcctgccgccggtgagcttgacctggacgcccttgtcgacgaacttggccaggtccagcaccgtctccttgcgccccgactgctccaccaagacacgaaaccggaatcaatcccaccaaaccaaaccaagaactagcacccgggatcgatccaatcgagcacccgaaaccccaggaggggagaagagggtttacaacttaccatcccggaccttagccgcggcctctggtcgcttcaaatctgcgaggcaaggagggaaactttgtcaaatttcgctgcaagatccgagacgacggatgggagaagacacggcgcccgccggcgacggcggcggcggcttaccggagttagggggtggtggcggcggtggcggatgcgggggttgatggtgttgtgtttttctctttttttttcttctttttttttctttttctcgcaatcactttatagaggtataaggaggacttttcttattgggccttcagcccattttagagatgaagcctaattgcttcaatgtgtatgatttgaagcccaattaatggggtgttcctactgcacgcgcacgcgccagaacgggaagccgcgcgtgttcctactaaccctagcgcttaccgtgtaaaaaaacgcagtacatttttttttcatgttcgcacctctttttttttctctgagcgcgttttttttcctccgtttctttccgatttttttttaatcttttgcacacctctttacaaatgtagaattggaaagttttttattttgacttgaaattttttaatttttgtattgaaagttttttaatttgagttgaaaattttcaaatttgagttaaaagttttcaaaattgacttgaaagttttcaaatcttgacttgaaagtttttaaattttgtattgaaagtttttaaatttgagttgaaagtttttatatttgagttaaaagttttcaaatctggcttgaaatttttcaaatctaggatgaaaagttttaaatttgggatgaaaagttgaaagtttttaaaatttaacttcaaaaacttttcaaatctagattgaaagttttcaaatctggattgaaagtttttagaatttgacttcacatatatatttcttttcaatttattacttaaaataatcttcggaaaaaagacaaatcttatcttaattattatcattacctagaactaaccgaatcagttttatacgtatagagaaaaaattccgaaaaaaataaacgcgcgtctcgccagcgcaagcgctgagaatggctgaggatgagacgtgtgggccggcgcgtgcgcgccaggggcgcgtgcgcgccaattaggatttgcgcaattaatgtgatgaacaactgaactatttttgctctagtgagaacaattgaatatacgatactaccctgtcccaaaatgttgcctagatttataatggaaagttaatatattttggagcgaagataataatattttttcctaataaaaagattatcttgttttattaaaggtagagataaagttaggtacgaaaaacaagaaagtgttgcgttttaattattactaagttgaaataatgatttatcatgtattttaaaataacttatatataaaatgttttcacatggaatatactgtttagcaatttgaaaagtatgataataaaaaccaacataaaaattactatatcttaatgggggcaaatggattttttatactaaaaatcaacgaaaatagaagaagggttgactctttcatgaactctatccaaaccatgacaatttttttaaagtttttttttgtcaactatgtttcaaatctaaagtagatattaaccaactaattgttttagctatgagttgtgtatatcaatgcattaggcctgtagttttgctaatcaactactagatgttagatgtgttttttaagctactaactccgtctcaaaatatgttacatttaatattaaaatttatcataaaatacaactaatagaattttctatgaaccgttccatctcaaccaatcacaatttttctgatttaattttttcacctactttttttttcaaccaaccataactatttctcaccctaacattaatgttttaaaaaagagagtaggtagttgtattttgagatagaggaagtgataaacaactttcagaacaaacttttatgtctgaaaaacacatggttgatatgcctagttttatagtcttaacttttaattttttggaccttaaaaatactcctacattcttatagaatatagagtttaaacatttttttaacaaaatgaaacaatcccaacttcctcatagctctagatccaaaataattttgagctaatgtcattttaaacacgaaagtagctcaaaataattcttgagaataattagagttttaaacacgacattagtataagtaaaaactatgaccctagtggctcaaaatcctggctccgcccctacatccaacttttattgaataaacaaaaaggaccttaagctgtggtttttgagttttagaatttaattttaaaggtaattagtttttttttgccgctactttttctccgtcctcaattgtacccggcccttagaagcataaaatttcttcataaaaaatattattcatctttatcacatatcttcgttttagagcgagtttaatagtgtagccaacttctttccctaaaaatttagatatcatctacaaccactttaatagcctctgtatagttttatataaacatatattgcaccattaatacttggcctactttttatacatacacaatatcttatcttaaagttcgtgttatagctgggctacaaatctgcagcactttttttctttctcctcttctctctcctccacatgtacttgtagctaaccgcctataaccttctattactcttacaagcgttgcggccataaattaaagagatctctaaattaaaagtatcttccaaaaagatccaaggaattaattaaatagttggtggattgaccattgtttttttatatattttttagctgctagattatcatgagcacgcttccaaactgtcaaatggtgtgattttgaaataataaatctttctatttttcaagtttatagcatttaatacgtaaattgagtatctttttccacaagccaaacggctaatcagccaaaccgcatatccaaaattctacccacaaatttaatattgatgttaaagtttcttttgatcgtaattagtttattttggtagtaattttaagtcgttaaaaatacatatacaaaaatctcgtccataactttttccaataataagcgctatatatatcctataatcagccaataaatgaaatgattacacttaatcctggattaattctcggaggagtatgaaatgcatctgcagtaaatgctactccgatctagcccccatcatttggcttattctagccagacattatatttgcaaacaaaaaataaaaaataatttatgaataaaactttcatatatgtgttcttgacgatttaaaagcaaagactaaaaaataaactaaaatgagaaaaccacaaaatcaactgaaaattcaaattttccatgataagcaaaatcaactaaggccgtgtttagttctctgcccaaaatttttttaaagtatacgacacacatttgaaatattaaacgtagactaataacaaaataaattacagattccgcctgtaaactgcgagacgaatcattagcaaatgtttattgtagtatcacattgtcaaatcatggcgcaattaggctcaaatgatttgactcgcaatttacatgtaaactgtacagttagtttttttttgtctgtatttaatgcttcatgtatgtgtccaaacatttgttgtgacatttttagaaaaaaaaaaaggaatctaaacacaccctgaaacgatgagcccgtaaggtagctagggtagccccagctagctagctatcaccagctgagcgaggcttgctctggaagctggaaggctgactgactgactattcagctacatatatacgagcatatataagctagctcgcgagctatcctttatcttcttcttcttcttcttctttaggagatctgctcatctgatcgaaatccagctcccctcgcgcgcaactagctaatcgccattgtttcctctcttcttctctcgatcgatttgctgccggccagcgagagagctagctagctagctgcatcggcgagcgatctccgcggccggccggcagatcgaccgtcagctagcgccgacggctgcagcgacgacgcggtcgaacgatcgatcgagcacattgtttcttgtcgtctcgttgacgatctccacagatcgatcgatcgagctaattaaggcgtaagatataataccaaatgtgagctcgatcgatctgagtgaatatatattgattcccccccccccccaagttaattaatttgcacttgcattattgttgcataaatactgtcatatactcatatgctcaactatgtatgcatatgctcgtatatattatattagagttaattggggtgtttttttttctcctagatgcatgtgtgagttcattcattatttggggttacctagctagatatatatgtatctataggagcatcgatgtgccatccagcatcagttctggtgtcctgatctattagttgagtacctgtggtaaattaattaatttacgtgtaattaatatatgcaaaactaacttctcaaactaacatccaaatatacaaatgatcgttagcacagctaattaattagtgtaaaaatgtaaatgtatatatacctgaaaatatatatttataatggtaatatatatgccattataaaccagacgccgaaatgtaattaagatatatacataatcaattgtttatcgctttattattagtttggttttctactgctagtcagaaaccccctaattaatttggaacaagttaagctagtagatcacaagatagggttgggatattgcatggcttgtcatttcatacacgaattcaatgatgaatatagtatgctatgtatcatatgtaccgcatgcaagcatataggaaatatatcgatatatatatatacaattaattattaacaactggatatctagtccatttgtaaacatttgaaaatggtagctggcagatcactccatttgatacaatatgatggcttgaacaatgttttatagctcaatcaacatgacatatatatgtcacatatttaagtttgggtctgcagctagtgtaaaataaaaacatattttcttgtacatacacaatgcatgctagctttgcatcatggtacatatattttatatattattcgatgcaatcatagttttattatgtatttttcggttttactagcaactaaagctagtgtccatggtactgaggggttgatttgtaaacattatgtagaagtacgcttcttaactccttttattagaacttatatttatattaaataatacaatccataggtttgaacatgtacttcaattaactcctttcattagaagttactcctgcatgaattgagttgcaatgatcttttttttaggaagagaggcacacttctcacatttctgtcactagaaatgaaggttaaaagacaaaagtttgcgaagacaattaaatttgtcatggtaacttggtaccataaatcccaccattcagcgtgagagtcaaatccaccattctgcatacctagcaaagtctaattaagccaaagatccttcaaaattaccacactacatcattacatcaaaggagtttttatgcacacatgagaagctcaaaatgagctgcatttcaactttccaacaagaagcttccaaacagtgcagctagggtttcctgcagttgtcttgcattaagccctcaaccatacattgatccatgtacttcacaagccacccgctttaatagttgcgtcctgcatttgcacctttctttgcttttcctcctccttttgaccaagatgaaatctagctagaaacaagtgtagtgtattagttcaattggaacatttggtagttcatttcgtgcccgtttgaaacaaatcatgcattgaatgaattatggcagtggattatctacttgcttatagggataaattgaatattttgataaataaagttaacaaaaatcttaaagcaagtagtctaagcaatacaaatagtagaatatattttttagaaagcgtattttagaggcgtggagcaaataatctgtggtaataattcggtgaaatagctaaaaagaatgggggcaaacatgttgcatttcttgttttccagatagaccaaatgattgacaccacacctccaataatcattttctgtgtttctttatcaaaataatgcatccaggtcccaacacatgtgggctatataatttcctggtttcagattaaaggtacaagctaccatgaattccaaataaatattgccaagggtcactttaaaaataagtgctcaattgtttcatcatcagcacaaaatcggcattaattccttttcccctttcttctatcctttcttaaacaagttatcttttgttacaatactattcttttgcaatgatctaaattgttacttgcaatgatatatgtgttttgttcttcagggatgaagaagaaaatagcatgctgcgcatattggtggcgactgactgccatctcggctacctagagaaggacgagatccgaagattcgactcatttgatacttttgaggagatctgctcattagcagttataaacaaggtatatcttatcaaaaaatgagaacaacgtgtagcctggctggtagagagctaccaggggcatgccattggccagagtttgatccccctcaaacccaggttttctcacaattttcttctctatcaatactggtgctaaatttctccttagtatcccaacatattcgaaaaatatcttatcgaaaattgatattaattcagtttttatttttgccaagttaaatatcatcttatgtttgtgatgatcaggtttatgagtcgtttgatttttttaaaatagtagaagaataactcctggtgtttggattaacgagaatgcacaccaccattatattcctatgacctaaaaatactgaaacaaatggaccacatcaagaaaactttgtacatagaatgcagagtttcagtttcataattaagctgaaaataacaaatgaaaagcttccatcttctaccttaaataatccgagttgtttgataattgatatgatggttggagatgcactgttaaatttgcaggttgatttcatccttcttggtgggaatttgttccacgagaacaaaccttcgatttctacgctggtgaagagcatggagatcataagaagctactgcctgaatgaccatcaggtgcagtttcaggtggtcagtgaccaggcagcctgtctgcagaacaggtgcagtaaattaaattatttgatcttttcatggctgaattaacttctcaactttgttactttatctcactaggctttagctaatcatcatctaattatatattaagaaggccaagccaattatttattcctggctactgaactattattcagaacttaacacattatgatgtcattcaggtttggtcgagtgaattttgaagacccaaatttcaacattggcttgcctgttttcaccgtacatgggactcatgatggcccagcaggagtggtatggataacacatagtaaatactatttggacaaattttgaaatctcacaaacacttatgcatttctgctcatgaaagtatatcctcaaggtcttaattctttgttcaacttataacgaatttggtttctctatttgtaggatggcctgtctgccactgacatcctttctgcttgcaattttgtgaactattttgggaaggttgatcctggcagttctgatgttgatcaaatatcagtttgtccagtatttataaaaaaagtaaatttattttgttctatacacaactccaagtaatcaacaattgtaagataataattctgtgacttgtgctacttgattcagggtgcaacttctgttgctctatatggacttggtaacattcgggatgagaaattgagcaggatgttacaggtatttataataataaaaaaagagcgcatgattacgatttgaagaattctcatgtgttgtgcacatggagatgttaacttgttgattatgaataatttcacatgtatgtgcatatatcgtttttcagacacattacaaaatacagtggatgaaagcagacagtgaagatgactggttcaatctttttgttttccatcagaaaaggtatgcaaagtggctcatgattataattattctttgttgtcttttttcacttgcgcttcctagcaacaatttgtctctctaatttcggcaggagaaagggaagctcaacaaatggcatcaatgaacagctcttgccaagttttcttgacttggtaatatggggccatgagcatgaatgcctaattgatcaccaggtaacacattttgagctactgcaaatttcttactaatgtttgtcaagtgttatttttatttttaatctagctaaactttgcaggaggtttctggaaaagattttcacattatccatccaggttcttcagttgctacctcactgagcaatgctgaagcaaagccaaagaatgttgttttgttggaaatcaaggttaacactactgcagaatggtgtattgatcatactattttatcattgtctaatcacttatatatgtttcccttgaatcagggaatgcaatacaagcaaactaatataccattaaaatcagttagacctttccaatatgccgaagtaagccattttcactctctacttacttcatgtttactttcaatgagatgattctcatcagtagcataccatataggttcaattaaaagatcaattgggtgttgagctcaataacgaagcagctctttatgagcatttggataacattgtaagttttgagcccatagtttttgttcgaaaaatacttctacacagtttcttgataaacatggccaggacattgatcattcaattggagttcaataatgatatgttaaatgggaaatatcctatgaaaacgagctaagtgttgaaaactcgtgaaagtcatacctaaaagttttgtaaattcacgaaaaaaatactagatataggtgtatatatgaaatacattctcaccaaatttcaagtcaaaactcaactttatttgagagaaacaaaaatgacaaatttcagataaatagtgtcctgttaatattcattcaaaatttgtcttttttgttactcccaaataaagttgagtttgaacttaagatttggtgagaatgtatttcatatatacacatacctctagtaattgtttcatgaatttacaaaacttctaggtatgattttcatgagtttccaacatttagctcgttttcactgaatgtctgaatatgtcctcatgttaaatgggaaatatgttagaaattggatgtttgcgaattgtagttttcagcagtactattgaatacagagttatttcaggtgagcaatcttatcgataaaacagcaattagtggatcagagcccaaacttcccctagtcagagtaaaggtaaaatagggtgctcttcagaaaatattaccttcctttaaaatattgtataaattctttatgtcaaatttctgaaggtggactactctgggttttcgacaataactccacagcggtttggtcagaagtatgtcggaaaggtacctcaaccactaatatgaaatttactgatgcatacctcctttatcatatactttttttttattgaatcctttatcatatactttaactggtgtattctttacaggtcgcaaacccaaacgacattattctcttctcaagatcagctcaacagaatcgaacacgaggtacctgtttatgtttcatgaaaaatgggaatatacttcaggttaactgcactaaaataattaggaattaggaacaattttgatattaattgactggaaaaatgcatcttaatctttgttgagtaatgtgttgttcactctctctttatattgcagaacacactggtagttctgaagaatgtgaaccaaatgagctagatcagcaaagtattgaagaattaattgcagagagtaacttggtactaatttaacattctcctggtctaagtctagtagtgtatcatgttggtgtccttttaattcatggtggccaggtctattttgcttcagatatccattcctttagataattccaggttagtggaaacaaataaaaatacactggcgcatttaatccttcttttacagaatatgcagattcttgacaaaaatgacctagacagtgcactgcatgattttgtcaacaaggacgagaatatggcgtttcattcttgtctggacaaaaatattgatgcagcaaaagtaagatattaccatcatatagttccattcaggatatctcatatttgcaatgaaaaaactgtttgcttgggattgcagaaaaagttgacgtttgcaacaaaggatttgaaagctgaagaagatatagtacttcaactggatcagtgtatgcaggtacagaggaactctatttctgcatatactagatttgatttcagccaaaaataaagatagcgaaaaagggtgttgttaattcttactccataggagcgcatgaatgaagatcccctcctctccaagggaggatcagaaatcatgccgtgctctcagagcctgccaacgaacgcgctcagcgcgtttcaggaattgaagtgctcatcaaatgaggaacaagatactcatgaatcagatgaacttatcgaaatttctgtatgcattgttttcctctcttgttgcaaatatcgtcaaccagttgtaggcttgtagctcaattctagtatcattgccaaatgtcatcttgaactgcttttgctgttccatgatcaaggacaaggagcactctcaacaagcaagccagaagaggccagctcctgtcgatggaggctctcaatcttcaaggagaaaaacagacttgagttctttctaccgtaccgcaccgtcgaagaacaatgatgatggtggcaagaaaggcaaagctcctgtaagtaaaattctctgcagctttgcctctctgttgtcactattttgtagtagtcagcaacattcagatggatatattcagaactacattcaagttatctcctgtaactgctatgtacaggttatctgaagatattgctctctgtctagcagatagcaggcagatatggagccataagaagaagatgagattaggatgggaatgagatcaatggccaaaatggatagctgatgcaagccttcagctacattctattccttttgagaatttaattgaatctttatatatatctgaatctgtatgtattatccggttcatccaaggagactagactagtttgcaattactgaaacaaagaatgtgatgaccatcttgttagttgggttcctagctctagcaagcatctatggcaactcaccgagcaaacagcagaatgggcggcgccgccatggcctgtccacctggccgccggcgcgtgagatgcggcggcggcggcggccaaccggccatcttcctcctccctcgatctctgagtttccaccgcggagcggcactcccctcgccttggtttgattggactgagtggtgtagaacccagtgactcctagaagcgagctctggcggcgccgtggcttcacggcgcccagggggggggggggtctccggcgagcggttcggtctccggcgagttgccgccaccgggtgctaccgataagtgggcctcacgatcccactcgagcacgcgactggtttaattccgaagagaccctcgaactacacccgtattatcaatctactccacccgtgacaggatctcgaccgttcgatctcccctgtgcggctcagatcaaaacccgaggcgatggggaagagagattttgcaacgaaaccctccttttatcccgctcttaccaacgggtccccagaccgcaggaagacgaggagggcggcgagccggcgaccatggcggccgccggccggccggatggacgggatgcggcggtgcgggaggccacgggagtcccggaggtggatgccggggagttcagtttagtcggaaagatcagatcctggcgggactgttcaatcgctctccaggtctctgtcttctttttgttcctcctgatttgtatggaattgggggatttatgaatttatccatacccaatcgtgtttccatcgtgtgtagtaagttaaaatcagtttattttaaccgcgacgattttttttaattatgtgatttcaccatgaattgcaactaaggattgcactgtccttgttattgccgtgttcttgggctcacctaattgtgaagaaaagcaattgcagacgggatttagttgttaaatttatattggagctgcttttatgcttgttatggttgatatcaatagtgagtgatcaagatctgaagaaggtcacgccattatatgctgcatataattgaattttgttaggttcagcaacaacagcaacaacatttgggcttgcacgcttctaaacacaataaataatgcatacactttttcttgtgcgacttgtatttatctatgtgaatgctcattagtttcttgatgttatatgtaaatctgaatggcaatagttagctagttctttttgtttctagacattattttggcctaaaattgttcactttgtgcttgtaattagttgcgttgatgtcccataatctgcattgtggtctgttccatgtcaaacttgttgtcacactgatacatatttcttaacaagttctggatgtgacatgtcagtagtttcttaaaaaactaccaaatttttttgtgggctggagtaatttgagtttcgacaatggagtggtgttcacaaaatttgcttgcagtgttcatgaggtgcagggtgatttttccggtacccaaatgttccaacattgtagaaaatttatgatgagctattgagttacttgtaaaactgttttctcaacaaaataaggtataaaatcattgtgttaccatgtccatataagacaacaaccaatcatgatgttgtagaaaacatgttatacgctgttctgagacataaattcatcagtacattttctcagctactcctgggccttcgtttctccgagattttccagcatatcaaatagcattggtgttcacaactgctataaaaaatctaggatattcccttcaggcttcagccatggtttctgtcattgtagtgcagtgaattttcaaatccaaaactcactctgggattgatgtggcatctacttacttttcttttgtaacttcactactactattagtagttgcagaatcgatcatcttcttcttggatctggtcttcttcttcttgggtctcttattctgttgttgagttccatcatcatttacagacatattgggcttcacagcagcagtaccaccagccatgtcttccacagtttgtttcaatccgtttttattggcatcacctaagctatgcttggatatcttttccaaactaccatcaatactctttttattcttggtttcaccagaaactttatcaatttccttctccaacagtttattgtacctgacgcgatcactgtcctggtctagggagttccctgggtgttctatcctatgcagttcttcatcttggctgtctactccactgttagtcaaaaactttttgttccgccgaggaaattcgatcttctttgaatgactttccccgtagatatcatcaatatcttcaatggcatcatctgttttgtcttgtaagccatcttcttccttgctagttgcagatttcacttgcttttcttctaaagatgtgtcttttgggtgtctactttctgctgttgtggtattcttagaactcttttcttctgctctagtgggtgtagcatcactggagcttgtgaccttttcgactacagcattgtcaggtcttgcatttgcgttgtttgattgaacatgagtgctcttactgccgacgctcttccgttccgttgtcttgtaatcctggaacctgaccttgatctcttcaagctcggcttccttctgctgcaggagctccatcagagctgccatctggtcaggatttgtgcctgcggctctctcttccatttgtctgatgtggctgtttttatctgtgagagttgcttccatttgactgacgcggctatttttctctgcgagaactgcttccagttctttctctctgttcttcagagttgtggctgtggcttctagtcctttgatcttcgttttcaggtctgtcttctgagtccttagggaagatgttgtggccttcagttcttccaacttcctcttcatctccttgttaaacgccttctctttctggaaggataatgtagcagtgttcatgcagttagctactcattcacgggataattgttgaattaaaacaaaaacagaagctggccaggccaaataatattttgctacgcacactcttaccatcaaaccatttttctggaacacagttcatacaaattagcaaatttctaaatagtaaatgaataaatgttcggaacactatattcttagttacatggactgtgggaagcacgaagaaaacataacctagttttttttaatagatggttgtcagtcacaaacaggtttcagtgtcgcaattacatattaattgggggtaattcaagtagtgtgtaatgcatagcgctctgatttacatacccttgaaaagaaatggtcttgtctggcgatactgggactaatttttcacagattatttataaggtctagcactgaacagaatgatgttcagtttagcattctcaatggtaagaattcaaaacagagcaccctaattgttacagttgacagactttatgcatcgggaagtaatgcatagttggctcgattcggttcatattatgcttcgagcccaaaattgtgttgctaatattgttcaatacataagtgtctgcattaaaattatgcatttcagtaatgtcacaaatataaaataagtgcacatttcagagtcagcaaatgtacttgctggtattgttaaaactccaactccaaaaggacgttcttgtgcagtgagaaatggtcttttaacaccaatatattgaatgctgtagttaagtttggtgatcatggtcaagatttgtgatttaaaggagatcatcctattagagagagagagaacaaagaatggttacggtttgttagtaagaacagcttgtcaggtcgtcaactgctttaaacttgtaaaactttactctttttaagatatttttaaaaatatatcatttacttaatttttaaaaatttggagtttggttgtgaggaagaataatttcctttgcaccttctagttattacaaataacaactgagatatgaccatctggtatatgcttctttgttcgcttaaacaagacacctcagaaactaacaggtttgcaagacattgtgcaatgcaggtacatggaaatagcagtaaagtgcatcatgatccatcaccgtacctggaggaggatccgcgtggagatgagctgccggtcgcgctcccggagaagaacagcaaacgcgcggcgctccctgaccttgtgcaggacgacgacgctgagcgcggcggcggccagcgccagcagcagcagaaggacataggcaaccttcttgctggcaccgaccatggcagagcccttcgccctgtacttgctcccatccatcaccttcaccttcaccttctcctctgcacgccgcaccagctgctcccgtttgcgccgccttctcgcagtgatccctttgcaggatcttggaggagctctaccttgtttggagcaaattgtgaaagaagctagagctggagctggagcttctttcttgggtttgggaacactatagggctttggagactaccttgtgcatggaggagggaacagagatgagcctttgaggtgatgcactcatttgctgatcgatgcacatgaccttgaagtacttctaggggagtttgaggaggaggggatcgagaaaattagaaagatacacgaaatgaggtgagctattagctcgtgattaattgaatattaactattttaaattttaaaaatggattaatatgatttttttaaagcaattttcctatagaaaatttttacaaaagaacacacggtttaatagttttggaagcgtgcgcgcggaaaacgatgtgttttctccctcaatgtcactagaactgtggcataaataaaaaaaaagatcatagccttaataaaaaaaataaaagatgttctgtccattgacttgcacttactgcagagtattagctacgggagggattactactgactgcatatggatggtctaatgatgcaccggatggtccagaatgagctaagccatctgaaggttcaaaatgtgcaagtaggaagtgccgttttttttagtttgtagaaattgattggaagtgtattgtcagtcaaaccggctatcttgcggtaatgtaacttcttcctccatccaatcttgtgaaaagtcaacattgatcataatattggcattaaatgagattcttcttctatgcttctcagatctccaggcaagatgaataaatctattcatggagcagcaggcagcaatgtgagtgctccaccatgaatatattagacctaggcaggatccatcaaagacgtgcggatttgttaaccatggctagctagtatagctagttccaaagtccaaagagttgccaagaagagaagaacacagctggttgctttaatagtttgctccctctggctctatataattcttgatgttttagtcttttagacatggttgaagtcaaataattataactttgactatcaataacttttaaaatatttagtttgtagacactagaacaagacatatagattactattaaaaaatactttgataaaattaaatatttactgttttttctgtattataatagaaaaaatcatagtcaaaaatatgttttggagaacttatcgttgtccgaaacgagtactagcttattaccatgtgactctgatgtgaaatttttactttttacaagatgacatggtgacttgagatgcagcatgtgcaggctccattttgcatgcatatggatactcagtagtaaactacagagcaacagtttaatggagtatgtcacaaatggccaacaatgacataagcacaactgcaatctgcaatggaaggtgagtatatgcatgcttgcacggccatctcttctaggtggctgagagcaagtataatagagggctataagaaagctgaatgctgaggtggatgagagaggagaggagagagatgagaagcgggttgtaagtttacagccggcttaggcacaagaaccaataaaatctgtgagacagacaggtggactatatatttatagtgaaaagttaaccactatataagtgagctgatagataggctataagtaagcagttggttttattattatccttgctctgatgggctgcatgttgattctgctgcgtcggtgaaatgaacccaagaacatggcaggcatcaatcaacattccttgcatcatgaactggctagttgagtcttgtgggtggctctatgcgaattcagggaaaatagtgtcccaaaggtcaagtctaatatttcttgatggattaaagatttgtaattgcaacgagtttcagagttcagttccaatttggtgggaaactggagaaaaaaacttgttaaatgttgatttccatgctttgttcatgtgtatctcactggacgctgctttgctgaaatgtactttacctgtatctatcacaggttcagaacctgtgattgtgaggcatcatgtgaataaaggagtgattttacaagttggaaatgcatccgccagttccctttttgttcttttctgcaattccaaacggaaacatccaaactctttttttcaaaaactttttatatatatttttttaaaaaaataaaccccatttcaaagtttgtaataattaatatcatgcgctaatggcttatcccgttttttaaaaatgtaagctaaattccaaattcgaactaagccttagatctgaaactgttccagttgcaaccactaactttatatttctatcttagcgaaatgaaagctgggtcttttgcacgttctgaagaaatataatcagattttattttaacgacggaaagaggggcgaagcacacagaaaaccaaacgtgtcaaaacaagttgcaactctgaagaaagcacaaagatacaaatccatcagcatcatgcaatgcacttgactcctccagctgaccctcccagtgttccaggaagaggctattttaacctgagttttttttcttaggaaatagtatttgagtcaatacttttgaccgatgactccatcagaaattcaattcagacacatgtcagttttcaattccttggctgccaagccaattcttcctttctgctgcatcatcaaccactacaaataacagacttcactacctggttttttcagtcacctgaactcctgaagcaggcaagcaatttgtcactctgttcttgacaagaacacaagaaaaaaagcagcagttttttctctgcagcaatggtgtacgaagcagctgtggccagtgcagcaagaagccatgaacatcaggtgaggaaggagaagaagctgaagcagattggatgcagcatcctctgggctttcaggaggatctacccaacagcctccagcgcctcagggaagaaatgattgaaggttatcatgctgtgacagttgcatcatgatgtaaatacatacataacaggtcaaaagacttttcttttcttttcatagatgacaatgttaacttttcgatactcgtttgaccattagtcttatttaaaaaaaattatgtaattatcatctattttgttgtgagttattttatcactaaaaatatctttatgtatttgcataaaatttttaaataagttgaatggttaaatgtgtaagcattgtgattgtagccacgaaagaatggaacatggtgtacaatgaattgttgttgtagtcatggatcttttgatacaacatccaggtgatgatgacatgatgtatcattcagaagcacttgattacagttcggacttgtgaatgatagtgcagcacaggaaatgaaccaccaacctaggccctgtttagtttccacgcaaaaacttttcactctgtcacatcgaatgtttggacacatgcatgaagtattaaatatagacaaaaaaactaattacacatattgtgtgtaaattgcgagatgaatcttttaaacctaattgctctatgatttgacaatgtggtgctacagcaaacacttgctagtgacggattaattaggcttaataaattcgtcccgcggtttatcggcggaatctgtagtttgttttgttattagtctatatttaatactttaaatgtgtatccatatatctgatgtgacacatcaaaactttttgcccctgaatctaaatacatacctactctgttgattgccaaaaaccagaggatcgtgcaacttcctgttgatattatgaggtgatgggtgtgcggtgctggatctagcaacgttgcctgaccctctcacaaaccacaacggctagtttccaacagttataacacaagaattactcccaaaatcctacaaatatagcaacctagtattgtctatgttcagatttctagtattaggatgtgtctaatcaaataatagatcggtgtatttttggacagagaggtaataatcaattctggcatacaacaaatgtagaatgaaactataaacaaacttttctctctctctcgttcatcttgcttggcctcctacgctctttgtcatccatacaataagcaaacttggtgacagctgattgtacatcactccaacaattcacgagagaattatgattgcgatccaaatagatcgaatttcttgtgctcaaggaaataagaatgaatcatgatccaatagctagagcaaggttgtttgttaccagtaactaggatgtgtctaacccaatactaagttgctatatttttagacaaaaaaagtaataatcaatttcaacatacaacaaaatataccaagaaactagaaacaaacctcatctctctcgttcatcttgcttggcctcctacgccctctgtcatccatacaagaagcaaacttgttgacaactgattatatatctctccaatgattcatgagagaatcatgattgcgatctgaatcgatcgagtttcttgtgctcatggaaattagaatgaatcactatcctacaactgatgaaaatttccccccaaaatttcttgctgcagaacgggaatcttagatccatgatggaagaaaaatctggcatcttctaatgcacgcacttatgcacaactaatcttctactttaagcggttcaatggttgaaccacacatggtttgtctgtttaagtattcattaccttttgtagcatttcaatctgagctcgcttgacggcggaactttctaagtgttgtggtccttcttgagggcattggtaaggcacccagttctctccttggtgggaacccctgagggaaaatagggttcagaacccttggacgagcgacagctatgctcttagcatcatatccttcttgaaggcgccatctagcggtcccgtttctcgcattctctgtctcaactctcaagcaaatggggtattttttgtaaggcggcgggtttgtatgagggacgagtggatcttcttctctctcttctctctcgccttctccctctgcaacccttctcgcgggtgtgtccaaaagatcgtgatttcagctgtttagaggcatgaggcaagagcaggtgggtcagtgacagtttcgtggtaggtttggtggcgttcggtcacgcatagtggtgtcacattcggtacccgtctattggtgtgtgtaggagatgtcagcatgtggtgatgtgtttttttcctttttcctgattataagcctcccaaggttatagtcttgcaattttttttgctatatcaatatgaaacattgcactatttttgtgatattcatttttaaataaaacaagcttggtcaaatggaggcggaggtgacatccgcaatggagctttagggaggcaccaacaccgaaggggagacttgtacaaggcgaagcttgaggagacgttgaaggtggcgatgcttgaagaggatcctcgtggtgcacggcacgacggcgttggcagcagcgcttcttgtgagtaggtatcactggctaggtttgggtagccatccaacctattacccacataaaaacccccttgaagacactaaggccctgtttgtttcagcttaagattattgtaatctagattattaaattagattactctaagctgaattataataatctgacataaaataagctacgagttatttgtttctctggattattagaggcatctaagggtagtgggtctttagccactcaacaatctaaaaaaagctcctctagaggagattattggattatagtaatctggcttatagattataataatgtagcataataatctacttgtttgtttcaacttactcctagtaatctagattataataattctaagctgaatcaaacagggcctaagtagggcacctgagttcaggaacatataagaaaggatggacctcatcaaactcaaagacacaaacaccatacatccatcaggatcagatgctttcgccccaagaaattgggtcgggaatggcaagttgggctgcagaagagcaaatgtcaagacgtcgcctcactaacatggtgggccccaacctcggtatctgatagctacgtccacgggatcgaggctaggggctaccgttggtagagtgggtaacataagtccattatatcacaaccatcataaaagagtaaaagtctcatatcccaaaccatgaaccactatctcatgtacttgtatattgtttcagtcccaatccaaatgtatatccaaacacaaccaaaggggttgtttggatgagggcaatgaaactgttttttttttcacttaaaaacaagatttgtttctatttagaagaacaacaattgttattatattagttctatcattaccatatatggatgagcaaaactaaattttggtttagccaatagcatgtttggctgatgaatgctacttgattgattaaacactcatcactttcctatttctagtacgacaattcatcatctttgcatgctaactatatgaattacccaggtttatatattgagacgtaggaagtatttatttattattactcctctgacttagagtcaggctgatcagaaacacaacgggaagttttcctggttagacgggctccactaatgcattgattacgcacccgcattacaaccatacgtgcaaaggacgatgaaagagttactttggatgtactactttgtaaatttaataatacctatagcacaacactactagaggatttaactttttccactcttcaccacacatccattttacccctctcacatgagtagcaaatcttttaccactccactcctctagagtggtaaaaagtaaatattcgaaacacttggtggtgcacatgatattcagctcttcctctcccctctctaagggatttaacgttttgacactctttatcatattggtttaatctctcacaacactcttccttaatgataaatctattgtcactcacgtattcatagtgatgattggcccttattcatatgcttatccgaacatcttattactaactaaaaaataatttgtggttaagccttttatacatgtgtcgttagcaatttaaaagaaaatattgtaaacaatctatgatgaaaaagccaaaaaaatcaattttaaaatttaacttaagaagcataagcataatcgaaacaatgagtattgatcaaagacaaattttgctatatgacacctaaaatttgtttaatttgttgaacaatataaaaaaatgtgtcatggctgagagacattattttgctagatgacactttcggcttaattagagagacctaagaaagacgagaatgctcctaggaccacatgcttcaaacatgacgttagagtaaaaaagttagatattatgcaactttaaatttaccatcaccccaagtgcatcactagcatacattatatttcatcttcactccaacctcagctcaaaagaccctaagaacattctcatcttttaaagaatttccctcttcaattgagtcgaaagtgtcctccagcaaataccagtttttacgatgcctatcaatcgtgacacatttttacagtatatcttagtaaattacacaaaatttaaatgtctaatacttcccccgtttcatattgtaagactttctagcattgcccacattcatatatatgtgtgtgttaatgaattcagacatatatatatgtgcctagattcataacgtctatatgaacgtgggcaatgttagaaaatcttataacctagaacggaggtagtagcaaattttgccaaacgaatgccccgttcgaatccactaaaaataatggattaacttttggattaaagtggcacgtttttcaaactgttaaacagtgcgttttatgtgagaactcaactaatcacacgttattaccacatcgttttacgtgaaacacttttagtttgcattcatcttcctttccgcgaactctcactccgcgacgaccgaccgaccgggtccgaccgcaccacctcgcgcgagcctcacccggtcgcaaccccgacccgacccgcaaacacacaatctgctttctccttccctccctcgcggcctctgccttctgtatatacgacgtaccaccaccaccacccccccacgcgagcccgcgagccccgccgcgccgcgccaccgatctccggcgaccccccggccgccgccgccgccgtctccgccgccaccacccggagatcctcccgcgtgcctcccccctccccgccgcgtgctcccggcgcccactgccctggccccgaggtgggggctcccctgctccccgcaaaccctaaccctagccctagcccacccccggcgcgggggctgcctaggtgagtctcctgctccgtacgacgctccctgtggcctccttagggctcgtggctgtcccctagggccgcaattgaggtgtgcccttggagggggctgcccggcctctcgtggtgtgtgtttgtgtgtggtgaggtgaggtgggctggtggtgctactgctgttagccgtttaattgtgctgcatttgcgagtttgcgaatggagtgtggggggtacgtgtggtcagcttcgcgcgctcgctgtaactgaagcattcatggtttagcaacgctgtaaacggtttgagctctgatagcgcggaatgttcgcgggtctgcttaaaaaaagtgattttttagtgtgccttatatggcatgtggtctgtttgttagtgaaagaaagactttctagcttcgcggcacgttctgtcgttatgtgcgcgcttagttcgatcaggccataaggctgtcgaaccgtttgcgtgtgcgtgtttgattgggcaagtgtggttggacttggcatgctctattcttgactgggaaaatgctggcgctatgcatttattttgtctcctttttatttttggtaataaggattgcgttttccgtaaacttgatatgggaggacgccgtcacctttatgatatttagtttctactattgttttttgcatattgttgccttgttatcagcaacatggtttggttttacaggaaacaggttgcacattttgcggacttttgagaaggtcatgtccattgatgagtgatgacatggcaagctgagtagataatgcttgcagtgatgcctttgcatatcctgatcctgtgtggatactgagctgtgctctatgggaggaattgcagaatgtggtgtgaacattgatcagaaagcttcgccacgccgtgcggccatagagaaagctcaagaggagcttaggtacattgacggccatcttattatgagcctgtatatgctttctgtggattcctaatgttctgtacaaacttcaggcaagaatatgatgtccgtgaagaacgaagaagggagcttgaatttttagagaaggtatgttgcaatcggatccttatggtttggagtgtatgttgactttgcattagatcatttgtcctgatttattaatctgttattgcagggaggtaaccccttggatttcaaacttggacatgtagcatcacttagtgtccagtccacttctgttgcagatcatataaccgaacaaaatgtgataaggtgatactgattttcatggtttgtcatatgataacggtgctgccattattgtttgatacgatcctcttttctcacttgcactacagtgaagctaagggcagctttgcgtttgctgcctcaccccatggggattcagttgaaagtagtggcaagccaggaagttcatcatgccgtgatgccaacacagctgataatcttatgcttttggatggagataccagcaacacaggtggggagaaacttgtcaaatgtggtactaaacgaactaatgtatctcaacctgatgtgtccctgcgctgtgatggtcaaaacaatgtaaaagaggctgaagattctagtttgttccgccctggggcaaagaaccaggcgtatgctcgtcgcagatcgaaatcaagcagggagaatgccactgcgtctgttgggtctctaccagtttccccactatattctcaagggaaagatgcaaaagggataatacaagaaacaaaatcagaagatcatggtgcctcatctattggcaactcaaaaccagcaagtccagatcggaacaacacatcaaaggttgcttcattaggtgatcatgatgcgatggagatggacaacactaatgaaggaaaccaagcagcaactcatgaaacaacaaacttcaaagatggtgttgaaacaccggaaatctcaccaaacagtgtgaatggtaattcacagcttattggagatggtttggtagttactgcaactacttctgcagaatcccctgacacaagtccaaaagaagctgctttaatggcaacttcttcatttccatcttcatgcaatgaagtcttggaagaagcatgtgctgcggaagaagcaggtaatggatgctcagataaaaatttggttgttcatgcagatgatatggttagcaagagttctgttcctccctctgaggtagaaattgccagtttgaatgaaaatgaagcggatataccatgtgcagatgtgtctaagaccgttgatgaacatcctggaaaaagtgagaacttatcagggaaggtgtctgatgaagatttaggtgatgctataccttctgacaaggatggaaacaaagatggtcaaccagaaggtggtgacatgcccacagttgttgatggcgtttctaattctgttcaaccagaagtcagcaataccatttatgccaaagatgacgttgatgtccataacaagatggttgatgcacaaaaggatacagggaatcttgctacttctggtcttgacaaagtcgataaggaagcatgttctaatttgaaaaaaaataataaatgttctcctgattctaatattgctgataagttggattctgttaccgtggcgtctggtttgctcatgaaggacgtgcctagttctgtgtcattaatgaaccctgacaatgatgttaataaaactggtgaaaatattccaatgatggaaaagaaggaatgcgaagattctactgttgccaagaaggaacatgaagatactatccttagaagggcacgattaatagaggtacacttagaatatatacttttctgatactgcttttctgagaagaaagttaataaatacttctcaggtcaatatcaagaaagctggtgaacgatctctctgcaatatttctttggagaagaagccaaagagtcactgggaatttgtcctggaggagatggcttggatggcaaatgaatttatgcaggtattctctaaagtgatcttaataatcaattcttgttctcatgcaggctgcaagttttttatcttgtcgtgtaacatttcttttactgtatttacatattcaaagatattatgtaacatcacgttttctatttaaaggagcgcctgtggaaaagtgcagcagcttcccagatgtgccactggattgccttaagtggtcgagcaacatttgaggaagcaaacattcaaaggaaacagaaatcaattgctagaatcctagccaagagtatcatgaagttttggtgttcagctgagactttacgagctaccagtggtgaaatgcgtaaagagaagcaagcagaggagtcaattgggattggggaaacaaagctggctggaatcaatgcagaaaaagaacaggtcagcgaaatcaattttctaacattgttccttctttatattctcttacatgcaaccactttttcacttacgagacaatttaagatttcagatctttctagacaacttagaataaaatagggacattgtatttattatgttgcataagcattatttacaaacttatagcgactaacatatttgtgcttgatgtaatttacaaatctggacagtgtaacgaacctctggaacaagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 44560 - DNA, 1129 bp, Oryza sativa
gccgtgtatttggccacctttccggccagagccaactcggcctgctgtttgttgccccagaggaggacaacagggagacgatcgtcgcgcaggatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggtatttagatagcaacaaatgcttcaaagcaaccgactcgccgccaaccattcaccatccatccagccagccatccagccagccatccagccagccaaccaactatccatccacaatttgtggacacaattccggcattcaaccaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgcacggcaagtctaacctacatctaactagggaagtgctttgtatttgaggatgtgcggactctggggttctgaattgatgggta

SEQ ID NO: 44561 - DNA, 13080 bp, Oryza sativa
  unsure (1)..(13080): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatatgcaagatagttaaaaaataaatgaaaatatggtgatacctgcaacgtgaccactggcgcaagcgtcagcaaccgcctgggtatccatgattgctccacgagcattgttcacaatggtcacacctttcttcatctttgcaatcctctctttgttaaacatacctctgaacaaaaaagcatacaaattcagataagacaatgtgctagcacagaaattttggaacaataaacaagaacgcaatgaaggacgataaaccttgttttctccgtaagaggcatgttgatcacaacgacatcacactttggaagcatggcatcgagatcctcctcatacttggccccaatctccttctcaagctccgggtcaatcttcaccctgtcatggtacatcaggttgcagttgaagggcttgagacgctgaagcaggagcctgccgatgcgaccagcaccaacagtgcccacagttttgccctcaagatcataggttctgtgggcaatgcccgcgacattccattcgccattaacgatctgatgggtgataataaaaaacctaacattttagtctgcgaaattcaaggactgagtttaaaataggataaactgaatttctatttctatttaaactaaaaatatacgagggctagatagggttgtaaaaggactagtgaagcttaacacattacctgatggtgaccaggcaagaagttcctgagaagaagcaggatgcgcatgagctggtcttcagccacggagacggtgttgctgccggtgatctccgccacggttagacctgctgccgcggctgctgggagatcgatgtggtctgacccgaccccggccgtgagaagaagctccaggttcttggccttcttgatcctctctgcggtgatgtaggctgggtggaatggggtggtgatcaggacgtgggcatcctcgatgtgcttctccagctctgggaattgatgtacaacagaagcgtcagttgtgtgcgcaattcagacttaagacctatatatttagtcagagaaattttatgatccttcagatacctcaaggtatttagtatctggagatgtactcagacgtactaaattttactgtaaaaaatgtgatgcctattgatatgttgttaaggatagaaaaattacccattatgttgttatagggtttattttttcaacgaacagataagacatcagacaaaaaaggaaaaaaatataatgcatgtttgaaacatttgcgcaaaaaactggtcatacaggaatttgaattaactgaacatcaggccagcatgaaaaacataagataaaattaattccagccggctgccaaccaaaatacacgtctacatgctgatagatgctacggaatgctcaaaaaaagtttatcgaaattgttcgtagaaactacctcttgatcacagctaatactccttcagttcaacaacataagctttgactaagaattactcttaatttcatgacataaatttgatcttatttgatttgtattcaaaagtagtctttaagtattatgtgaaggctttattgtactgaaacaaaatacatacttcttaatttttagacggagggagagtactactaaccgcagtttatcccctccttgtcatcggtgacaatgtagcgatgccccttagattcaagccagccgcgaatgccgagagcggagtcgacgcagccgacgaagttgggattcttgtcggcatactcgccacccttgtagaacacacccacgaccttcttgctgcctgctgatgtctgcggtacaaagagggaaaccaaaaggtgtcattcgtcatatcgagctgcatagaacaaatttgttgatcaagtggatttgttatatttaggggtgtaagtgggtcagttgtgaacaacttataggttaaaataagcgggttgatggcttgttttagcctataagtggatttcgcgggttagccacttacactcctagttatattggttatgattatttgtccatcaccattcctgagaaaaaaaaaggaaacatttctcgggaaataaagaaaacccgacaggcaggggtataaacgtgacaggtattttcagcccgtctgctgaccagatgtttatggcaaggatacggtaaagaaaaatgattacctggtatgatccgtgtccaaatccaaattcgaaatatatgaaataggatatgggaaaatttgtattagccgaaatgttttgtattatcaaacatacaacaaaaattatgagtttatgatttcacttgtgaacatggataaaagatttgttaatcaccatttgatgagcttacaaattaacaatattgtgtattttttctgatatgtcattaaatagtttttaacactctacttgcattgtttggtcatatatgttatatgtagtgcagatacaaatgtgactgtctgggcctacccaaaaatatggaatgaaatagtgtgttcccatcgtgtgcaaggtaattactattttataaggttggtgctgtgtgacgaattaaatgtgtctaccaaagaggagcaatagttaaaagccgattacattgggatgaaaacggtcagaaacaatattatttatacagaaccgattctcgatcggtcaaaaattctcatatttatcaatttatcaatttagtggcgattgcaatatgaagtgaaaagaaattaaaaatatatataaatgttatatatagctaaaaacagaaacaatcaaaaagtgtaccagaaacagattttcgttgccattttctttttgattacagaacatttggctatgttcgattgtatatttttcaacttctatatatactttccctttttcacgcgcatccttcctgaatagtgagaaacgagaggactggagcatagactggtcattgaatttttaggtgattccccgtgcgttgctacggaaatttctggataatggctttttgatttttttggtggggctctaaatgtgaagtttgttagtataaatcatgttgtacagttgtttatgtggagtagaatattaattacttctattggaatatgacaacacgtgaaaggttactgcttatttctcaacgcgcttagtacatgtgaatagcaaagtaaatgagtaatcaaacatgaaatgaacttctaaacatccaaatgaaattcaacggatgataaattgacaatgacaagagtcaatgtggtggcttctttaccagagtaactaggtgaaacccccgcgcattgctgcgggaatttagtatgataacaataaaaaaataacgtgtaagatagctagataatatcagattaagtaaattaatgtagtttatgataatataaatttaaatagtatgtagaatgatgattcaaacgtaaaaagtaaggtggtacgactttatgaaagaagaaaagtagggatatagtttagaccgtagattaatcatctaaaagctaaaaacaattgatgtgatatgacttaattagaggaaagaaggagaaagataatttggaccatagaatattataaaacataataaagatatgtattgaaacattatatgaattatgttggatgataatttaacatgtttgtatttgaaaagctcctaaattataaaaactataaagatatagcatgtttgcatgatgtttaaatgtgatgattgttagtggataatgatgtggcattttgttaattagtggatgatgatgtggcatctttgcatgttaagcttaaggagttagtgggggataactttatagtaagataggattatattaagtgggttgcaactatatatatatatatatatatatatatatatatatatatatatatatatatatatatatatatatatatagaggtttgaacctagaggttcggatctcatctcatccgttatggaaaacgagatagttcattagtacataattattaacttattagtacatgattaattaagtattagtaaaaaacataaaagttaatataacttttttatagaaaatatttttaaaaacatattgttcaaccgtttagaaagcccgcgcttgagaaacgatgggccagggtttacgattccgacaggcccttccgtttcgggcactggcggaattcggaatttcgcgaaatccggtggaaaactagtaaatttcgaacaaatttcataaaccaaaatttgaataaaaattccctaagtttgccgacaagttcttgaaaaccggtcggttttggcgaaatttcgatcactaatccggtccatctaagtgttttcctttttttaattctttattcttttctttcctgatgtaagtttcagtaaatacacacaatacatcatttttttggaaaaattatatcccaataggttctatgaatatcatagtatttataagattttatttgattttttttctttttttatcaattcaaatttaaatttggatgaaacttctcgaaatctcatacggtttctactttcgagcctcgtcgaaatatcgaattttcgcgaaatccgaccaaatgtcgtcggaatcgtaaaccctgcaatggctataagctgagataggaagcgcggaacatagctaggaaagagaaggatacgtacctgcgcagccgtagatgcaagcgcgcggccgagcagctgccccgccgccgacggtgccctccacatcgccatggaggaaaggatatgaaattgagctcagcaacggcgagcaagcgagagagtggcacaagaggcagtgagtgtgatggaatatcgatcagtattcagtgcaggcaagcagccgactcgatcgatgcgatggaagtggaagcctggattggaagggatggatatttgtagctccgcctccgccacctcgcgccgcccgcgtggtggcccctcggctgctgcgaccgtgcagtcagcgtagtgcatacccccagggccttgcctttgtcaggtaaaacctgagcataggtggattcatggaaaggcaaatactcgcgtgaaaggtgcgttctaatctatattttctcaacttctttctcgttgtctacatacacgttttttccaaattattaaacacgttttttccaaattattaaacagtataattcctctattccaaattagacgtcgttttgactttttttaacgcttaatcattcgttttatttaaaatatttgtgcaaatataaaaagagacaagttatacttaaaatacttttaataataaaataagtcacaaacaaaataaataataattccttaatattttgaataagataaatagtcaaatattaaataaaacttaaaacgacaagtattttgggatagagttaattttttaaaaaaaactattaaaaggtatctttgaaattttatattaatctatttttctaaagctttttaagctaatgattaataataagccactctattttacttgcttctttagagaaaaggttcataacacctactgccacagaccgacatccgtgacatgtactcaacaggccagggcccagggccagtgaaccaccgagtccaaggtaaaagccatgaggcgctggccgcctgtaataattgttctgttccatacgtctctcgcggtcgttccaatcgaatggctcttgtttcacaggaggaaagctaagaattgatttttgattcctagctaggaggaaagctacgagacacatgcaggcaaaacctaaaaacgcagatgccacgaggtgttagccgccctctagctagtatggttgtttcaatctgtttgctgtaactaagggcagggcccgtttagttcccaaaaattttttctaaaaacatcatgtcggtgacatggggccgggggtatcgtgactagaggcttggatagccgcggtcacccacgtggcctgaccccctcggggggggggggggggtcgggcccgagggtgacacggccacccctccctccgtctccccgaggggtcgggccgcccctgtttcggccccgagggctggggcgccccgaccccctgtggttttggcgccacttgtgtgggttaggtgagcacagcggggctcacctaaccgcatttatagcaggttggacgagcgcgccacgccgcatttaatgcggcgcagcgcacgcttatccggtccgtgaccagtcgcggtgtgtgagaccagtcagatcgcgggttaggtggcaacaggcggcctgtcacacgcctcgccccgtcccgtcggaatgatgagagcttcctggctctcgtccctagccggagccggcgtggtaactcctggagttggcatgtcagtcccggtcagatccattccaggcttcatcgcaaccatggcaaggaagtcattgtatgaagaagggcagacgtgtggcatgctaaactgacgcgtggtggacaagaatgaccggtttgtgactggtctaacaccggtcacgtcatcggcagacaaccgtgctcccacgttgcatctgcttccggcggagtggaggcgagtgacggcgctgggcctcactcaaggacaagctgtgatttagcttccaggcgaaggcgcgagccaagttttggtcaagatagggtgggtccccacccaaaagaagagtaggtagaagtggtgcatgtggtatccccttgagatataaaaggaggaccttgcccacgggaactctgagagagggggactctcagacgactctgggaatacctgagctcgtagaggagagaaaggggaagaggggttctagagcctgaactctcttgctctccggctctctgtaactccttcacacacagatccaccagaacacaggagtagggtattacgcttctcagcggcccgaacctgtctacatcgcccgtgtcttgtgcatttgctctctcgcgaacattccacagatcgagggtgaagaacctcacttagcgcccccggccgaaccggcaaaggggggcctgcgcggtctcccggtgaggagccccacgctccgtcatctggcgcgccaggtagggggcgcgtgtgtctttctaagccctcgtcctctttcgtgtgcgccaagcttctcccgctcagcccaatggccgaacgggcagtggcgcacaacctctctccgagcgctagcggtgacgacggggagcagaacccgcgccgtcgagctcgtactccaccgtccccctctcgccgaagtcttgggcgggaggaggcgctcgagagggtcgaaagatccgcgacttcgccgcctgcgggcgatggagaaggacggcgagacggggagcgtcgcctcctcgtctacggcgatggcagcacgccccagagcgcgctccaggctgcgggcgcactcctgcgtcacccgcccgtcgtccccgatccagagactccagcccgacgttggctggatgacatggccgacttggtcatgacggcgccgcagcgcctaggcgccggcgggcggtcctccgccaccaaggcctctggcgctgctaccgtcggctccgtgtcgtcgaggcggagggcgcggcgagcggcggccgttacccgccgttcgtccgccattccctcgtcaacgcctccgacccaagaagatgtgcgtggggggccagatgcccgcctcaatatcgagcgccggcgcaatggtcgtcatgctgcccacgcaacggagggcgcttcctcgtccggagcgccacttcggtccgggcacgggggccagccccccgtgtccccggttggtggtgccggctgtcgagcctttgtggcgagccttcggaacgtccgttggcccccaaggttccggcccaccatcaccgaaaaatacgacggaagcgtcaaccccgccgagtttctccagatctacacgaccgggatcgaggccgccgggggtgacgacagggtcatggcgaatttcttccctatggccctgaaaggtcaggcgcggggttggctaatgaacttgccacccgcgtcggttcactcttgggaggatttgtgccagcagttcaccatgaacttccagggcacatatccgcgcccaggtgaagaagcggacttgcatgcggtacagcgaagggacgatgagtctcttcgctcgtacattcagcggttttgtcaagtccgcaacaccataccatgcatccccgcacacgcggtgatctacgcattcagggggggcgtgcggcacaaccgcatgctcgagaagatcgcctccaaggagccccagaccaccgcggagcttttccagctcgcggactgtgtggctcgcaaggaggaggcctggacctggaactcctccggttccgatgtggcagctccggccgcccccgggtccgccgctcggtcagggcggcgggacaggaggaggaagaagaggtcggcccattccgacgacgagggtcacgtcctcgccgtcgagggcgcttcgcgggccacccgaaaggggaggcctgcgagcgacaaaaagaaggaggtcggcgctcccagcagtgagcgcccgaccggcaagtggtgttccgtgcacaacacctccctccacgacctcgcggactgccgcgcggtcaaaagtttggctgagcggacgaggaagtgggaggaggagaggaggcaggagcgctgtgagggcaaggccccggcggctcccacaggcaaccgtcgaggtgaggccaagcagaaggccaccgccgaggacgtcgacgatggcgacgatgacctggggttccaggagcctgaggccaccgtcgccaccgtcgatgggggagcgtgcgctcacgcttctcgccggagcctcaaggccatgaagcgagagcttctggccacggcccctacccatgaggcgacgcggcgggcgcggtggtcggaggttgccctcaccttcgaccagaccgaccacccgccgtgcgttgcccggggaggacagatcgcgatggtggtttcccccaccgtttgcaatgtgaagttggggcgtgtccttatagacgggggtgcagccctcaacatcctttcccccgcagcctttgacgctatcaaggccccggggatggtgctccggccgtcccagccgatcatcggtgtgacgccggggcacacttggccgctaggtcatatcgaccttccggtcaccttcggtggttctgccaacttccgcatggagcgggtgaactttgatgtggcggacctcagtctgccctacaacgcggtcctggggaggcccgcgttggtgaagttcatggcggcggtccactacgcctatctccagatgaagatgccgggccccggtggccccatcaccgtccatggcgacctcaaagtcacgcttgcttgtatggagcagcgcgcggaccacctcgccgcggcgtccaagcccgcgggtggcgacgagaggctcagcacctccgtcccagccgccccgaagcagcggatgatcacgtgcgacgaggtcccggtcaaggaggttgccctgggcgacggcccgtccaagaccacacgaatcggtggtcttctggacgacaaataggaagacgcgctcgtctccttcctgcgggcaaacgccgacgtcttcgactggagaccggcggacatgcccggggtcctcagggaggtgattgagcaccgtctcgccgtgcggccgggcgcaaggccggtccggcagaaagtgcggcggcaggccccgaaacgtcaagccttcatctgcgaggaggtggcgcgacttctggaggccggattcattcgtgaggtcatccatccggagtggctggcgaacccggtcgtcgttcccaaggcgaacggcaagcttcggatgtgcatcgactacaccgaccttaacaaggcatgtcctaaggacccttaccccctgccacgcatagatcagattgtcgactccaccgcagggtgcgaccttttgtgttttctagatgcatactctggttatcatcagattcgcatggctagggaggatgaggaaaaaactgcattcattacccccataggaacttattgttatacgacaatgcctttcgggttaaagaatgcaggtcctacttttcaacgtactactcgaatttctttgggtagccaaataggacgtaatgttgaggcctatgttgatgacttggttgtgaaaacgcgcaaccaagagaccttactctcggatctagcggaaactttcgaaagtctccgctccgcccgcataaagctgaaccccgacaagtgcgtgttcggcgtgcctgcgggcaagcttctcgggttcttggtctctgcccgaggcatcgaggccaaccccgagaagatacgagctatagagcggatgcgcccccccaacaagcttagggatgtgcaatgcgtcaccggctgcatggccgccctaagtcggttcatatcgaggctgggagagaaggcgctacccctatttaagctcctcaaacgctccgggccgtttacctggacggaggaggctgagcgggtcctcactcagttgaaggcgtacctcagttctccccctgtcctggtcgccccggagccagatgagccgttgctactctacctggcggcaaccccgcaggtggtcagcgcggcgttggtcgtggagcgcgacgaggacaaccctcactccacgcatccccaccctgtgtcgactcgacccgagaaagagcagggaggagaggcccccgagccgaacggtggcctaaggcccccgacggccggagctggccctccgcctgcttgtccgacggtgccaggcgcccccgacccccaggacggcctcggggccactgcgcgagggccgcgcctgtcgccctttgaccccgaggtcgtcggcacagaagccgagtgctacccgcgtgccctctcggacgaagagcgccctggagatacggcccctagcgaagaggatcggccccgccgaaaggtgcagcggctcgtctacttcgttagcgaggccctccgggacgccaagacccgatacccttaggcccaaaagatgctttacgctattctgatggcttcgaggaagttgcgccactatttccaggcgcatcgggtcacggtggttacgtcttaccccctcggccaaatcttgcataaccgagagggtactggacgggtggtgaaatgggcaatcgaactctctgaattcgatctgcgctttgaaccacgccacgcgatcaagagccaggccctcgccgactttgtggcggagtggaccccagctcccgagcccgtctccgcccccgaggccacctcgggcccctcgcagctgcctcacaccgcctactgggtgatgcagttcgacggctccttgtctcttcagggcgccggtgcgggggtcacgttgacctcaccgagcggagacgtcctcagatacctggtccgcctcgactttcgggcgaccaacaatatggcggagtacgagggactccttgcgggactcagggtggcagctggactggggatccgccgcctcctggtgttaggcgactcccagctggtcgttaaccagatctgtaaggagtaccggtgctctgacccgcagatggacgcttacgtgcgccaggtgcggcgtatggagcgccatttcgatgggatagagcttcggcacgtgcccagacgggataacgcggtcaccgacgaactctcaaggctcgcttcctcgcgagcccagaccccaccgggcgcctttgaagaaaggcttgcccagccgtcggcgtgacccgaccccctaggggagacggacgcgcctgaacggcccccgaggcccgtcggagtccaggcctcgggacccgaggggagcgctcccagctcccttagattgattgcttggatcgctgagatccaggcgtacctcgcagataagactctacccgaggaccgcgaagagagtgaacgcgtccagcgcatctccaagcgctacgtgctagtggaagggaccctctatcggcgcgcggctaacggagtcctcctgaagtgcattcctcgggaacaaggcgtcgagcttctcgccgatatccatgaaggcgagtgcggagcccactccgcctcacgcaccttggttggcaaggcctttcgccagggtttctattggccgacggctctcaacgatgcggtcgacctggtccggtggtgcagggcgtgccagttccacgccaggcaaacccatcagccggcccaggccctgcagaccatacctctttcgtggccatttgctgtctgggggctcgatatcctgggtccgtttaggcgggccccgggcgggttcgagtatctgtatgtcgctgtcgacaagttcactaagtggcccgaggcttatccggtcatcaagatcgataagcactccgcgcttaaattcatcaggggcatcactgctcggtttggggtgcctaaccgtatcattacggataacggcacccagttcactagtgagctcttcggtgactactgcgaagacatgggcatcaagctctgcttcgcctcccccgcccacctcagaagcaatgaccaagtggagcgcgccaacgcggaaatcctcaagggcctcaaaaccaagaccttcaatatcctcaagaagcacggtgactcgtggattgaggag

SEQ ID NO: 44562 - DNA, 3062 bp, Oryza sativa
tacggcgcggaggcggtcctcccatctgagctcaccctgaggtcccatcgggccaccatgtgttgcgaggctgatcaagatcagcttcgcagagacgacctcgactacttggaagagcgaaggcggcgcgcggccctccgagccgcgcgctaccagcagagcctgcggcgctaccatcagcgccacatccgggcccgatcactctgcgtcgacgacctcgtcctacgccgcgtccaaacgcgtgctgaactgagcaagctctcaccaatgtgggagggtccgtatcgagtgatcggcgtcccccggccgggctccgttcggctggccacgggcgacggcacagagctgcctaacccgtggaacatcgaacaccttcgtcgcttctacccctagtaggggtcgggtgtcaggtctcgggctcgggccaaccccgcacccccccgggcatgcagggttggccgggggctaccacatgcatatacttatcttttttctcttccgtatttcaataaaagcattttcgatttcctaaggactgtgtctgtgccattgtttccttttaaagaatcttggcttgaattagcacgctcgtgctcgatcctgccctcggtggcccaggccggctaaaatcgccaaaaggggcccagaaccgagccatgccccggggcgtggtgaactccgggggggaatcggcaaaggcccacaatcgggtcatccataaccctcggtcaccacgctcccggcctggccagtctcgacacgtggatctccccaggcactagccccgacccgcgccgtttgaggctgggacctgggcacgagcccttgttcaagccaagacacagaaggaccgcggcacagaccatcctcgtctcatacacacaacaaatagaattgacacagaaatttcctctttatttgattgcagattaaattagtctatacaagaagggggcccgaaggcctcggaagaagaaagaaaaagctatttaagattggcgggggcctgggggctcactccgacgcgcccgggtcaccagcctcgtcgtcgctgtcgtccgcaccaccgtcaccgccctcctcgtcggagtcgagggcgaacgcgagccgaggggccgtaccttcgaagctgtggacgatgtggtcggcggcgtcccggacctgcgcgcgtgcgccatcctcggttccgggagggaactcttccagcgctgcccacggggagaagtcagggtccctggcctggtagcttgccagtacgagctccaccgccccccgggcgaggtccctcgaggatgacttgatcgtctcctcgagctcctcggggagccgccggagggccccggccatctctgagaggcgctgggcgagacccccctggttggcggcgtacttcgcgcaccgcccgccctagaggcccgcctgccgcccgacgcggtctagatgggagacggcgtcccgaagcatgccgggccctacctcgctcgccaagcggagggcctcgacctccccggcggacgagtccagcgcgccctgcagcttggcgatggtgtgttcggcagctgcgaggcgggcggctgggtcgccatggcccgcggccgccccgccgctgtgcgctctcgcatccagctccttcgcccgcgcctcgagctcagcggcccgctgatccagtacggccccctcggcgcgggcgccttccagatcgcggcgcgcttgctcctcccgcgctgcctcgcggagggacaggctatccgccagccgctgcgccgcggcctcggcctccttgagagctcgccaccgctcggtgagcacgtcctcgcggaagcggagtgcggactccttttcggcgcaggcgacctcgtgcgacgccagtgttgcctcccgggtggcgacgacggcctcgcggtccgctagccctctctccctcgcgtccagggcgcgggcgctctcctccagcgccgtggcgcgagcctcaagggcctctttgcgctgcctggacgccgccttgttctccgccgcccgctgttcccgggcagcggcggcgtcaagtactccccgggcggcgtcgagcttcttctctagctccaccgcccggctcccgtattggaggcggaggtcgtcccgcgcctcgttgagcacggcggtggcgatgaggacagtctcccgctcctcctccacctccctggcgatctccgccaggtccctacgacgggcctcgagctctgaggcgtgccggcggtgtgccttgcggcccgcctccaccatggcctccaccgagcgccgcccctcttcgacgcgcgcccacgccgcgtcgagttccgcccgctctgcctgtaggacctccatctgggcacttaacccgtccaacaccgtggtgttcgtggcggccaaggcctgcaggaggggctccgcgctcggtggggcagcggaaggcagaggggagagccgcctcggtgtgggtgccgcgcggctcggcccgctgatcgacgtgccggactcgggggcgtcccccggagctggctcgtcccaagcgtcgcccgaggggtcgggcccgagcggcgcgcccgcggcctcgtcgtgggtggcctcggaagtcgtcgtcacctcgggcggagtcgggtcgggggcttgacaggccgcctggcgtgcgcgccgcctctgcctcccggacggactccccggcccggcggagtctggcctcctcccgagcggcctcctcagcctggcaaacccggacggcctcctgggcagcctcctcggcttcccggaggcggtccgtggcttctcgccggtcagcttcccgcctccgggcctccgcggtcaccgtctcctcggcctcagaccggccggacttggaatggcggggggggcgcgacgggatctcgctgaggcagaagaaaaatcagaagacaaaaagaaacgggtgagtgaaaactcgccttgggagatgggagaatgaattcggccgtggtgggcgcggggactaacctacggggaggccgctaaacgaccacctctggggcgagatgaggttcccccgcatgactcggtcccccccatcttgc

SEQ ID NO: 44563 - DNA, 1623 bp, Oryza sativa
cctcttgcatgatggtcaggatgttagcgcgctctggatcgcagcagagggggaggaccccttgggggatgagggatgcctccacggagctgagattcagcacccgttggaccaccatcctgaaatcctcagggtaccagtcccatgtgcgcccctggtgggcctcatggagtcctcgggcccggtgtactcccaggcgccccgggcgcgccgctggagcggcgcgatccggcgacgaaggtagtcgccgaacaccatggcccccgtgagcccctgggatcgcagacccgccaggcggtcaagaacggcgtcgtagccgtctcccagatctaccgccgcccgccagctggaggcatgcgccggaggctggctcggaagtcggaggcgcgcttcgtcggcgaggggggtgtagaaccaatcgctcttccagtcgtcccacttcttgcggaggacgcagggaatgtagcggttcagcacctgcccccgcggctggaagtagcagccaccaactaccgtcggcggcgacaccggctgtacagtggagaaccaccggaacagccggagagatgggcgcaccccgataaacatctcgcacaggtgcgcgaagatggccaacgtcattatcgcgttgggggtgaggtgcgccatctggagatcataaaactccagaatatccatgaaaaaattagagaatggcgggaccagccccgccattgcgaaagagaggaagaagacggaccgccccgggtagtctggcgtcgggcgtccctcgcccagcgcgaccaccttccggccggtggcagattccggcatgaatcggcgcggcagcccggcctacctctcgctcacgatgcgggaaggcggcagcacgctaccatcgagcggtgcggagccccgtgccatgacgccggtggaggaggagcttgagagcgagcgagtgcggcaagggtagggcataggaaacgaagagttagagcgcaagtggcgaaggcaaggggaagagtggcgagaggaaggaaacgaatcccttcctcggcgtctttatttccttgccaacgctatgcccggctcctcgcttcccgcgcccactacctcgccctctcgtttctcgcgcccacgcctccactaaccccattcgtccgtttgcggcgcacacggcagatgtgcggccgtggcggttgagatggggcagatcgtgcgcgcattaactacgctcgccaaccgagaaaaacgccatcatcacgtctccaggcgaaacgaaccggctcgccccgattcgcgcgctgctcgagtaatgtagcggtcttgaagaggccgctcattattgtcggtcggttttcccttgccgatgcgcgcgatttgcgaccgctgggtttctgcccgcctgtagagaccggccccacctgtcaccgggcctaaggagtggcgtcacgcccgagcgcttccctcgaggggggcgatcgccctggcataacgccgggggctactgtcggtgacatggggccgggggtatcgtgactagaggcttggatagccgcggtcacccacgtggcctgaccccctcgggggggggtcgggcccgagggtgacacggccacccctccctccgtctccccgaggggt

SEQ ID NO: 44564 - DNA, 19953 bp, Oryza sativa
  unsure (1)..(19953): unsure at all n locations
tttgtgactggtctgacaccggtcacgtcatcggcagacaaccgtgctctcacgttgcatctgcttccggcggagtggaggcgagtgacggcgctgggcctcactcaaggacaagctgtgatttagcttccaggcgaaggcgcgagccaagttttggtcaagatagggtgggtccccacccaaaagaagagtaggtagaagtggtgcatgtggtatccccttgagatataaaaggaggaccttgcccacgggaactctgagagagggggactctcagacgactctgggaatacctgagctcgtagaggagagaaaggggaagaggggttctagagcctgaactctcttgctctccggctctctgtaacttcttcacacacagatccaccagaacacaggagtagggtattacgcttctcagcggcccgaacctgtctacatcgcccgtgtcttgtgcatttgctctctcgcgaacattccacagatcgagggtgaagaacctcacttagcgcccccggctgaaccggcaaaggggggcctgcgcggtctcccggtgaggagccccacgctccatcacatcacatcgaatctttggacacatacatgaagcattagatgtagataaatgaaaaaactaattacatagttagggaggaaatcgcgagacgaatcttttgagtctaattagtccatgattagctataagtgctacagtaacccacatgtgctaatgacgggttaattaggctcaaaagattcgtctcgcggtttcaaggcgagttatgaaattagttttttcattcgtgtccgaaaaccctttccgacatccgatcaaacgtccgatgtgacacccaaaaatgttcatttcctcaactaaacacaccctgactaaaaagacgggggctattatcgataaatctctgcccttattaaattaacataatatttataagcatcaatatttaaacctggtggatagagtatatactcacaacttcgctaccacaccattaatgtaaattttcagtaatacagtattagccaagtattgaatgtgggaattttgagctttataggtcaggtggtggcatccagtctggatttttcacaatttaattcttttaaaaaacttatttcgcaaatagatctatgaaaaaatttatcccaaaaatatagtcctttttgggcgctagagaagctggcgccgtcctcctaccaccgtggcggggcgacgctaaggtggcagggggagcgcaccagtgtggccgacgccccccccccccccccacctcccccaagtgtagagagatgtgcaactttatatatatatatatatatatatatatatatataagaaccaaccgtagaaaaattaaactcaaatggacaaaatatgtgacttgtagaattttccaaagctataccgaaaagcccccctgttggtatttcttaacgatattactagaaatataattcccagcaatggcgcagaaatactcctggtatattatggttacggagtttatccacaagtacacggatataccattgtagcatttaacccgagagtattccaagagtatcatatttgtttaatcccgtgggaagattataatagagagaaccgtactaataatttatatattacttgtaataaccatagtctaagtaggggttagtataatccaaagggtagggtgacacgcaagcatagaactactcattctcatattaaattatctaagctaagtggaaagaaaatagaaaagaatctatttctatacttctagtatacatactgtacatacattctagtcatatgattaacaaactaataccctctatccgatgccctcctgatacttcaagaagccacccctagctgccgagttccttacgacagctcgtcatgaccatacaaccggggctaaatacggaggagtaccctccccaggaaattaacttaggactatatacacgcgcagaggaatagacgtactgagctgtcaccatcagcggcctacctctcatccacagcacgcctaaactaccagatactactttaataacatcgtcatgacatagagtaattgcataagcaaatattatacctgtacctatgcatatcctagataagttagcagtataatcagtataacatgaacataaaataaagttggcattcatatactcaatatactcagaaagtatttcaataccagaattgtataaagaaaaatattctaaataaagtacaaatcttacaaaagagaaaaggagagctactagagccatacccgaactcttccgaagacttccggactccgatttctattctattcctactccactagcttgagactactaaactaaacttgagagaatatgagatagctgttgcttgaagtgtgtgaagaaatgaagagagtgagctccttaaataggcaggtaatgatggttatggcggttagaaaggtcggtaataccttccaaccgcctgtcacgcccagaaatttaggccaaatttccagactatttttgtgtataaaatccctatccaggactagctaaggtacacaaaatgacaagtaataaacagttccaaacgtaaataaagcgtaaaaatacttacagaagaggcacttagtcctcacaccgaaagagaacgacagcagcagaaaaaggcgatcctagcggggcttcagctccactccacaggcaaaactcaactggggtctgagccttggtcttctaacttcgtcttcagctcagaagcactacacttctaaaaagggggaaataatagcaaggctgagtacaaccaccgtactcagcaagccacaccaacgatgcaggcgtgcaaggggatataaggatggcttgtggctatttgcataaaggcgattgtaaaacattttattgagcaaaacggtaaaactgttgagtaattaaagtaatattaaatctccactgatcaacgctacaccacgttgaacaggcccaaccaacccacctgaactacagtgcattgggtcgatttattaagtatgagactaatcacggtgattctggtcgatcgcccataaccgcgggcacggctattcgaatagttttactctggccagaggtgcacaactatacccacaagacacaatccaccagcatgtcaccgtgcccggccagacacgtcaccatgtcgagtgattgtgacaagacccttcatataacccgctctgaccaagcacaccacaccttaagtttcatccccgcccctagcaggcagcgggcagtcccctctcgtgcctaggtgaatccggaagcaacagaggtcgtcgcagggaccgccccgctccatcacgcccacccttgcctggatgcgtcagccagagaaaagctatacttcaagtcaggcagttacctattcccgcttgtggcaagcgctgtatgtcttccagtgcatcccgcgaactggtccttaattgccatgggtgcgaccagcaaaaccatgcacccacagcccaccattcagtcacgttttagttggatacttacgaccaatgaaacatggtcgggtgtctcgagcacgcagctcgtcatgatactaacaggtctaatactgcaattatcccatcaactgagctagtggtaattaagcatggctaagcatatggttctagctgtgtcacataagtaacatgagctagtcgatttatcacccaaggttgacaaagagcagatatcagtaaacatggcgcaagcaagcagataggtaaactctgatcccatgtaattagcaaaacatgcatatttatttgcaaatggtaaaatatttgcaaattggaatcaacatgctcaaggggaatgtgtgacttgccttgcttcttcacttggatcttctgaactcttttcctcgcgactgcgaacttccgaaacgacgtattctacacgctggcacgcaaaacgagaaaaaactcaaataaaaaccaaggaaacaatacataaaaagtaaacaaacatgtagagctcaattttagatgaattttgcaagttgaacggctcaatttggagttcgaatgaattagatatgaattttagcagttttgagccatttaaatgaatttctagaattaaatacgatttatgacgcaattattaattatttttccaaaggaaaaagggttgctgacgtcatcaagggggaagggcggtgccggcaagcgggccccaccggtcagcggcacaagggcgtcggtccatcgtggaccgggaccaccgaggcggtccaccgccggtccacgggaaccgacggcccagattggcccgagccgatcggatggccacgggcggtgctgctggggcatggcatggctcaaagccggccgatcgagtgatggcgatgggtggcgcgcggtggagcagccagcggcggcgcacggcacgggggaggccagcgaagggggaaggaggaaaaagggagggggagtgctcaccgagcgacacggcggaagcatgcggccggcggcgaggaacggcgacggcggggctccccgggaggacagcgtgatggagctctggcgacgggtgtcgcttgggaaaggggtggacaggcttggcctcgatttgaggaagatgaaggaggggttaggaaagtgaggatggttgcgaggtgaccggaaacgacggccgaccgtgacaatatgaggaagacctcaccggcgaccgagggaggtggagctccggcggatttccggcgaagagaagcagcggccgaggacctcctcgtccttgcggagccgagggagacgacgacgtagcgcgggacggacgagagcggcggcgattggcggccgaaggcggcaatggcgacggtggctcgggttcaccgtggagagggcagctcgggggtggaatgggggagcggcgtggtggccaggcttgctcgcggggcggcgaagccgactgtggtggtggcagggcgcgggagcggctcaggcggcgacagcgtgcggctggaggtggtgaaagaggcggcggcctcgggtgtgcggtgggagttgtgctccggtgatgaaatggggaaacggagcgggggctgaggtgcggcaccgtgcggcggagcctacggcggtggctacgcggcgcagcgaccactagggcggcagtggcgggcggccgaaggttgccggcgagcggcggcgatggggtgcggcggtgtcgcggtggtttccgggcacgggagggctcgggagagaggggaaaagagagaaggaggtgcggggatcgttttatagagctcgggaggggaagatcgtggccgtggtgggcggtagaggccggcgacgtggagcggcatcatggcgggtgtggcggctcggcgtggcgccggttcccgcagggagagaggggagtggggcgggatgtgggcgcgaggtggacgggactcgagtccacgccggttaggacgaggggaggcgcgggatcggcggagggagtgggcagtatggtcggcggttggagccggcctgaggttggggatgacaggtgggcccatgggtcccacctgtcggggagagagggagggggaaacgggctagggaggtaatgttgacttgagggagagagagagagagagccgagcggggccgagcggcccaagaggagaggggaggagggcggccaggcccgagcggaagggaggaaggagagggttgggccgaaagcggcccaaagaggaaggggagattttattttgcttttctttttattttaattggttaaatgatctctgtgactttcaaattatttcttgagctccgaaaattcacggaaaaatccggagagtatttgaaggcacaaagaatattaaaaattattcccggccaatgatatttaaaaggaaatttttaattccctcaataattcacttgatgaaattgatttaacttttattaaatttctagaaaatacattatttaatgatttttaatcccgaccgaaaatcggggcgttacaatagggaggcaatgcacaccgtccagaagaagtccggcatccaacggcaccgaagaggattcggccgaaccatgggctgggcctccctggcccattttcggcaggtggcctcctcttttgctctactctgcagacttgtgaattttggcccaattcgacgtgtcatttctaagttcttggcccattcatacataagtctgattctcgatatcgtccgattgattgatcatttggttagatgtagattctcatccactttatggttattctctgaaaaaggttagtaatcctaatacaagtggaatattattattctaacttaaatatgcattgcaagaataactagttctcctctattttggaaataaaggcggtagaaacttgatcgctaagacagtnaaaaccccccctccccccccccccccggcacgcgctctctccctgctctttgttgttttggtttttatttgacctccccgactgcagctccatcttgtctggtagcatcaaattcaaaagtatggggaaaacgcacgatgatcgcagcgaaggaaacatatgcgcccgtgagcactaatcctccatgattctctctcctcctttccgtcgttgggcggggcaactttatttctgcatcctctacttctcgatggtatcactacaagcagcttcagccatagctggatgactttctaggttttgtacccatgccttctgggcaggtaaaaagcaccagatagcttggagttccaacctaccatatcctttttgttaggagtttttaatctttcaatgagagggggataacttctatttggggaaggagtgacgttggcagtctgactacaactaccacatggggtgttgcaccttatcaaccaatacaccaactccagttttttgttgttcttgctgtgccaagaacaatattaaacctgcaattaatcgaagaacaagtaagaacaagttgataagaaaacagttcacatcacttgccaatgatgaaaccgatacacacaaagttggggttttgaatgaagtatctgggtgatctagccagcaaacacaattacagtgaagtagctgaagctaaatctgttatctagacaaaacgcaggttgcaaaaagaggctactaggggtttttataagaggaaaaacgacgaggcggggtggtgggagcaaaccctagcctttggggtggtgcgagcaaaccctatcctttgtggacccctgatgggctctactgaagacaaggcccaagcccaagtttctggtccaaacattgtttctattattctaggcagctccactcaaatttgatagtgaggctaggctcatttcaaagtagtcgacgatatctttacaatgagtactcatgaggtccaaacgaagctcgtatgtaaatttggtggccgttttaaaacacttaggacgatatatttttttcacacttaggagcacacaaaaaccaatcatagaaaaaataaactcaaatggacgaaatatgtgacatgtagaattttccaaagctctaccgagaagctttttgccttgaaaatacaatcttgcaagcagaatttagaggttctaatttcgctgaacccgacaaagcgggggagaattggatgtaactttttctgtagatgtccgtggatatattatttgcttgattccaagtttgtatgaaaaaattacgcctgttttaagaaatgacacccaaatgtaaaaaaaaagaacacaaaccctaacttttttttttggtttataggatgtaaaaggtataaaaaaaaggctaaagagtgttcgaaacctgatctactttttttttttgggaggtgggggggggggagaggggactatataagggctcacacatgcttacccccgctcgaacataaaccaatgtgggtggtaggagcgaaacgtggctagccttgctgcgtatgtgtcgaaacatgatttcggcaataataaaagggggtggcgctcgagacctaaaagtggatggatgcggagacaaaggatttagacaggttcaggccctctcaatgagaggtaataccctactcctgtttggggatttgaatccgccgagtgtgtattgatctgacgatcaggttgtctcatatatatgccccctagagggcctcctgcccaccttatataggatggggggcaggattacaagatagaaaccttaaccaatacggtatcggtttcctaaatcaggactctaggccgttccgtaatatacaaggaaacgtaacacccaagtcatgatctgttacatattacatagatataagttatcccctataactagtcggataaccatgccgtgtgggtatggggtacccataatctccacagtatgcctactctttagtccatgggattttttgcctagcaagttagtgttggaaaaaaataagagtttacatatggaatttttatacacggcaattttatgtcatagaaatgaaactttcgatatataatctttgaacaaattaatttgtagcgaataaaaaaagaagaaaaaaaatctatagataagtttataaaaataaaacttgtatgtagaaacttttgatacatatgtaaaaatttgtactttgtgtaaaacttttggtatataaactctatgcaaaagcagattaaaaaaaacatttgtctacaaattttcacctaaaaatttgacagatgtaattatagtacaatcgtagtgtaattacactataacttgtatgtaaatacactgtaacatgtaactacagtgtaacttgtatgtaagtttcacgtaattttgaatcattagatctaatacaagatttgttctagtgaggaagaaaaaaatcacagcacacacatgtgtgaaaggatttgttcccacgacctccattttaccgaaatagcatgttatggagagatttttaaaagttatatacaagttactgtgtaagtataattgcatctgagaaaaaaaattatcgacaaatatatagcaaaattgaaaagagaaggagaaaagacaaacatgccaaatgtgtcatgaggcccgctacttatcggtccatcacttggtttcggcctttcatggcccactccaaaggaccaaaatcgaaaatatctcgaccatgcaaagagaagatggctgggcaacatgttcgtgcggctggcgctgggctcacgcacaaacgtttgcactcatgtgcaatcagctagtttgttgccataatttttgtgtatgtttgtttcgctatcaaaaccatgtcatgccacgtgtttttaagtacaactatatcatgtcacgtgtttttaagtcttaggatccagtgtcacaattttaaagctggccatgccacactttagataaggtaaaatctaattggagaaacctctccaattagtcttaaccagagacaccccacgtgctagtactttaagagttttggttgctattaatccattgagcaagtagggaaaatattcctatcatctatacttcaaataaaattttctcttaaattactcatccgatttacaatccgattacaccgttgtgttcgtaataattaaatctttacaacaagatctcacatgattatattttgatgaaaaatcacaaattacttttatgatatgtctaaattacttttaggtttcactaagttacttcttagacatataaaagtaaattcagtaaagcctaaaagtaatttacatatattatagaagtaacttataacaaaaaaaaaagtaactttaattaatgccttttttcattgaaaaaattatcatgtatatctaaaagttacttttagatttgattgaaatacttcctatacattcataatgctctgaggtgattacttttttttattattattagttaattccataatttgtgctgattaatttaatttgtactgataatgtttttatctctacaacagatttatgacatgctaaagttaccttcattttgttctaagttacttctataatatatgtaaattactcttaggttttactgaatttacttttatatatataagaagtaacttagtgaaatctaaaagtaatttagacatatcataaaagtaatttgtaatttttcatcaaaatataatcatgtgagatcttgttgtaaagatttaattgttacgaacacaacggtgtaatcgaatcgtacatcggatgagtagtttaagagaattgtatttgaagtataggtggatggtgcctcttatagatggagtggtagctggtttagacaaaccagctaccactagccgtgtagttacgtcctttagataactactactattaaccacattgtttgggcaacatgtcacaacttggttaaggacaagtttaggcaacaactaaccaaagattccatagataacagactgcagccctccagccgactgccgaggcagtaaggcaaagggtgcccccggcccctggcatggaggtactcaggtacaagtacaattgttatgtgcaactggagtactggaccagaaaattcacatcaaaaacagagagcagaaagcacataaaagatcatacatagacgaactgaactgaactgtttaatccgagggctttttattcttcggagccatggttgccatggcaggcatccattatttccggtgtccaatagtttctcagggaacactcaggcaacaacaacaacacaaggtgttttggttcctatccgaatctctgtttcccttcactgcgggaaggtggccacaggatggacacccaacacacaaggaagggttattactggtactggctcgcgagctgaccttccttgacgatgtagttctgcaccgggaagtcttcccctttgaagtacctgtccagcatgtccttcactcctgctgcgtatctcagctgcagcaattgttcatttgccgtgaaatttcgttacagacacagtcagcaatacttataggaaacagattataagaccaatccaaatgcccacatataatctatgctagacataatacaagcaggacccgttgccaatgtagtgagaaattgaccgccgaatctcaaccctatggctgaataaagcagttgtgcatatttaatctagcttggagtaaaaacatcttatatgattttgatcttaagaaacaattattgatgaatcaataaagtggcccttggtttgtactatgtatcatgcaaaacatgcgctgccatctgggtaactaagttactcatctcactagctgacatattgctctacagttttgttaaagcattgtgggggtacccacagaatcagattctagaattttatgctccaatgccctaagttaaagtagaaaacatatataaaagctgacctgtgcatcaattgtagtcccagagatatgaggggtcatggcatgattaggcatgtatcgccatgggtgatcctttggtgctggttgggggaaccagacatcaccaccatatcctgagaaggaagaatgaggttttcatgctaaaggaaatattgatcaagatagaaatattaatacggcatcattcttataatttttttttcaataggacaccaatattagttctctggaaggaaaggacatttagtagtttgtcacagattaaagaatcatggtaagagagctaatttacataggtgcagagaagttcttttatttttttaaaaaaagattcttcaataattgtgaacaacaagttatcatatttgacatacatactgctttactgggttagttgtcctggttttaagttttttcatatcacccctcttaaatgtgaagcatgataggctccaggaaaatgatatacttcatggatcaaaaagaaagatttagaccaaatctgatggcatgctagtatgcagtgtaggctataagaaatgaaaggatgatggtacctgcaacttgaccactagagcaagcgtctgcaaccgcctgggtatccatgattgctcctcgagcattattcacaatgattacacctttcttcatctttgcaattctttctttattaaacatacctctgaagaaagaatcatacaaagttcagataagtagatgtactatgtatatgattttgcaacaaacaagaatacgatcatcaggaaccttgttttctctgtaagaggtgtattgatcacaatgacatcacactttggaagcatagcatcgagatcctcttcatatttggccccaatttctttctcaagttctgggtcaattttaagtctgtcatggtacagcaggttgcagttaaagggcttaagacgctgaagtaagagcctgccaatacgaccagccccaacagtccccacagtttttccttcaagatcataagccctataggcaatgccagcaacattccattcaccatgaacaacctgctgatacccgggcaagaagttcctgagcaaaatcaaaatgcgcatgagctcatcttctgccaccgacacagtgttacttccggtaacctctgccacagttaaacctgctgcagcagctgctggcagatcaatatgatctgacccaatcccagctgtgagaagcagctcgaggttctttgccttcttgatcctttctgcgctaacataggctgggtggaaaggggtggtgatcaagacatgcatatcctcaatgtgcttctccagctctgacaacaagaaaagcatcagttatgtgcacaagaggagttaaaaggataggttcagagctatgttgctatttaaatactgtagttgttatctgtcttagaactaaagcacaaaaatagttgctacatgtttttcgacaaatcgataagagatatgcaaaagaaaaaaaaagttcaaacttgaaacatgtatgcaacataggcacagacaagaatttgagttacagaacagcatgccagcatgaatagagttaatttcagccgtgtgctagaggaaaccacttggctgccaaccactcaacacgtgaaagcatgactaccctaaccacatacatcaagaacctcctttccaccttccatcaaccagatgaatatcatccttaattctcctgatcaaaagataaaaataatcatcggcgaagttaagtaaacgctcatgtccacctatggcaactccatccacctctattcagcctgtacagggccaacactacaagctgggagatgctagctactcaattcatcatgtgtaagcggctccatgcaaatcatacaccatgcacaactaaaaaatgttggtagaaacttgagagaaagctctgaaaatctgaacatctctcgcggatactaccacttaccgctgtttagcccctccttgtcgtcggtgacaatgtagtgatgccccttggactcaagccattcgcggatgccgagagcgccctccacgcagccgacgaagttgggattcttgtcggcgtactcgccgcccttgtagaacacacccacgatcttcttgctgcctgctgatgtctgcgattcagagagggaaaaccaaaaggtataccattcttcagagttgcagcaactgagatttgttcagacaccgaaattcacatcacagaagagatcaggaaaaccgattgcaattgttcatcacccattcccgtacaaaaggggagaaacatctttttgggaggagaaaaaaaaagaaattccgggaggggacaaagcatactgggaatcacgaaattagggaggaatccatgcttttgcaaaacccaatctacaatagaatgctcttgctctcgcaaaaagtaaaagctaaaacccaaaattcacctccgaactgcacccaaaaaaaaaaaaactcgcagcagaaacaaaaaagaaagagatactctagacaagaagaaccccggtcgatccagttggaagtacgtacgtgcgcggccctggagccgagcgcgcggccgagaagatgccccgccgccgccctccacatcgccatgatcccaggaggaggaggagaaatcgcgagacgaacgcacaggcaaccgcgagcaggcgagagagagagagtgatggaatcgatcagtgcagccgactcgatgggatagattgatatggatagataaaggcccgccacctcgcgccgccaggtgggccgcgtggacgcgggtaggtgggcgcggcgggctgacagctggggaccagaggctgtgtgggctccatttgtcagcgtctgcagctgctcacactattaggatatttattttcattttctggagtatatgtataagctacacatacgtggccccttggcgttgttaggataagacggagccttgctggtgatcatccaaaacaatgtaagcacttattagcaaataatctggttttaatttgtgacagggactgaacaagtgaggacactagggaagcacgcacgcttcgtgcagctttgcgccatggagccgtggcagaaacagaaaggctgcgtgagtcacccatgcacgtaggccctgtttatttccaaagttttttttccaaacttccaactttccatcgcatcaaacatttcatacacacacaacttttctatcacatcgtaccaatttcaaccaatcttttaaacttcagtgtgaattaaacacagccgtagaacctccgaatgctcaaaatcgggcgcctgatgcggcgaaaaaaatggggcgcccatatgcgcgggccgcccccactatgtatgtccatcattcgcgccccattacaatcagtggcggatataaatttaaaatacagatggggcggcagagctagccctaattaggtaatggcacaatgcacacaaatcatagtcgccggctcacggcactggtacagcaacgcacggcatgaacattgagaaagttaacaacgaaaattggtagtcgaacaaacgtatattaattatatgtagagagaaaaaaaaaggagaaacgttgttagacaataataaggggaaccactttcaatacattggaggtataaaacgaaatgaaaaattatttagaggtttaagtgttttgctaaaatagttcaagtgagtaaaatagtttcttttaccaatttaactttattgtagaccgtattatgtgctaaagaaatagaaaaaaagtcaaattttacatatggccaaaatcagaaacggtcgaaatggtactactcatacagaaataatactcattcagtcaagaattttcataaatgttgtttatgccatggagcagtgtattgttgcaatggcatggagcccgggcagctgcccgtgctggccgggccctgcctccgccattgtgtttcactatgtatggatgagttgcagtggattttgatattgtttcgtaatttcatcttagtggacacgtggtttattgatgtacacggggtttaagtgttgcaatgattttaaatcgtttgttgcatatgttgaaccaaattatttcatcaagtgatcttactgtgtttcactttttttaacaattgaaacattctttcgctatttgctgaaacattgtttttatatagggtgaaacaacgctcgatttttttggaaaccgttgttttatatattgtagcaaaatatttcatgaggtgatttggttgtgtttcagctttttacaagattgaaatattttcgatctacttggtgaaacagcgcccgatttatacagaaaaaattgggcgcccggtttgtaggcgcctccacagaacctgcacaagcctcaccaactcttagtctaaagccatgagtctctctagccgcctctaattattgttccatatgcatctatagtgattgttccaatatggtcccttttgtttcatagccaaaacagttctccttcatctttttttttctattttttaagtagtattattgaaataaaaaaacaccattttgttgatcataaataggcgaattttgaggtccatttaacaaggtggcattctccctcttgtttcaaagtaaagaccactgctacaaaaccctaaatgaaactagcatctatggatttttttttccacctctacgtgatgaaaaaatatagtatcgacaaatttgaccattgtaggtatcggttctagaggaaaacccgacatcaatactatagataccggtttttttataaaaaaagaagggtacccataaaatagattgagccaagccgtccatatacaccacaccacttgcattttatcctcttcccacccggctgtctctttcgcacatcgttcgatccccatcccactcacacaaccccgccaccgctccagcctcacttgcgcttggcctcctcctcattgtctgtcgctcctcctcctctccgtctgccgcccatcctcctcctccttcctctccatccgccaaccctcctcctcctcctttcccttgcagcgcccctcaccacttcctcgccgccttcgagctatgtctccccaaccacgtcggatctggtcacctaaaggtctgaggccaccggatccggcctccttgaggtcagggctcaccggatccgtcctccttgaggtcagggctcaccggatccggcctccttgaggttggggctcactggatcactaacgtggatcaccttgcatgtgcttggggctggtgcggtctggctagaaggagataatggcgacggtggcggtcagtcgaaggagagtagcaagggaacgaaggcgacagatccaatgggacagtgagcctgatatgttgaacatgtaatggtcagccatggcgaaacatgtaactgtgaattgttttgatctaatctgtgattagcttgttcttgtccttttggtttgtgatgtgcttctttgttttttgatgtatgcatatgctcttgtgttcttgttgatttgcaatgtggatgggggggattgcagatggggctaggtgtcggttctgtctcgagaactggcagctataatctctataggtaccggttctggaactagcacctatacatataggtaaaggtgcctccaaattggtaacagttgggaaacccacacctataaggggttcccaaccagcacctatggggtgctctgtagtactggactcaaaatgcacatcattcgatagagtttcagaggaggttttcgatgctagcatattataaccctttagtgaaaaagatattttaacacatgagcttgcacttgacaaatacagatccaatagtagatacatgcacactaaataggatcaaaattgataaattattattagaaaaatggcatctataccttctatatagttggtatccactagcaattattacaagctaaagcttaacatgcaagtacgtcacattaccacccactagtgattattactattctaaagcatgttaactctcatgcaagcatgatacgtcatatagaatataatattgtagagctcaacatataaatatgtcaaatgatcttccttacacctttttcacaatatttaacatttagcatttctataatattttatattcatccatatattccagaacgaagcgcgggtatactagcaattgtaaagaagaaaaagtttgagtcaccacatggcacacactaagattatttaaaatatactgaatcattttgtgatacattgtagacattgatataaactgatagcatccaaaaaattaaaagccttgaaggtgaactcaaattgggctagtggtattttcttaataattttcccatgcaccaaatattttttaaaaaaatatttcaaattttaaagcgcaagaaattttattgctttagttaaaaccccatatttcaattttattaattggtctattcatggaacctttcttttagttcaaatattaaaagccttgaagatgaacatgtcgatgggctatacatcactaaatacgtacctatatatatgccatatctttaaggacgtaaggaacagctaatttgaggatataaatgaaactgagaaagagccaaggagacatggatttttatccaacccccaagatgggtaatagccctagtcatgtttactggaggtcagtgttgccatcatatatcaatctcttacaagtacaaactatcgggaggaaaacataatctaatataccaatctattggcgcagagctcgggaatggtggtcagcggctagctattgttaattttctcgggtattgactcaacgagattggaggtggctctagatctctcttggcttactagtttctaacacattctcttctctcctcctaggggacttacatttatacccttgggtgctcctttatcgaagtaaaactacaagacaagtatgcatataatcagaatagtcctgaccatgcctacaaaagactcaacatttctttccttatctgggactccttccctatctactttagactttatctatgtgtatgaaggtttgttttcgtataaaatcacttgatctatggtggtcccaccgagttaaatgtgtgtgtgtgtgtaggatatctcaaacctaggacactgatagaacaattaaaacctttatcaaagttttttttacaacagaataactaaaagaaactcccttatgatctcaagtgggctgaatacgacccacccctcctttctctctcctgcgcccatgatctgtctccacttgttgatccaccttcctcacctttcttctaatagaatttcagtatccaaacttatcgcattttggagtgccttttattttataacctaccaatgttgttactgtcaaaacctagacaagttttcatgctaccaaatttagtagagatcactattgggtataactcaaaaatcgatagtattagcaacaattggtaccaaaccattcatctagatagtactattcagttaccaaagggcaaaaaaagtggcataagttagaatttatttggctccatactttcgtttcgctacaacttgcaacaaaaataactgcctccgcagcccattagttgggaagaaacatagcatgcctgatagaggctagctcatctgtctatggtgaatgtgttgtatagttcctagtgtagttttagcaagtcaaggaaatattaaggaagaggttaaagaactactagaccattttgtcgacggtggatacccgtagactggatatagagggtattggggtacgctggtacgaggatctacgtgatacgacatcaagcaaatagaagacaaggattatactggttcaggccccttgataggtaatagctctaatccagttggtatgggattatatggtggaaaccacatattacaaagataatagcagaactcggtgatatcgacaataccgtagtcgagttggtccgactagatcacccggcaacttggctcctataggctccgacttcctaggttgtggtcgttgtgttggcggtgagattcgatgccttaggtcctcccgggggtcccttttataccgtgggtcagttgatctctaattagaactcggagatatcggaccccacacgatatagtaacgacccagttctgtcagagtaggactccttccatccgtggactccatttctgttacgtgcgggatttccttaacgtgtacaggaaacatccatatacgcgcaggtataccgtatctagggatgccaatgggtcgggcacgggtagagcaaaaccatgcccgacccgatgcccgacattgcccacccaaaccctacccattagagttagcgggcaaaacttcgtgcccgtacccatgcccggcgggcgcgggtatgtccggcgggtacccaatggatctcacatgaataataacttaaaagatatgtaacttaacaaagagaataaaatcaataatttaccaaattatcgttaatcaacaataatttgaattacatcacaacttagtatcagttagcatcacaaatgaactgagagaaatggtataag

SEQ ID NO: 44565 - DNA, 1958 bp, Oryza sativa
cccataacgtcttcgggtctcgggcgggcgtgcccatgggtaaaaagtcacacccacgcccgtgcccatcgggtcgggtatcacggatacccggacccatgggtaaaattgccatccctaaccgtatcggtatacaacatacatccaagggtaaagggtataccttatccgtaaccctggcagtagcccccgacttctgcttaaatgaactcatgtgaccgatcgcgacttctgatgtcggaatcgttatcactctcaacaggtcgatctcggtatgagaaccgtagagacatagagttatcgataactttgcacgaagttcaacggtcatgagtgaatttaaattgaagtccgaaaactgctgcgcgtaacggatccagaaatttccagcggccttctctctcctttccttggaattcgcaccgtcggtagtgcatttatttaagggagttttggggatccattttgaagtccgtttgctgcaaaacttcccagcctccaagcgcccctcgtcttctccgctcccgcagaaaaaaaccctagctttctcatcttgtcttgttctccggcgatctccggcggtgatggatctcgacaagtccaccaccaccaatgcgtccctgaagaagctgtaggacgacggtttcctccttggtcgcgggaccatggagagagaaacaggaggtactgaacccgaacctgtcctgggccgcatggttgcggttgaggattacattctttgtggttttcttcctccgccctccaagtttcttctccttgtcttgaatttttatggcctttccttgctccatctgaaccccaattccatcaccttcctcagtatcttctcttatctttgttaggcctacattggggtagagccatttcttggtctctttcgcttttactatgagttgcgctggatggaaccgaaaaaggtatccagatgtgtcggtttccgacttcgggatggcctgaagtcgcgatacatccccttccagtgcccctcttctcgtagcaaatggcgggcgaggtgattctatctccagatagagaactcggatccagtctttgttgttcctgaggagcaaccagacaagattccggagtggaccgccaaacctgccctaactccctcccttcagtctttcatcgacattatcgatgacctccgagtacgcgggttgttggggtatgaagtcgctgccgacttcatcggtaggcggatccaaccgctccaggcccgagcccatatggcctttgattattcggggccaaaggacgcgacccgggtttctcctcggggtatttttcttgtatttcagatttcattctttatgtgcatgttcctcctgacttatcgagtgctggttctcgatcctacaggtttgaacagcgaaatcgtggagcgccgtgccagtcaagtgatgatcagcggtcctacaacggcgagcaacatccccgtccccatttgcaagaaggggaaggccaattgcatggctgcgatcaacgtgagtgtatttgacgactcctttacttctgctttcctgggatcgcattgtgacttcatgtatgcaggctctccctctgacggatgtcatcgggccgctcgcggaccaccaggcggcagcgtcgttaaagcagggcgttgccaaggaggcatccgacattgctgctgctgctgctactacgatgagtggcagcaacgttccaatattttgacctcatatcgtgccatcttgcttaggcctcggatgcgtctcccccgtcctagcgaaggcaaaggctggtgacgcttggcgagaagtaagtagatgttttggaagtcttgcttgcctgtcttcatgaaatcgcggaaatcctttacagggcggcgcgggcgaaggcgacgcaagacgggtccggcgcaacctccagcgcgtctcctgtggcgacctcgacggatgtcgtggtcacaa

SEQ ID NO: 44566 - DNA, 5306 bp, Oryza sativa
ccgagtagctggcgtgctatctgttagagacctgcgaggacctcctcaagatgagggagttggtggctggcaatgaaaggcaacggcagggactcgggcagatgtcggagctcgagaacaacctgtcggagatccgcggctcgctgcgggtgtcttacaccggcctacaccaactcgccggggacttcggtgtgtcacgaccaccatcccggcaacccccgacgagttctcgctgacgtcctcgctcgcggagctggctgtggtgatggaggagatcccctccaaacatgcggccaggatcagcgaggagacgtcaaatgggatctacaccggggcgtgccacgtcctcgcgtgcgtgaagctggcgtaccctgacctcgaccaccagaggattctggatcagggggcccccaatgacacgcgcaagggcgtggtggaagaagtcggtgacttgggggagtctattctccccctttttgaagagtaggattttatttcccttgtactccttaatcaattatgcctgtaaaacttttgtaggttcaaactgcctttgtgtatgcagttatttccttcattttctttagcatggtgattccgagtactttgttgtcattgtagagatgttgatatcgaggatgtctagcagcgtgggcaacctgagtcgccggtagtcgttctggcacttgcgcttgagccgtatgtgccgcgggacgatgtcgatcaaagccttaggttggtacaacttccttaggttggtactttagtcttcatctcctttattcttttgttcgaatcgacttaatttgccgtgttctcgaaagaggagaacgacttgacttagtcatttccgtgttgagcagacctcgagagtgcgttggccgaccaagatcgtcgaatccaatattggaagacgaagttcgaggtggccgaactcgagaggacaatggtggaagtgaagaaagaccaagccgtggaagcactccgaggtcgcgaggtgtggttcaactcgtacctcaggagctgttgtacagcgatggttggagtctgcagagagctccgagtaccccgttggaatcccgaggagtcggcggctgggtatatctcgtggttgaacggggcctgcgctcagcttgaaggcatcggcaagcgtatcgacgaggccctgaagcaggagtgtcgtcgatcgagccgatatgctggagggcacgtgctggcctgtatccgagatcactgcccgcagctgcacctcgagttcctccacgaagggttttcacgttctcggaggactcccgcagagatagataatctggcgaagtcgatggcaccgcttaaagagaaagtcttccagtccatggactggcgttggccttcctggtagtctttatatcctataaaaattatctcaaggagacgtgtaatatattttggagcaattatgaattgtaagaagtactcgtgaaatagaaaagggatctatctaactaagttttcttactctggatgtgctgtgtgagtgttttctcatttcgcgacttcgatcagtcacttgagtcatacactctcccaagcccccagccttgtcgtcggagaaacgttctcggagaataaggctcttggacccttgacctacctcagttgaaaaagcactgaccctagcccccagccgtgaagttggaaaacttagtttctgattggttaatacgcacggcgagaactcttacatgaccagatcttacatggtcgtttgtctctacatgatccgacaaggccttatccgctctgggcgtccccagccgaagttcccttaggttcctcagaggccttgtcaagacggcgtaaagggacatgaggataggtttcaacgctaggtgtcgtcgtggtaagggatcgtcgggaaagaacactttgatcgtagtctgtacctgaaatcaactttattgaagtcgtaagatgtcttacaagtatggatactattgatttatacataaaatttacgtaattgatcaatgttccaggaatttgctaactcgcgaccatcgtcgtctgcaatcttgaatgcaactggccgaaagacttgcgtgatcgtgtatggtccttcccacttgggtgagagcttgttacgccctgcttggctttgaacccatcggaggacgtaatcgccgatcgaaagcgtgcgtgctctgatgcgcttctcgtggtatcggcgaagggcctgttggtagctggctgctctgacggtaactctttctcgatgctcctcgagtagattcacatcgtcgctttgctgctcctcttgatcctcgtcagagtacttctgtactcgtgtgctctgatgtcgtagctcagtggggagcatggcttctgagctatacatgaggaagaagggtgtgtccttgttggacgttgtcggtgtggtacgcacaacccatagtacagaggggagttcttcaacccacttcttgtcatgtgacatcaatctgtcgtagacatgggtcttgattccttggagtactatgccgtttgccctctcgacctatccattgctctgagcgtgaggaaccgaggcaaagcagatcttgactcccaatctgatgcagtaatcctggaagtcagcaatgatgaactgggagccgttgtctgttatgatgcggtggggcaatctatatctgcagaatatccctttaataaacttaatggcgttgtcggccttgatttccccagtgggcgtcgcttcaatccacttggtgaaccgccacgaatagaaacatgtaggcgccctgtcctcgtgggaatggtccgagtatgtcgagcccccagcacgagaacgaccaagtaagggggatagtctggagcgcttgcgcttgtagccttgtgtgtttgctgtggaattgacaggcttcacaccggttaaccatgtcgcaaacgtctttgagcgcagttggccagaaaacctttgtcaaaaagcttttctgaccaaagtgcgaccggcggcgagtgacccacagatcccttcgtgtatgtcgaggagtagatgtttgccgtcatcgagcgagatgcatttgagaagtaccccgtttggtgccttcttgtatagatcgttgccgatcatacagtaaatcttggcttgtcaggttattttctcggctgttgcatcatcttcgggcaactcgacactactcatgaaattgatgagtggggtctgccagtcatatgtggtctcgatgtccgcaactgcgcgttctgcctatgtaacccacgagccgatgtcggggacgactgtgctatcttcgccgattgtggttttgtcacgatgtccatgaaggtgccaggctccagcggctctatctggatgcacgccgcgctaggtcgtctggttcgatgttgtccttgcgatatacgtgtcggacttcgatcccgtcaaaccttttctcctgcttcctgacttctgtgaggtacttggatagctcggggctagagcacttgtagtctttgtgcacctggtttgcgactagttcggaatctcctttcacgattagtcacttgactcctagtgcggctgctgctcttatctccgcgagtagaccttcgtactcgactgtgttgttggttgccctgaagttgaggtgaattgcatgcttgaactggtctcccgaaggtgatgtcaagatgaaccttgcccctgctccttggctgttgagtgcgccgtcgaacgccattgtccatgtttcgctgtcggtttgactgtccggcctgttttcaggcataatccaatcagctatgaaatcggcgaggacctgggacttgatggctgttcgtggcacaaagtggacatcaaactggcttagctcgattacccatttcgcgatgcggccgacaacgtctttgtttctcacgacttcaccaagagggaaggaggaaacaactgtgaccctgtgggcttggaagtagtggcgtagctttcttgatttcatgattactgtgtaaagcagcttttggatctgtgggtatcttgtctttgcgtcatggagagcttcgctgacgtaataaactggtctttgcaccttctctctcgacaacaatgacggtactcacagaatatggtgtggcggcaatatagaggaataattcttcattaggttggggagcaacaagtacaggaggatttgacaggtagcgtttgagtgcgatgaacgcatcttcgacttcctgtgtccatacaaatttgtcttgtttcttcaacagagtgaagaagggttgtccttgttctcccatcctagcaatgaatctgctcagtgccgccatgcatccagttagcttctggatttccttgagtcttgtgggcgacttcatgttctcgattgccttgatcttctcgggatttgcctagatccctcttccagaaacgaggaacccgagcaacttgcccgatggtactccgaacgtgcacttctctggattgagcatgaggcgatatcatcagaggttgtcgaacgtttctcggaaatcgtcaatcaatgagtcgcttgtcttggtcttgacaacaatgtcgtcgacataggcctcgacattgttcccaagttgatcgttaagtgccccttggaccgtgcgttggaaagtatttcctgcggttatgagtccaaatggcatcttgacatagcagaatacaccgaatggcatgatgaatgttgtcttctcctcgtcctctttcgccatgctaatttggtggtagctagagtaggcgtcaagaaagcttaacaactcacaaccagctgttgagtctaccaattggtctattcgaggaagagggaagtgatccttgggacacgccttgttgaggtcggtgaagtcgacacacatcctccacttcccgttggccttgcgcaccatgactggattggctagccactctggatggagaacctctctgatgaagccagctttgagaagcttgtcgagctcttctcgtatggcttgtttccgatctggtgcaaatctccgcagtttttgttttactggcttggcatcgggtcgcaccatgagtttgtgctcaatcacctccctgggtaccccgggcatgtcgcatggctgccaagcgaacacgtctgcattgtcgcagaggaaggtgatgagcgcgagttcctatttctcgttcggtgatgccctgatcttgacggtcttgtcggggtggcgctggagagtggaacgatcttgactgcgtcgtttggcttcggcgtcttgtttgttttgctcactttcttgggtggctcaactgtggcgggtgggttggacgtgtgctcaaccat

SEQ ID NO: 44567 - DNA, 3274 bp, Oryza sativa
tgccagctttgcgttcccctgaatagtgattgttcccttcggcccaagcatcttgagcacttggtatgcgtggtgagatgcggccatgaacttcgcgagtgcagttctcccgatgatggcattgtatgttgtatcaaattcagcgacatcaaaggtgatctgctctgttcggaagttgtttgcttggccgaaagtcacaggcaacgtaatcttgcccaatggcttggacgatgactgaggagtgattccgtggaaaggttgatcagtaggtgtcaactcgcttcgtgggattcccaccgcgtccaaggtgctggcgaaaagaaggttgatggagctgccgccattgatgagaacccgtgcgaccttgatattttgaatagtgggctcgatcacgattggatatcgtcctggaatgaccccagtcttggggtagtcttcctctgagaattcgatcttctgttcggaccacttcatcttgggcgcagccccctgccatgtcgaacaaacttcgcgctccactttcttgtactctcgcttcgaagagtacgccatagaacctccgaagatgtgcgagacatggagatcggaatctgggtatgctgagtccgagtcctgagtggctgcttccgtggccttctcgactacacgtacttgcttgcccttccccaatgcgagttgctttgtgagtgattttttgaaaacgaaacaagcttctaaggagtgcttgtccgatttgtgtatagggcatcatattttcttcatgtcgtcgccttatgggtctgggtgtttgggcaggtccacgtattctgctgcgaggacttccgtttgagctttctttttcccactcttgcgactcttcttcttgcttgattccgatgcgtctttggctggtttcttctcttcggcttgtcgttcttgcgtctcagtgtgtcgtccatgtgagcgcatcgatcgacaatctcgaatagttttcgagcagttgttatccgtcttgtcgccaactcctgggtggtgtagtgatctctgacaccagtcttgaaagcgcggatcacggaggcatcggtgatctcggggatcgtatttctgcactcattaaagcgccaaacgtagtccctcaatgattcgcccggattctgtgtcaacgcgtgtaggtcgtcttcgatcgcgtggcgtttgtatgttccttggaagttagcgacgaactgctgccacagatctgcccatgaagaaatccagtatggtgggaggtggactagccatgaatgtgcagatcctttcaacgtcgccggcaaataatttgccaatgcgttgtcgtctgctccggcagcgtagaatactgcggaatagacctgaaggaactccttagggtcggtgctcccatcgtacttctctattgctcccggtcgaaatctctcaggccatcggacatctcgtagagcacgactgaaagctctacacccgccaccgggggcggcaggttgtcggcgatcgtatgtcctccgtggatgcatgtctaatgacgaggatgatgacgatgatgatgagtcacttggttccggggtacgattacgaggatgacttccgggttctcgagaatcttgtcgtcgcccaccgttgttgtcccggcgccgatctttgtcgtcgtcatcgttatggcgacgtcctcgaccagtatcgcccggcatccgctgttcgcgatcatggcggttatggcggttatcatggtcttggttctcgctcgggtgtcctcctcactcttcgttctctcgacgtcgcgaagagacgcgatgccgggaacggtttttgttctcacgcgcgtcatgcttctcggcggacattcaaatggtcatggagatcactggtgccgcgaggtggaggagtggcttgacgaggtgatgcccgttgcccgggtagttttccattggcaccgccagttggcggttgctctggcagtactccggtggcggcctcttcgaacgcgttactgaggttagccactaattcccgtagtcgttctgtccactctgcgagatcatcgttcagaacgggatcataaggggtttccctcagtattgcgttgatagccctgatgtgttgggctggtgtaaccacttgatcctctgcttctgcgttagcgcgcgcagacgtgctggtcccatcgatagcgaacacatcacgtggtgtactcgttgatgatgaggcctggtcttcgagcaagtgtagtactgacggctcgtggggatcgatgtcgattaccccgatgaatcgatctgagataactgtcgctcctcgttccttgtccgcatctctaagagagatctgtgattgctggaccttaggaggtgacgtcctcatggcgctgagaagaaccttgcagcttgagaggtcgtgattctttgtcttgtgaataggacaatagacatcacgggttagagaagtacgttgaattccacgctctttgcaggcgtcgagaaatacccagcaagcttgtaaggtgtgtttcctggttttgtggatatgacaccaggactttgtcgcctcggaagttgtccttgtcggctcgtgattctcgtcggaaggacaagatttggccgcattaggatccttctcaggctcggatgtcgtcgatgttccgttctccacttctgcgggaggatccttcgacatggagccgtccagggttgtaaccacggcgttctcgcttctggtcattgatggaccagttgagatcggcaccatggtgtaaaccaggaagacgatttcgccgacttgagtccacaccagcattgttgaagtagaaactccttggttgatgccggggttgacgctgttgtcgacgaagcttgatgacatagtagtagaaccttgagcaccaagttcccctacctggcacgcccctgtcgacggtggatacccgtagaccggatatagagggtattggggtacgctggtacgaggatctatgtaatacgacatcaagcaaatagaagacaaggattatactggttcaggccccttgataggtaatagctctaatccagttggtatgggattatatgatggaaaccacatattacaaagggaatagcagaactcgatgatatcgacaataccatagtcgagttggtccgactagatcacccggaacttggctcctgtaggctccgacttcgtaggctgtgatcgttgtgttggcggtgagattcgatgccttggtcctcccggggggtctgtcggtgacatgggaccgggagtatcatgactagaggcttga

SEQ ID NO: 44568 - DNA, 36373 bp, Oryza sativa
  unsure (1)..(36373): unsure at all n locations
tcgtgtttcgtgctctttcgatagctggcaatctttccacatacagagagagcttgggatcatcaccctgagcccccggccgaaccggcaaaggggggcccgtgcggtctcccggtgaggagccccgcgctccgtcatctggcgcgccaggtagggggctcagcgtgtgttttctgagctctcgtatttttccgtgtgcgtcaagtttttcttgatcagcctcatggctgagcaagcaaaggcgcccgacctctctcccagtgtgagtggcgacgacggggagccgaacccacgccgtcgagctcgtactccaccgccccctccacgccaaagtcctaagcagggggaggtgctcgaaagggtcgaaagatccgcggcttcaccgatcgcgggcgatggaggagaacggcgagatggggaccgtcgcctcctcgtctacggcgacggcagcacgccccagggcgcgctccaagctgcgggcgcgctcttacgccatccgcctgtcgtccctgacccggagtctccagcccaacgatggctggacgatgtggccaaattggtcatgacggcgcggcagcgcctagatgctggtgggcggtcctccgccaccaaggcctctggtgctgctaccaccggctccgcgtcgtcaagacagagggcacgacgagcggcagccgctgttcgccgttcggctgccactccttcgtcgactccttcgacccgggaagatctgcgtggggagcaggacgcccgcgccagcatcaagcgccggcgcaatgaccgaagtgctgcccacgcaacggagggcgcttcctcgtccagagtgtcacctcgacatggacgtgggaatcagccctccgtgcccccggttggtggtgtcggctgtagagcctttgtggcgagtcttcggaatgtccgttggcccccaaggttccggcccaccatcgccgaaaaatatgatggcagcgtcaaccccgccgagtttctccaggtctacacgaccgggattgaggccgccgggggtgacgacagggtcatggcgaatttctttcccatggccctgaaggggcaagcgcggggttggctaatgaacctgccccccgcgtcggtccactcctgggaggatttgtgccaacagttcaccatgaacttccagggcacatatccgcgcaccggtgaggaagcggacttgcacgctgtacagcgaagggacgacgagtcacttcgatcgtacattcagcggttctgtcaagtccgcaataccataccatgcatccctgcacacgcggtaatctacgcgttcagggggggcgtgcggcacaaccgcatgctcgaaaagatcgcctccaaagagccccagactaccgcagagctttttcagctcgcggaccgagtggctcgcaaggaggaggcctggacttggaacccctccggttccggtgtggcagcttcggccgcccccggatccgccgctcaggcagggcggcgtgacaggaggaggaagaagaggtcagtccgttccgacgacgagggtcatgtcctcgccgtcgagggcgcttcgcgggccacccgaaaggggaggcctgcgagcgacaaaaagaaggaggccagcgttcccagcagggagcgccctaccggcaagtggtgcgccgtccacaacacctccctccatgaccttgcggactgtcgcgcagtcaaaagcttggcagagcggacaaggaagtgggaggaggagaggaggcaggagcgccgggaaggcaagtccccggcggttccttccggccgtcggcgaagtgaggccaagcagaaggcccccgccgaggacatcgatgatggtgatgatgacttaggtttccaagagcctggggccaccattgccactgtcgatggaggagcgtgtgctcacgtttctcgccggagcctcaaggctatgaagcgagagcttctggccgcggcccctactcatgaggcgacgcgccgggcgcggtggtcggaagttgccctcacttttgaccagaccgaccacccgccgtgcgttgcccggggagggcagattgcgatggtggtttctcccaccgtttgcaacgtgaagttggggcgtgtcctcattgatggaggagcagccctcaacgtcctttcccccgcagcctttgatgccatcaaggccccggggatgatgctccggccgtcccagccaatcatcggcgtgacgccggggcacacttagccgctaggtcatatcgacctcccggtcaccttcggtggacccgccaatttccgcacggagcgggtgaacttcgatgtggcggacctcagtctgccctacaacgcggtcctggggaggcccgtgttggtgaagttcatggcggcggtccactacgcctacctccagatgaagatgccgggccccgacggtcccatctctgtccatggcgacctcagagtcgcgctcgcttgtatggagcagcgtgcggaccgcctcgccgtcgtgtccaagcccgagggtggcgacgagaggctgggcacatccgcccccgccgccccgaggcagcggatagccacgtccgatgaggtcccggtcaaggaggttgcactgggcgacggcctgtccaagaccacacggatcggtggtcttttggacggcaaataggaagacgcgctcgtctccttcctgcgggcaaacgctgacgtcttcgcatgnagaccgncggatatgcccggggtccccaggagggtgattgagcaccgtctcgccgtacggccgagcgcaaggccggtccggcagaaagtgcggcgccaggccccggaacgtcaagccttcatccgcgaggaggtggcgagacttctggaggccggattcatccgtgaggtcatccatccggagtggctggcgaacccggtggtcgttcccaaggcgaacggcaagcttcggatgtgcatcgactacaccgaccttaacaaggcatgtcctaaggatccttaccccctgcctcgcatagatcagattgtcgactccaccgcggggtgcgaccttttgtgttttctagatgcatactctggttaccatcagattcgcatggctagggaggatgaggaaaaaactgcgttcattacccctgtaggaacctattgttatacttcaatgccttttgggttaaagaatgcaggtcctacttttcaacgcgctactcgaatttctttgggtagccaattaggacgtaatgttgaggcttatgtcgatgacttggttgtaaaaacgcgcaatcaagagactttactctcagatctagcggaaacttttgagaatctccgctccgcccgcataaaactgaaccccgataagtgtgtgtttggtgtacctgtgggcaagcttctcgggttcttgatctctgcccgaggtatcgaggccaaccccgagaagatacgagctataaagcggatgcgccccccagtaaacttagggatgtgcaatgtgtcaccggttgcatggccgccctaagtcggttcatatcgaggctgggagagaaggcgctacccttatttaagctcctcaagcgctctgggccgtttacctggacggaggaagctgaacgtgccctcactcagctgaaggcatacctcagttctcctccggttttagtcgccccggagccaaatgagcccctgctgctctacttagcggcgaccccccaagtagttagtgcagcgttggttgtggagcgcgatgaggacgatcctcattccgcgcaccctcaccctgtgctgacttggcccgggagcgagcagggaggagaggcccccgagccgaacggtggcctaaggcccctgacgaccggagtcagccctctccccgctcgtcagatggtgctgggcgcccccgaccctcaggaaggccccgaggccactgcgggaaggctgcacctatcgccctctgaccccgaggctaactctgtaccgattcgacctgggagcgagcagggagaagaggcccccgagccggacggtggcctaaggcccctgacgaccagagttggccctttgcccgcttgtccgacgacgccaggagcccccgacccccaggacggccccgaggccactgtgggaaggccgcccctgtcatcctccgaccccgaggtcatcggcacagaagacgagtgcgccccgaggggccacttggacgaggagcgccccggggatatggcccttagcgaaggggatcggccccaccgaagggtgcagcggcctgtttactttgttagcgaggccctccgggacgccaagacccgataccctcaggcccagaagatgctttacgctattctgatggcctcgaggaaactgcgccattatttccaggcgcatcgggtcactgtggttacgtcttaccccctcggtcaaatcttgcataatcgagagggtacaggacgggtggtaaaatgggcaatcgagctttctgagttcgatttgcgctttgaaccacgccacgctatcaagagccaggccctcgccgatttcgtggcagagtggaccccagctccagagaccgtttcagtctctgaagccagctcggaccccttgcagctgcctcacgccgtccactgggtgatgcagttcgacggctccctgtctcttcagggcgccggcgcgggggtcacgttgacctctccgaatggtgacgtcctcaaatacttggtccgcctcgactttcgagcgaccaataatatggcagagtacgagggactccttgccggactcagagtggcagctggactggggatccaccgtctcttggtgttaggcgactcccagctagtcgttaaccaagtctgtaaggagtaccggtgctctgacccgcagatggacgcttacgtacgccaagtgcggcgtatggaacgccattttgacgggatagagcttcggcatgtgcccagacgggataacatgattgccgacgaactctcacggctcgcgtcttcgcgagcccagaccccaccgggcgcctttgaagaaaggcttacccagccgtcggcgcgacctgaccccttaggggagacgggtgtgcctgaccggcccccgaggcccgtcggagtccaggcctcgggacccgaagggagcgctccaagctcccttagattgattgcttgcatctccgagatccaagcatacctcacagataagactctacctgaggaccgcgaagggagtgaacgcgtccaacgcatttccaaacgctacgtgctggtagaagggaccctctatcggcgcgcggctaacggaatcctcctgaagtgcattcctcaggaacaaggcgttgagcttcttgccgatatccatgaaggcgagtgcggagcccattccgcctcgcgcaccttggttggcaaggcttttcgtcaaggattctattggccgacagctctcaatgacgcggtcgacctggtccggcgatgcagagcgtgtcagttccacgccaagcaaatccatcagccggcccaggccctgcagatcataccactttcatggccatttgctgtctgggggctcgatatcctgggaccgtttaggcgggccccgggcgggtttgagtacctgtatgtcgcgatcgacaagttcactaagtggcccgaggcttatccggtcatcaagatcgataagcactccgcacttaaattcattaagggcatcacagcccggtttggagtgcctaaccgtatcattacggataacggcacacaattcactagtgaactcttcggcgactactgcgaagacatgggcatcaagctctgcttcgcctcacctgcccaccccagaagcaatggtcaagtggagcgcgccaatgcagaaatcctcaaaggcctcaaaaccaagaccttcaatattctcaagaagcacggcgattcatggatcgaggagttgccagcggtgctctgggcgaaccgaaccacaccaagccgagcaactggggaaacgcctttcttcctcgtctacggcgcagaagcggttctcccatccgagctcaccctgaggtctcctcgggccaccatgtactgcgaggctgatcaagatcagcttcgcagagatgacctcgactacttggaagaacgaaggcggcgtgcggccctccgagccgcacgctaccagcagagcctgcggcgctaccatcagcgccacgtccgggcccaatcactctgcgtcgacgacctcgtcttacgccgcgttcaaacgcgtgctggattgagcaagctctcaccaatgtgggagggtccgtatcgagtgatcggcgtcccccggccgggctccatacggctggccacgggcgacggcacagagttgcctaacccatggaacatcgagcaccttcgtcgcttctacccctgagggggggtcgggtgtcaggtttcgggctcgggccaaccccgcacccccccctcgggtgtgcagggttggccgggggctgccacacatgcacattctcattttctcttatttcagtatttcaataaaagcagtttcaaattcctaagggctgtatctgtgccgttttttcctttttgaagaattttgacttgaaatgaggtcacttgtgctcaaccttgccctcgggggctcggttcggtcagctaaaatcgccaaacggggcccagaaccgagccgtgccccggggcgtggtgaactccgggggggaatcggcaaaaacccacaatcgggtcacccataaccctcggtcaccacgttcccggcctggccagtctcgacatgcggatctccccaggcactagccccgacccgcgcctttcgaggactgggacttgggcacgggcccttaaatcaagctaagacgcaaaaagaggaccacggcacagatcatcctcatctcatccgcatagcaaaataaaattaacacaaagaattttttcatcatttttgattgcagattataagttgatttatacaaaaaacaggcctgaaggccttagaagaaaggaaaagaaagaaattgaagattggcgggggcctgggggctcaatccgatgcgcctgggtcgccggcctcgtcttccacgtcgtctgcaccgctggcatcgccctcctcgtcggagttgggggcgaacgcaagccgaggggccgagccctcgaagctgtggacgatgtggtcggcggcatcccggacttgtgcgcgcgcgctgtcttcagtcccaggtgggaactcgtccagcgccatccacagagagaagttggggtccctggcctgatagctcgccaggacgagctccaccgctccttgggcgaggtccctcgaggatgacttgatggtcttctcgagttcctcggggagctgctggagagccccggccatcttcgagaggcgctgggcaaggcctcccaggttggcggcaggctttattgtctgccctttccagaggcccgcctgccgaccggcgcgatcaagacgggagactgcatcccagagcatgccgggccctatctcgcccgccaaacggagggcctcggcttccccggcggatgagtctagcgcgcgctgcatgtcggcgacggtgtgttcggcatctgcgaggcgggcggctaagtcgctttcgcccgcagccgccccgccgatgcgcgccctcgcgtccagctccttttcccgcgcctcgaggtcggcggcccgctggtccagcgcggccctctcggtgcggacggattccaaattgcggcgcgcctgctccgtcagtgccgcctcacggagggacaggctgtccgccaaccgttgcgcctcggcctcggcctcttcgagagcccgctcccgctcggaaagagcgtcctcgcggaggcggagtgcggactcctcttcggcgcaggcagactcgtgcgccgccagcgttgtctcccgggaggcgacggcggcctcgtggtctgccaggtccttcttcgcgacgcaggcgcgctcttccagcgccatggcgcgcgcctcgagggcctcctcacgccgccggagcgccgcttcggcctccgttgctcgctgctctcgggcggcggcggcatcaaggaccccctgggcggcgtcgagctttttctttagctccgcctcccagttcccgtgttgaaggcggagggtgtcctgcgcctcgttcatcaccgtggtggcgatgagggcagccccccgctcctcctccacctctcgagcgatctccgccagcgccgtcttacgggcctcaagatcagagacgtgccggcggtgtgccttgcggcccgcttccaccatggcctccaccgagtgccgcccttcctcgacacgcgcccatgcggcgtcgagctccgcacgctccgcctgcagggcctccacctgggcatttaacccatccaacaccgcggtgtttgcggcggctaaggcctgcagaaggggctctgcgctcagcggggcgacggaaggcgtggggaagagctgccttgaagaagacgccgcgcggctcggcccgccaatggacgcgccggcctcatcgcgggccacccccggacctgtttggtcctgggcatcgcccgaaggagtgggcccaagcgacgcgcccgcggcatcgtcgcgagccacccccggacctgtttcgtcctgggcatcgcccgaaggggtgggcccaagcgaggcgcccgcggcctcgtcgcgaactgcctcggaagtcgccgtcgcctcagcctggcgaacccaggcggcctcctcccgagcggcttcttcggcttggcgagctcgggcggcctcctcccgagcggtatcctcggcttggcgagcccgggcggcctcctcccgagcggtatcctcagcctggcgagcccgagcggcctcccgggcggcctcttcagcttcccgtaggcggtctgcggcctctcgccggtcagattcccgcctccgtgcctctgcggccgccggatcttcggcctcggactggccggacttgggatggtgggaggaacgcgatgggatatctctgaagcagaaggaaaaaccagaagacaaacaagatgggtaagagaaaacttgcttttgggatagaagaaaagcggttgtaatgagcgtgggacgaacctgcgagggggtcggttaaatgaccactttggaggggaaatcaggtttccccgggatggttctgtctcccccatcttgcgcagccgcttcttcttgcgctccccctcgggctgcgatgttggcgcggccccctccgggcgcctgctgctggcacgcaccgccccgccccctcggggaggagatgggggaggtgttcctcccagcttcctcttcccccgggcgtcggtagggcggttgctccccgagcccccgacgcggggcccagaagcacgaccccctccgggggtagattgatcccccttgcggctcccgcctgcgccgtcgtggcccttaggagcctgctcctctgaggccccgaccgccgccataatggtcaagatggaggcgcggtctggatcgctgcagagggggaggattccgtgggggatgagggacgcctccacggagttgagattcagcacccgttggaccaatatcttgaagtcctcaggagcccaatcccatctgactccctggtgggtccgaatgtagtcttcggacccggtgtactcccaggcgccccgagcgcgccgctggagcggcgcaatccgacgacggaggtagtcgccgtacaccatggcccctgtgagcccctgggatcgcaggcccgcgaggcggtcgaggacggcgtcatagccatcccccaaatctaccggcgcccgccagctggaggcttgcgccgggggctgactcggaagtcggaggcgcgcttcgtcggcgaggggggtgtagaaccagtcgctcttccagtcatcccacttcttgcggaggacgcagggaatgtagcggttcaacaccggcccccgcggcaggaagtagcagccgccaaccaccgacggcggcgacaccgactgcacggtgaagaaccaccggaacagccgaagagatgggcgcaccccaatgaacatctcgcacagatgtgcgaagatggccaatgtcatcactgcgttgggggtaaggtgcgccatctggagatcgtagaactccaggacatccatgaagaaagaagaaaatggcggaaccagcccagccattgcaaaggggagaaagaagacggaccgccccgggtagtctggcgccgggcgtccctcgcccagcatgactatctcacggccggtggcagactccggcatgaagcggcgcggcaacccagcctgcttctcgctcgtgatgcgggaaggcggcagcacgctaccatcaagcagtgcggagccccgtgccatggcgccggacgaagaggagatggagagcgagcgcgtgtggcgaaagaagggtgcagggaagaaggagttagggcgcaagcggcgaaggcaagggaaatgatggcgaaaggaaggaagcaaatcccatcctcagtgcctttatacccttgccaacgctgtgcccggctcctcgtttctcgcgcccattatttcgccccctcgcttctcgcacccacgcttccactaaccccattcgcccgcttgcggcgcgtgaagtggatatgcggttgcggcagtcgagatagatcgtatcgtgcgtgcgttaaatacgctcgccgaccgaagcgacgttaccatatctccaggcgaagcaaatcggctcgcccagatttgtgcgctgctcaggtgatgtggcagtcttaaagagaccgcccattattgacagccaagttaccattaccgatgcgcatggtttgagaccgttgggtttctgcccaaccatggagaccggtcccacctgtcaccaggctttaggagtggcgtcacgcccggccacttcccatgagaagggcgatcgccctggcataacgccgggggctactgtcggtgacatgggaccgggagtatcatgactagaggcttgaggcagacacaatcgcccacgtggcctggcaccctcgggggacgtcgggcccgagggtgatgtgtgcgcccacctcttggtctccccgagggggggggtcggaccactcctgcctcgcccccgagggccgaggcgccccgacccctcgcgtttctactccacgtgtatgagttaggtgagcacagcggggctcacctaaccgcatttattgcgcctcggctaagcgtgtcacgccacacgaagtgcagtgcagtgcactcgattatccggtctgtgaccagtcacagaccggtcaaatcgcgggttaggtggcgacaggcggtctgacgcacacttcgctccatcccgtcaagacgagagcttctaggcactcgtccccggctggagctagcgtgttacatcccagagatgacacgttaacctcgatcgatatatgccaggcttcatcccaaccattacaagcaagatgttgtttgaagaagggcaaacatgcacgttgctaaaccgacgcgtggtggacaagaatgaccgatttgtgaccggtctgtcactgctcatgtcgtcagcacacagccaccttcccacgacgtgctcgcctcaggcagaagtggaggtaggtgtgtgctgtcccgtcaggaggatgttcggaggacgaccgtgcaaatctccgtccatttatggagagaagaaaagtccagtttggaaagggaggggtgcatgtggtatccccttaaaatataaaaggaggaccttgcccagaaaaaagggggggatggctgccagattcagaacctagaacaagggagaggttggctcacactttgtagctccttgatacatagatccaccaaaacacaggagtagggtgttacgcttctcagcggcccgaacctgtatacatcgttcgtgtttcgtgctctttcgatagctagcaatctttccacatacagagagagcttgggatcatcaccctgagcccccggccgaaccggcaaaggggggcccgtgcggtctcccggtgaggagccccgcgctccgtcagggtcccttttataccgcgggtcagttgatctccaagtagaactcggagatatcggaccccacacgatatagtaacgacccagttctgtccgagtaggactccttccatccgtggactccgtttctgttacgtgacggattacaggaaacatctgtatacgcgcaggtataccgtatcggtatacaacatacatccaagggtaaagggtatatcttatccgtaactctgacacatttattactaatatgaagagaaaatgaggaggggaagaaaacaaggaggatgaaggaacactattggtttagttaatgactacaaataaaaagaaaatgatgtaaagtggtctactacaccactctaaagctaaattcttttagggataaatttttgactaaattaacacttatttagggacaaagtgagtactcgataattccttaattatatgccacttgttacctcacttgacttatacatacggatctatgagagggatacaactaaattttttacattttaaatttatccgaatgtaaaacttcaatgaagaaggaaagatcagtaatttaaaaatgcataaaacattgaaaatacataaatacagtaactttaagcctatttctattagaaaatatgttttctctatcattggggaaatagtaaaaacattatatcgattctgttcatccctggaacatggcatataatatctcattatttttagaattattttgaatatttctacaattaatactccctccgtccctaaatatttgatgcctataacttttttaaaaatgtttgaccgttcatcttattaaaaaaatttaagtaattattaatttttttcctatcatttgattcattgttaaatatactactactactcaagtttttttaataatattcacaaaagtttttaaataagacgaacggtcaaacatgtttaaaaaagtcaacggcgtcaaatatttagggacagagggagtattactcaagcataacattacttgaaatgggaaatctatattgaattacaaaccaaacttccttttattactccagttatctatttatatttggtcggacacctcaactttgttgacactgtttctttggcaattatttggttcattatcatagttattatggctagccacaagttttactcatagctaggaccctatatatcaaaggtttgttgtagtgttggctgagttgcggctagcaaaatgcatttttgaaaaatgacagggtagcaaaatgcatttttgaatactagctgcggcaaaacgtaaccttgcccaaggtgtggtttgacaaagtaaccaaacaatatatatgccacggtttgtgatgggtccatgttgtaagattttgctcatttaattaccctttgttcctcgcgtagaaccactagtaacaatccaaatgttgtcatctgaatacgtgataccttccgcatagtaccagctagtatggctttacctccaagaatggaaagttcatttttcgaaaagaagagcgaatggatgtattgtgcacattgtattttattagtgttttaaaatagctgtataaaaatcaaatggaagggttataaaccaaggtaatatgactatgtgttcgcataaaactctctcgtttctaaacttggaaactaaagtggctcaatggagaaactaaaattgaaatactccccctttcagatttaagtcgttttgattcgatcaaagtcaaactatttcaagtttgattaagtttatggaaaaagtggtaatatttttaattcaagataaatatattataaaaatatttcaattgtgttgtaaatattaccatatttatctacaaatttagttaattttgaagtaatttgacattgatcaaagtcaaaacgacttatattctgaaacagagggaatagaaaactatcgtgtcaacaaaattggtttaagcatggtagcttgtaggttgtgctaacaaaattgcaacacgatgtggtgcctacctgcatttatctataagcttgtaagcaaaaagatacaccttttaagatgaaggagattgggcaacaaccattccattacataataatttgtttagatctccaactttgatctcatgatgaatgatatatagtaatataatcatgtagtccgtgaaatctatatactcctataaaaatgtctccggcatgagatggaaggaacaacaaacaatgaaacccacaacacatatgatttatgctactcattaactaaattacttgtagcgtgccattcatggaactaggtaaaataaaacaaaatgttggattgaaccaacaaatcatcatctgcgattatgtagctgttggtttgatttcacattgcacctagggcagtcgaagattgtcttagatactcaaacctttaatctcacaataaataatatatggtaatataatcatatcatctgaaaagtctatacaagaatatctctaacatgggatggaaagaacaactaaacaatgcaacccacgcacatgattttaccccacccatattaatggaactaggtaaaagtggacaaaatccttgttcagatcaacaaatcatcaccctctgttcagttacgtagcggttggttcgatttcacattgcatctagcctaaggtaacgtttggaacagagtactcaccatattattcatacgaattatctactttaaatataggaaggaataaattaaatattttgagacataaacctaataaagaggttaaaacaattgatctaaacaatatagtagaagaaattgtttttcttgagaaatactacctccgtcctattttaagtgcagtggtgagttttcatgtccaatgtttgaccgcctatcttatctaaaatatttatatttttttttaaaaaataatcacacctaaagtactattcatattttattatctaataacaataaaaatactaatcatattttttttcaaataagacggacagttaaattaaacatgaactgtgtaaaatgcagtctttttaggacgaaggtagcacttacttctaaaaacgtggagcaaatggttgtcataatatgatgaataaagtggaaagcttttacaagtacggctagtgcaataattcctttgagaaaaatataattgtagggtcaccaagaacaacaggagctagcacaacacatcgcttggtttagctcagtggcagtgtaggccgccccgccggcgaccatgacgcgagaatcaatcgagatcctggtcgacaccacatgccacatgcagcataagcgaatccatcaccaagaaatattccccaaccaaacccaggggaagaaaaaaataaaataaaaaaacgaagtgagattaacttaactagtcaagttttttaatgacagaatcagcccatccaagtttacattctagttttaacacggatgctttcatgtatgattaattatttttttactgataggatgctttcatttatgattaattattcttttactgatagatgagttttactgatagatgaggcagccatacacctgttgctcataggtgcagagagtgcatgtactgtgtttgtttaaaataaaataaaataaaataaaaagcctctttcctgaaaatgtccggtccagatgccactcggccacagggcagccacagaaaatctcgcggggaagacccccactccaccttctcttcctccctcgacacctctccccacgttacgctgcctcctcctcctcctcgcctccctctcgtgggcgtcgtccccctccgccaccgccgccgcccgccgcagcagccgcagaaggggactccacctcctcccggatctgctcgatcgcccccgattctgtagcttctcctctgctcagatccgcccccttgcttttcatccagctcgtggcacccgagatccgctgccgccgccgccgtctctgcggtcctcctcccccctcgccggtggggaaccccgccgccccgaagcgcgttgcaggtaacgatgctgacgtggcatcggctcgcttggtgctctgcttgctcgctcgcggcgcttcgattccggggtagctcgactttttacggcctgatgccggaaagggcgtggcccttgtagctcaatcgtgatttccagattagagcttagtggctatggcttgcttgcttgctgctaggggacgacgagtgtataaccctgagctttgtgctagctcagcttagtagtattggcagagtgaactaaaggcgttagcgattcttgtcatggatggggcgattagcttgatcggagtgctgagtttagaaagaggagtttggagtatagcccgtcgtctaagtaaatgcctcatgtttccttgagcttgggtttgctgaactgaactgaactgaacggaagatccatttaagctaggacggtgtgatcgatcgttgagttgatgaacttggtctatggctagctggcttaagcgtggccttccaatcagtttgtattctcgtgattttctttttatgttctctatcagggcaagtaggttctgtagtttctctagtgttacagctgttggtttctctttcttaggtgtatacatgatgctgaatatgactaccttttatttgcagcgtgtactactgccggactgccaaagtacgcttgctgctagccatttcggtagcttttgtggtttctacttaactatcgtgtttggcaatacaacaccttggaccaaaggatgcttgaaagatagactggataattaagactggatgccaaagtacgcttgctgctagccatttcggtagcttttgtggtttctacttaactatcgtgtttggcaatacaacaccttggaccaaaggatgcttgaaagatagactggataattaagaactatattggactgtacattcgcctatagacttagtcatgctgctggttgttctctgtcgctgctacaaggtgttcgtgctattgccttctgcttctgtgtgctatggtaattgtaactctgtggttattgcgcatgatgctctttgaatttgagccatggagcatgcaaggagatttccaacagatcccaaagaatataaattatgtgaggaagttggagatggtgttagtgctacggtgtacaaagctctttgtatcccacttaatattgaagttgccattaaagttcttgaccttgagaagtgcagtaatgacctggtgagtgttttgtcctttgttcattttttgtgccaaatttcattttgtatagcattgccttgttgatctatttcccccaacaaaataatttctttttttacaaaagcaattttttacttgtattatatactttcctaattttaagcaatacaaatttcgaatatttatttgttttgtcgattctcagatgctctttgtgaacatgggttcacttttttcttgctaatcgctttctactgtactgtcctattactgctttatattcttgacatgcatgacattctattatgcatgaaacaagaagagaaacattgatgccaacaaaaataaatagatgtagctcatttccaaggatgtctatctcaacagaaggctcagtttgttcttgcagaatatttatgacatattgacatgattcgatcatttgagcagaacataccttgtatttgttaggggccattgtagtactattctaagttgtcactgtaacactttactacatgagagttaaacctttttaattgtaagttagttggatcagtgtttgtttagattctttctttttttaggttgcattattatggactcccctctttataagaagaggttgtgtgtcatttggattaagtaatggaaatgcgttagtttagtcttttcaacctgcacctgacattgcctggtgaaggttgtctgtcattcattaagtaatgaaaatgaattagtttagtcttttcaacctgcacccggcattgcctggttaccctctgtgtggtatttaccctgatgaaccaatattcaacacattttattttaaacatcaaatttttgagtgagtttctactgtcccaagtagaatggaagcacacatatgatacaaatttgtcaaaatatttacaagttaagcataacataatatccatgttttactttattggtgaaatgtggtagtgatttttatcagagcttgcgcatgctttctcattgtacgcaccttatgctgaaagtagattaataataaatccttgaagagtattcatgaagagtcctgttgaaaccaacaagtgttatagagtatggattatggaatacagttattagacagacatggtactgccaaatgaatagaatacgaacaaataattcgaattatactaattttgtgtttatcccaatatatgtttatatttgataattgatgcggttagagtattaaagatatcagatatctgcacacgttgtattgtcatattatgagacttacttgtaatactctcccgttatgatgtagaatccaatgaatgggatgggatagaaattcttatctgttctagagatgcaaggtagacaaagtagctggttttgccatctaattgggccgctagttatcgggctgattcaggatcgctcagtgggtttctgggcttagttggggattaccagtttaatcaagcaattgcatggaattggtcggttaatcaggtgaggtggctgttttggcattcacacaagctaattcctttccaattcgctggtttgtgatgttctcctctgcgactctgcgtacttataagcgtcaaagtaagcagccattctggccgatttttacgacattggttgagactaggcttcctacaatttggtcattctttccagaacaactatttttctaccttcagtgatatggtttgagtgctggatatcaggatatgttattcctgcaaatggcatcgttcaaataacttatcttaaaaaagtttgacttgtgatctttaagtgaactaacttttgtaacaatctaaacttccttacttgggacatggcttttcgtgttaagataaaaaaaattgtcctttgaaatatagatggaaatgttataagctactgagaaagtaacatttctttttgtgccacaagtgcatagtatcacctccttcagttcattgcttttcctgtcactaaacatactaacttcaaatcagctgcttacattttggtgagcttgtgtttctatccttacggaattgccattctttaggatgggataagacgagaagtacaaaccatgagcttgattgatcatccaaatcttcttcgagcatattgctcgtttacaaatggtcatcagctttgggttattatgccttacatggccgctggatctgctctgcacattatgaaaacttcttttccagatgggtttgaggagccagtcattgcaactcttttgcgggaggttcttaaagctcttgtctacctacactcccaagggcatattcacagagatgtaaaggtaatattgaatctccaccattctattagagtggaagcataatatgtagcagcacagaatttgcataatgcgttgcactggactcaatatgaaattcaatcacatttcacctgtccatgttttagacttagagacattgggatgacacatgattaatggagagacatgaggcatcacatttttgttgctcctgtgttatattgagggtacagctaattgacagccagtgtgatttaaggcttgggaacaatcactgactcgcatatgcctcaccttgggatggttatgcacccagaagtttagtgccacatctgaatcttagatgggctttattctcaaaaaagaatgaaaatacctataatggtccaatattatagtaattattctaaacaaagtcccccacagagtactgttcatcttaatattatgtcttaacaatttgtactaggctactagcagaagattgggcatggattctatgtgaactaaaagccattagtggatatttagatgtcactagtttattataacctagatgtttaaacttgtttaattacttttatcatatgcatgcataccttctgattgtttcacatgactaatcatttcaggctggaaatatcctaatagatacaaatggagctgtcaagctaggagactttggagtgtcagcctgcatgtttgatactgggaataggcaaagagcacgaaacacttttgtagggaccccttgctggtgaatattctgctgatactccctccattcacttttacaaaatatgaattaactttgtgtggtccttttaattgaactttgaccatgattgttccagtatgtagttattgatacaaagtcatgaccatttgagatcacattgaaatacaaatctagtggaacaacttttatttcactaccctacaggctacatatgttagccaaattgttgaccaaaaacttaagaagtttgaagtttgaatgccagtcgttgcattattatattttatgtaaacatatttatgttaagattgtgtaaccccatactttttgcaggatggctccagaagttatgcaacaactgcatggttatgattacaagtaagttcataactggcaatctaaatctgatttgttaagctaccacaactgattaagttttccttttgtcatcatgttcaaaacatagagctgacatttggtcctttggtataacggcattggaactagcacatggtcatgctccattttcaaagtaccctccaatgaaggttagcactgaagtatagtttgttttcttattcttaataaatttccatgaggttagataacgatagcggtacatttatcacattgtaggtattgcttatgaccttgcaaaatgcaccaccaggtctagactatgagagggacaagcgattttcaaaggtttgttgtattcaccatgttccttttgtcgacgacttagactgtatattaatcataactgttcttttttgtagtctttcaaggatttggttgcaacttgcttagtcaaggatccacgcaagcgtccatcttcagaaaagctcttgaagcattctttttttaagcatgcacgtacagctgaatttcttgcacgaagtattcttgacggcctccccccgctgggtgaacgctttaggacattgaaggtgcaaatcactatttatgagatggcattcaatttgatttgacttgtctaatctttattatactcaattgcagggaaaagaggctgacttgcttcttagtaataagcttggttcagagagcaaggagcaactatcacaggttagatgctgctcttttgttctaagaaataatattgtcagaatactactctctctgtgactctgtcctaaaatgacttgatttctagccattccatggagtagtcagtgaaattttctagagatctcatgtcattggagttaacatgtgatgagagatctaggttttgcctatgttgaagcaaagactagagatagatatatatgttaaagttgttgatctgttcatccacatttcttgatttaatgatatcattaaacaaatagttttgctagcttgtttttcatcatttcctttctacatgtgctagattgagttgagttttattggatttattaactaaatggtgactgcatttctacaactgtggcaaatatatatatttttaaataataataagaactatagttagctaatagcaagctcatattttgaccataagtaagctcatatctcacatttatatattttactgtgtatttatatattttactgtgttgtatagaaatgacttattgtagtcatgaattgcacggtgcatatagattcaagtattattgaccaataggctattactgacttttgcttttcagaaagagtacatacgaggaatcagtggttggaacttcaatctggaggacttgaaaaatgcagccgcccttgtaagaattcgattcgaagtgctaaatctttactactgaaattttgaagtcatgagctataattaagccgtaacttttgtttgcagtgaaccttttctaatcttgaaattttgttcttccgcagatagacaatacaaacggaacgtgccatttagatggtgttaacagcaaattcaaggatggtttacaagaagctaatgaaccagaaaatatttaccagggacgggctaaccttgttgcttctgcaaggcctgaggtaccgaggtcccatcgtcttatttatgcaactaagaccccatgaactagctggaaacaacaaatctattgcattatagctttactctaaattttacaggatgagatacaagaggtcgaagatctggatggtgctctcgcctcttctttccccagccgcccccttgaggcactaaagttagtagtaaatccatgtcttttgcaacattttccaatcatgtttgaagaacctttgatattgtggaatgatgtggtttatagcttattgtttaaataatctacttgtcatgtttgaattgtcagaaccctgaacaataatttccttgctttttgaaccttcatttacattagatttatcaatatttcgcagtcaatctgagagtttggtaacttaaccccaatcaggtgatatggtaacaatggagccatgtttcaataggaaaaagaaaatcttaattgctaaatatattggtgtgaagtatcttaattgcaccacatttgtaataatgaatttgttgtgtactccttccgtcccataaaaaaccaacctagtaccggatgtgatacatcctattactatgaatctggacatacatctgtccatattcgtagaaatagaatgtgtcacatctgctcctagatttgttttttatgggacggagggagtagcttgcaaataaattagtacttgtagtgtgtgaatcctactgctccattctgaagtagtataattttgaactggagtggccaccttaaattgttttggttcgctgtattgatgtgctgtcaattttgcattttttgttctcttcgatataaaaaaattgtgagctgtgaagaatctttactgactacagtgacacagatcttgctttgatgtttgtggggatgatgatccccctactgctactgatttgagggagcaaccaaatatggaatctacatcacctatgcagcagttccaacaaattgagaatcataaaagtgccaactgtaatggtgaaagtttggaaagaagtgcctctgtaccatcaaatttggtcaatagtgggtcccacaagttcttaagtggttccctgatacctgaacatgttctttctccttacaggaatgttggcaatgacccagcaaggtgaattaatttcctttgttttctttatttattgttgaacagataacttatgattgtgttttcatctcaagtctgaagtatgtgcttaacttagtttaagttcgataatccccccaccccactcctacaaagagaacatataaacatgccttaaagtgaacagatttttttttgaatcaagtcattgctagttaccaaccaagcacaatgaccactctatttcgttgatgcaaactcttagatgatgcaaccatttgcagtggcatacagcaggctctgctgcagcacctagctgagcgctgagcttgcctagctcatgagtcatctcattcctctgtcaatgtgctcacttgatccgctgccacaggaggacaagttccactgcatcacatgctttcttttttccaaatcaggtcatcacgtgaactagtcagctgaccagcttacagttttgttggtggttagcaaacttgattatccaagtgattatttgcattaagctttgttcagttcaaaaatatattttaaaatgatttgatagattatttagcgcctagaactgaaacagtgttaaactagctcagtttgtgtggaccagctctctctgtgtgtgtatcaagtgtgtgggtggttgcatgaattcaagggttaattctctgtgttctgcagttgacagtctagtatttttttctttgattccttgataaatcaatgtttatagaaaacaagatggaccaagctgtggttctttttatttaagattaaacgagttgtcaggtacagtttcaaaagcttgtgcctagtgcctatgatactgtgctcaccttgtgccacaactttgtccctgtcattctgcctggtttgcattgcgatccttcatcatgctacacatggccaaactaggtcttgtcgagattggggatggtaatcctgctaggcggaaacgaaaaggatcagttctatacacatggattttacttcgcccatatgagaactgtagtgttcacttcaaattttgaaatacctgcatgaaaaatgtgggatcttagcatgcatttttttttatgctagtgaagtcaaactattgaaattggtcattattgtgagaagatttatattgtattgtgcattttagatagctatgcgacaatctcaattcaatttgtataggcaaagtactctttgccctgtaaaatcatgtttatgatatgctgaataggctaaaaaaactactatgggaatttagattggacctagaaaacatgatagaaccaaaaaaaaaaaagaaagaatgaagcatggatttacatgtacatatttgacaaaagtaacacttgtaaaaaaaacctttggttctttttcgtggcctcctactgtagtcttaatatttcactctcattttgcttcttatcatatcgtactaacatatcccatattgtctaatattctagtcggtgtaacacatgctattttttttttgcttcttttctgatttaggaatgagtgtcatcagaaaaatacatgcaacaggaaccgcagtgggcctttattccgccaaatgaaagatccacgcgcacatctgcctggtaagataatcatgaactctatcaactaacacgttacagtttttctttttttagaatagcaagaaaaagctttaaacctgtctcttttatttgtcattgatgtaatttggcttgttatgactgtttttgagagcagttgaacctgaggagcaatccgaaggaaaagttatccagcgaagggggcgttttcaggttacatcagatagtattgctcaaaaggtactggtttgttaattgagcagtcacatgaaactaacatggagggacgtcatatgcattgactattttgatcaatactccctccgtcccataaaaaacctagtaccaaatgtgacatcctagtactacgaatctgacacatcctagtactatgaatatggacatacgtgtcacattcggtactaggttcgttttttataggacggagggagtattaattaagcacagtatgttgcagttcaggactttgatttttaattatttatatttatgctaagcatgcctttaactgctacaatttatattatgtcaaaacatattcgaatatcatttaattgatacctgtagtgattggcaatgtttaagacttttgaagtggagggcaagaggacacaaatattttcttgaaacttttgtttgtttcatgattttcagctgctatatagcaatggctgctgaaatattatttgatcagtttgctagttgacttgcaaagagacaagcatgttttgcctgctctctgactgcaaaagaaaagatgcagaaatgggattctgttttctgattcatgttatttattgctgttccttcaaatttatttctcacagtccctgcatggtaatcctcaaaaggatttatcaccaatgctattctgatatcaatatttttgtcaggcttaattagtaaagtgcaaatatttttttcacattagtttgacaattacaaatgtcttaggtagcttcatccgcaagcagcagtaggtgctcaaatttaccaatcggagtaacacgatcaactgtccatccatcgacaattcttccaacactacaattcatgatacagcaaaatactatgcaaaaggtattcacacacttgttatttcacttggcaagaattgttcagaattttcacaattcttcgttttgacaggaagtgataagtagactgatttcttcaattgaggaaatatctggtatgtatgataaaattacttttgttagactttaaagagataatttcattagtatactgatgttatggttttaatggggcatgtttctgacagatgctgctgatgcaagtacaactggttcatctcaggtgtgtatcacgaactgtgggttatactgtcatttggtcttcaggtgtaaactttagatagttaagcagctcagagataaccatgccgtgtggtagtaatttcaattttaggttcattttaatgttgcacaaacatgaggtttcctcctatgtgtttattcagagttagtataataagtgcggatatatgtgcagccatctggagtgcatttcagagagaaggaactgcagtcgtacatcgccaacttgcagcaaaggtataaaatatttcttgtaggagtaactttttgcatatttatgaatacttgactgaagtttatgaaatatttccagtgtcaccgaacttgctgaggaagttcagagattaaagctcaaaaacactcaggtaaatctatttttaaacttcaatttagatttggaatcatgaacaccgtgttattttgtctaaatattggatgtattctctacattacagctcgaggagcagatcaatgcattgcccaaaaaagatgaaaggttacgaagagaggatacccgacaacaatgatatgcacaatgcacttgtaacccccgctgtaaaatcagttccccaattttgaatttggttagcaaaattatttgtattttgttcgaagtcaggcctggtgtatctttgtaatttgtaattattttagcaaggtgaaattatagttattttcatttgtacaggatatttcaatctataccaaagttaaaagcttggtactagaaaataccaaatcatctttcctaagggcccccttgatttgttggaaaaatgtaggaattttggaggatttcaatcctatggggaaaaaaatatcctatgaaggtctttgaaacaaatgattgaattctatccaattctttaaaaatcctatggaatgggtaatcatatgtatatttggaaagttagtaagaggtttaactttttggaaaattttctctgggtctatctctctcatctgattcccgtgtttttcctgtggtccaatcaaacggttattcctgtgttattcctgtgtttttttttttgtgtttcacaatcctctattttataattgtattccttttagaattatgtgatttttctattcctctgttttttcatccttactattcaaatgggtcttaaaccagtagcagagtgcatatatataatggtcaaagaacgaacatacaagtattgcaatcaaaatcagtcatggcaaaagaagtatatctctaccatcttaaatgcagagttctccactcgtgcaatgtgtatgcatgaaaaagtaaccatcatctctctaattatatcagcttggcctattaacatgcgagcttttagtctacccctaatatctactattataaaaattaaaatatttttaccagtactttggtagatttgtatttgagtcgggttttaaagttcgttcgcttttgaaaatacagaaggagtcgtataagaaatcatttttaaaaaactagcaagcaaactcctaattaccgctcatgattttttagaataatatatatccaagcgaattcctacagtgaatttcaacttaactaaactgtgtaacaataacaagattaaaatattaaaataactttcacccgttgcaacgcacgagtattttcctagttatatcaatatgcgtctgatccattacaatgtgcgggcatataactagcaaaagtaaaaaaaaaaaaggattgtttgcaattgtggaggtagaactagttcagtaattcaatacgcttgctagcaaagcttgctttgtttttgatagttgcggcatgtcatgtcctgtcgtgattttttttacagggagtaactatatttacggcgtcatattttttataaaaaaaatagtcgacatgtatttacattataagtccataaattacatatgtgattttagtgcatctacaatgcaagtcctaaaattacatatgcaagtcctaaaattacatactaattatataactaagtgggggtgtaactatggtgtaaatttatataaatatataatggcttgtagttgttgcgcaacagtacgtgcgaaagctactcacacgaagcagcactaatcttggaaaaaatctgaccgaacaagaactgactgtaatgaggcagaaaaagtggcgagacaattctagcaaagccgttttgttatacaacatttactggtcgagtactacctttactcttttagcattaatatttaatatattcttaagtattgcaaaagaaaagtattgaacttgtataattaagtgaaagtatgcttcggttacatgagtataattaagtgaaagtatgtgaaatgtataatatgtggccttaaatttgaaaattcatagagacaactggtgtattttaccatgaatagtacttctctcttttttttttcggggatatgaatcgtacttgtcaaagagaaaattcaagccacagtactattaatgagattgaagaacactattaataggaaacccattagaaagctagcataatatatcctgatagtaccggacaataccttgtgctaactcgtgatgcttcactgagaagtttggtactggtcgagtactacctttactcttttagcattaatatttaatatattcttaagtattgcaaaagaaaagtattgaacttgtataattaagtgaaagtatgcttcggttacatgagtataattaagtaaaagtatgtgaaatatacaatatatgaccttaaatttggaaattcatagagacaactggtgtattttaccatgaatggtacttctctttttttttcggggacatgaatcgtacttatcaaagagaaaattcaagccatagtattattaatgagattgaagaacactattaatagggaacccattagaaagctagcataatatatcctgatagtaccgaacaataccttgtgctaactagtgatgcttcactgagaagtttggtagattcagaatttctatttcgtgaaattaatatattggttagcatggaggaaatcgttaatgatgccattgtggcctttcaaggtgagctagctaagagcgctgatgaaaatggcaatgatgctgacggaaagggcagctggcgtgtggccaaaatgaaacatgtagcttgctgctacattgatggggcaatatggattttttcctatgtatgtatctctatgatggtgtttgaatctcccgaagatgaagatgaagattaagtgtttcacgtaaaatgaggtggtaataacatgtgattaattaagttttaattattacaaacttgaaaaatggattaatctgatattttagaacaactttcatataaaaagttttcacacgaaacacaccgtttagcagtttgaaaagcgtgacactttaatccagaattttagcagtttgaaagattcgaacggggccatgtatgcaactatcatctgtaggactatggacctgttggctgtgtgctaaaccatatgtggacacgttgatccatggtatgaccttgtcatttgtgtgcgctaaatatattataggtgaactttatgtatgtatgcacctgttaatctattatatgtgcaccttcatgatatatgaaccataaatgttatgttttgtattttgtcggtgtgtcatatttgtcttgttttttttgtcagtttttgaaattttgctacctattaatcaagctaatgtggtatgtacatgagagcaattatgaaatcatattacttaggtcataattatcgaatcatattacttaggtcataattatgaaatcatattatttaggtcatagcaagttttgatgcactatctaccagttttactttggaaaaagctactagacagtttattacgctcatgttgttcatgttgagacgcccaactagacagtttattatgctaggttgagtgagcttctcatatgggtaagtttaactagcatctccgtgcaaactgcgcatagctgatcatctaagtgccttatggccctattgcaggtatgcatcagtaattgagctctctcatttttttcattcataatgatcgatggttaagatgatactatctatgcagagtctgatgatacaactgaaccttagtagtattttcttagcattcagttcttttttaacctagtagtgtttttctcctcatatatgtatgcaatcatatctccatgcacaggatgtttttcaaacatggttcatatgcagcaggacaaactgaagcacaaattaatttaggtgcaattgtaaatttaccactgctttcaatcgttattgcaagactgccactagaaaattgcaaaaataccactagaactgttattcgagtggcatctttgcaaaattgaaaaaaacggtggcaaatttacaaatgccccattaatttagaggcttgctaacccacggtataccgttagaacgatataatcattagtcggacacctcaaccctaatgcacatggcgggcacgcaccagcttgcgtgcatgtgctagtgctggtcgtggatactgtatattttttttggaagcaattcacatacacaaatacactagctaattactactctgcgcatctgccatgcatgacatgacaagtgctcctcactcatgcacccatagattatatgaatgcctatccttttggtcacacataactacaaactcctctataattgcgtgcttagctatatgacatgttattgttattatagctatactcagtggttgggctggtacctcagtatcttatattatgatactattttttacatgtcaaaatatgattatctataatagtacctcgaaagtatcgtaaagtatctatcatgatacatgtgggtagcaaaccaagcacatatcagctggtatatgtgggtctcagttttaacatatacccagtctgataccaaggtatcacgtatgatacctattatctctggtatttgtggtactaagcatgatacatatatgtattatgttgatacctgtaggtaccgggtctgatacttatatgtactagacataatacctaggtatcggtcgtgatacatgtagttaccaagtctgatacttataagtatcgtatattatacccaggtatcagtcgtgatacatgtaagtaccagacatgatagatgtagataccagatctgatacttatatgtactagacatgatacctaggtaccgatcatgatacatgtagttacgaagtctgatacttataagtatcatacatgatatctaggtatcagtcgtgatacatgtagataccagacatgatacttataagtatcatacatgaaacctgggtatcatgtctggtacctcgggatacatgtaggtaccagacatgatacctagatacgactcatatactcacgtattttaccttgaaacaagaccgtttatcatcaggtcacataggatcacatatagcaatagagaatcaagtcattttctcttgctcatggtcattggcaactttaacttcgatttgatgcaaatagcatcatcaaggcaggagtagtcattttttgatcgtgacaatagtagactagtagtgcatgtactcctcctatactactagtgcatgcaatagtatatggcaggcagtagtatagtacggagtactactagtactgtactagtagtgcatgcgcaaagagttaatccgtggggctcgtgggacccatgcgggaggagagatgggtggttcatttgcgacgctgggttggacggtttgatgccgtgcataatttgtactgtcctaacggtataccgttttatagcttttctcttaatttatatccccacacctcagaatcaggaggtaagtctttcattttcatctatttctgtacatacggtttccctaattaatctgcatcattgaatcacccttctttggcttcatcttcaattacttttagactttattggtttactttcataaattgataaatatctttggagtaatttaatttaatctaaaattaatttacatatatgataaaagtaatatttacaacatacatttttcatcgaaatataatcgtgtaaaatcttgttttaaaaatttaattgtaataaatataacggtgtaattggattaaaaaataatacctagtttaaaagatatactacctcctttttaatatatgacatatttgactttttgtgtccattcgatttattaaaaaaaattaggtaactataatttattttgttgtaagttgttttatcactaaaagtattttaagcatgatttatgttttatacatttgcataaatttttttaaataagacgaatgatgttaaaaatcaacgacgtcatctattaaaaacgtagggagtaagttttttttagctgcgctgatatcctttataactaaacagcatgcatcaccttgtctaatcacgaaccagtcgcgctataagactaatataagtgcgcgcacaataattagattttaccgtaacaattatatatatattaaactcctatgtttggtacagcatcaatacagaaaccgatcgcccccgtcaccgttgtgcgctgaaggaaaaatcagaatcggcgatgtcggccgacgaggatgccatccacctcctgtccggcgggtcgtctagcagctggcgagacgcagccgccgccggcaccgggtatatgtcctcctccggtgccggtggtgaggccaccgtgattgggctcggcgggtcgtccgacctcgccctgtgatcctgcagcaggtgcaccggcgacgcggaccggctcgacgccggcgtcgcgaagtcgacgctcatctgcgccaggaacgcgtccgcgtcccggaccttcttcttctccatcgccttcttcctccagttcatcagcgccttcatcgtttgctcctcgaagattgtcttcttcatgttcgatcccatctgcaagtgatggccaaaacacataccaacacaaagggcatctcatgggttcaatattgtggaaataaagaaaagacattttatggggactggtagtgaaactgaaatttcgaaacaaaaaaaaggttttggactgattttgaacaaattttgcaaaattccaaaaaaaaaccccctccttttcttaatagatgatgctgttaacttttggacacttgtttgaccattatcttattaaaagaattgtacaaatgcaaaatataaattatttaaaaagtacttttagtgataaaacaactcaaatgataattacataaatatttttaataagacaaatggtcaaaacgtgtgtctaaaaattaacagcgtcgtcaattaagaaactgctaatagaatttgtgaatggcttgttcacctgtgtgacgagcgcgtagagcgggaaggtgatgtagctgcatagcacctgaagagagatccccacaatgacttccacgatgctcagccaaatattttcatggaagcatttcttcagaccaggtgttgcctgtcacacacaaaacaaccagatcgatgaacaagctgtgtcattttttgtctcattagtcagtgcatgcatcacacttaatttgcttaagaactgataatggcaacaactaagcaagtagcatacacaccatagtccatacgaaatgcgccatctgaaatgcgttctggtgatcatcgatccgtcgtcccatcgatcagtagccacaaatggatggatgctatgttagttaattaggtgttaattgtgaaagataaagtactatttgtagttgagcagcaaggtttaggttttaaacatgtacatggaagagtgtcaggtgtatgaagaacaagacccagtcagggcggttgaaccagaagtacttgttgcttggttcaaccacaggtgctccctggatcacagtggccctgtcctgtatctcttgggccatctgcatgatcaccatctctagcttggtcccaactaacaagacgatctgagacaacggtggcattcacatgaatgtttgttcattagttatatgatcatattaattttcatgataaattaaagcataattaattatgttaactgtttctttggacagggaaatttcgctcttacgatgagaggaacaaaagagatccaaataagtgtgccaagacctacacgcggggaaaaagttgaaaaaaaatcgatggtgattataagaccaattcagaacaaggttttgagagtaaaaaacagaatgaaataggacaaggattaccgtggatatcgaggaagagtacaaggattccgacgaaccacagagggaggctgcaaaaccagccaaatgtgtcaagatccacatacacatacacaactggagactaaatatgtttctttataaaaaaaatgttgaatataagagtcctataattaataaagcgaggacggacctgatgccaacgacaactttgaagtcgtcctccaaagacctcttgatgtatttgtggaagtcgaacttgctattctgcgacaaatgcgcctgcaaaagagaagaagctaaaaccattactcaatgcacactcgaaaaaaaaacctggtctctgtttgcatcatcaatgttgaattggtcaggtttgattagtatatacattgatgaagccttgccgcatggtcaggtagtccaccttggtgacggacccaaagaactgcctgaagaatgctacctaacaacaaacacggcatgaatattttttttttcaaaaaatatggattgaattggaacagctaggccagttgcaagaataaaaaacaagcatgtattcggagattgataactcacgatccatctgagcccaggggtgcttgagaatgatcccagatgccgcttcacgaacgacgtctgatgcgtgaacctgaatcgtgaaggatctgcatggatcgatcatatttttcagctgatttgctcctcctctttcaagacattatcataaaggttctgaaatgaaatagttagggagattcttaattcactaccgattgcgaactgatactccaatgagttggtctgtgactcccacttcttccatttcttcatctaaaaccaagaaagaccaattattatatatttactggcaaattaataaattgggtttcttgtcgaaacaatccatttgaaggactgacaatcttgctagaactagagaaaacatgtgcatgagggacagaacgacaaactcactttgaggcgccctaaacccatggtgatgacgcagtaggtaacatggaacacggcgagcacgaagatgaaaatgtgcagctggtgcatgctctttgccgacatcagcgccaccttgccctgcagaaaacccaagaaaaatcaattatagttaaattagttattgcatcgaggttgtgcttgccggcagctggtgttattctcacatcgaatttcgagcagtagtccccgccgccggcgccggccaaggaccggcgatcacttgctgcttcttcttcgatggcatcttggcctgccttgcacggcaacaagatgttggcagccgacttggggatgcagatcttggagatgggcgcctgtgccacggtgagaagcagggatatgaagcccagcagcatcagctctgcaagtgcagataggacaagaaatatgagaactgcggtggttttctagtttgtgtgccatctaaataattatttttttaaaaaaataaattaatatatcattttacaaatatatacataaaattcaattcctaagttgaaaaaaaacaaatttaatgtatattaacagttaaacttgtttgttttgtaatttacagaagttaaatttaatcctacatgctcgtgaaatgatctatcacatactaatttgtattgttgttattttttaaaaaaatcataaccatttgaacagcatataatcaacgagggaatataaaaaaaaatcatgtaatgactcctccaccctaccttaaaaaaacaaattaacaaaaataatttttctttctcctttttggcctgattgctcgctcgcttgttaattctctctcaaaaatgagagttcaaaatcataaccatttgagagttaaaaatattt

SEQ ID NO: 44569 - DNA, 1871 bp, Oryza sativa
caccgtcgatccgtcgtgccggaaggtggatgaaaaaggaaggaggcgcgccgtcgcgccggctcgaagtacgcgaaaaaggagcaggaggagggagcgtcgtgccatgcgggctgtaggcattttgtgcctgaaatcggcccatggtctgaagtaggccgtagcgggctgcttcttgggtcacggttactctttcagctcggcaacagcaatagactcactcactcacactcacggtcacaccgatttctccctaggcgaccataccggaaaacccgcgactccccaactccgacgagaacgacatggacgccggcggcgaggaggcgaagcaggagcgccacctggtgctggctcacgagctcttcctcctctcccgccccgacctcgacgacctcgccaatgtcgccctccgctccgatgccctcgacgccgtcaagtccgatggcatggcgccgctgttcgagtcgctggccaccgcgggcgtgctgctcaagccggacgacgcagctgctcgccgagatgcgcgcgcggatcgacgaggaggtccgcaagctcgacgagaagtgagtggattcttcctctcttcgattttatttctagccccacaaaaaagaggtcgcccgttgctgtgttgcgtatgcctgcagtagtactatgtggggataggttttgtgataaataactctggtgttgatatgatccgtttgcctaaactaacctagcttgctctcggtgcggaacatggatgctaaagctggtagacagtggcgaagctagagcaaaatggaggggggttcgagattttgccacaagtatatcaatatatataacttcaagctacattttcgatagaaccgttgattaataattttttacatcaacagtagagacacacatgcatcaataaaataaaaaaagtgacaaacattgtttttcaaaattaagaaatccactaataacattgataattgagaattggttactaacccatgagcaaaagatgatctgcatatgcaaacataagcaaacaccattctatttcattatctcaacatcctcgacgatgatttgataacctaaaacaagttaacatcaaaatcagttctcatttttcaaataaaaagtagaatccagcgcacttagatacaatcattaccttcaatcatcatcaaatatgcgtccttgcattttcatgaagcgacgaacaacggcctcattggtgactttcttcatttcttctttctccacataacaaataaggctatcacttaagtactcatcaccaattttattgcacaaatatgttttcacattcttcatagctgaaaagcacctctcaactgtggcagtagcgacgggcaatacaagtacaagttttaaaagttgataaaccaatggataacaaagatgttttcttgtctccaccattatttgagaaagctcggcaatagtttgtatgttggagaatctaccatcatccctcacatcagcgatgtagagaccaagttggtggctaaggtccctcaaatttccagaattaaaatcactaggatacaattttgctaaactcatcaaattctctagattgaaatcatgaaatgagtctcttggactaaaagccgatgagcaaataagcaattgagagcttgtctcactgaagcgattgtcaagctcttgaagtatccaatcaataacatcattaaaacaatccacttgatagtaatgcttgtttgtaattctagatttgtgcctacgcttcttgggatcaatatatgtatcttccatttccaatttgacaatatcatacttgtcacaaaagtcagagacttcatctaaaactttctcccacttttctctcctaagctcat

SEQ ID NO: 44570 - DNA, 21534 bp, Oryza sativa
aaagcaaatgtgcgaggttgacaagggccattctccaagtatttccttctcaccctcttctgagattaggatggtactcatcaatttgttttcttaatcctggatcatatttaatctcatcttcccagtttatatcatccaaacatgaattacatgcattgttagcactattcggctctggcactttccttttgtaaaatcgttccatcaattaacctatcattagatgatttaggaggatgtaaatatatactgattttatcattcattcaagtacagaagtagaatgaaaattgatatgacttacatccaaatagcaccttcaactcaaattctcaaatttccccccaatctgcaattttattccaattctgaaggattccaaattgaaccctactggcctcctaattctacaatgtaaaaaaaaacaaccaataaaaattttaggcctttgtatctaataaatcaaattgattaaaaaagaaatagatgaagcatgctttcttaccttgtctctactaacgcacaatgtggctgtgtgctgatcagttgatggagatggatgatgtcattgttggcttcatggcttgtgaaagtgtggtctgacgcttgctcctggttagctggttgcctggcgaccggcttcctgccttcctggctcctgcggctggagcgagcaacgtaggcactaagcaagcaggggcgacggcgacagcgacagtgagctgccgagggcgacggccgacggcggcgcgtcacgatgccgagatgggcaagtgttgtctgggagactgggattggctgattgcagagcagtggcgtggaagccaaacagatgcgaggcggagtcgtcaagattggcagcgacgggacgcggcatacgagaagtcgagaagagaaaagattgatctggattcgactctcctcatgggcttacaacgttaactggactgttgtttggactgtgggtgcactatattgggccaaggggggtgcatatagggccgagatatgggggtaataactaaaaattttgtttgaggggggttcatctgcacccacgggcctctattgggcttcgcccccgctggtagatccgtagatagcttgcatttgatttggtagttgtaaatttacgaattatgcttagggtcaattcacctctatataaatctgtactacataatactaataaactttctccacagttttgttttagattcatgtacatattgatgattttgtacattatctctgcaatgtgtaatttagcatgtagaaaagtaattgagattgctaaggatcacaatgcacaacatcccaactgatacgaataatttgtgtgtcccttttatccagaaaaaataccagtgtaaactaatgtgaaggaagaatggcatgttgaacttcgttagtaatatggtatcgatttccttggtcgctactttgttgtcctaggtaaattgttatacatgctcggtgtctgtatgaagtgcatggcaatgcatccggaagcatcagctgtcgccccatgtcttcttgatatgatcagatctaggtatgccaagcctaaacaaacatttccctgttaaggaattttattggtaagttaccattttgacatcaaattttgttctatacagctgtttcacaacatcctgaagcatcagaaggtctgtgttgtttgcagctttttgcatattgatagtgctgcacccattgtatgtctcatcagctcttatagaaggaaatcgggacatttcaactggtttggaattgatacacatatgggctcttcatgttgcagaagctgatcctgatacagaatgaatatcagtatgtactttggtcactatggggggatatatctgttatgaatcaccgatttgcattttgttcgtcaaagtagagcaattatagtacaataggctcagcacataatactaatagggtcatttttgaaccaacaaagaagtacagttgttcagggtaaacgttatatcaaattcatttgcatcgtctttgattttaacctgaaagaagagtattttcactgtgagataattcactatctgaaaataaagagctaataactcccaccttatgctttagtttcctgtaacgtacttctttctatcattccatttggtcttctattatactcaaccagtgatccagctcttttcagtaatgtgtagagtaaaaccagactagttttttgttcaactcataattagaaaaccatttcagtacactggaaactcagtaacttctcacattgtcatctaactcttccattgtcatgtttgtctccttgcaggcatcatgacctgtttgcaactctgttccgagatcttcagacatcatgagcactgaatcagtggatcgcagcatggccaggaactgcaggtctctgccttttaagcttgataccatcaaaatgatcaatgtactggactagatatataaatcgattgatgtatttggtttcggagtgctagatttttcgtcattcatacatagaacatgaattgatttacgtgaaacaatttatgtaagtcttctgttccagattactactatgtttgaaaactttgaactgattagttgagcaaaagaaaatttacctgtggatgggtcatgcagggcgagaggaggaggaggagggcgtgtgctccatggggaccaccagccacagaacggggcactcctggagcgttggatcagctgcgagggacaatccgacggccgagatgcgtccagtgcaggtatttaagcgcaatgctgcttctccttgcgcggtttgctgcacaaccactttctgcttctccctccctcacaggctcacgcattctcatctcaagagcactagtggcgaaagataaagggcaaatgttatatccaattccgtctgcatcgcctttgattttagcctgaaagaactaataatttcactgtgatatgattcacaatctgaaaatgaaagagctaatatcactcatcatatgctttaattttcagtaacctactccctcctctcattcctttaatctaatgttatactcattcagtgatccagctctttcagcaatctgtaaagaaaagagatcttcaaacgagtagattaacaaaagcgtaaagtgtctagagtttttggaggcgtcaccctaaggtggccgtttttcttttcttttggggggcgttagctgcggctagcaccctgctcgactgtctaaggtcgattctgtaaccttcgtgacaccctctttcttcttaatacaatttgggcgacctctttcggctgtcccggcaaatctgtaaagaaaaacaggacctctttttaccttataaagagaaaccaatccactaagctggaaacgcaataacttttaacactgccatctaactccattggcatgtttgtcttgtagatggctatgagctgcatgcggctccattctgagatggcccttcagacatcacgagcactggaatcggcggatcacagcaagaccagcagcagcagcagcagcagcaggtctctctaccttctaagcttgataacatcatcataccatttgccaacatgatgtgatcgatgtactggattaatttgtaaaaaaaacttatattatcttgccatgtaatattacaaattccagttcagctaatcctgctacagtctacatgatttttttttgtctgggatttgaaatgttagaattttggtcatccatgcaatgatgcaaaagaacatgacttgattagtgtggaaattgtatggaagctgtcatgttccagattaggagtatgtgtggaaactgtactcagattgatgaactgactagttgatgatgagtataaaagagaactacacggggatgagtcatgcaggctgagggatccgtggggaccaccagccacaggatggggccactcctcgagcgttggatcagccgcgagggacgatccgacggaggagatgcgtctggtccaggtatttaagcgcaactttttttttgcccttcgcagcacaactgcacaaccacttttccgcatctctctctctctctctctctctcgtctctctctcgcgcgcgcgtctcaagagcagcggcgaaaggtgagaggtgagatctctctcccacttcgtcgtcctctcctctgtggtttcgtccgccgcctccatccctaaaccctacttcttctccgaaagcgccgtgagattcttctccctactcttcttcgatcttgctccattggtgcggtggtggtgtttgtttgcttggtgtttcgtgtcgcggtcctctcgttcttgtcttcgctgagtggcattgatcgagcggcgccgcgcgtcgaactcttgcttgaatctggaggcgtctcggtttccgaaacttgaacctctttaccgcgctatgatcctctttgtttttttttttcgtgttcttggcttcctgtacccgtgatgttgctgcttgatggttgatgcatttgaggcgtggttttcttagagttggatgagaaggttgacgagcaacggaacttcatggtggtctccgactccgttcgcctctctcccatcggagcatgttgatgttgacagttcctggcgcgaccagtgcgtgcgcgagaagttagacgccatgaattcgtctcttctctgatttttttttaattttttcagttctgttttggtgtgttcttattatttttgctgttcctgatgcaatccgctcgtcttccttacgtcttggtcaagtagcaccgcgcctcgttctcttctcgaattttaaggcgtttcggagtccgaaatttgctaagattttacctggcagtgatcttttttcccctcgtgttcttggcttccgtacccgtgttgtactgttgcttgatgtttttgaagttggggtgtgcgtgggtttcttggatgagtttgatgagcaccgaagcttcatggtgatctcgttcgcctctcctcagaacacgttggtcttgatcttgccttccgtttctctatttgtaccagtgcaagcgcgagaaattagaccacatcaattcgtttatcttctctgcttgtcttttcagtttgctctgttttggtatgttgccgaagtgccagtttctgaatttgtattagctagatgccttcttctgttcatttcgctgttcctgatgcaatatgcaggatgcttcttctctacacgtctcttctgttttctgcctcgaaagaactctctgtcctattgtggctttgtttactcgatgctattttttcgttcaatgatttctgcatgtgtcgctccattgaattgcttgtaaatcttctgattctttacctatcaaagaaacttccatctcttgaatcttgatttggcttccttcccccttaccgagcaattgtacttttttttcttgtcttttacctattttttacttctctgtgatagtgttcggtgctgtactgtaggttacatgtctctggttttcttcttcttccgtccatcatactctgtttggaatttctttaagttttgactcgctgaagagatgaccatatctagaggaaattgatcatccttgtacagtacactttatctgttgtttcctcttcttttctcactttggaatttggttttatgatttgtgtctgtaaagcttatatggcgttcatagaaaaccttgtgtgtattttgttcacagtaatatttcaattccttgcttaattcttgtacaagataagatgtaggtgtaaaatactgcaacgctgcaactgaaatcactattaacaccctgtgctttgcgctagataactagtgtcgtatcaagtctgatgattctacctgactttatttcatatgtaaccaagctttctggcatttaatcgatctgtattgttgtttaagtgtattcactttattctttccccgtttttgtcaataatgttattgtatatttgtattcatgttaaattttcagcaaagcaagctccactatgggtaacagccttcctgtagaatcgaaggtcactgttgaagaagaaaatgatagaattaagtatatcgtgtcatctatgcagggattgggtcataaaatggaagatgctgtgagtaaacttgcagccttttgtattacaaaaattaggatagttctgccaaaaaattcttattgatctgtaagtaatttgtgtaaaatgccgagactgatatacgctctccttattctctagcatgcagctattctaagtcttgatgataccacgtccacgtcattttttggtgtttatgatggccatggaggtttgcttcattgtcatcttttttgtttcaaaccctccaaattgttggcgtaactgcttacgtcatgctatgtttgtctgtgtgtatcacatttttatctttgtgcatgttttgaaaacttagctgtatatgttgaaacttttacctgtcaattttcaaataaatatgatgctatagttaaggataacgaaccaagttcagtaatcacattcgtgcggcatgcttgcaagggtaacctgaactacataaaaggaaattttaattcatgagggataaaacaccgcatgaatgtgagttaatacaaatagtcatgataattaagaggataatcacagattaacaggttggctaactctattttcttatgaaacctgttaaagtgatgttctgctactagtgttcataacattgttttaatttataagcttctatgcacatagaagtaatcatgatccatcctatcgagccaccatactgagttgtttattttctatcacaggagctgaagtagcatcgtactgcgcaaaacgatttcacattgagctttgcaatcatgaagactatcacaatgatctcaccaacgcactggacaatgtgttttttaggttattttagcctactttatcattttgtttatagctgcacttggaaatgtgggatatcattgttcttgtgtaaatgctgcagcatggatgagaacctgcaacaatccgatgcttggagagagttagttattcctcgtgataatggatggatgtattttctcaaggctggtgtctgtgctaacttttggcctttcccgcaggtagtaatcttttatcccctagtgtcctcgaatatccatatcttgaagaagttactcaaaattgtatttgttggacagtgtgcatattgtatctatgaaaaaggaaatggaagaatgtgtttgatatcgagactgttgttctttcttgagatgtactttggagttggaggagatatgtttaaccctaacctcgactaattgctcctattaaaaaaggttcaattagttacatatcaattgctggtttacagagttggaggccaacaggttattaagttctcattgcaccttggttcttatcatactatgctacccaaattgaggtattttttgcaacatcccttcgatggctatttctttcgtacactggtttggttttcagaaatgtttttctttacctgttggctttcttgagctattttttggtagccttttccttctatgttgtggttctgtgttttacacttcagttttgttcttgtttttccaggcgtatactgggccagcatatgaagggagcacagcatgtgtggttgtcatcagaggtgaccaaatgattgttggacatgctggtgattctcgttgcgtactctcaagacaaggtggtctggtatagtgattgtttccctattgaatttctggtcgttacctaatttgcatgctcgtttcttgtggtgcctaacatttgtgcttgtttctgttctgtcaaaaggctattgatttatcctccgatcataaaccaagaacaagcgagtctgaaagagagagagttcaaaatgcaggaggaatatctcttggagttgattgtgaaaaagtaatggagaattatgtaatcaaggaacaatggatcctcggttactttggggaaagtgtaacaatctcaagatcaattggtatagttttgcctgagcctatttttcattgattgcatgtaataaaaaaaaccacataacactgtgattggcgttttacctacttacatttcaggtgactttgctttcaagcagaacaaagatttaaatcgtgaagaacaaatgttgatatgtgatcctgacatccacactgtaagtgtaaatatgttcgtttggtagaatataaagtttgttttgccggggtgggatctgatggaaaatggccctttctacgtcagcatgacataactggtgacatggaatttcttgttatagcaagtcaaggcctctggtaagtggtaactcttcagcaaaaaagaactgtcagtaactatttgatcattttgatgtcaccagtactcattggcatgattctttttctcctttttgatgcatatatagtttcattcataatttcatactaaccgcattacgtactgtatattttttccctgcaggtcttgcatggaaagtgcggatgtggttgcttacatacatgtccgtttattggtgagtctttttttttttcctcagtttgtcttcttggcaggacaatatatcttattggtattaattatgctatctgttctaggaagtgacttcaaccaagaaatataaataacctggtttctcttttttatagaataacagtgcttatcccctaaacccccgaaaaccagtactttgtttcgcgctgaatatacatgcctgactgacaaactgccatctgctttgagtttggattctttccctgttaaaactgctgttaccaatattgctgtgaccaattaatattgctatgcaggagggtgtagagctgcgtgtcatctgtgaggagcttgttcagtccggcttggcatcgggcgagaacacgaccgtcatcctggttcagttcaagcccggcgccttccagttccagtatgagctagtcgatcccgctgcctttgacactgccgcctctaacgttgccagcaccagtgccggcccggctggtggcagcgacagcgacacgagcgccacgagcgacgagggcgtcgacgacactgccactgccgggaccaccaccacgggctatgaggccggctccagcaccggccccggcagcggcggcggcagcgccaatgccgcgttcgacagcggcggcgacctcgccgctaacttggacatcgccactaacttcggcagcgacgacctcgccgctaacttggacatcgccacggacatcgacaccgaggacgtcttcaccttcatcaacagcgacgacacgttcggcatcaacagcgacgaggtggagctcgatcccaacttcaggcccaagcctcaggtccgcagggcccacgacggcccctctcccactcccagcgaaatcgaggccgacctcaatgccagccccacgaggtacaatatgagggatatcttcgaggccttcgacaaagtcgaggccgagttgggcggcttcccgttacagggccacgatgtctccagcaccagcaccaaccccaacaccgcgactgacactggcagtggcagccgcaccggcgacgatgacgtcgacggcgccattgccagagccatggccgtggctagcagcgtcatgacgggcgcgggctacgaggtcgactccaccaccaccaatcccagcgctgcggctgacactggcagctacaccggcgacgagatcaaggtcgacgacagcaccagcggcagtgccaggggtgacagcggcgagctcgtcaacaacgacaccaccgttgctgacaacaatgccagtggcgttgctgacagcaccaccgtcggcgacgaggtcgatcccactgccactgtcgcggccgacgacagcaacaccggcgacaaggtcgatccccctgccatcaccaaagccacggccgacagcaacaccagcggcgaggtcgacgtcgacgccactgccactgccactgccagcgccagcgccgccgtggctgatgacgagggcacggctcctgatgacagcgagggcagcccgtagatgcatgattcagaagaaagaggtcaccggttcattacagcttccactcaattttgtccaagacggagatgatgtgtgatgatgcatgcaccactgcattcgagggatgttactgatcataggtagtagtagtagaactaatgcattgataggatcggagtagttggtttctgctaccttgtttttggtttatgactcctggttggctgggtacgtttggggtaggagattttgcttgctagacttggttactgagaacacttgtctggtttttgagtttttatcaaagtacttaatctagtgatgcttttgttgatcttcattttgaatctattacacatgctgagagctgagtatgtactacttgctctgttcccgaattaatgttctcttggatacgtaatcagtaatgcgcttggtttggctgattacctctcttctcttgtctgaactgaagagaattgcgtgctgaaaccggctctgaaaatctgaagccggcctatggcatactccagcaccgcaacagcaacggactcgtcactatcaatataaggaaatcgggacatttctactagttctgcacatgggttcttcatgctgcagaagctgatcctgatacaaaatgtacgtcagtaagtgttctggtcattatggatcactagtttgcatttcgttcgtcaacatagagagcaagtatggtattggctgagcgcataatattaatagcgtcattgttcaacgccaaacaaagaaatacagttgtgcagggtaaatgttataccaaaattcatttgcgtcgattttgattttagcccgaaagaagagtaacttcattatgagctaacaactgcaatttgggtcaattagtactaaaatcaacccaaatactataatctactctctccgatccccaaaactctcttgcttcgtgctgcccaaactcgcaggaccaaatatttatgtccgaggtgatctcccttgtggcagacgaactgtatgacttgggaacaaatgctatttcgctgtcacgtataacaaggtcgacatggatggtctcgggccagtcgtacagcctcgggaggaacaccttgttgtgcatcaacctaagcttagtcttcctcaacatcgtcgtgtatgtcccggtgaacaacgcatgtccttccaatgaccgcatcttctcccactccatcgtctcttcattgagcttgacgacatggacaggcgcaccactgtagccaacgaggacagccatgagcgcgccagcttggtcggactcaaacaggtggctatcgacttggtgttcgattccaaagctcccaggcttatcaagaaccttaaaactatcgccatggttgcacggatcgtacaccgcgagctccccgtcttcgccaagaacgtacagcaagccaccgtggagcaccgggttgctggtcggtgccgccagaatttgcggtccgaagcccgtcaattcccagggcccccattggccatcgtcttgttggatcgcacgggcgagccgtagcgcggacgtcgtgttgacgcaatacatccttcgcgcgcggtcgtcgtagacgatgaaatcgggcgacgagtcgaaaggcggtgtcggcttcggcagctcatggatggtgctgccggcgagtagtacgagatcggcttggaggatcgatttaggtgagcacagcgtgaggcgtcgtccggtggagcagcagatcctagcgttaggcaccttgacgagcgtgtcggcgatctggaaacacttgtggtagtaggggctgtagtacctggcgctcgtgacgccgacgtcggcggcgctcaggaggagaggcgtgatccacgccgggtagaagggcgacacggcggagcgccagtgccggcacgtcgacgcgaagctggggtgggtcgaccacccgagccgatattccaggacgagcacgagcatgtccaacgggagagacgaccagtcccgtcgtccttgcgccgccgtcgcggcggccgcctccatctgtcgatctctgcttgcgcttctttttgcggtgctcctcacgcgagtcgcgagagttcgtgcctgcatggcgagctgcgttttgtgctgctacggagctctactttcatggcgtgtttcctccggactcgtattataggtcggcttcagctcggagattgtataccgccccagcgccccggttggtttttgttggtttgctacccactctccatatatgcaaagtatttagattttgcttttgaattgggttgatagtttgaattttgatatcgtgtaggaactcatgtttccttttcctgatctacgggcggtgcagatgataattggtaggagtactaattgtaggtagtggacgtgcatacctctttcctatgccaatagttatttataaggactagcaaatatacccgttcgttgcaccgggtgaatatcaaacaaatatggatggttaagattgcttgtgtacttataatacatgtgcacaaaaatattgaatttgtacataccttgcaaatatctccaagttttatacaggaaaatatcaaaacatatctcatactgtatacatattcagattcaggtcgtatctcaaactatattccaaattttctacacattcagacaatattccaactttcacaaattttcataaacgggggcagttacagctctgaattcaccatgctctacaaaagaaaaatggtaaaggcatctgcaatgggaaagaaacacacactttgtagtatcgaaataaaattcactcaaaaatctttagtggaatatgtttgaattctagaaataatttaatatttaaggaaataatggggcgttttggtttgataccaaaatattgccatatcaattttttggtagtttaaatagtaaatatgatgatttggtttgaagccaaatgtttggtaatgcctatactcaatttggcacaattctagaatattcttcatcacaatttaaaatttggctctcaattggcataaatccaaagacactcatttataattctaccctaccaaaatattggtagtgtcaaaacttgcctagagtttggcactaccaacataggataataaaccaaacaagcccaataattattttgacatgaaaccatattaacttggtcaaatacaatatcatatgattaatactttctagataaattttttgttggtttcatttatctaaaaataatctatgagtgattaaataattaatcgtaatttcccaacaattttaaatggcttaaaatagtaccaaacaaatttctgtaaatataaaaataattaaatcagttgcttagaaaaataaactgattttggcctagcattgtggtttagggatgaagatttggggacaacttgagggaccaaatctgaacttatccgtgcgaagcatacacgtggcccaattgtgtggcggcctgggaacggcaacccgacgcgggagaagccacactcgtctgatctgatcaacggtcccgattgatccgaacatatataaaaagtcggcagcccaaaccctaaccctaaaatcacttcccctcccttctctctctctcaaacctacggcgtcagcggcgcctctccccttccgccgcttcccctctccctccccaccggcggcgccgctccccttccccctccctccatcagcaacgccgctccccttcccctcccccatcggcagcaccgttccatctccccctctccctcccgtctcgctagcatggcacagtgttgggggacgacggcgacgacgaccatccttccatttcccctctccccgtaggcctcgatggtggggctacaagcctatgacacggagacggcggcgacgacagtccttctctctttctctcctctgtctccgagcaagaagagagcgccggaaggtaggtcgccggggtagagggagggggtgtgtaagttcaagtgccttaatttggtttcggtgattaatgacaaatctaattatatgagactaacgtttttatgagtctttctttgactagtctcatttggatatgaaagtaaaaatgatgagaggtatgtattaaacttcacatattctaacttggtctctcttgtggatccaaaatatagtgtgagcttcctatttgatctttattgattatgtgcatatgcgttccttcatatgcatatgtatgcacatcttgagggggagcttattctattttttttattataagatttctatcttgatttgaaattattttttatctcatctctctatattgtttatatcgggttattatccatcaccaaagagagaaaagattgaaagatcttggattaaacaatttgtgtaattgttactttggtgatagatgataaaccgatgtttatgggattaacttctcttttgtataagttgtctactaggttatttcccgataatgagatgtggaagacatgcatttttttgtgatggaccttaatcatgacaagaatgaaatgcatggagataaaacgatatataccacttcttatctcctacgttttgatatgttcatatatatgatttccatgttattgatatataagtgtgagactaatgtttactcgaatgttatcttatttagtctcatttacattgagaacatggagatcatgaaggtatatgttttatgttagtctacatcattactacatatgtcttctctatatgtataggataaacccccattggtcattctctaattatgcatacacttgcatctcttgtatatttatttgtatgcatatatttagggggagcaaatcctatacatttattgtgcatgttctagatccatgttgttcacctattatttatatcggatctttgcacttgagcttgcatacgagtatatgacacttgtgatgttaatgaatactcaacaaacatatccatatatttcatatgcacccggttggtcatcaagtgaaggatgacaaccgatttgttgagactaatgttctcctttgaggtgtgaaaaggaataggtcccactacgatgaggctaatgaatgacaccatgggttagtggtcaccaagccaaggacatcatcatgttggcaagaatgaagtcaagcttgtgatgagaataaagtcctgacaaaagatggacaagacctcggcataaacatggttcaaccggatggttacaagtgttgatctcggctcaagcttgaccccaagatggatggcgcaaggcaaaggtataatgtagctaagaatgttttcttagtcttttcccggtcttggtgtttggtgtagaccggatttgctagataggcgccgtactatcaagaggggtctatgaagcgagcttgtggatgatcttgtgccatattagttcctatgcatgtaggtgcattttgtgggcttgtctaaccaagtgtgatgagttttctcaagtcctaaaccaagagagaagtgggcatgtcaaataggagtgagtgacatcttgtgggtatgtccggtggatatcctttggagtgtgagccctttatccttgacttaagttgtgtttcttggatggatttttcatgggttggatggccctttgaataagctttccatatattccaagaacgccaaattccgagacccgagtcaagagatatcgccgttttactaacggtcggttgagctgaaaagtgacctgcggtctgaccgtgggccttaggccggtctgaccgggtctgttagccagtctgactggcgtggtaaggccggtctgaccggccccattggtctgttgcactagtctggtttttggtggcgatacagagccgccagagccgcaaccggtcagaccgagccgacagcagtctgaccgagccgtggacggtctaaccggccactacactgcggtcagaccggccaggttgagtgggctcaatgattgccctgtaacggctagttttctagccgttacaaagtagtccggtctgaccggcatcacaacggcggtctgaccggcagaacacaaagttggggattttggttccaacggctagttttgatggttgggggtatatatacccactccccagcagcaagggtaaggttttggcactccattgcattatcttgaacccttgcaagagctctcacacccttgtgcacttagtttatctagtgaggtgttagagagtgagttaagtcaatccaagtgcattgcttcattgttagagctagtgtggcacctgatcatcctcggcaagcatcctagacttgttactcttggaggttgccgcctcctaaacggcttgtggaggtgttgcccggtgacctctccgaggagattgtggaggaggcccggcgccggttgtgagtggtttggagttcaccaccttgggagcgaaggaagaactacccctagtgatcgaggcttgggtagtcctctccgtgggccggctctcaccttgcccaccccttgacgaacggggcgtgcggtggcttcgtggttgagcggtggagttgggctcgcctcaacggggattaggaaaccggcgagtttccgaacctcggtgaaaaattccttgtctcttgtctcatttattttctgcatttacatttgtgcaatttgcattcatagagacatatttgagcccatatcacctaggtttgcaaaatttaacttagttgcttagttaaccttgcacctcaccttgcctagcaacttaggttagttttgtttaagtgccattaagttttaagaccgcctattcaccccccctctagtcggcctccttgatcctacagggtgccgtgcgcggttggggatgtggtgagtgtggccgtgcccggcgggcgaggccatgacaggagcgcggtcaatggcaatggtgactgtcacaccctgaagttctttcccaagcctaaattgaagttataaatggtctcaagaaaataccagtgtaaagcaagagtaaaccttaataaattaatgcaaataataatcagatttggcatgtgggatttttcttgagttctaaatgtcgaaatacgctaacaagatttttagtggaattttcagagctctagaaataattttaaccaattaaaattgagcacaagcaatatttaatcccaggaaaatccatttccttccttttctttttcttttcccctttttttctttcgaatgggccgccggcccgttctctctccctcctcttcttgttgggccggtcgaaggccgaggcccagccgagctgagccagccgcccgcctccctctcccggggttgccgacaggtggggcccacctgtcgggcccgtccccttcctccggccggagccgccgcgccccgctcccacgtctcccgggccacgtcgcccacgtcgccctcgcgcccgcgttccccgcgcccacttcccctctctcccgcctgcgcccgcgctcgagacagccgggattcgattttcgaatcccgcctctctctcctctcccacttcccccacgtcggccggcgattccctcttctaccggccacgtccgagctccctctcccctatttaagcatccccactctctcctctctctttttcccatttcgccaagctctcccgtgccctctatcgccctagcgtcgtcaccctcctctccgccgctgccgctgctccggtcgccgctagccacctctagccgccgtgccgagccgtgtcgtcgacgccgtcgcgttcgccgtcgtgccggccaccccgtccacccctctcccgtcggattccgccgccggaacccgctccacgccgtgcgccggtgagcatcgccatggccgccgcccttggccgccgtcctcgccctcttccatctccctctccctctctaactcctttcatcgtgttcgctaggtggttccggagatcgtcccgccgtcgccatcgccctccgtcgctcgccgtcgtcgcttgtcgtcgatgaggcacctcctcctctttctctctctctctctctctctctctcccgcaccatctagtcgccgcgccgccgcctagccgcttagccgctgccagcgtcgccgcgccgtcgcgccgccgccgcttgccgtctgccgcgccgccgccccgcggtagcgccgccgtgcgccatggccgccgggccggctcgagccgcccgtgcgcgccggccgcgtgctccccaccgccgtccgatctaccctcgggtagttcggggccgtcggttcagccgcccgcgtggcgtgccatgtggccgccgcgtgtgcgccacgtcagcgccacgtggtgcgccgctccttccccggtccgtggacttggtccaccatgaaccgccctccccgagtcactgccatgtggggcccgcatgtcggcgccgcccctctctctctcccgtgatttatttattgcgcaataattcaattaaggatttttctgtttatagtaaaaacacagtgaatcttctaaaatttatatctaattcatccaagctccgtttaagcccattgaagtctcagtaaatcaataaaaatgtgtagaatccattaaaaatggttttgttctctgtttcagtagtcttatagcctgtttgtattgtttgctttgtatgtcgcttagattccggctctccccacgctccggtgtactttgaaatagtcgccgaggttcctccagcagtagagcaaggcaagtcatgcttgtcacttgaacatgttgatcctatattgcaaatgctccattgttttccttcaaatactgcattgttttataatattaccatgggaagtttacctactgttatagccatgctattttgtaccatgttcctttgttagcttgggatataacatgactagagattggactagggatttcttagccttgcttagttcaactagcacacaatgggggacaacattaatgcatagatatcagattctaggaatgatgttggttaatgctcaccgctccagtgttggttaattaaaatatattaaatggtgggctgtgggtgcatggttttgatggtcgcgcccatggcaattaaggaccggttcgcgggaaatcctggaagaattcctcgtacttaccacaagccagcgtgggcaacggctgagcttgtagtgtagcttttctctagccgacacatccaggcaagggtgggcgtgatggagtttggatgggccttacgacggcctatgcggcttccggattcacctaggcacgagaggggactgcccgctgccttgcgagaagtgggagtgaaacctgaggtgtggtgtgcttggttagaggtggttatgcgaagggtcctgtcatggcctctttccggtatgtcgtggtggcatgtcggcgcacggaaacgtgtcgtggggctgtgtcttgtgggtacagttgtacacctctgatcagagtaaaactattcaaatagccgtgcccgcggttatgggcggtcaaccagattcaccgtgattagtctcaccctagggtagtctgatggaactgattagttcaggtggatggttgggcctgttgcaacgtggtgtagcgttggacagtggatggttaatattgattaattactataatggttttacttcttccaactactgtttataaatgctcgctttatgcaaatgaaccactctagctatcctttgattaccctgcatcatacccctatcccggtatgacttgctgagtacagtgggtagtacttagtcttgctctatttttcccaaaccccagagtttgagtatgcgtcagatggtggcttttccgaggagtaggtttcgtccgtgccatcgaggatgcctgtggagtggtgttcccgctgcagtccaagtcaaggctaagctccagatatcttttaagttttccgctgcatttatgtaagacttttataatatttgtaagacgtggatctgtatgtcaactttgtcgtttgtgtaccccggccggtcctggacggggattttaatgcacattctgcttggaattctattcgggaatttctaggcgtgacagtgacgagctcagaacaaccggatccgatggcaaactcgctcatttgtgtgatttttttcctctctttttttccttttttctagggttctcaatctgtgtaactatccgattggatgattcttttagattctccgtgtagttctgtttgataggatgacttttttcaggttctctcagtccgtgtagatctttgatttgattttgtgctttatccatcgtacatgattggtatatagagtgattaataagaacaaaaaaaattctaccttttttatcacggacggtgggtcttcttttctccgtgtcattgatgaatcggacttttcttttttttttctttttatatgatgagggcatcatcaccatggataaaccataatgatgttttacctaatcgaacataaggtgcaagcttcttatgaatcggagaggtgtatcgatcgctaagggcgcaacgcaatgccttgtacggttgtagtcggatcatcaacgtttcttccaaatcgtagttatctcaactcaccgaaagatcggtccaaacaacagctttgagcatcttgagtggagctcagggtttatcattatatatttgttcgcctttttttttatcacgatgacgaaaacaccttcaattttttaagtatttttttaagtagtagagatagagataatagaaagattaaacaagattcgatagacgcatgtgatgatatctctaatctaaaaaatataccaacttagtcttggagattctcatagagatatgttgtgcgtgtgtgctttcatatggatcaatgtgcacgtgtttatatgaatgcatgtatctatactgtgtttcgaaaaaaaatacaacctgttctcaacgctatattgacgtgaaagtaaagtgaaagtcttttttactttcacgtagaataattgattttgtatttttcttatttacttaaagttgtctttataaattttagcaaatgagatattttcaatagactttcatgtctaaccggaggaccgtagcgtttaaaaaggaaagaaaataaataaagaaaatgggaaccgttttctcgctccccttcccaggcgctatctcctcccaccactcgaaccttatcccctccaggcgcctcactcgaaccttaatttcgtgttctagttagaaatttggaatttagaaacacagctggattggggttctcctatggatcatgcttcagattttatttaggtggattagagtcttattcctttcgattttggaacgacctgggctacggactacacacgttaggatttttatcgatctctttttctttctttggccgctgtaaaatagcgaagatagagggccactcagtcggaatcgacggacgaatcggtcggaattgacgcacgaaaattttgtgacgaaaggaaaattttgccaaaggaaaattacgattctttatattagttaagatttatgaatttgatcggccagtcgtccgtcgaaatcat

SEQ ID NO: 44571 - DNA, 2792 bp, Oryza sativa
ggctgccccccgaccacgacggcaccgtcctcgccgccgaaggcagcatcgccggaggtgcctcctgtcatgctgcggtcccatggacccgaccagctgcaccgtgcttgtcatcgacctcgcctacccggagctctggtattgccgccccggcgacaaccagtgggtgaagctccatcagcatccgtaccagtaccgcaaccctgcccaccgtgacgccatcatcagttttttacgcaagtttacggcgatcgacggcaagttctacaccgaactacacaccggcaatgtcggcgtcctcgagttctcgccggaggttgccgaggggaactaattcccctcggcccaccggcacccgttgtcaagcgttatcaaatccatgcaggctcttaagtcgtgtagttatacaaagtcacaaacctgtattatcgacgaaaatctcgttccttgtagattgagatgcatggcctctctgtttactttaaacatcattcaagcggacaacaggtggatgttaatttgcctaaaaccgacatttttcatcttcactaatagctgatccattttgctgtgctacttatttactgttctctgcaatgactgtttggagatgctgctccacaaaattcagtggtgaatagatgtgtcttgtgtatttatcatacatctgttcactttaagccaatattcgagccttttgccctgttacatcaaattgcattattcacttaaataaataggtatgaataaggttactcaaaaaaatgctttcgcagcaacaaatctgacaaaactgcaaaagttcacccttaagaagagggatatatatatatagcattggttctgcacttctgcatgctaaagtactccacatgatacagcaggctggctttccatccataaggttacaaatgggcaggattgccgtttctgtttgagataaaccaaaggagttgcaagttagaataaagcatttatagtcacatcatgcatacagtttcagtactacctccgtcccaaaataagtgcagtcgtggaaattcgtgtctaacgtttgaccgtccgtcttatttgaaaactttatgatttttttaaaaaaaattagtcagacataaagtactatttatgttctatcatttaatagcaataaaaatagtaatcataaaaaaatttcaaataaaacgaatggtcaaacgttggagatgaatagtgcaaaactgcacttattttgggacggagggagtacaagatacaacacacagcgaactggcaatagattgcttttttgtaaatcttagcactccaatgcagcttgagcttgattagttccaggtgttgacagacggtcctgtgactggttgctcatctagggcacggcgcaactcctcaaagaagttcatctgtactaccaatgaccacagaaaaggaatcagagtacagaaactaagacgtaggagaacagtatgacaaaatcgcaggttcaatatacctgatgaggaagtttcatgtgaccatgaccccatgatgatccactagatccagagtacatcaccggcttatctggcaaaacatcaacagcatttaataggttactttggtttagtgcttcccgttggtacaactgacatgaaaattcacttgagtgcacagggtacttgatggtgttcatagtaacatattaacatcacgaattgctatacaatactataattgctagcaccataattgtgcggcgtcactactgttgccaacactttatattcacctccatatttctatcataacttatgaaacggtaatctaaattaaacataggtctaggatagtatgccaggtcttgtagaaattgatcctaaaatatctaaagattcctctaccatgattcatgacatagtaaatctcccatcatgcggcctgaatttgcttaaggactcaccaggggaatcatatgactgatcattgtacaagttcattgctgcagcccaacctacaggggaaaagcagcaaaggtttattatcacataagaagaatggttgtaaataaagttggttcaaaattagtacagcaactgtaggaatacatctttgttatatatgcctagaccatccttgattaaaagttgcctaacttccggtaaattaccggtggcatatgcacaattgcacataaagagaacagttgatggtatgattaatgaacaaaaaagataggataagcagtaggtacacagtttgaatattcttccatgttactaacatgcagagaaccccaaaataaatcacaacaggtgctccacgtatttttctttacaacttacagtatctgaatattggattatcagcctgtgtaaacttattaaagcaatgggcggttctgtaatatactgcatgtgcttttactacttactccctccgtcccaaaatataagcatttttagaccacgacatagtattcgagatgctactttgaccaacaatatctataaaaataaaatggtttaaataaaaagagttgcatataataatagtttgattaatgataaatttagtaacatcaatttcacattattgattttttttatttttttgctattaatagttaaagttaaaaatggttgacttagcactatgctaaaaatgcttatattttgggacaaaatgagtaatatcttattactgtagacataatgtatcactaccacaataacatgcaacaattcccagaaagtcaaaaagataagaacttatatcatagaacttctacaagcatttaaaagggcagcttggtctct

SEQ ID NO: 44572 - DNA, 15640 bp, Oryza sativa
cccataaattaaattgttatgcttaaacatacagataaatcattaaaaaaacacatggataaggaaaagatagcccataaaaaaattattggaaatatgaataatcaaataaagacatgtcaaggttagaagattctggacagctattggacataataagtaaactctgagtaaaaaacacatttgacttgtaaatgactgattgtggggattatgattgcaggtagcttgcattagatgcatgaagttgcatgttgtacagagtattggcatcattaatacaatggagtagaggggctcatacaaggatgtttgcttgcaaggatttccttatagatatagagtagttatcaacatggtcggtgtaaggcacatatttttcagcccatttgtggaaaagaaacatggcagtttcactgcatagaaatctactagaggaataatgaattaagtttgataccataacaaccaacaactggataagaccttatcaactaatttggagaccttatatagcagtcaagccaaaataataataaaggaaaatataataaatccccaaaacatcatgaaatccaactgattcaataataattgcgtcgattgttagcacggttcctgaagcatattcagtaaagatagccatcagaaagcatatctatgcatgatatgtagcaagattattaaaactaaataataactaacattagactgcagacaacagaatatttcaagaaataactgatggtttcaaacaaaataaatatttagctcataaatacaaagatggaacaaagaagccatatcaagttatcaactaatcaaatcaacaaggtgatagactgattgaacaatatgtcttaagcaaatctacttcttcattgtgaactccacttataattgtgaaattgtgattacgcgatcacctatcaaagggcaattttcaatatctggcagtacagtaactaaagtatgatagtctttatgcagtcattatatgccctgtgttgaagtcatgcgttaaacttatacaagctgaccgactggcagagttttgctaggcaaggttagcttaatccgctaacccaaattcgaaacatgggcaatccttcacttgctaaaacaggtagttaggtcagcattaaacatgccctgaaataagccattagccatgtagcttgaacaaagatttttctaaaataaataaaagttagttgctaaggttgttcattctcaaaaagctaaaaagagagaccagcgagccaataagccttataggtcggcttccgcttggagattgtataccgccccggcgccccggttggtttttgttggtttgctatccaatctccatatatgcaaagtatttagattttgctttagaattgggtagtggtttgaattttgatatcgtgtaggaattcatgtttccttttcctgatcaacgggtggtgcagatgattggtaggagtactaattgtaggtcgtagatgtgcatacctctttcctatgccaatagttatttataaggatttatgaatttgatcggccagtcgtccgtcgaaatcatggaggaggcaggcgatgcatctgcagcactggatcccaagtttgctcctctgctgctgttcggcggccacggcgacgccacgttcctgtacagcgtgccgacgagggcgctgctgccaatgccaacgccaacgagggtgggcgacggcggcgtcgacgacatgatgagatgccaccgctggtggaccacggcgcagggctggttgctcatggcgcgccgcggctcgccgtgcacttttttatgggaccctttcaccggccgccgtgtcgggctgcctcccgaccacgacggcaccgtcctcgccgccgaaggcagccatcgccggaggtgcctcctgtcatgctgcggtcccatggacccgaccagctgcaccgtgctcgtcatcgacctcgcctacccggagctctggtattgccgccccggcgacaaccactgggtgaagctccatcagcaaccgtaccagtaccgcaaccctgcccaccgtgacgccatcatcaggtttttacgcaagtttacggcgatcgacggcaagttctacactgaactacacaccggcaatgtcggcgtcctcgagttcttgccggaggtggcgttcaccaagatcgctgtacacgacgacgataggagaccggcggtgtacaagaaacgtactacttgcttcgtggaatcaaacggggagctgcactccgttgtcttctctcacccgatcggatgtgaccggattgtcgcgcgtgtaggcgtttacaggttgagcattaatgcggcggcaacgcaggagcaaagatcagcagcatgggtgaaggtggattcgctaggtggcagagcgttcttcgttaagataggcagttttggagcgtcacttgatgcggagggaacaggcttgagagggaactgcgtctactactcggtgttcaatgggaaagtgttgtgtgtatacgacatggaacgaggaactacggctgtaatcgatcccggcacacatcttccgtatcaccagtcaccccaagtattgatgccaacatttcctagatatcatggcggagcaactcgaagtgttgaaagcatctatcaggttgggccaacaattcaggaaaatgcttatgaggtaaaagacactaaggtaagtaaggtgaagagggatgttcgatttttcgagggtggttgtacttgtttgccgattcctattcaaaataagttaataaatcagaagaagagtaagaggtctatggctgaaagatttccttgtcaaggggaaggtgcaagcagtcccgaaacgaagaactcataccgcggttgtggctttcctttggagccgctcaaatgtcttctgcgtatgaagaaataggagtgcactacatagaggatccaacttaccttttatgccaactcgatgagtgtttttttagttaactcattcattcaaaatatgcactaatgttagctcggctatgtcacgtctattaatttcattaagttttggtctctactatgtgattgggagctctttttctctgaaattttatgaaaccatcttcttttttcttttaggtgtttaacagctccccaatctgctttcttcctgagaaagcctcgttgtgtagtgcccgttccgtcgtagcgcctagctaacatcgtcagatcccaatcccccaatccatcgtcaagttcgaattccaacttcaagtcccctccaaatcaaatctctcgacagaagtctatttcgcctccctaaagttttgtgggccgagctccctccctcggcacatcttctccctcagcccatcccctcctctcgcacatgccgtgcgagtgcgctgagccgagccgagagagagccctctctctcattttcttgctctctctttgttctctctctccccgatttcccgccaacgacacccaagttgccgcgccgcctgttgccgcgcgtgcactgtggtggccgaccggccggtcgccgccgccgtcagccctgcctgttagagtatatggtagttagagtcatattaggatagaattggtttgtttggattccttccatatctgtaatccttccttatcttctccccatgtactcctgtatatattggctccctgagactcaatacaatatgtccaatattcacagtatcctctctccctatattatctaacatggtatcagagcagacgatctagtcgcctctctctcacgcttccgctcgtcgccctcgggagggtttcaatctcctggggcggccaccgtttttttttccttcgcgtcgtcaagtcgatgtcccgagagagatcgatctctcggacgcttgcgtcgtcatcaagcggcagtagcagagtctccggtcatcatcagtctgcacttcgtcctccacctccggtccgccgcctccaccgcccctacctccgatggccaccgtcggcttatcgacctccgccgggctccgcggccgacggacgaccttgtctccgcctcgaccgctgtcttcatcaagctccgccggggggatggaccgacgtcttcaccgcctctccgcctgccttctgcctcgtcgccggcaagacgctgctggtccggcgtctctggcacgggcgcgcggcccgacacctcgccgccaggatctgcaccattgtcgccgcttgcggcctcgacgcctccggactcagctccctcgtcgttgccgccggtcagcccctacgcgtccgcgtctatcttgcctctcgctccctgtattgtttggttgtccgtcactttgctgtgatcttacacgtgattagcaagggagaggagagagagagaagatggttgcagagagcttgttggctggctggctggctgtggagggaaccgattgtgcatgtgtcgctgctgctggtacagttgaggcagagaggttgctggacgtggacttggtctacggaccatttgagcacgtagggctggttgttactgtgctgcttgctgctgcatgtatctttttttttcccgatcagagatcgggtttgcgtcgtccaccgcctcgtcgatatctacgcgtctctgacatcggcatcgacttcgtcgtcctgccccgcgcatcttcggcttgatcacccgttcaagcgtccgactacaacgacttctgtaaccgatcgtcatcgagcatgcgtctacgccatcaagctctgggttgccgctgtgtcgcctccttgggccgcagtgccgctgcctatggtccacacctccattggctattgcaacgctgagaggcgcccttctcagcgtggcctcaccgccggtggacttctcgccgctgcatcgacatggagctgcagctgtgctgtcctctcggaccatagctttgccactttcgtcgtcttcatcgccgttcgcgcatcgacaacctcgtcgtccgcactggtcatagtcagccgctcggggtctccttcctctacttcaagcatcgccgccgcatctccaagctgccactgtcgccactctaggccggtggtgcagctacctctacatggctaccgatgtcgccgtccaggccgttggtcccgctatttcgccttctactttgtccagcatgactcatcgccagcgtcgccgtatcttcctcgactacacttcgctcttctccggcaactgcgtgctgctccggcaattctccctctacgccgttctcgcgctgcgactgtcccagaggccttctctgctagtctcctccgacattggcgtatgattcatggtggtctcctgtctcgcccgcgcggtattggcaacaccggcgcgcgcgtttgtcccgagttgtcccggggtctggcaagccctgtgtaacgtctcgtcctttacggttcgactacattggctcttcggcgtcatcttcctcaacgaccgccgcgattgtatcaccgtcttcgtctccagcgcgtcctcacgcaccattggtccacgatgccctcccgtccatccacgaccactctacgacgccccctgcgccttacggctcgactacctcgacatcatcgacttcccgacttcggctacatcgaccacggctactctacgcacggcttcatcaaccacggctctctcggctccttcgctttggttacatcgactatggcacaaagggctatcatctgtgttgagtactctttccggtttcttctccagtccaagtgtccgcgctgctcacgcttggactgcgggggatgttagagtatatggtagttagagtcatattaggataggattggtttgtttggattccttccatatatgtaattcttccttatcttctccccatgtactcctatatatatcggcccccctgaggctcaatacaatgtgtccaatattcgcagtatcctctctccctatactatctaacactgccgcgcctgtgccgtctgtgcccgcgctgccaccctgtagccgctccgctccacaccgcccctagccgtcatcgccggcgtcatccactccggccccgccctccgtgcgcgtgcgtccaagggatggaggtagagccctgcctcatcgctccttctccctccttcctttcccgttttggcaaggagtgccccccctttctttcttctttttcttctttttcctcccctcgccggcgtcatcctctgtcgccgatttggccgcgtgcgccgagcgccagccgagccatttgactgcccaaggtcggttctcccctcccaaaccgacatcgccatcccaatctctcttgttttcactctccaccgctgtcgcacaccattgtcgtctcgctgtcgccgtccgtcgctgagcgtgccggaggagctggcgcgttcgtggacgcgtgacgtgaactccgcgctcccgcttcatccccttcctcggccaaaacgatcacgtttcgcgccgtgtcctctcttcacggcgccctgtcccgtcgcggtatcccctccgttccccctcctcgctctccctcctccccgtagcacacccgatagctagtaggcgccaccccaagccccgccgccgctcggcatggtctcgccgccattgccgcccgtcgcttgccctcctcggctctgcttcgtccaatccgacgctaggaacgagtcccggtggtcgtgtgtctgctctagcttcaagaaatcgaaccctcgtcgtcacgtcgtgctttccctcttttgccgccgccgacgaacaccgccgcaatccgccgccgtcggaagggcgacacggcggagcgccagtgccggcacgtcgacgcgaagctcgggtggctcgaccacccgagcctatctaggacgagcacgagcatgtccaacgggagagacgaccagtccatctgcttccgcttctttttcgccggcctggctggtgttccacacgcgagagttcgtgcgtgcgtgcgtgcgtgtccgcgatggcctgcacggcgtaatataggtcggcttccgcttgtagtttttgttagtttgctatccaatctccaaatagatgcatactggagtactagtacaattaattttgatgtcgtgtaggaattcatgtttccttttcctgatctacaggccggtgcagattataattggtaggagttactgattgtaggtcttaggtgtgcatacttcttcgcttctttatctcttgtagacttgtactactattaaatcgcttctttatctcggatgatttggaacagaaatcacgagacaacacttgtaggatttctaaaacactgcacaaattcgtataccgaaagatcgatcggccagtcgtccgtcgaaatcatggaggaggcagtcaacgcatctgccgctctggatcccaagcttgctcctctgctgctgttcggccacggcgacgccacgttcctgtacagcgtgccgaagagagcgctgctgccaatgccaacgccaacgagggtgggcgacggcggcgtcgacgacatgatgagaggccaccgctggtggaccacggcgcagggctggttgctcatggcgcgccgcggctcgccgtgcacattcttatgggaccctttcaccggccgccgtgccgggctgccccccgaccacgacggcaccgtcctcgccgccgaaggcagccatcgccggaggtgcctcctgtcatgctgcggtcccatggacccgaccagctgcaccgtgctcgtcatcgacctcgcctacccggagctctggtattgccgccccggcgacaaccagtgggtgaagctccatcaacatccgtaccagtaccgcaaccctgcccaccgtgacgccatcatctggggattacgccagcttacggcgatcgacggcaagttctacaccgaagaactctctggcattgtcggcgtcctcgagttctcgccggaggtggcgttcaccaagatcgccgtacacgacgtcgataggagaccggcggtgtacaagaaacgtactactagcttcgtggaatcaaacggggagctgcactccgttgtcttctctcacccgatcggatgtgaccggattgtcgcgcgtgtaggcgtttacaggttgagcattaatccgacgacaacgcaggagcaaagatcagcagcgtgggtgaaggtggattcgctaggtggtagagcgttcttcgttgagattggcagttttggagcgtcatttgatgcagagggaacatgcttgagagggaattgtgtctactactcggggttcaatggaaaagtattgtgtgtatacgacatggaacgaggaactacggctgtaatcaatcccggcgcacatcttccgtatcaccagttgtagcgcccgttccgtcgtggcgcctagcgggaaaattatctcttaaaaaccctaattgcgaaatttgtttccttgctcgttgtgtagtgtccgtgccatctcagatctcaaatccccgatctatcatcgagttcaattccgaatccaaatccttccaaatcaaattcctccgcaaaagtctagtttgcctcccccggggtcgatgggcccaatccctctcggcccatctaccccggggggggcgcgctcgacccctgcggaggtcgctgtctcggccggctctggctccggtccagtgcggacccacgcgccgcccgccaccgcgcgaccctggccgagcgctccccctccgctctggccgcatgcgcgtgagccgcccgcgccgagcgcccctccccctccgctctgcccgcgcgcgtgcgcgtgagccgcccgcgccgagccgagccctcctcttcgctccctcgctgccgctccccgcgctcgttcgcgcgcgcgcccgcgtggttgccgcccgtgccgcgccgtctacgccgtccgcgtcacccggtcccgctgccctgccgcctgcagccgcgccgccgctcggccccgcagccagcgcgcgtgcccgagccgcgccgctccatccgccgcgcctcccgttgcaagccgcgcgcgcgtgccgagtggccgaccgcctggtcgccgccgtcgtcagcgcctgcccacgcctgtcgcccgtgtcgccgctccactccaaaccgccccgccgtcatcgccgtcgtcatcgcctcggccccgccactccgcgcgcaagccgccaaggaacggaggcagagccctcctccctctgccgcgacgcccccgctcccctcctccttttcccaaagaagaaaggggcgagccccccctttctctccctcctttttccccttttcctcccgccggcgtcatcctccctccgccctgtcgccgattggacgcgagtgccgagcgccagctcgcgccttgaccgcccaagtcggtttccaaaccgacattgccgccctttaaggccccgggcgccctccctctcttctcctcccatcgcctccactccattgttgctgcccctctgtttcgctgtcgccgttcgtcgttgcgcgcgtcggaggaaccggcacaagcgaggacgcggaaggggactccgggcgctcgtcttcctcctcttccccggcccgaggccggagagattactctcgcgccgtcggcctctcgtcacagcgcccctcctcatctcggtagtgcctccctccgttcttcctcctcgctccatctcccccccttagttttcggtagtagctcgagtagcctccccgtagctagccggcgccgccccgaccgttgccgtcgctcgctgtgtgctggccgccgtcgccgcccgagctccgtagcacccgctcgtcgccggcctcgctcggcgtagctccgcccaatccgacgctagcaacggattcccgtggccgcgtagatgctctcaccgccgggatttggcccctcgtgacctcgtcgccgtttcccccttttctttccgccgggtgccgccgccgcaatccgccgccgacggactccctccggcgaatccgagccgttagctcgctccctctcactctccctcgtcatcccggtgtacgccccgtcgcccctcatcatcgcaaggcgtccccgagaaaccgccaccgcccgccgtccattcgcggccgacgccttcgtcttcctcccgccagcccacgtggcagccacgtaggcgccacgtcggcgccagctcgaccgaggtcgggtcgggccgaccccggtcagcccctcccgtgcgcacgttctaccgcgagccgtgaggctgcgcgtgggcccgccgcatccgttcctccgcgaaccgcgcgcgtgcaccgcgtcccagccccgcccgcgcgcgcgcgccgcgtgctcgctccgcacggtgaacggagtcaccgacaagtgggtcccacccgggaccacgcgcggtgagcccggtccaccggctctctctctctcctccctcccgcgcgagcgcgcgccttgggccggccggcccatttagctcggccagaccgccccaattctctcgggccgcgccctagccgcccgagaaaagtctatattccctccctcttttcttttcttttattttcttttcaaaaaggatttaattaaatccttttcctttagaccaaaaatccaataatcttagaaattcaatatcttcccaaccataaatccgtttgactccgttcaacttccaaaattcctcaaatctcgagatctatctaatggcacgcttagaggtcattaatagggctttattttcgccgtttgttgagttgtcccgtttcgcgtgtagtttcggagcccgaagacccgcagtgcgaggatttcgaggatcaagctccagatctcgagcaaggcaagccacctttgaacatcttgagcctatatttgaaatttaattatgttgcttgaaaaatattatgcattgataggaccgcacttaatctgtttgtcccgtctgcaaggcagattggcggacctacctagtttgttgcatttgatccttcctttgttaattgttatatcatgtccccttgtatccatctagttgtgtctcgatattcgtgcaccctgtgcgagtatcgacggacgccttcaaacttaaaatttgaataacaacttgggtaaaacttgggttttacaaaagacttggaaaacccggcacctgggtcggtgcttgcgaactaaatgaatttccaaaaccgcggaccggggaacgtaccgggagtacggtttcccgctcttgcacttaaggaccgtttccttggaatttcatccaaacataagacaagtacgaccatatgggtggaatgggacacccctagctgagtaactagcttatcaggggagccttgatgccgagagacatgtggattcgccgaggtggtgtcggggaggactctgggcttcctggcacagtatggtctgggacctaacctgttgttggtctgggacccctctcgtcggcatatggtaaacctgtgtcggctttggaaatgccttgttatgaaagcttggaggtctcccgatgtggctgattcccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgactactgcttgtgaaattacggttgtggaaaggggttcgatgtttgaaaaatctgcagctgatgggatcagctaggcccgggtggccgtttgaaagttgttggcccgggtggccgtttgaaaaactgttggccgggtgccaaccttgattcaattctaaagactgatacattgcacatactccgagcggacgagacgcactgtctcatccgtgtcgtttgagaagcactcacttagttgtttttagaaaagagttcaaataaaatcaattgcaaaaacaacagcctttcctcgaagcctgcattaaacacttatttcccatggcttgttgagtactcccgtactcacccttgctctatataaataatcctccccccccagttgctgaagaagatgaagcggaagctgctgatgagtagttcttccaggagcaagccggctacgatgagttttagggtttcggcctagttcccaagtcgcgcctgtgttgtttggtccaagtcctggcttccgtttcccttttgtaatgcagttgtgagctcgggatctgtccgcagcccaacatgactgtacctctactctataataaagagacctctgttgctgtgatattctgtctccctgtgataccagcactgtttcctgggactggtatcgaataacaggttaatttggagcgtcacgggctagttccggtcgggactagttcggggcgtgacaccagtcgcctcaagtattgatgccaacatttcctgcaggatgttacggcagaccaactcgaagtgttgaaagcatctatcaggtagggacaataattctgaaaaatgctaatgaggtaaaagacactaaggtaaataaggtaaagagggatgttcaatttttcgagggtggttgtacctatttgccgatttttattcagaatacgagagtgacaaagcagaaagataagttaataaatcagaagaagagtaagaggtccatggctggaatacctccttgtcgaggcgaaggggcaagcagccccaaaacgaaaaactcataccgtggttgtggctttcccttggaggcgctcaaacgtctcctgggtacgaagaagtaggagtgcactacatggaggatccaacttacctttttatgccaactcgatgagtgtgtttttagttaactcattcatttagaatatgcagtaatgttagctcggctatatgacgtctattaatttcattaagttttggccactactaagtgattgggagctctttttctctgtaactttatgaaaccaaaccttctcgttgcattaagagaatgatttggtaaattttctttgataaaataagttagaaaatattaaaattaattatgaccttttgtttttccaaatatttgttaatttggcaataatttattcaaattcagtaaaagaatgtgttaaaatttcaaaaattttcgtttggagtggtgcctaccgaaattttctagctttttagaaagaaaaaatcctgcttatacccggttttagaattgagggccgcaattgaaactcgacctcctccataagagacggaagtggacttttccaactgaaaagcatttcctgcctgaaaccggagagtgagagtcagagactcgttgttctaaaaaaaagttctgaaaaaaaagtgagagaccctcaatccctccccaaccggaacacccactccgacgagaacgacatggacgccggcggcgaggaggagaagcaggagcgccaccgggttgatggtgcttcgccttccatggtcgccctccgctccgacgtcctccacgccgtacggcaccgcaccgccgtctctctccctctctctctctccatccatcggccggctccccgcctgcacgccggtagctgacgtgttttggtttttcttttcttttctttttttatgcggggttggctgccggacgacgcgctgctggccgagacgcgcgccgcggatcgacgggtcgtgttactcttattgctcagaaaattaggtttgcccgttgctgttcttatggctgtaggcaactcaagtctatgtggggataaattttgtgacaactcaagtctttgctacgattcgtttgcctaaacgaacaggtgtaattgggcttgtagaaaagcaatatgccaatatagattcctaaggatcacaattcacaacttcccaaccaatataaaaatttctgcaccctcgtcaccaaggataaaacccaatgtgaactaatgtgaaggaaagtcgagatatagaacttcattagagcgtaaatagtatcctttggttccagacatcaacacatgcccttttagctggtcgcatatatcttccgtgctgctctccgcatttgttctgtatctaatgtttcagttactagcaagtttgataagaatcattgcttcctctgaaagtaattatttttcatgtatcaagaattgctgacgctgaagagaatttgggtgaggttgaagtgcgtgaggcccatatagccaaatccttgtacttcataagggttggggagaaggtataaatctgtatatctctatactttaccctgtgacctggttgacaaagtacatgctcgaaatttagctacttcagtgacaggggacctcctgttgcaggtccttggagggaagtctcataatcaggacacttctgaattggtcacactggtatgaaagagtttcatctatcatgtcaagttaaatcagggaaatcttgtaaatcgcgtcttggaaaaactaaagatttgcagtcggagtggtccaaaaacaaatttcctttgtatgcttatgctgctgcttttatgttcctagtcatgcaagaatatgataaaagatcacatggtattgacttcctcaatcgggactttgttgtccgaggtaaattgatatacatgctcggtgtctgtatgaagtgcatggcaatgcatccggaagcatcagctgttgccccaggtcttcttgatatgtcagatctaggtatgccaagcctaaacaaacatttccctgttaaggaattttattggtaagttaccattttgacatcaaattttgttctacagagctgtttgacaacatcctgaagcatatgtcagaaggtctgtgttgtttgcagcttcttgcatattgatagcgctgcacctgttgtatgtctcatcagctcttatagaaggaaatcaggacattctacatacacatatgggttcttcatgttgcagaagctgatcctgatacagaatgcacatatcagtatgtattttggtcactattggggggggggggggggaattatagtacaataggctcagcacataatactaacagggttatttttcaaccaacaaagtacaggttttcagggtaaactttatatcaaattcatttgcgtcgcctttaattttatcctgaaggaagagtgctttcaccctgagatgattcaccatctgaaaaataaaaagctaataactcccaccttatgctttagtttcctgtgacatacttctttctatcattcctttaagtcttctacttcaaccagtgatccagctcttttcagtaatgtgtagagaaaattcggactcttttttttcaaaaaaaaaaacgtataatgagaaaccatttcagtacgctggaactcagtaacttctcacaatgtcatctaactcctccattggcatgtctgtctccttgcaggccattatgacctgtttgcaacttcgttctgagatcttcagacatcacaagcactgaatcggtggatcacagcatggccagcagctgcaggtctctgccttttaagcttgataccatcaatgtactggattagaaatataaatcgatcaatgtatttgggattcagagtgctacattttcgtcatttatacatagaacatgaattcccaacatgaattgatttatgtgaaacgtctgttccagattactactatgtttgaaaactttgaactgattagttgagcaaaagaaaattactacatgtgaacgggtcttgcagggcgggctgcagg

SEQ ID NO: 44573 - DNA, 1615 bp, Oryza sativa
gatcagccgcgagggacgaaccgacggaggagatacgtccgtggcagggggagcgatctgtggggaccaccagccacaggatgggggcactcctcgacgttggatcagccgtcgacgatccaggtatttaagcacaactatttgcgcttcgcagcacaaccacttttccgcatctctcctctctctctctctctcgggggtgtcaagagcgcagcggcgaaaggtgggaggtgagatctctctctcacttcatcctcccctcctcttctgtggtttcgtccgccgcctccatccctaaaccctacttctccgaaagcgccgtgagattcttctccctactcttcttcgatcttgctccattggtggtggtgatgtttgtttgcttggtgtttcgtgtcgcggtcctctcgttcttgtcttcgctgagtggcattgatcgagcggcaccgcgcgtcgaactcttgcttgaatctggaggcgtttcgtcgatccttttgtttttcgtttcgtgttcttggcttcttgtacccgtgatgttgacatgttgttgcctgatgcatttgaggcgtggttttcttagagttggatgaggaggttgacgagcaccgaagcttcatggtgatctcgttcgcctctcctcagaacacgttggtcttgatcttgccttccgtttctctatttctaccagtgcaagctcgagaaattaaaccacatcaattcgtttttccattggtggtggtgtttgtttgcttggtgtttcgtgtcgcggttctctcgttcttatcttcgctgagtggcattgatcgagcgacatccgaaatcttgcttgaatctggaggcgtctcgtcatccgaaacttgaacctctttaccgccctctgatcctctctattttttttcgtgttcttggcttcctgtacccgtgatgttgttgcttgatgcatttgaggcgtggttttttttggagtcggatgaggaggttgacgagcaccggaacttcatggtggtctccgttcgcctctctcccatcggaacttcatggaggttgatcttgatggttcctggcgcgaccagtgcgtgcgcgagaagttagacgccatgaattcgtttctcttctctgcttttttttttcgcttctgttttggtgtgttgcggaggtgtcactttctgaatttgtatcaaccaaattatttttgctgttcctgatgcaatacgttatacgcccgtcttccttacgactgatcaagtagcaccgcgccttgttctcttctcgtctcgaatcttaaggcgtttcggaatccgaattttctacgatttttcttggccgtgtttggtatcgcggttctctggttcgatcatgtcttcgctgtgtggcatttgatcgagcagcaaccgcgtctcgacctctctttgaatcttgaggcgtttcggcacccgaaacttggggcaaggttcacagcggtttgatcttttttttttccctcttgttcttggtttcccgtacccgtgcttttgttgctttgatggttttgaagtttgaggttgggtgtggttttcttcgagttggaggagaaggttgatgagcgccgaagcttcatggtgatctccgttcgctt

SEQ ID NO: 44574 - DNA, 795 bp, Oryza sativa
ttgaacgagcgcgtcactccgcatgtaacgcagtgcagcgcgctcgtttatccggtctgtgaccggtcacagaccggtcagatcgtgggttaggtggcaacaggcggtatgacacacgcctcgccccatcccgtcaggataagagcctccaggcacttgtccctagccggagccagcgtgctagctcctggagatgacacgttggtcccggtcagatatatgccaggcttcatcccaaccgttacaagcaagacattgtatgaagaagggtgaacatgcagattgataaactgacgcgtggtggacaagaatgaccgatttgtgaccggtctgacactggtcatgtcgtcggcagacagccatgttcccacgtcgcacctgcttccggcgaaagtagaggtaggtatgggccgtcccatcagaaggtcattcggacggcaaccattacaaatctccgcccatttatgaaggaaaggcgagccaagttttagtgaaaagaggatgggtccccaccaaaaagagaaataggtagaagtggtgcatgtggtatccccttgagatataaaaggaggaccttgcccacttagggaggggatccggaccagaggaccaggggaggagagattggagactcccggaggatccaggagaagatcccacgagaggcaaaaaggaggaaaggggtttctagagtttgagctctctggttctccagctctttgtagcttcttcgtacacagatctaccagaacacaggagtagggtattacgcttctcagcggcccgaacctgtat

SEQ ID NO: 44575 - DNA, 4904 bp, Oryza sativa
gagaacgaggatgatctgtgccatggttcttttgtgtcttagctcgaacaagggctcgtgcccaggtcccagtcctcaaatggctcgggtcggggctagtgcctggggagatccacgtgtcgagactggccaggccgggagcgtggtgaccgagggttatgggtgacccggttgtgggtttttgccgatcccccccggagttaaccacgccccggggcacggctcggttctgggccccttttggcgattttagccgactcgagcccccgagggcaggatcgagcacgagtgacctatttcaagtcaagattcttcaaaaggaaacaacagcacagacacagcctttaggaaatcgaaaatgcttttattgaaatacagatagaagagaaataagaatatgcatgtgtggtagcccccggccaaccctgcacgcccgaggggggtacggggttggcccgagcccgaaacctgacacccgaaccctattaggggtagaagcgacgaaggtgttcgatgttccacgggttaggcagctctgtgccgtcgcccgcggccagccgaacggagcccggccgggggacgctgatcactcgatacggaccctcccacattggtgagagcttgctcaatccagcacgcgtttggacgcggcgtaggacgaggtcgttgacgcagagtgatcgggcccggatgcggcgctgatggtagcgccgtaggctctgctggtagcgcgcggctcggagggccgcgcgccgccttcgctcctccaagtagtcgaggtcatctctgcgaagctgatcttgatcagcctcgcagtacatggtggcccgaggggacctcagggtgagctcggatgggagaaccgcttccgcgccgtagacgaggaagaaaggcgtttccccggttgctcggcttggtgtggttcggttcgcccagagcaccgctggcaactcctcgatccacgaatcgccgtgcttcttgaggatgttgaaggtcttggttttaaggcctctgaggatttccgcattggcgcgctccacttggccattgcttctggggtgggcgggggaggcgaagcagagcttgatgcccatgtcttcgcagtgatcgccgaaaagttcactagtgaattgggtgccattatccgtaataatacggttaggcaccccaaaccgggctgtaatgcccttaatgaacttaagtgcggagtgcttatcgatcttgacgaccggataagcctcgggccacttagtgaacttgtcgatcgcgacatacagatactcaaacccgcccggggcctgcctaaacggtcccaggatatcgagcccccagacagcaaatggccatgaaagtggtatgatctgcagggcctgggccggctgatggatttgcttggcgtggaattgacacgctctgcatcgccggaccaggtcgaccgcatcattgagagctgtcggccaatagaaaccttgacgaaaggctttgccaaccaaggtgcgcgaggcggagtgggctccgcattcgccttcatggatatcggcaagaagctcgacgccttgttcccgaggaatgcacttcaggaggattccgttagccgcgcgccgatagagggtcccttctaccagcacgtagcgtttggagatgcgctggacgcgttcactcccttcgcggtcctcgggtagagtcttatctgtgaggtatgcttggatctcagcgatccaagcaatcaatctaagggagctgggagcactcccctcgggtcccgaggcctggactccgacgggcctcgggggccggtcaggcgcgtccgtctcccctaaggggtcgggtcgcgccgacggctgggcaagcctttcttcaaaggcgcccggtggggtctgggctcgcgaggaagcgagccgtgagagttcgtcggcaatcgtgttatcccgtctgggcacgtgccgaagctctatcccgtcgaaatggcgctccatacgccgtacttggcgtacgtaagcatccatctgcgggtcagagcaccggtactccatacagacctggttaacaccaggaggcggcggatccccagtccagctgccaccctaagtcccgcaaggagtccctcgtactctgccatattattggtcgcccgaaaatcgaggcgaaccaggtatctgaggatttctccgctcggcgaggtcaacgtgacccccgcaccggcgccctgaagagacagggagccgtcaaattgcatcacctagcgggcggtgtgaggcagctgcgaggggcccgagctggcctcggggagtgagacgggttcgggagccggggtccactctgccacaaaatcggcgagagcctggctcttgatagcgtgacgtggttcaaagtgcaaatcgaactcagaaagttcaattgcccatttcaccacccgtcctgtaccctctcgattatgcaagatttggccgagggggtaagacgtaaccaccgtgacccgatgcgcctggaaataatggcgcagtttcctcgaagccatcagaatagcataaagcatcttctgggcctgagggtatcgggtcttggcgtcccggagggcctcactaacaaagtagacgggccgctgcacctttcggtggggccgatcctcttcgccaggggccgcatccctggggcgctcttcgtccaagcggcctcgcggggcgcactcgtcttctgtgccgacgacctcggggtcggaggacgacaggcgcggccttcccacagtggcctcggtgccgtcctgggggtcgggggctcctggcatcgtcggacaagcgggcaaagggccaactccggtcgtcgggggccttaggccaccgttcggctcgggggcctcttctccctgctctctcccgggtcgagtcggcacagggttaacctcggggtcagagggcgataggtgcggccttcccgcagtggcccccgggccatcctgggggtcgggggcacctggcaccgtctgacaagcgggcagagggccagctccggtcgtcgggggccttgggccaccgttcggctcgggggcctctcctccctgctctctcccgggccaagccagcacagggtggggatgcgcggaatgaggattgtcctcatcgcgctccacaaccaacgccgcactaactacttgcggggtcgccgctaagtagagtagcaagggttcatctggctccggggcgatcaaaactgggggagagctgagatacgccttcaactgagtgagggcacgttcagcttcctccgtccaagtgaacggcccggagcgtttgaggagcttaaataagggtagcgccttctctcccagcctcgatatgaaccgacttagggcggccatgcaaccggtgacgcattgcacatccctaagcttgctgggggcgcatccgctctatagctcgtatcttctcggggttggcctcgatgcctcgggcagagaccaagaacccgagaagcttgcccgcaggtacaccgaacacgcacttatcagggttcagctttatgcgggcggagcggagactctcgaaagtttccgccagatctgaaagtaaagtttcttggtcgcgcgtcttcacaaccaagtcatcgacataagcctcaacattacgtcctatttggctacccaaagaaattcgagtagtacgttgaaaagtaggacctgcattctttaacccgaagggcattgtcgtataacaataagttcctatgggggtaatgaatgtagttttttcctcatcctccctagccatgcgaatctgatggtaaccagagtatgcatctagaaaacacaaaaggtcgcaccccgctgtggagtcgacaatctgatctatgcgaggcagggggtaagggtccttaggacatgccttgttaaggtcggtgtagtcgatgcacatccgaagtttgccattcgccttgggaacgaccaccgggttcgccagccactccggatggatgacctcgcggatgaatccggcctccagaagtcgcgccacctcctcgcggatgaaggcttgacgttccggggcctgccgccgcactttctgccggatcggccttgcgcccggccgtacggcgagacggtgctcaatcacctccctggggaccccgggcatatccgccggtctccatgcgaagacgtcagcgtttgcccgcaggaaggagacgagcgcgtcttcctatttgccatccagaagaccaccgattcgtgtagtcttggacgggccgtcacccagggcaacctccttgaccgggacctcgtcgcatgtgatcatcctctgcctcggggcggcgggaacggaggtgccaagcctctcgtcgccaccctcgggcttggacgcagcggcgaggtgatccgcgcgctgctccatacaagcaagcgcgactttgaggtcgccatggacagagatggggccaccggggcccggcatcttcatctgaaggtaagcgtaatggaccgccgccatgaacttcaccaacgcgggcctccctaggaccgcgttgtagggcagacttaggtccgccacatcgaagtttacccgctccgtgcggaagttgacggatccaccgaaggtgaccggtaggtcgatatgacctaacggccatgtgtgccccggcgtcacaccgataatcggctgggacggccagagcaccatccccggggccttgatggcgtcaaaggccacgggggaaaggatgttgagggctgcccccccccccccccccgtctatgaggacacgccccaacttcacgttgcaaacggtgggggaaaccaccatcgcgatctgtcctccccgggcaacacacggtgggtggtcggtctggtcgaaggtgagggcaacctccgaccaccgcgcccgacgcgtcgcctcatgagtgggggccgcggcca

SEQ ID NO: 44576 - DNA, 2704 bp, Oryza sativa
agcatgcggttgtgccgcacacccccctgaacgcgtagatcaccgcgtgtgcagggatgcatggtatggtgttgcggacttgacagaccgctgaatgtatgagcgaagtgactcatcatcccttcgctgtactgcgtgtaagtccgcttcttcacctgggcgcggatatgtgccttgaaagttcatggtaaactgttggcacaaatcctcccaagagtggaccgacgcgggtggcaagttcattagccaaccccgcgcctgtctcttcagggccatgggaaagaaattcgccatgaccctgtcatcacccccggcggcctcgatcccggtcgtgtagacctggagaaactcggcggggttgacgctcccgtcatatttttcggcgatggtgggccggaaccttgggggccaacggacgttccgaaggctcgctacaaaggctctacagccgacaccaccaaccgggggcacggagggctgatccccgcgtccgtgttgaggtgacactccggacgaggaggcaccctccgttgcgtgggtagcacgtcgaccattacgccggcgctcgataccgatgcgggcatctggccctccacgctgatcttcccgggtcagaggtgctgacgagggagtggcagccgaacggcgagcaacagccgccgctcgccgcgccctccgccttgacgacacggagccggtggtagcagcgccagaggtcttggtggctgtcacgaccggaaataacccaacgggcattccttacgtgcgtgcatgaatccttgtcccaggaggcaaggtacaccaaaagttgatacaaatcagagtttaacaagcggaagcgtaaatagttaacttattacatgggcagcgaaggcccagcacacacagagacaaacgagaaacagcggaagactagggcgacgaccacaggcgcttgacggcaggcacgagctagacaccaaagccttcatcttcaaggagctcctcttctgggcttgggaaaaattgagcaagactgagtacaaccaccgtactcaacaagacacacccacaaatgcagaataaatgcaagggagtacaagggaattataatataaagggttagggttgcagtaaacagcatttaaagacatttagttgctcagggctattttgtaaacacgatcttagaactatacaatattattaatcaaggccgtgaacccacacgaacctgccttaacccaaggcctatgatgattcagaccgaactggcaacccgaccctgggtcccagctcgtcccaagtcaacccaggccaaccattccatattttagttgttaagcaagttttaagaattaaaacactaacttgggtacattgctcggcttgcccataaccgagggctcggctattcgaatagattatactctgatcagaggtgtacatctttacccacaagacacatcttcctcacgtgtaaccacgtgccacataccaccacggtatacggacggaagacgtgacatagtttccaacccatcctagccttagacaagagtaccgacccaatcccgcctacggccggaacccccgggacaggcaggcaggactgagcccctagcagcagggcaccaaccctctgccatatgacatctcgactaccgggccgcagctcgtgtagccttcatttgccctggagaatgtccatcgacccccgacttcatccatctccaatccgtgtacttttgtttatgactagactgagccacaaactaagccttacccactagacatgtggaagtacggtagtgctttgcaacagaggcccgaagaccggtccttatatggccgaggtgctaccatcaaaaccatgcaccccgagcccagcctaaaaccattttaggggattttgaatagagggggcggtgtgaagccaattccacaataatccaacaattccatagtgtccaggtgatatgaatatttcccaagtctaaagttataaaaccacctaatgttacctaattaaattgcgaagcatctacctaaatttaaactagggataccacgagtagagtgtccactagttgaggttttgtttactctagggtgaacaaggtaataataataacaataacaataataatatggtcataacaaaggtaaataggcatggctaaataaaacagtgataacgcgggaatttaaataaagcgataatgcaataatttaaatcaacataattttacaaactgggattcaatatgttcaaagatgatatgacttgccttgctcgctttcccaaccgatggcttcgacttccacgaagagcggatcttccgaagctgcagcgtctacacgaccaacggaaaagaaaaggcttttacactactaaactccacataacagcagaaacaaagcacaaaaatgggttcttgacttcttaaggaaaaattagagacttgaacggtccaattccgagttcaaatggccaagatatggccatttgaagtttatatgctctttaaatggatatttacgaatttcttcatttaaattttaattaaaaatctcatttattgcgtcagccgagggagagggcgcgcggaccgggtccacgggagtggggcccacgcgtcagcctctcggtccacggtggaccgggagcacgcggctggcggcggtcggcgccgtgggtcccacgcgtcagccgcacccgcgg

SEQ ID NO: 44577 - DNA, 1454 bp, Oryza sativa
  unsure (1)..(1454): unsure at all n locations
aaagtgcgacggtgcgggctcattccgacggggagagtgagcggcgagtggcggaaacggaggagcggagctcggggattgattttatagcgacgggagagagagagggcggccggagagaaaggaaaccggccgcggagttctcgggctccattgaagacgccggcgacgattgcgggattcaaatcggacgaatccgagggagagagagagggaaaagagggggaatcgggagagggaatcacggggagtaattcgcccctctttatggcgcgcggggaaggcgggatgcggcggaatcggcggcggcggcggcgctagggcacgggcggcggcgggcgcggcgcggggttggggatgacaggtgggccccacccgtcagcgagggtggcgggcgggcccgcctgtcagcggcgcgcgctcggggaggagccgatgggccggaggggaggagagagagagagggagggagagaagtgggccgagccggcccaagaaggaaaaggggggggaaagaagacttttagggatttttctttttataaaccttttcaactttgtttatttcttttcaattattatttgtgctctgaaaattccactaaaatttatttacgcattttaggcttttaggaaatatacaaaaatcctccaagcctcatttgacttttatctttgcacattttaattgttggaggctttcacatgaattttaattattctttgcacaatttcgaggatgtattttagagtcgatttgggacgtgacaaacctaccccccttaaacggaatctcgaccccgagattcggaagaactggcgaagagatcgggatgggctgccttcagctcgtcttcacgctcccaagtagctttttcttcggcgtgattgctccactggaccttgcaaaaacggattacccggttcctggtcctgcgctccatggtgtccaggattttcactggcctctccacgtaggtcaaatcttcgcgaacttcaatttgctctgagtcggcctgctcggatggcactcgaaggcatttcttgagttgcgacacatggaacacatcatgcacgttgcccaaggaggcgggcagctccaactggtaagcgacttctccgcgtcgagcaatgatacggaaaggacccacataccgaggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 44578 - DNA, 1934 bp, Oryza sativa
atttccttccttgcagaggcacggatctgacgtaaccacttcaaggcaacatctggacaaccaaagtgtgagaatgggattataactgaaggaactttgcaactgacctaactgtgatgaacaatcaagaagttttgagtgtatagtaatcaaattgtagagatcgataaacaatacaaatgaagtatgacttgtatgactggcagataacattataagcaaacaggagagttgtacatgtaaagaatatcaatggtacaaagtatatatgcagtgatagattcaagagtaaacttacggccaagcaaaatcttagatatagtaggaaatgctggaccatggtaaaaagcatgcctccaagatccccgttcatcattgctgaggcttacgccattaattatctgaaagtacagaaaataattctccctgttacatcatggcctaaaaggatggaactccaattggctatttggctgaatcatattgaaggaagcatgtgtctttgaatatccatactaatttatctctcaagcatgaaacatgatcttctgtattctgaatgcattatcaaatgacacaggttttacaaaatgtgtgctgctacagctcacctagcaaggtcctgcaattcgattacccattgtgtgaccaaagttataggtttatcaactggaaaattctgtggatgcttatcaatccagtttcagagtaattccttccagagatcaatttcctcaaatatatgcaccacaattatgacattacagcggctgaaacattgtccacataaccaatagttcactatgatatcttaatgctccatttctattttttgtggcagaattactgctccatttcggcatacagtcctttgtgattgcaggtcaaaacaaaaactcaagacttccccattttttttatcacagaccccttccatgattattagaaatcacacatcattgtttatgccagaaccaaaaatagcaaatgataaaactactagtaatttttctcagatggacgaaataaaaggcctaaaattagcacagagcttcacctggctcctgaagggttcgtccacggtacctacaagagaggccatcagacaccccaagtgacggcgaatgagataaatgggaatagggagcatgtcggattaggattcggagcctcaccggctacagcagcggagtcgacggggaagacgagggcggcgacggcgtggatcgcgcggacgacctcgccggcgctcgacgcggcggcgaccgcgtcggccgcctccgccaccttgtccagtgctaggtcttcgaggcgcgcgccaccatggccgccgccctgggagcccgcagccctcgccgcggagctgcttgggttgctcgccatgggagggtgaagggaaacacacgacgaacctaagagagagcgcttgagaaggggaggttttggagcaagagtaattagggggttttgtttggaggagaaataacagttttacccggcttgactgccgttggctaagataaaattttggggtatgtttgagaatatcaaaatttgcaaatgaacttttgttagagaagatgtgtttgagataccaaaaaaataattgaaggaattaagaatgtccaatgtcaattgtacttttattcatgataccagtagtatattactcctattatttctaagtttttttataaggatagaattggagctgctaagagcaagtttaatagtatagccaactactagctctaaatcatctatagtcaatctactccttccttcccaaattgattttatacaccaaaaccaaggataatttaaatcacatcaatcaatacaacatacacacattctcccaccatgcatcgattaaaacctcatgccacttacaccatagcatgcacacattcttccatgctgtattaactgta

SEQ ID NO: 44579 - DNA, 3417 bp, Oryza sativa
tacagttgggcagaaacccaacggtcgcaaatcacgcacatcggcaatggtaactcgactgtcaataatgagcggcctcttcaagactgccacattactcgagtagcacacgaatcgggacgagccggttcgttttgcctggagatatggtgatggcacttcggtcggcgagtgcaattaacgcgcgcacgatatgttccatctcgactgccacagccgcatattcacctcatgcgccgcaagcgggcgaatgggattagtggaagcgtgggcgcgagaaacgagggagcgagatagtgggcgcgagaagcgaggagccgggcacagcgttggcaagggtataaagacaccgaggaagagatttgcttccttcctctcgccattattccccttgtcttcgccgcttgtgccctaactccttgtttcctgtgccctaccctcgccacacgcgctcgctctcaaacatctcttcttccggcgtcatggcacggggctctgctccactcgatggtagcgtgctgccgctttcccgcatcgtgagcgagaggcaggccgggctgccgcgccgcttcctgccggaatctgccaccggccaggagatagttacgctgggcgagggacgcccggcgccacgctacccggggcggaccgttttcttcctccctttcgcaatggcagggctggttccgctattttcttctttcttcatggatgttctggagttttacgatctccagatggcgcacctcacccccaacgcggtaatgacattggccatcttcgcgcacttgtgcgagatgttcatcggggtgcgcccatcccttcggttgttccggtggttcttcaccgtacagccggtgtcgccgccgtcggtggttggtggctgctacttccagccgcgggggccggtgctgaaccgctagattccctgcgtcctccgcaagaagtgggatgactggaagagcgactggttctacacccccctcgccgacgaagcgcgcctccgacttccgaaccagcccccggcgcaggcctccagctggcgggcgccggtagatctgggagatggctacgacgccgtcctcgaccgcctggcgggcctgcgatcccaggggctcacaggggccatggtgtacggcgactaccttcgtcgccggatcgcaccactccagcggcgcgcccggggtgcctgggagtacaccgggtccgaggactgtatgaggacccaccggggggtcaaatgggactgggtccctgaagacttcaaggtaatgatccaacgggtgctgaatctcagctccgcggaggcatcgctcatcccccaaggagtcctccccctctgcagcgatccagatcgcgccaccatcctgaccatcatgaaggcggtcggggcctcagaggagcaggctcctcgaggccatgatggcgcgggcgggagctgcaggggagaacaatctaccccaggagggggtcgtgcttccgggctccgtgacgggggctcggggggctgccgccctgccgacgcccgagggaagaggaagcaagagggttcctcctccccatctcctccccgagggggcggggcggcgcgtgtcagcagcaggcgcccggagggggccgcgccgacgccgcagcccgagggggagcggaagaagatacggcttcgcaagatgggggggacagaaccatcccggggaaaccttatttcccctccaaggtagtcgtttaaccgaccccctcgcaggttcgtcccacgcccattgtggctgtattcattctcccaacgcgagttttcactcacccatcttgtttgtcttcgggtctttcttctgtttcagcgagatctcgtcgcgtccctcccgccattccaagtccggccagtctgaggccgaggatacggcgaccgcggaggcccggaggcgagaatctgaccggcgagaagccgcggatcgcctacgggaagccgaggaggccgcccgggaggccgtccgggctcgccaggctgaagaagccgcttgggaggaagccagacttcgccaagccgaggcggcgacaacttccgaggcagctcgcgacgaggccgcgggcacatcgcttgggcccactccctcgggcaacactcaggacaagccaggtccgggggacgtccccgagcccggcacgtccatcggcgggccgggccgcgcggcatcctcaccgaggcggctctcccccacgccttccgttgccccattgagcgcagagccccttctgcaggccttggccgtcgcaaacaccacggtgttggacgggttaagtgcccagatggaggccctgcaagcagagcgggcggagctcgacgccgcatgggcgcgcgtcgaagaggggcgacactcggtggaggccatggtggaggtgagccgcaaggcacaccgccggcatgcctcagagctcgaagcccgtcggaaggtgctggaggagatcgccagggaggtggaggaggagcggggggctgccctcatcgccactaccgtgatgaacgaggcgcaggacgacctccgccttcaatacgggagctgggaggcggagctagggaagaagctcgacgccgcccagggggtccttgacgctgccgctgcccgagaacggcgggcggcggagaccgaggtggcatcccggcggcgcgaagaagcccttgaggcccgtgccatggcgctggaagagcgtgcctgcgtcgtggagagggacctggcggaccgcgaggccgccgttgccattcgggaggtcacactggcggcgcacgaagccgcctgtgccgaagaagagtccgcactccgcctccgcgaggatgcgctcaccgagcgggagcgagccctcgaggaggccgaggccgcagcgcaaaggctggcggagagcgcgtccctccgcgaagctgcgcaagaggaacaagcgcgtcgcaatctggaaggtgcccgcgccgagagggccgcactgaaccaacgggccgctgaactcgaggcgcaggcaagggagctggatgcaaggcgcgtagcggtggggcggccacgggcgacagcgacttagccgcccgcctcgcagctgccgaacacaccatcgcggatctgcagggcgcgctgaattcgtccaccggggaggtcgaggcccttcgtctggcaggcgagatagggcccagcatgcttcgcgacgccgtgtcccgtttagaccgcgccgggcggcaggcgggtctctggggcgggcggactgcgaagtacgccgccaaccaggggggcctcgcccagcgcctctcggagatggccgggactctccaacggctccccgaggagctcgagaggacgattaagtcatcctcgagggacctcgcccgaggagcggtggagctcgtactggcgagttaccaggccagggaccccgacttct

SEQ ID NO: 44580 - DNA, 1547 bp, Oryza sativa
ctgaagtagcatcatattgtgcaaaacgatttcatattgagctttgcaatcatgaagactacgacagcaatctaagtaatgcgatgaggagtgcgttttacaggttattttcgcctagtctatatcattttgttgcactgaatgatgctgcacttgcaaatttggaatttcattgttcctgtgtaatttctgcagcatggatgaggacctgcaactgtccgatgcttggagggagttagttattcctcgtaataatggatggatgtattttctcaaggctgcagcttgtacaagcatttgcaaggtatcttttaaaccctgaacgtcttttaatatccatatattgaaggtactcaaaactgtatttgttggacagtgcatattgtatctatgaaaaaggaaatggaagaatgtgtgtgatatcgagactattgttctttcttgagatgtactttggagttggaagagatatgtttaaccctaaccttgactaattgctcctattaaaaaaggttcagttagttacatatcaattgtctggtttactgcgttggaggccaacaggttcttaagttcacattgcaccttggttcttatcatactgtggtactaccctaaattgaggtattgtttgcggcatctcttctatggtaatctctttcatacactggtttggctttcagaaatgtttttctttgtctggtggctttggtgagctatttcttgcttgacttgtatttctaactatgttgggattccctattatgtcctccaattcatttcttctttttccaggcaacttatactgagccagcatatgaagggagcacagcatgtgtggttgtcatcagaggtaaccaattgattgttggacatgctggtgattctcgttgtgtactctcaagaaatggtcaggtatagtgactatttccttttcgaatttcttgttggtacctaatttgcatgttctcttattttggtgcctaacatttgtgcttgtttctgttgtgtcaaaaggccagtgcattatccgtcgatcataaaccagacagtgagtctgaaagagagagagttcagaatgcaggaggagtagctgttgggcatagttatcgtaaaataatggggaggtgggtaaccaagaaacaatggggctttactgattttaagggaagagtatcaatctcaagatcaattggtatagtcttgcctggatctgtttttcgtttattgcagataatagcaccgaaaaaaaacatattatgttgtgatttgctgatgtgttttacccacttacatttcaggggactttgcttgcaagaagaacgaacgtttacctcctgaagatcaaatgctgacatgtaatccggacatcctgactgtaagtgccactatgtttgtttagtatttggttgaatatgaagtttgtgctgctttgtggggtctgatggaaaatccccctttctgcgtcagatggacataactgatgacatggagtttcttgtgatagcaactgaaagcctctggtaaattttgaacaaaaaataact

SEQ ID NO: 44581 - DNA, 9025 bp, Oryza sativa
cttcccgtaccgtgcttttgttgcttcgatggttttgaagtttgaggtggagtgtggttttctgagttggaggaggaggctgatgagcaccgaagcttcatggtgtattgatcttgctgtgtgtgtctcaaagtctctaccagtgcgtgcgcaaaaaattagaccacgtcaattcgtttctcttgtctgcttgtattttccagtttgttcagttaattttggtgtgttgcgggagttcagtttctgaaaatttattaaccagatgccgccttcgcccttcttgttcttttcgctgttcctgatgcaggatgcttcttctctatgtgtctctctgacgtgttctcttggtttagtttctgtttggaaagaactccatgttctctctgacgtgttatcttggtttagtttctgtttggaaagaactccatgttctgttcatacaatgatttctgcatgtgtagcttggttaaactgcttgtttttttttccctttttgatgagaaatcttctgattctttgcatatcaaagaagctttcatctcttgaatcttagatttgggatccttctaagcccaacggttttggttctgcaagattgtacaatttcttcatgtttgttacctatattttacttctcagtgacgctgtcatgttgtattcttcttgctgaattctactataagtgcacgctgctgtctctgtttttcttcttctgttcacttcatactctgtttcgaattattgaagttttaatacaccaaagaggtggccatatcgggaggaaatttattgtccttgtacaatacgccttttctgtttgtttcctcttcatttcactttggaatttggtgttatgatttgtgtcagaaaagcttatatggcgttcttacaaaaccttgtatgcattttgttcacagtaatattttattttaattcttccttgcttgattcttgtataagatataagattaatgtgtataattactgcagcattgcaactgaagattgatgatctcatgttatatgtctcaaaaatgcatttaggggccctgataaatagtgtcatatcatgttatgtctagttgactccttttcgtgtttttacgaaagctcttatgtatttaattgatctgtagtgttttgtaattgtattcactttactctttctccatatttgtcaataaagttattgtatatttgtattcatgttataaattttcagcaaaacaaaggtctgctatgggtaacagccttcctgtagaatcaaagttcactgatgaaaaagagaatgacagaattaagtatgttgtgtcgtctatgcaaggatggggtgagaaaatggaagatgctgtgagtaaacttgcagccttttgtatgacaaaaaaaaggatagttctgcaaaaatttcttactgatctgtaagtaattgtgtaaaatactgtgactgacatatgccctctatattctctagcatgcagctattctaaatcttgatgataccatgacgtcattctttggcgtttatgatggccatggaggtttgatcttcattctctctcttttttttttttttttggtttcaaatcctccaaatcgtcggcataactgtttacatcatgctttgtttgtctttgtatgtcatgtgtttatctgcgtgcatgttttgaaaactttactgtttatgctgaaacttttacctgtgaattctcaaataaatattaggctacagttctggataatgaaccaagtttgctaattagtactaatcacctttgtgcggtgtgctttctaggataacatgaactgcttaaacagaaatattattttacgagggataaaacactgcatggttgtgagttaatattaacagtcatgataattaaaaggatagccactgatgaacatgttggttaatttatgtgtggtgctatttttcttatgatacctatgaagtgctgatctgctgtgttcatcacattgttttgctttataagcttctatatgcacataggagtaatcttgagccaccattctgagttgtttattttctatctcaggagctgaagtagcatcatattgtgcaaaacgatttcatattgagctttgcaatcatgaagactacgacagcaatctaagtaatgcgatgaggagtgcgttttacaggttattttcgcctagtctatatcattttgttgcactgaatgatgctgcacttgcaaatttggaatatcattgttcctgtgtaatttctgcagcatggatgaggacctgcaactgtccgatgcttggagggagttagttattcctcgtaataatggatggatgtattttatcaaggctggtgtctgtgctaacctttcgcctttcccgcaggtagtgatcctttaacccctaaacatcttataatatccatatgttgaagaagttactcaaaactgtatttgttggacagtgcttattgtatctatgaaaaaggaaatggaagaatgtgtgtgatatcgagactattgttctttcttgagatgtactttggagttggaagagatatgtttaaccctaacctcaactaattgcgcctgtaaaaaaaggtccagttagttacttatcagttgcctggtttggtgagttggacgcctgacaggttattaagttcttattgcaccttggttcttgtcatagtatggcactaccctaaactgaggtattgtttgcggcatctcttctatggttatctctttcatatacactggtttggctttcagaaatgcttttctttgtctggttgcttttgtgagctatttcttggttaacctgtatctctactatgttggaattctctattatgtcctttagtttctttcttctttttccaggcaacatatactgcgccatcatatgaagggagcacagcatgtgtggttgtcatcagaggtgaccaattgattgttgggcatgctggtgattctcgttgtgtactctcaagaaatggtcaggtatagtgactatttcttatcgaatttcttgttggtacctaatttgcatgctcacttattttcgtgcctaacatttgtgcttgtttctgttgtgtcaaaaggccagtgcattatccgtcgatcataaaccagacagtgagtctgaaagagagagagttcagaatgcaggaggagtagctgttgggtatagttatcgtaaaataatggggaggtgggtaaccaagaaacaatggggcttcactgattttaagggaagagtatcaatctcaagatcaattggtatagtcttgcctggatctgtttttcgtttattgcagataatagcaccgaaaaaaaaacatattatgttgtgatttgctgatgtgttgtacccacttacatttcaggggacttcgcttgcaagaagaacgaacgtttacctcctgaagatcaaatgctgacatgtaatccggacatcctgactgtaagtgcaactatgtttgtttagtatttggttgaatttgaagtttgtactgctgtgtggggtctgatggaaaatccccctttctgtgtcagatggacataactgatgacatggagtttcttgtgatagcaactgaaggcctctggtaaattttgaacaaaaaataactgacaataattattatttgatcattttgatgtcactagtactctttgtgatgctgttttctttctcctgctgatgcatatatagtttcatttatagttgcatacctactgtactatgttttttccatgcaggtgcaacatgacaaatcaaaatgtggttgatcacacacatgaccgtcttttggtgagtccttttcttttgctcagtttgtcttcttggcaggacaagagatctcctactgtaatagcaaaaatattttgtgtcaaattctaggaaatgacttcactcaggcaatataaagcatccgattttttaaaaaagaaaaaaacaagtgctaataagtacactgtcatctgctttgtgattgttcgattcttttgttgttaaaactgctgttccttttgccttgatcaatattgctgtgactaatatcttgcatgtttacgtcaaaaaaatatcttgcatgctcgattgtttcgttgttaaaactgttgttccttttgctgtggccaaatattgctgacttgctgtgaccaattaatatcgctatgcaggagggtgcagaagcgcgtgtcatctgtgaggagcttgttcagtttggcttgccatcgggcgacaacacgaccgtcatcctggttctgttcaagcccggcgcctaccctgctgttccgccggtcgacaccgacactgacactgacagccacaccggcgatgatgtcgacaacaacgaccccgccaacgaggttgatcccactgccaatgccgggtctgatgacagcaacaccagcgatgaggtcaaggtcgacgccactgccactgccgtcggcagcagcagtaccaccgccgtggctgccgacgaagccaccgtggtgtcgttgtcgactgcaaccatcaccattgtggacaactacttcttcattaacaccagcgaggaggttgatcccactgccaatgccgggtctgacgacagcaacaccggcgacgaggtcaaggtcgacgccactgccagttccggtctttccgattgggaacttatatattctgaattctgatcctgttagtggtagacgagtaatagcaccgacccgttgatagtagtagtttggttgtgctactttgctagactgagacaccttgaattaattgtttacgaatcatctctagcctttttagttctgaaggtgattgatctagtgatgcttttgttgatcttcattttgaatctctgtgcatggtagtggtttatgaactactagtagtatttttcccagtttccttttgaccaaagttttcttcattcttctagtctctgtgactgtgatactcaaaatcttttctcgggaatctgtaactaggattaaggcacgaaaattttctctcctttttttcaagagatatcctgaatttgcgacctctctcttccgccttccccgcgcggggggtaaaaaaaaacagaaagttagaaaaaattatgtataaaaaatttgaattcaaattcaaatttgaatcaggtatgtaaacttttgacttataaactttggatctataaagtttagatgtatagaaatactatatatagaaaatatttgaattcaaattcaaatttgaatcgggtatataaactttaggtctataaactttagatgtatagaaatactatatatgaaaaatatttgaatttaaattcaaatttaaatcagatctaattcaaatttaaatttgaatcggatatatgaactttaggtctatgaactttaggtgtataaactttagatgtatagaaatactatatataaaaatatttgaattcaaattcaaatttgaatcggatatataaacttttagcaaaaaaaactttagatatgtaaacttgaggtgtataaactttaggtgtataaatttactaaaataggaaagtaatatggtgaaaaaaaaaataaattaggtggagggagggagggagaggagggggaaatctaatcgccctgggcgatcgctcagtagcatttccgttccccgcgttcacttgcccacccgtccgcttgatcgtgcgggaaaccaacaggcaacagcgatgcaggagggagttctatgtattgggtactgttgaatttgattccaaaattgaatctcaaaattcaggtttccaattaaatatcccttcctatgaatccttgccatctacttctcccaattccaaaaatatcgaattcatattcacgctcccatcggatggcctaatcagtcaaagaaaaagccaaatgttaaattttcaaacttaattttaagatattttcaacgtagtttctttttcaccattggtttttaagtcataaaaacacgtatataaaagttttatctataaattcatttttatttcctaataagccgtaggaaaaaagccaaccgatggggacctcagtttaccttcttgactccttgttgaacccttgagttcaaatatccaatttgaattcaagtccaaatcaaaccagaccccaaatttcttcaaataatttcctggaaaatggtcaaacattttcccctctggtgggctgcctctcctttctttttagataatggaaatggattgcatctccggcttctgtcataagacacacagccataaatttaatagtaataaaaatgtaagataaaagtaaatcaaaatgagaaataaggtgatgggacaaatccccaactcccctttattattgactaatgttaaaccacataaaatattttagctagcaattcttatgaaactacgccacccatagtggaataagagacccttggctaccgattccaagagtgtagcaccattgcgcatagtatcctgctcctcttgtggtagcattgtagaccataagtggagccagtaggaagacatgaagataacctgcatagggttagataattgtttaccattaaaaactttatcattgcgacaacgccaaattgaccaacatacagcgctagctccaattagaatcatcttcttaatggacctagatacccctctaagccaattatcgaaaatgtttttggcgttacggggtggggggatattaaaaacaaaaaacacacatctccaaaaacaaactgagcaacatgacactcaaagaaaagatgttggattgtctcttgtgtatagcagaaagaacaatgtttgtctccgccccctccaattttcttttacccaggttatctttcgttagaaatactttcttgtgaagaaactacataaagaccttgatctccagtggaattttcaagtcccacagaattctctttttgatccgaacattacagttcatgatcgcgacatacatagatttgacggaaaattgaccattcttatagagcgaccatacaaagcagtccttttcatttgacagagttatattagctagcctgaggatcaaatcgttccactcgattagctagcctctcctttctatgtggaaaaagtacattgaaggtccctcgacttgtcatcgagttacaaaatcatccctcacccgtaaaatcagatatatgacatccttcaacttacaaaatcgttcattttagatcctttagtagttttgttctggttttatttgacatggcggctgagtcagcgtgggacccacgtgagccccacatttctggatgccacgtctcttcctcaccagtcaacgaggttttttcctatatgccattaagaaagatggtgcctgcttctgtgccactaaaaagtttaagcctccctctctgccatcgttaaactttatcgtgccctccacactattccgtctgtttttgttgtaacggtgggtaatggcgcagtaaaatgacttagttgccctttggtccaatatgctctctcctagcactctcctctctcccctcagatgcagcagcagcagccaaggagcggaggggagaagacggcggcactgcgacagcgacggggcgctgcgacgacgacgatgacgacgggggcagcgctgcgacggcggcggcggcggcattgctgcgacgacgacggtggcggcatcgctgcgcgacgaagacggcggcaacaacgctgcgacgacgacgacgacgaagacgggggcggcgctgcgacgacagcggcggcggcagtgctgcgcgacgacgggggcggcagcgctgcgacaacaacgacgacgaccaacacaactatggctgcgaggactattgatacttgctactggtgttcatgactgttgatgcttgctactagtaatgcttgctactagtgatgccaggaccagcacaacgacggccgacggcggcgaggactattgatgcttgctactagtgatgccagcgacctcgcctgatcagccgcgcggcacatccaggaagccatcagacccacccagctcgaccgaaaaaattcgcaagaaccacagctcacagccacaggaccaagtgtccgtcctaatttccgcgaagacgagtgcgagagattgcttactcgggccgccgaaggggatgggtccggggttgagcccggcggcgatgctcggcggcggctggacgtggagcacgacgagcgcgccgtcagggcggaggcggaggttgtcggccggaggtcctcgccgctcgtgttgacgccggcttgcatctgcgtcagcggcggaggcggagccgccaccgcaacgtggactggttcgttgaactccatgcggatccacggcatggtgaagctggaggagccggttggaccgaggttgaggaacagcgcaccgacgacgaggatcaggacgacgacgaccgggccgaggcgacggcggcgcggtgccccagctgggcgcggcctgaccgcctgagggagaagaggggaatcgagggagaagactgagtgaaagggcaagagcgacattttttctacccgggcccatatgtcagagctgccaaatagttaaatctaaacggaatagcaacggaacggtgtggagggcgcgataaaattcgacaatggtataaagggagggctcaaatattttagtggcacagggacatatagggccattttggtttgatgccaattcttgccctaccaattctttggtagttttgaatagtacatgttagcattttggattggagccaaattttgccaaatcaatagagtggagccaaatctgtactataaaaaatttgttagtgccaaaatgtgcctaaggtttggtactaccaatattttggtagggtttcaaaccaaacaagcccatactatctttcttaattgcacacggggaagagcctcccagtcaccacgtctcttcctctctcttctctagtcgtcctgtcgaggagcatagccgacaggggaggagggccgcgcccggtgggcgcgccggcgcccggggggggggggggg

SEQ ID NO: 44582 - DNA, 4373 bp, Oryza sativa
ccaattaatatcgctatgcaggagggtgcaaaagcgcgtgtcatctgtgaggagcttgttcagtttggcttgccatcgggcgacaacacgaccgtcatcctggttctgttcaagcccggcgccttccctgctgttccgccggtcgacaccgacactgacactgacagccacattgacgatgatgtcgaccccaccggcagcaacaatgccaccgcgtccgacaacaacgaccccgccaacgaggttgatcccactgccaatgccgggtctgacgacagcaacaccggcgacgaggtcaaggtcgacgccactgccactgccgtcggcagcagcagtaccactgccgtggctgctgacgagggcactggcaatcctcctcatggcgcactagttgacaccgacgacgaggacgggctgacctactcccaggacatggacttacccccggcgtcgacgtcccccccaaccttcccggacgaggacgacctcccccggtctaacccggacaagtcccccccgcacgtatcaatcttattcagagtttgagtccagatcaggaaaggccagaagctatagctatgattcggaaggagtagttcgtttccacttgatttttgtctagcaagtcgaagatgatgtgtgatgatgcatgcaggatgatacttatcgtaggtggtagtagcactgtgcattgataggagtagtttgtttctgctaccttgatgatgtgtgatgatgcatgcaggatgatacttatcataggtggtagtagcactgtgcattgataggagtagtttgtttctgctacctttggtttgtggtttttgcctgctgctttgcataggagattaagattttgcttgtcagactcagataacttcaattaactgtctacgaaatctcgctcactggtttttgagttgtgaaggtgattgatctagtgatgctttttgttgttgttcattttgaatatctgtacatactgctgggttatgacttgccccgtttctgaatacttagcttttaaccaaattttctcttcattcttctagttatcttgaatatgtaatcagtaatgtgcttggtttagcggggaagtctatttgtccctgaaggacaattccttctgctgcatgccacccaaaaactcatcaaaaagtttgaaaaaaagaaaaggacgagatagatcgaataaataatatcactccacaaatatgcaagcttaaatttgacacatataagtagaattagaactaagtaatttgattgtgaataatacgaaaaacttttttttatgtcaaagacaaaaagctagggcgaattctcattgaatctcggttgttcatgatagtgatgaccatccattcaaatcttcaggtagcacccccaaatcttcaacaaggcggaaagttcgtgtgttaaaattgttgttttttgttttgtatatgttgaatttgaacttacatgtctgttgagtaatatattactcctacatgttaatttatctttaaaatctttaatgaattttcggatgacatacatacataaataaaaccggagacaaatccacctctttggttaagttagctctgttgcctgctgagaccggctctgaatccggcccatggggaccgtatctgaatccggcccatgggctgttaggccgtagcgggccgcactcctctttcatcagttcggcaacagcaacagactcggcatcactcacccacccaacccagtacccaagccccaacctcgcctcgcctcgtctcgagccgacctaaccgcgaacccccaactccgacgagaacgacatggacgccggcggcgaggaggcgaagcaggagcgccacctggtgctggcccacaagctcttcctcctctcccaccccgacctcgacgacctcgccaaggtcgccctccgctccgacgccctcgacgccgtcaagtccgatggcatggcgccgctgttcgagtcgctggccgccgcgggcgtcctggagccggacgacgcgctgctcgccgagatgcgcgcgcggatcgacgaggaggtccgcaagctcgacgagaagtgagtggattcttcctctcttctgattttattttactagcaaatatgcccgtgcgttgcaacgggtgaaaaaacataatgataatatacatttttcatgcataaccatgtcgataacaatcagaaaattagaactacgaaactttattttctagcgcgttttcttttgtgcttttttctgacatttttccctcacgtgtttttttaaaccgtttttattttctcgcgcattttttccttttttaatatactgtagaaacttctctttttatagttagattagattagattagagataaagaagatatataaatggactaaaaaacgacgaatataaatttgacttttttcctccgcgcttttttccgtccttttaattttttttctcgtgcatttcttttacgaagggtttttttcaccactttcacatagtgtcaaacctttctagatataataggattcgattttttttaccgcatcacgtataattcctttttctttagaaacagacaattttttcgcccttttttatcgcgtcaacggagtcggaatcgttttgattttttcccctttttttggatcggacagatttttttttgcccggtttatttcgcccgatcgattttttttaccgcgtcacatataattccttttactttggatttttttcgccctttttttaccgcgtcgacggagtcggattcgttttgattttttttctccctttactttggaattttttcgccctgttttcaccacgtcgacggagtcggattcgttttgatttttcccctttttggctttttttggataggacagatttgtttttttttcgccccgtttttttatcggacttttatcttttttttcgcatggtttttttattttttttaccgcgtcacatataattcctttttctttatcggaaagttttttttcgcctttttttaccgcgtcgatggagtcagattcttttcagctttttccttttcttttatcggacaaattttttttcgcccatttttttttctcctgtttttttcggatcggactatttttttcttttttcgcccggtcgatttttttaccacgatatatataattcctttttctttggaataggacagttttctttttatttttttaaactctttttaccgcgtcgatgtagtcggattcgtttcgatttttttcctttttttgctttcttttttgtcggacagatttgttttttttccacccggtttttttccgcccaggtttttttatcggacttttcttttttttttttgctccacgatacatataattcatttttctttggaataggacagttttctttttatttttttaaactctttttaccgcgtcgatgtagtcggattcgtttcggtattttttccttttttttcctttttttttgtcggacatatttgtttttttttcgcccggttttttttcgccaggtttttttatcggacttttctttttttttttcgctcggtttttttctcccgttttttgacggacgacagaagcacctagagaagtgttttttttcttttctccaatccaatacagatcggatctcttccagggaaatcagattttttttctccagggaatcggactctttttttttcgctttttttattcattaaacggtttgtctctcggactttttttttccctttttaagggatcgggtgtttttttgccagggaatcggacatctttttttttcctgtttttttcgctgtttttatttatttgtgacggacgatggaagcacctcttattttttaagtagtagtagatttttagccccccaaaaattaggccgccccttgctgtgttgcgtatgcgataagttttgcgataactcaggtgttgatatggtccgtttgccttagctaacctagcttactctgtgttgcgagatgtagatgctaaaactggtagatagcttgcatttgattcggtagttgtaatttatgaattatgtttagggccaattaattcacctctatgcaaatctatactacataataataaactttttccacatttttgttttagattcatgtacatattcatgattttgtacattttctctgcaatgtgtaatttagcatgtagagaagtaattgagattgctaaggatcacaatacgcaacttctcgagacaaaataccagtgtaaactaatgtgaaggaagaacggcatgttgaaatttgttagaaatagtttccttgagaagttgaggttccagtcaagatatgtccttttggtgatttgcatg

SEQ ID NO: 44583 - DNA, 6025 bp, Oryza sativa
  unsure (1)..(6025): unsure at all n locations
tatacttcatggcaacgagaaacttcaagaaagctgccagcttatttttagattccatctcaactttcacaacttacgagttgtttccatatgatacttttgtcttctatacagtcatcacaagcataatcacattggatcgtgtatctctaaaacaaaaggtaatttcacttcttacactctcttttctttttcttaattgactcactaacaagaaatatggcaggtggtagatgcaccagaaattttggcagtgattggcaaagtacctcatctatctgagtttctgaactccctttacaattgccagtacaagtcattttttgttgcattctgtaagtgtaaagtatcttgataagctgtctatagttttactgttacagtctgtacggctgggctatatgaatatatggtctaaacttcttttcagctggcatgacggagcagattaagttggatcgctatcttcagcctcatttccgctactatatgagggaagtgcggaccgttgtctattcacagtttttggagtcatacaagagtgtgacaatggaagcgatggccgcagcatttggtgtgactgttgatttcatagaccagtaagtgctgtcacccatccgcattagttttatgtttgtgattcctgtgtaggacaaaacattcttttctgttcctgtgctgtggagataatatctccctttcatttgttccagggaattgtcgcggttcattgcagctgggaagcttcactgcaagatcgataaggttgctggtgttctggagacaaaccgacctgacgctaggaatgccttctaccaagcgaccatcaagcaaggggacttcttgctgaaccgcatccagaaactgtcacgagtcattgacttgtaaattcaatggtctacgttggacgttggaggtgtgatccttctatatacctgcanagctccccatggacataaaccgtactgaaattgctgttctacttgtactcctaggctcatgagaacatgatctttatctcggtttgattttattgcggacagcaaaaaggttttaaagagaacctccgtgtgcaatttcagtaagtgtgctttagatttgtagaacgagaagagtgcatgtctttctgagatgaatctgttcgttcatttcaagtcttgtggcgatgtctttttggggttccgcactgtttgatcttatgggtctctatatgcttgaaatagcctgacatgctagtctcaaaagagaactgcaaaatagaaccaagcgtaattccttttgttctgagcctgttttcagatgcaacatttcagaaaacagataaacagcattcggtcatacgcaatcgcgcgcacacactgtacagccactgtaactcatcagaaacgaggtcaatatacaacagtaattttcgccgttccataagtccataaaataccgatttctaatatcccaggagactctagctgcagatttagtaaggaagaacaaagcaagttactcagagtcacaggcaagctacacattgtttgttgcaaaaaaactcgaagtattgaggaactacacagagctaatctgggacagggaaatgagcacactggaaaattacagccggctgttcacttgacgatctctggtatgctgcgctttacaatcagctctccgtttctgcagatcagaaatggtaaccatgcaggcaggtcagaacgtctgtgtttgatggctatacaaaggcctagagattcacacaagcaaaatcacaggaagcagtaatgtagtttagtgtaggagcattgtctctcttacttactgatcccctgcttctggttctgcttctccttctgttgccgcttcctctcgtttcgcctcttcacccagggcttctcttcctccactggcgcttctgcctctgcgctgacagatcctgtaatctgcgcaaacgactctttggcgccagaggttacgtcgccgaagaagtccttcaccttgtcaaccacagttttgagctttctttctttgggagctgggataatcaaaacattttactgttagtgacttgctacctttgctcaagacatgcttactgaaaacatggtcattggtacatttactataaaaaatgcctaccatcctcacttaactgcatagaagttcttttccaggacaacattttctgagctactatctagtactaggccaaaataatttgaaggttgtgctctagaaaatgtcagcctaggataaagcaagatacaagtctgaaatgtacattttcagagatttcagctctaatgttcatgagaaattgctactcctacataacttgcagagaattcgacagggagaggagataaaaggcgctagcgaaacgtacttcgatcacattacttgtcgtcagcgcagacctcaggttcccattctcctgctcacccaaatgagacaggtaaattgcaattctcaattttttcgagtgcaacaacatacaatcacgcacagaagatgaggactgagaaaattaccacaactttgtagccatatcgaaactcattgtcggtcttcagcaccctgtactgctcttttgctgtgtctattatgtcatcctcatccttcagaaatcaaatcatgaaacacgcacatttaaatcttctcttttctacaactcttcaaacacgattgtgtgacaatttgtgtaagcaaacagattgtgctgttaattactttgtagatgacagcggcaaggttcctggcgagcgtgtccttgtagatgtactttccgaggaagttgtccttcgccgcgagcatgatcttcgccgtcgtgccgccggtgacgatgttgagcgggtaccagaagtacacctgcagaaaccagaaaaaaaaacccacacaaatcttgatcacacgcacgcgaagcattgggatcaggaatggagaagaagaagaagaagaagaacaagaatcagggcagcacggacattggcggtgcggatgaagatgacgaagcgcgggttgccgtcgtcctcgatcttgggcagctgcggcatgcgctgctgctgggaccgccggtccgaccaccccctccccctcgcctccaccaccagcgccgcccgcctcgccggcctcgccgccgcctgcagcctgctcctcggcgccgtcctcatcagcaggaagctccccccgccgctcgcctcgccgggcgacagctgccgcagccgcgcccgcgccggcgccggcgaagacgcgctcagcgacgacacgccgcccaccacctccattgaaacctcctattccggtctcgcgccgctgtgtggtgtacgtgttgtggccgccgacgaggacttgggagaagaagcagtggaggggaagaggagggaagataaagccgtggaggggagcttatctggtggtggtgagatggctgtggggtcgctgatgtgtgggcccgggtgggggttctggacccacttgtcagtgtgccagtgagtggaccgggattatgcggatagtttttgagatggtttcgtgctctcggcatacgtggcgtggttacggacagctgaaataaaggcacagtagcagtcgcgtggcttctcccggggacgccacgttgcacatggaacggcctcccagtttatatgttggaacacatcaaatttacaaaattcttgcaaaaagataagtttaacagattactcgttggattattgttactgccgattatatatttgatttatgaatgaattaatgttttaaaagtaaactttataaatggcttcgaacaagtgatctatagaaaacatatttaagagacctagagtaaataatctgtgacaataatccaataaagtagctaaaaagcccgtttaatccctaaaatttacttatatgaaaactatctgttctaaaaggaggcctaaaaggctaaaacggagtgtaaacaaagctagaaagatgtaattattatgtttaaatttaaatggtattatttgtagacaatgaaaagcatttttttccgaaataaaattttagaagtaagcaaatacacgtcatcgagaaattgaacttacgacgtttccaaacatctcatttcacatttcaattaaaaaaaacttacgtacagatgctaagctacaattacatgcaccaccttttttacgggcgaacaaagcgttcgtcggccaagagaaatttactaagatcaaattaatggttacaaagaggtttaccacaatcaacaacatcgttgatgaaacctcacacgtttgcaacggacttctgcttgtagcatcgaaatgccggcaattttttccccttccagatcaaccccttcttttttctgctacctgattctcttgactctcctagctaatcgtcgatcccctatatactatgattaattaaaccccttacgatgatcacattaagactaagggcaccacaagtctgcaaggaagcaacaggtagtcaatggcgaatctgctcttcatctcgtcgtaacccggccacaatgacgccatctcatgcacgtcgtacatctcctccatgcagcgtgccaggtacacgacgctgtatcccgtcaccgcctccagcccgtcgtcctcccacggcagcggcggcggcagcccggcatctgccagggtggtggccgcgtaccgcgcgaggtacaccgccgacgccgccacgacggacggcgggatcctcaggctccggcggtcgagcagcgtgaggtcggcgaggtggtgcgccacggcgtgcacggcgtcgccgccggagtagccgtacctggcgaggaagtggtcggcgaaggtgtgcgcggtggggcggcccagcctgtacccgagcgcgtcgagcaggtcgagctccctgtcgagcacctcgctcctggcgatggcgagcccgccggcgccggcgccggcggcggcgtcgccggcgctcagcctctcctcggggaggtcgccctcgtacttggccgcgacgaagacggccgtggcgccgagcagcgcgagcaggcggtggctcaccgcctccaggggcctcaccgactggtagcggtcgacgtaggcgacggcgcggtggagcgtgccggcggcgaggccggcgtgcccccgggtgatcccctccatccacgccacgagcgacgcgcgcgtccacgggtcgacccggccgcgctgcaccgcggtcatgtagtccggcgacgaccgctcgccggcggccatctccatggcccggaggctggcgtacaggtcggcgtcgtacgtccacgccgcgcaggcgcatctctcgccggcgcagtagctcccgtccgtctcgtcgccagcagccgctccgccgggaccattggcggcgacggcggccgcgatctcccggagcatagcctcgacgtcggcgtcggcatcatccagatagagataatccatggcgcgctctgggcgcggagctaggccgcgagctcggtgatggattcttggaagatgggaagagagggagacgacgtgctcgctgcaaatttatagcgccacggatatgatgatgaacccgttgactccgacatgatcactgcgatgcgacgagctcaagagtccgaattggagttgacctggcccgcaagtccgacttgatcccgtactgggccgagggatacggcctgtgggccggcctgctccggccttgggctgcagctagctgggccggcgactccgtggagaccatctccgggcaaggaatttttttcatttttaatttttttcttttaatatttacagaaataatctatcggcgcaaaaaattacaaaaatagaccctgccgccctagtggtgggcggcaagctgacgtggcagacggcggctcgacggcgccgtctgcggccgtctgcgaaaattgcatttagccggcaaggggataaatgcaattttcgcagcatttggctcgtacattttgcatctgggtcccttgccgccctactagacgtaccagccaaaacgtactaggcccgggctgtcttttttacatgggggccctgggctgcag

SEQ ID NO: 44584 - DNA, 1730 bp, Oryza sativa
  unsure (1)..(1730): unsure at all n locations
aagcacagtggtcagcttagccatgtggttcatgcactaatcgggagtacataatacattagtacatgaatggtgattattctgtataatttactgttatatacagcgtagtactccgtactagcgagctggatattgagttcttgtttatgggttcgttgagacgtcagcgagattaggacgaagacgtttagtttatcataagaccatttaggtcatagaggtgtcgaaacatgaattcggcaataataaaagggggtagcgcacgagacctaaaagtggatggatgcggagacaaaggatttagacaggttcaggccctctcaatgagaggtaataccctactcctgtttggggatttgaatccgccgggtgtattatagatctgacgatctagtttgtgtcatcatgccccctagagggcctcctgcccaccttatatagggtggggggcaggattacaagatagaaaccttaaccaatacggtatcggtttcctaaatctactttacaatattatcaaaccaggactttaggccgttccgtaatatataaggaaacgtaatacccgagtcatgatctattacatattccatagatataagttatcccctatgactagtcggataaccatgccgtatgggtatggggtacccataatatccacagtagcccctgagaccttcgcagtcgaaaagataatcttctctcgaaccagattactccaaagccgagtgcttcaatcatctttgtcatggtctcccgagtacttttaccaaatctgaagactgtggagggctggaaaataaagtcaggtgcaccgactagatgcacctaataggtgtagcccccgacaatgtggttaattgaacaaaccaagcatatagtcaaggaataaataatccaaccaaccgagtggttttgataatcgtaatcaaccaagtgacttgatatcaatatatagcatatgcggtgtgaatcctccaaataacatgatccgggtgatataccaactgctttgtaaaatatgatgagtgatatagcaaaatagctataaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 44585 - DNA, 3078 bp, Oryza sativa
atattcagtgctaaactaacaaatggttttgtgaggtttagggcttacacagtttttttttaaaagaaaagagaaaatcaggatatttacattgcttgattgaagtcatttcctagaacagatagcatgattaacaccactaagatatcttgtcctgccaagaagacaaactgagggaaagaaaagactcaccaccgataaacggtcatgtatgtaagaaaccacgtccgcactgtccacgcaagacctgcagggggaaaatatacagtagtcaatgcaattagtatggaactatgagtgaaactatatatgaaccaaataggaggaaaaaaaaaaaagagaatgccaatgagtactggtgacataaaaatgatccaatagttattgacaggtattttttgctgaagagttaccacttaccagagaccttgacttgcaataacaagaaactccatgtcatcagttatgtcatcctgacattgaaagggcaattttccatcagatcccaacccggcaaaactgaacttcatattctaccaaacggacctatttacacttagttacacttacagcgaggatgtccggatcacataccagcatttgtttttcacgatctaaatctttgttcttcttgaaagcaaagtcacctgaaatgtaagtaggtaaaacgccaatcacagtgtaatgtgcttctttttgtgctattacatgcaatcaatgaaaaacagatccagacaagactataccaattgatcttgagattgttacacctcccccaaaatcaccgaggacccattgttccttgactacataattccccattacttgttcacacctaagtccaagagatctccctcctgcattttgaactctctctctttcagactcagttcttgtgcatggtttgtgatcgaaggataaatcaatagcctattgacaaaatggaaacaagcacaaatgttaggcgccacaatgaacgagcttgcaaattaggtattaaccagaaattcaatagggaaacaatcactataccaggccaccctgtcttgagagtacgcaacgagaatcaccaacatgtccaacaatcatttggttacctctgatgacaaccacacatgctgtgctcccttcatacgctggcccagtatatgtcgcctgggaaaacaacaaccaaactgaagtatataacacagaatcacaacattgttagaaggaaaagactaccaaaaaatagctcaagaaagccaacaggtatagaaaaacatttctgaaaaccaaaccaatgtatgaaagaaataaccatcgaagggatatcgcaaacaatacctcaatttggatagcatagtatgataagaaccaaggtgcaatgagaacttaagaacctgttggcctccaactcagtaaaccagccaattgatatgtaactaattgaaccatttttaataggagcaattagtcgagattagggttaaacatatctcctccaactccaaagtacaacacaagaaagaacaacagtctcgatatcaaacacattcttccatttcctttttcatagatacaatatgcacactgtccaacaaatacaattttgagtaacttcttcacgacatgaatatttgaggatgctaggggttaaaagattactacctgtgggaaaggcttagcacagacaccagccttgagaaaatacatacatccattatcatgaggaataactaactctctccaagcatcggactgttgcaggttctcatccatgctgcagcaatcacacgaacaatgatatcccacatttccaagtgcagctataaacaaaattatgtaaagtaggccaaaataaccttaaaaacacattgtccagtgcattaatcagatcgttgtgatagtcttcatgattgcatagctcaatgtgaaattgttttgcgcaatacaatgctacttcagctcctgagatagaaaaaaacaattcagtatggcgtctcgctcaatacgatggatcaagattacttctattgcatagaagcttataaatcaaaacactgttgtgaacattagtagcagaacaacacttgaataggcatcattaaaaaaaaaactaacctgttaatctgtaattatcctctaaattatcatcaccatttatattactagtaactcattcatgcagtgttttatctctcatgaattaaaatttctttttatgtagttcatgttatccttgcaagcatgccacacgaatgtgattactgattagctaacttgttcattatccataactgtagcatcatatttatttgaaaattgacaggtaaatgtttcaacatatacaacaaagttttcaaaacatgcgcagagataaacaaagtgatacacacagacaaacatagcatgacaaacagttacgccaacaatttggagggtttgaaattaaaaaaaaaaatgagaatgaagcaaacctccatggccatcataaacaccaaagaaagacgtggacgtggtatcatcaagatttagaatagctgcatgctagagaatatagagggcatatgtcaatcacagtattttacacaattacttaaagatcagtaagaaaattttgcagaactgtccctttttttgtcatacaaaaggctgcaagtttactcacagcatcttccattttctcaccccatccttgcatagacgacacaacatacttaattctgtcattctcttcttcaaaagtgaacttcgattctacaggaaggctgttacccatagcggaacttgctttgctgaaaatttaacatgaatacaaatataaaataacattattaacaaaaacggggaaagacacttaaacaataatacagatcaattaaatgccagaaagctaggttacatatgaaataaagtgaagtagaatcatcaaacttgatatggcactacttatctagctcaaagcacagggtgtaattggtgctttcattcagggcccttaaatgcttaaatgcatttttgagatatataacatggaagtatcaatcttcagttgcagtgctgcattattttacacctaaatcttattttattact

SEQ ID NO: 44586 - DNA, 3289 bp, Oryza sativa
tccgaaacgccttaaaattcgagaagagaaagaggcgccgttctacttgatcaagacgtaaggaagacgggcagattgcatcaggaacagcaaaaagaataagaagagggcatttggttgatacgaattcagtaagtgacacctccgcaacacacctagtgcaaaacaggagcccaaaaaaagccaaagcagagaagagaaacgaattcatggcgtctaacttctcgcgcacgcattggtcgcgccaggaaccgtcaagatcaacgtgctccgatgggagagaggcgaacggagaccaaccatgaagcttcggtgctcgtcgacctcctcatccaactccgagaaaaccacgcctcaaatgcatcaagcaacaacatcacgggtacgggaagcgaagaacacgaaaaaagaggaccagaccgcggtaaacaggaaccaaccaagacgcagggtgctgctcgattcagcgaagacaagaacgagagaaaccgcgacaccaaacactccaagcaaacaaacaccaccaccaatggagcaagatcgaagaagagtagggagaagaatctcacggcgctttcggagaagaagtagggtttagggatggaggcggcggacgaaaccacagaagaggagaggaggatgaagtgagagagagatctcacctcccacctttcgccgctgctcttgagacgcgagagagagagagatgcggaaaagtggttgtgcagttgtgctgcgaagggcaaaaaaaagttgcgcttaaatacctggaccagacgcatctcctccgtcggatcgtccctcgcggctgatccaacgctcgaggagtggccccatcctgtggctggtggtccccacggatccctcgcccctgcatgactcgtccaattctcttttactcatcatcatcaactattagtcagttcatcaatctgggtacaattttcatcaattctctttaatctggatcaggacaacttccatacaatctccacacgaatcgacaaaaattctagcattttcaaatcccagattaaaaaaccctgtaatatgacaatatcaagcctaatcagaattagctgacctggaatttctaatattacatggcaagataatatatgcttatttacaacttaatctagtacatcgatcacatcatgttggcaaatggtatgatgatgttatcaagcttagaaggtagcgacctgctgctgctgctgctggccttgctgtgatccgccgattccagtgctcgtgatgtctgaagggccatctcagaatgaagccgcaggcaggtcatagccatcttgaagacaaacatgccaatgggaggagttagatgacagtgtgaaaagttactgagtttccagcttatactgaattggtttctcttttaagtaaaaactggtttccagcttataagtaaaaatatgtcctgtttttcgttacaaattgctgaaaagagctgggtcactgaatttgtatactgaaggaatgagagaaatgagtaggttacagaaaactaaagcatataagggtaggttactgaaatgattaggcgatgcagacaaactttgatacaaaaccagcataactgtactcctttgttcgtcaaaaaatgacctattattattgggtgtggttttaagaaacaaatgtcatcctattataccataattgctctctacgtcgacgaacaaaacacgaacaagtgatcgataacagatatagaccagagtacttactgatgagcattctgtatcaggatctgtttctgcaacatgaaaagcccatgtgcgtatccattccaaaccagtagaaacatcctgatttccttctataagagatgatgcaacatacgacggatgcagcgctatcagtatgcaagaagctgcaaacaacacagacctcctgacgtatgcttcgggatgttgcgaaacagccctgcagaaacaaaatccaatgtcaaaatcgtaccacttggttataactaagaaagtctttaacacggaaatgcttgttttaggcttggcagacctagatctgatcatatcaagaagagctggggcaacagctgatgcttctggatgcattgccatgcacttcatacagacaccaagcatgtatatcaatttacctaggacaacaaagtcccgattgagcaagtcaacaccatgtgatcttttatcatatccttgcataacagggagcataaaagcagcagcatataaaggaaatctgttttttgaccactctgtctgcaaatctttagcttttccaagaccccatttacgagattttcctgatttaacttgaccagatctagatggaacttctctttcataccggtgtgaccaattcagaagtgttcctgattctgagacttccctccaaggacctgcaccagcaggtccctgatcactaggaactagccaagagggagaggtgtcggatatcaagtttccatgccgcagctctctccttacaattttagtttccgcaagctcctgtgcagcctcagtcataacatcaataatcaaaatgcgctgacttacatccacgcttgatgagtacagcaacttggtgagaacatctaatgattcaaatgtgcaggttaccagcaaggcaactaatgccttctgtctcttttcttcagcagaatcttcctctccttccattgccacgtcagaacatcgaacatgcacaagtgctctaacaagatcacctgagttgtggcgtagttcatcaggtgatgctctcacaagcttttcggcagaactcagagcgttttcaaccttgggtaaaaaagaagggaggatgatcaggattttacaataatttgctctggaaagtacaggtagcactagatagaaacttacaccgtctggatcatcaggttttcgtagtgcagcagcaagatcttttaattgggtgaatttcttctgcaaatctgagtcatcgtctgacagatcatatggctccagggatgaatcactggaggcatcaatgttcattatttcctcatcacattcttcctcttcgaaatgcccattcacagcagaaccagacgtttcacaagaatctagtgatttgatctcaatgatttttgccctgttctctgaagtatcatgtttaatagcctttgcccttctctcacaagcatgtttcttgttctcaggcaaagatggtttcagtttgcttataagttctacatcctttgaaggggctgtgatttccttcggagataaaaccccaaagtcccactcaacattctcacaacagttatcat

SEQ ID NO: 44587 - DNA, 1352 bp, Oryza sativa
tctcacctcaaaaacagttttgtgcatgaagctctgattaaacaaagtccacagaatccagtatgcctcctcatcgcttgtatgttgtgatgcaagttggcgcaacatctcttccgccaacctttcaacagaatgctggtctctaatagcctcaaccacattaaaccaaaattgggaaacatgcttgatcttgtcaggacttatggttttatgatcagattccatacatctctttaagtgactacggatcctaggaatcagctcagcaactaaaatgcctgaaaagagcaagatatattatcagaaatacaacaaatagtagggaaaaggatggctacatagattacaaacaagaagttgttaatgactagaacagtgtgctaggatgatcagccatgacatgaggcactgctatcctgggtgacatctcaagcattgcagaccccaagtctactgtgattgccaaaagtgaacactggataaaaacccaaaaacaggctaccttaaatgtttaaaatttcagctgaagggactattagtggaccatcagagaaaaccaaatgtgtaccactgtgttgtattagtttgcataaggattaaagattatatgaggacaaaaaaggatctgctccatcaccctagtagcagaccatcgcaaacataaatgttgagttgaatacactataatcctaccagacacaaatgcattggtaaaccattactgcaccaactagagctgcccccattagtaaatagaaatgtctaaacagataaactaacagcacactgcacacgtcaagctacatcctgaaggatgaatactcaccagtagatccacgacggctaacacgagatatcacttcacccacgaagaggaacacagaattggaggcatctagtccattagcatcttcgccagcagccaactccatagccgcttgttcagttgcaacaagaagctgatcgacaacacacttgaagaatgaccttggtttccatcaaggacttacagtttggaggaacaaacatagtgcaaataaatacatattagctgagaaaaagctaacagaataaaaggaaaggaaaaaaataacaaagatgtttgtgtttgtgtgtgtcgtgtttggggcggtgggggtgaggatacgatgatgtcagtgcaggtgaagctcccattcttgttttatctggaacagatgcaagtagttgagcaacccttgaaatgaaagctgctctgcatgggtgtcgagttgtcatcatcgtgcttgctgcttacagtaaactctgcaataatctggctgacccccttattctcgaccaaacatagaattaacagcctgaaatggggggaa

SEQ ID NO: 44588 - DNA, 785 bp, Oryza sativa
catggtatcatcaagatttagaatagctgcatgtagagaatatagagggcatatgtcagtcacagtattttacacaattacttacagatcagtaagaaatttttgcagaactatccttttttttgtcatacaaaaggctgcaagtttactcacagcatcttccattttctcaccccatccttgcatagacgacacaacatacttaattctgtcattctctttttcatcagtgaactttgattctacaggaaggctgttacccatagcagacctttgttttgctgaaaattaataacatgaatacaaatatacaataactttattgacaaatatggagaaagagtaaagtgaatacaattacaaaacactacagatcaattaaatacataagagctttggtaaaaacacgaaaaggagtcaactagacataacatgatatgacactatttatcagggcccctaaatgcatttttgagacatataacatgagagtatcaatcttcagttgcaatgctgcagtattttgcacattaatcttatatcttatacaagaatcaagcaaagaataattaaaataaaatattactgtgaacaaaatgcatacaaggttttgtaagaacgccatataagctttactgacacaaatcataacaccaaattccaaagtgaaatgaagaggaaacaaacagaaaaggcgtattgtacaaggacaatcaatttcctcccggtatggccaccttttcggtgtattaaaacttcaataattcgaaacagagtatgaagtg

SEQ ID NO: 44589 - DNA, 1142 bp, Oryza sativa
agcggtcggaggccggcgaggaagaaggccctctcccggagcgcacgggagaatcgcgccttgactagcctcttcgcctccatcccactgctgcgcatgtcggcggcggcggcggcagcaggtcacgaaggcatcgaggatggagtcggcggacggggaggacggggagaagcgcggcggcggcgctcggtggcgaagatgggcggcagctgggggagatggagcagccatcttgtggctctgggcctctggcgtagactcaccatgtgcatcagtttggtcatcttgttcgtctttgtttgatggtgatggatcatccccttcaatcaagtatccctcctcatttgtagtctcgtttattgagtagcccctttcagctggatcagcagtgccaagatttgctaaacctgacgctaggcctgaaataggagtatcagcagattcccctgtatccatagacagaatctcatcaccagtatcaaacaggccttctctaaccaaagaagaatagatgtcatgaggattggcatctgcactttgcaagcttgcaaaaagtcctgtctgttcagagttatcttcttgtgctgatcttccactcggtgcttcacttgtccctgtcagcgtaacttggtcctagaatttcagatttattaactgaaaatttgttgaatttcagtcattagctggatcatttgctaaatttcagtcattcattgaaacttttgctgaatttcagagtcaccaacttggcacaatctctgaaacttttgctgaatttcagattctttgactgaaacttctgtatctcttttgctcttttttagattcgtttactttggcgtcattttctctggaactttgcctagtgttagagtaactaacttgatagcgccatttttttttctggaactttatctgaaatactaacttcttgttgcatttacctggaacaaccaaacaggttacatatctcagacagtgaaattggaagctctgggcattccagcatacagatcattttctttggttgagctcgaagcggcgactaatgacttcgaagttgatggggagaggcggggaacgcggcggagacactgaagttgatgtggccctcccgggcgaggaacccgtgcgccgcggcg

SEQ ID NO: 44590 - DNA, 2507 bp, Oryza sativa
gccctccccttctcccacgttgcagctgccaccgcctctccgccagcgcgctcgcccgccaacgccgcctcgccctaccgacgccttcccgttctcccgtgtttcggccacagggtagccgccgccgccacatcaccggccggctgtcggacctcctcgcctcggcgacctcctccccaccaccggctggcctgccagagagaagagtgagtgagagagagagagagagaggaggaagggacaggccggcctgctgatgtggcttgctgacgtggcattctgacatataaggcccacactgactcagtcgccacgtcggatctagtttttactggtttataagttagggggtgtgttatatctggtttttcggttggtggatgattttgtaactggatgacaagttgagggaccttcggtgtactttttcctttctatgtcgacccagcccagcgctcggtcacggcccagcaaccgcacgcgtcgcgcatgtgccggtgcggacggggacggcgctcccgctccaccgccgcgccgctcgccgtttcccccgcgcgcgcgtcacccctctgtccgccgcgaccgttttgccgccaaaccagagcaagctcgccgcttttgccttcctcttctccgaccccggtgcccgtggcgccactccttggttcacgccgaggccgaacgaccgtcatctcgccacggcgccccttggcatcgttaagccatgtccttccctcttccactcatactaacaccgggtgctagaattcttctctccttcctgccgtagcttgtcgctcgcttgctctctctgtgccgccgccgccgccttgattgataggaacggcatcttgaatccttagccgcgctgaatcgatctctgtcagcggaaacatgcaaacttagtcactcagctgatgactaagtttagctgatgacgagggcacggctcctgacgacagcccgtagatgcatgattcatgattcaggaggaggtcaccggttcactacagttccactcaattttgatgtccaagacggagatgatgtgtgatgatgcactgcatctgcatgcgacggatgatactgatcatacacgaagctcgggtggctcgacccaggacgagcacgagcatgtccaacgggagagacgaccagtccggcagttgtcccagctgcgccgccgtcgtcgcagcggccgcctctgtgattggagattggagaatctcgagagttcgggcacgcgtgtgacctgcatggcgtgctgcgttctgtgctgcactgcttcttcggaaacgtgtttccaccggactcgcatcacatataggtcagcttccgcttgtaatagtttgtaccccacccggttggtttttgtcggttgcatagtaatgtggaggatccgtctctatgccgtgccaaaaaactgatttaccggcggtgcagattataattggtttgaattttgatgccgtacgtgtaggaattcatgtttccttttcctgatttacttacatgggcgctgcagatttaggcgtgcagatttcttcgtttctctttcctatatgccaatatatatatatactagttctcaaagcctctcggatgatttcgaacagaaatcacgagacaacacttaaatcgggctgccacaaactctcctcgtttataaagcatagcacagattgaccggccgtctcctacgaaggattaattaccgaaagatcgatcggccagccgtccgttgaaatcatggaggaggcagtcgacgcatctgccgctctggatcccaagcttgctcctctgctgctgttcggcggccacggcgacgccacgttcctctacagcgtgccgaagagagcgctgctggcgccaacgccaacgccaacgagggtgggcgacggcggcgtcgacgacatgatgagaggccaccgctggtgggccacggcgcagggctggttgctcatggcgcaccgcggctcgccgtgcactttcctatgggaccctttcaccggccgccgtgtcgggctgccccccgaccacgacggcaccgtcctcgccgccgaaggcagccatctccggaggtgcctcctctcatgctgcggtcccatggacccgaccagctgtgtcgtggtcgtcatcgacctcgccgacacggagctctggtattgccgccccggcgacaaccactgggtgaggctccatcagcatccgtaccagcacagcaacactgagcaccgtgacgtcatcatcaggtttttacgccagtttacggcgatcgacggcaagttctacagcgaactcctcatcggcgatgacgggcttgtcggcgtcctcgagttctcgccggagctgacgctcaccaagatcgccgtacacggcgtcgacgacgacaggagaccaacggtgtacaagaaacgcaccacttgcttcgtggaatcaaacggggagctgcactccgttgtcttctctcacccgatcggatgtgaccggattgtcgcgcgtgtagg

SEQ ID NO: 44591 - DNA, 4266 bp, Oryza sativa
acgcaggggcaaagatcagcagcgtgggtgaaggtggattcgctaggtggcagagcgttcttcgttaagataggcagttttggagcgtcacttgatacggagggaacgggcttgagagggaactgcgtctactactcggggttcaatgggaaagtgttgtgtgtatacgacatggaacgaggaactacggttgtaatcgatcccggcacaaatcttccgtatcaccagtcgcctcaagtattgatgccaacattttctggatatcatggcggaacaactcgaagtgttgaaaatatctatcaggtagggccaacaattatggaaaatgcttatgaggtaaaagacactaaggtgagtaaggtgaagagggttgttcgatttttcgaggatggttgtacctgtttgccgattcctattcagaatacgagagtgacaaagcagaaagataagttaataaatcagaagaagagtaagcggtctacggctggaagacctccttatcgaggcgaaggggcaagcagccctgaaacgaagaactcataccatggttgtggctttcccttggagccgctcaaacgtcttctaggtatgaagaagtaggagcgcactacatggaggatcgaacttgaatttttatgccaactcaatgagggctttttaattaactcattctttcagaatttgcagtaatgatagctcggctatatcatgtctattaatttcattaagttttgttctctactatgtgattgggagcactttttctttgaaactttatgaaaccttctcgcgttgcattaagagaatgatttggtaaattttctttgacaaaataagttataaaatattaaaattaattttgaatttttgctttttccaaatatttgtgaatttggtgtttatttattcaaatttagtaaaaaaaatgtgttaaaatttcaaaatattttgttcggaatggtgcctaccgaattttttttgctttccgaaaagaaaccctgcttatacctggttttagaattgggcgacgcgattgaaactctacctcgtacataagggacgtggagagaactttttcgaactgaaaagcatttcgtggctgaaaccggcccatggcctctttcagttcggctcggcagtcggcaacagcaagagagtgagagactcgttgttctcaaaaaaaaaaaatgttctgaaaaaagtgagagactcgtcagtgaccggcacgacatggacgccggcggcgaggaggcgaagcaggagcgccacctggttgctcgtgccggcccgcaagctcttcctcctctcccatcccgacgccgacgacgacctcgccggccatggtcgccctccgctccgacgtcctccacgccgtcaaatccgccgtctctctccatctatccatcggccggctccccgcctgcacgccgcggtcgagtcgctggccgccggactacgcgcgcgcggatcgacgaggaggtccgcaagctcgacgggaagtgagtgggttcttcctcccctcaattttggcatcatgttactcttattgcggtattgcccagaaaattaggtttgcccgttgctgttcttatagctgtaggctgtagcactctctatgtggggataaattttgtgacaactcaagtctttgctacgatacgttttcctcaacgaaccttaggttaggtaattaggttactttggggaacttgtcgatcacttgcatttgactggatatatgtaatttatgaattatgtttcagaatggggtcggtatgtattgtatgaggttcctcttgagagagtttgcataccaagtgcctaattctgtcttcagtatattgccagtgttcgtgtatcttgattccaggctcacagatgtgcatcaatgcatgctttggttcattgttacaagatgtaattgggcttgtcaaaaagcaatatagattcctaaggatcacaattcacaacttcccaaccaatataaaagtaatttatgcaccctcctcaccaaggaaaaaaacccaatgtaaactaatgtgaaggaaaatcaagatatataacttcactagagcttaaatagtataattgtggttccagtcatcaacacatccccttttagctggtcacatatatcttccgttctgctctccgcatttgttctgtatctaatgtttcagttactagcaagtttgacaagaatcattgcttcctctgaaagtaattttttttcatgtatcaaggattgctgacgctgaagagaatttgggtgggattgaagtgcgtgaggcccatctagctgaatccttgtacttcataagtgtcaggcagaaggtataaatctgtatttttctatactttaccctgtggtctggttgacatagtacatgctcgaaatttagctacttcagggacaggggacctcctgtcctgttgcaggtccttggagggaagtcttagaatcaggacacttctgaattgttcacactggtatgaaagaggaggttccatctagatcatgtcaagttaaatacttaaatcaggaaaatctcgtaaatggggtcttggaaaagctaaagatttgcagtcggagtggtcaaaaaatagatttcctttgtatgcttttggtttatgctgctgcttttatgctcccactcatgcaatgatatgataaaagatcacatggtaatatggtatcgatttgctcagtcgctactttgttgtcctaggtaaattgtatgcatgcttggcgtctgtatgaagtgcatgacaatgcatccggaagcatcagctgttgccacagctattcttgatacaataagatctgggtactccaagcctaaacagacatttcctgtgttaaggaactttattagttaggtacaattttgacattaacttttgtttcaacagagctgtttcacaacatcctgaagcatatgtcagaaggtctatgtgttgtttgcaacttcttgcaaattgatagcgctgcacctgatgtatgtctcatcagttcttatagaaagaaatcaggacattccaactggtttggaattgatatgcatatgggctcttcatgttgcagaagctgatcctgatacataatgcatatcagtaagtattctggtcactatggggggatatatctgttatggatcactagtttgtattttgttcgtcaacgtagagagcaattatggtattggctgagcgcacaatattaatagggtcatttttcaaccaacaaagaaatacaggtgttcagcgtaaacgttatacaatatctcattttcatctactttgattttagcctgaaagaagagcaattttactgcgagatgatttcactatctgaaaataaagagcaaataactcccacattatgtttggcccctttgtatcgcaggaatggaaaaacggaggaataggaaaaacgtaggattctgacaggaatgcaggtgtaaaacagaggattggaaaatacaggaaaaacacaggaataaccgtttgattggaccacaggaaaaacgcaagaatcggatgagagagatagactcaaagaaatttttccaagaggttggacctcttgctaactttccttcaaaatctctataggattagccattccataggaattttgaaggatagtataggattcaatcctttgtttcaaaggctttcataggaattttttccaaagggttgaaatctttcaaattttgaacacttttcctacaaatcaaaggcaaaggggcccttagtttcctgtaacgtacttactctatcattccttttttactcataaagagagcccatttcagtaagctccttttttactcataaagagagcccatttcagtaagctggaaattcagtaacctctcacaattcaatctaactcctccattggcttgtttgtctctttgcaggccaacatgaccagtttgcagctctattccgagatcttcagaaatcacgagcactggaatcggtggatcacaattcataccaaggccaggccagcagcagcagcagcaggtctctgccttgtaagctttgataccatcatacattcgcgaacttgatgatcaatgtactggattagaaatataaattcgatcaatgtatgataatttgatcaacgaatatatagttttgtgataatttgatcagcttccctctcacacccctccctctctaatagttgggtcccactgatttttttaaaaaaatattgatttgattgtcacgtaggaacaaagccac

SEQ ID NO: 44592 - DNA, 912 bp, Oryza sativa
aggacagggcactcccggagcgttggattagccgcgagggacgatcccacggccgagatgcgtctggtgcaggtatttaagcgcaatgctgctttcccttactctcggctggctgcacaaccacttttctgcttctccctctctcacacattctcatctcaagagcagtagcggcgaaagatgaaggacaaatgttatatcgaattccgtctgcattgcctttgattttagtttgaaagaatggataatttcactgtgatatgattcacaatctgaaaaataaagagctaatgtcactcatcatatgctttagttttcagtaacctactccttcctctcattcctttagtctaatattatactcattcagtgatccagatcttttcagcaatttgtaaagaaaaacaggacttctttttatcgtataaagagaaaccaatcaagctggaaactcaataacattttacagtgtcatctgactcttccattggcatgtttgtcttgtagatgggtatgtgctgcctgcggctccattctgagatggcccttcagacatcacgagcactggaatcggcggatcacagcaaagccagcggaagcaggtctctctaccttctaagcttgataatatcatcataccattttgcgaacatgatgtgaatcgatgtactagattaagttgtaaataaacatatacttatcttgccatgtaaattcctgctcagctagttctgcttaggcttgatcatatcgtattacaggcaggggcggatccaggaacaaaagattgggggagttcaattacacagtttcttcaaccttgagccatttagggactttttagtttatcatttatggtgaaaaaatcgaacggggtactccggagggtatccatgggttttgtgggtgtag

SEQ ID NO: 44593 - DNA, 998 bp, Oryza sativa
tctactataccacgaaaaacaagattttctttaactgccttttcaatgctgctacgtactccactctctgctagtactaatctctgccggtttggacgccggtttcgcaacagttttgacgcagtttcagagcatgcaatgcgatggcatgcgatgcaagcatggagatcgcttcagcagttcagctaagccatgtgagagccggctgcagccgagctgacgacgagagagagccgaacaacaaccatacatactctagtccaaatggtcgacatgattgcgcggcgcggggaagaaggggatgatcattagtaattcagaagaccaaaacgctgttcttctgcgtcgtcgctgatgatctgaatttctgaatatctgatcaatgctgtttgtctgtcgtctgttcgcctgcgtctcccgtctccgctgccggcggtggtggtaaatgaaagccggagccatcggagagcgctctcgatcgatcgatcggctggtcggagctgaggacgaagacgttttacttcgtcatcgatggcttcgcttcatgccaatatcgatcgtcgatgcccgatatgctgccatgccatgcatgcatgacaccatatgcaatgcgcagagtctgtctaagagaccattgtttcatcatccgctgaacagttttgagatctgcagtataagaacatgagttcttggctggtgcccgtcgttttcgttggagcatgttggttgttcgtacaagttcaaggcttttcacaatgctaccacaatgatggttatggaaaataaattatatgtatggcaggactaactacgattaattgatatcatatcttaagactcctttgaaacgcagaaattcaaaaattagtttgtttcctacgaaattcctctaaaatgcctccatgccaaaaggggacgtaatttctcgagttatgtcaaccttacaattcctatcgtcgaaccatataccctccaatatattaatcctcaactcaaat

SEQ ID NO: 44594 - DNA, 4983 bp, Oryza sativa
agctttttcagcgtgtacctggttgaggttgtagggattcttgcgtccgtgtcgccgctgctcatcatcccaaaacaacagtagaaaaatcatggtgaatttggatggatgtcagtaacttcttcagaaatggaccgatgacatcgatcatgatgaacaaagagcagagtaatcagaatcacatgtttgacttggcagatcaatgttaagagttcccctagtacttagaatgttcatggccattacaggaataacatttcttgatgacagaaacttcacctgtaaatccatatccggagccctgattgagtgagtttcttgacgattggaaggacagtcatgtcagagtcgttccatgctcggttgatagaattactgccaaaatttgtcacatgaacaatgttcagacaccacaattgcatccctgatcgcaatataaagcatatttttgagcagagataagagattactggcaaagggagtatgctccagggatattggcatgcagagctttctgaacatctttacggttgaaatattcagtcgcgtacgtttgcgagcatggatcatagcccattggtatcttcaggaaatcaaacttttgcacatgaaaatattaaaaaacatacagacacacattgatcaacgatcgtacacatgatatgcagagagaaaatgactcagaaattttttgcttagctattactgaagtcaaggttgcttacacggctgctggtccgtccgatttgtgctgcaaacgacgagttgaagtttgggtatccgagctcgcatcgaggggtgtaaaggctgtagatatctatgatgctgtagagagcgttgaactgatcgattgcagcgttgcactctttagacagatcaaccaaactgaagttgcagaacttctgaaagtcactgtaaagtttgtctgagatgagtgcgtgatgccatgcagaatcaacaattcctagcaaatccgtgtcaccatccatgtaagcatttcctatctggaataagcacaaggcaaatgatgaaattaatataacaaatcaattgttagtttagttttttctttttctgaaaaaaaagaccaattgctagatgcagccatgcagggatattgcaattggggaataccatgatgcctttcaagtttatataattttctttaggtgcaatcttgttctgatccacaatcacattagcaagctggggaacgtaatgtcctgcatggtggcaagaaatgttagttaaacatacaaagattagtacacatccatgagcaaattaatcatgatttagtataatgagcaagtttggtagacctgcatagctctctccagctatgtagaactccttcattttgtgctgagggaacctctggaaccacctgatcaggaaagtgtatgaaccatatgctgcaaatcattcataaaactcatctgttatggagtacttctttttctgaatgtgagtacgccattatacagtttatgtttttataagataatagaaatggtttatatctcgggtctgtgtattactagttatgtgattgtcaaatacataccggtggaattgtctcctggtggatcttttccaaaggatgtgttggtgtaagaaaacccaacaccagcaggagagtccaggaacagcaaattggcaactgaaaaagtcaaaaagatcatcaagtaaacttcacaaaactaaagataattttactaaactatcacaaaactatagaaggtgttgtatcacaaatctacagatttagcgacacgtttatcataaaactacaaatttaaagttaagtatcacaaaactacatatttaatattaaagttatcacaaagctacagattttagagtttaaatatctagcactactatgctagagttgtaaatgttacagttttgtgattaaattgatactaaacctatagttttgtgataaatttgctaactaatcttcatttattgatactccatcttaaatctgtagttttgttaaagtatctgtagttttgttaaatttactcaaaattattatatagctagtgagccagccccatttccaccactgtgttttgatcaagaaaagattgactgtgacatgttactactggtttaactactgtaattaccttggttccatgcgtatggattcagctcaagttcagccacatctttcttcaccagaaatggccctagctcctgtgcctgtccaaacccaatggaagaacatccaggtcctacaaaatgcaatttcaaacagcacaaggttacacttttaagctaaaattctctcttcaaatttcagcagttagttttattaaccagaattcccagctgtcattaattagagatagatgcacttggtaattaacctccatttagccacaagacgagtggcttctcgtcaggcttgtcagtggcctccaagaaccagtagaagagtgccttgccaaggtactcgtcagtggtgacatagccggagtattgcctgaattccggcgagtaggccggctgcccgggcagcgacatcacgcggtcgagctcctgcaactccatggccgccgtggctgatgcatcgaggctgcccgtttcaggccgtgcagaagcagctgggccacacagtgtcagtgtaaccagtgcaagagagccaagtaggagtagcaagcaaggtgacgaagtctgaaccttcattgctgaaacctgaatgtttctttcacttgggttttgcaagacagtgtggcataggaactgtatatttataagtgtgcagccggcctgtcagagttgctatgtactccctccatccctaaatgtttgacgccgttgactttcatatttcaccgttcgtcttattcaaaaaatttaagtaattattaattctttttctatcatttgattcattgttaaatatatttttatgtatacatatagttttacatattttacaaaagtttttgaatggttaaatatatttaaaaaagtcaacagcatcaaacatttagggaatgagggagtatgttcgtgtgtggagacaagtaggtcgagccatcggccggctacaaggagtattatttccgggcttcattatcatgaggtgcattatgtagtaatacgtatttatctctcgaaacaaagaaaaatctgtatctttcagcggctttgaaggtaccggtattttacagtattaccaattcagagaaggtgagcatatgaattgaagaacaaaagtatatgctttagttctcaatcagatcctagaatgcaaagaaacctgacgaatgaaaaacgtgtttgtttctttttcaataatggaattcattccgacttttgtttcacataagttttagctaattattatagagattacaaactgaacgattacgggttataaaattacagtttaattaattgaaaaaagaaactacttgtaataaggatagagaaactgcttcgattaaaaacgattttgttgcatcattttgtgggctgagctgtatatgcctccccctttgggcctatgtttgccggctgctgcatcttggacaggcgtgcttgcaactgtccaattttttctcttcatcgtcgtcgcttcctcatgtacattttttcaccctcttacgttgtcattgtttgattgtttgatgtatgactaataagccgtgaaaatataaagaaaaaaaaactaatttataaaaaaaacttgtatatatgtgtgttcttattagcgattttaaaagcgaatgttagaaaataaattaagattaaaaacctcaaaattaactgaaattaagtttcagaacctaaattttggttgtggtcaataagccaaaagcctttgaggataattgtcccaatgagccgagttattaccctgtctgataggcttagtagttaaggatgatgagaaaaaaaaatgtagtgtccatcgttaaattatgggtggttgggaagtggaaggatgatagggagtaagtttgggtaaaatttactttgggatactttagatttgcgacatttggggtagaacaatttagttctagagtgattttatattccttgagaagatatcaggagttaacacattttttaatgtaaaatttaataccttcttggtactaggtagtatgaaaaattgcacaaaaatttttactcaaggataagttctaaattttaaaacaacttttgatttcggtaattaaggataagttctaaatattgcaaaatatgttcaaattcagccaatatttattcaaaattaaatcttgcacaattgctcaagggtaaatatgtctttttgaatgttttatcctatattagaaaagaaaaataatgattcgggtatctttaggcaagtgatcacaaaactaatctagagtgttgttgacgaccaaaattggtaagttgtgaactaggttcggcatagggatcgaggcagattcaacaaggagatggattcgaagaacagagtatgcatcggctacgaaggcatcggctgaagtatgcatcggctgagatggatcggacagaggacagccaatacagccgatagaggtgatgcagccgattccgatgacaatggtttcagagatgcttctagaatcagttggtgtgcttcatgaggattgccataatggagataaagctctcggataggcaattgtatctattaattagaatattttgtataatttccttatatatatgtttggcaaaagtctgccgcaaagatttatgatatcttagagtttgttagagataagtgtcgtgtccggcaagggcatatcttgtatctcgggtataaatagagcccgaacccatgtaatcaattaacacagttcaatacatctcggcgcatcgccaccctttttactttcgttttatttcgacgagttcttactttcgggttgaactgcatcgattcgatcttcaaccagaggtaaactgttatggcggcttgcgttctcggggtta

SEQ ID NO: 44595 - DNA, 18992 bp, Oryza sativa
tgaactaaacacagccttaataaattttgatataagagcctctcatttccagcagtttttttaatgtatcatcatacggattcgttgtttttctttccattcttattctgctcttattctacaagtattttttaatgtatcatcttacccccatcttaataaattatgcatctgttctttttttttctggtttagctcgagcttgcaaacaagcataaccgagtcggccttttagcttgttaaaataacgcacgagccagctcgatatccacctccgtgtgtaaagccttttctcatatgatgtcatgtatggtgagcgcgtggccggatatattactccttcttatggaagaatatcatgccttgtttaatttccattcggtaaaatttagtgagaacagactaatgatgagaaacgtgtgcatagatagctcaggttgtatggcatgtggtgctgtttcatgaaaacttgcgaggctaccgttgcttaatactccctccagtttatattatataagtcatttgacttttttcttagttaaacttctttaaatttgatcaagtttgtagaaaaatatagtagtattttcaacataaaacaaatacattattaaaatacattcaatgttaattaaatttaatgaaactaattcgatattttagatgttgctaaatttttctataaatttagttaaatataacagagtttgactagaaaaaagtcaaacgacttataatataagacggatggagtatttaagatagatactgaaaactagcaaatccaatacaacaaatacacaatcattaaggtccaaatgagttttttccttgaaaaattccagcactcgtttctttttgttggggtctctaaacttatgatttttagtattgattcaagaatatattgttgtttaagtaaaaaattaagatttgttatttttgtctctatcacaatgaaatatatttcttcccatgaacggtcatccgcagggggagaagactttaatttggaaaatcaaacacacacacacgagaaaatggagagcgtggtgcaactctggagtgactgggaaatccagttgctaatgctccttagcttcacactgcagatgctgctattcttcagcggaggcttgcggcggtgtagcaccaaggcactagttaggttttgcctgtggatagcatacttgggggcagatatggtagcactttatgcccttggttatctctcacgacaccaagatgtcatcattggagggagcacattgagggaggttcacccactgtctttcctttgggcaccattccttctcatgcatcttggtgggcaggatactatcactgcatttgccattgaggataacaacatgtggctgagacatttgttaaatctgggagtccaagttgctttgaccctatatgtcttttggaagtcagtggatcgccataatgtacatatcctaattcctggcatctttttatttgttgctggcatcatcaagtatggagagagaacattggcactcatgcagtgaagacaaggcaagttttccaaaagtagatggagacgaggttgactattttggccttgtttcttttgtcttgcactcagtgccaggcattcgagagctctttgcaggacataccttgcaccagatggaacaagatcatcgggaagtattgacatcaaaaattaatgaagtgcatttgcccaagttattggagatagagttgtgtctgatgtatgatgatctgtatactaaggctttggtgcttaggacaaggaggggcataattctccggtgtgtatcccaggtatctctagtagttgctttcattatctttcaagtaataagcaacacaaagagatatagtggagcagatgttacagtgacttatgtgttatttgctggaagctttcttctggaagtttgtggagtatttacctttattatgtcaccatggacctgggcatggtccaaggctaagaaatgcaatggagttaatcacatttctgaatttcttttctccagcaatagtggatggccgaaggaaaggccgttgtggtctaattccatggggcagtacaattttctgagctacttgggttgtgacgagtcaaggctgtccaagctagtgaaaaaagtaataaggaagatggggagcctagttggcgctggagaggaagcaggaacgtccttgtggatgagcaagctgttagacaccaagtatgttacggtggataaggagatcatgcaatgtgtcatacacttgatctataattatagtccatttggacctgcaagcacggatgatcaacgctggccaaatcttggtccgctgaaaaagttactactggactcatatgaattttggctatgctattgtgtactttcatatatttacagaggtgcacctatcgaactattatcttcatgaggtattggccagtgtgtgccggaaactatccaactacatgctctaccttttggtgagacaccctgaaatgttgccggtcagtggcactgctgaacctaccttgaaattctttcttggcagcattacttacagaaatgaccactacaagaatagaaccctaaaaagggcgagagatcggctgcaaattcaagaacctgcagatatgggcataaagacattagaggagatcagagacatgtgggcgatgcttctcatctactctgcaggcaagtccaaggcaaacatgcacgcagcgcagctgagcaaaggcggggagctccttacctttgcttggttgcttatggcccatctacagcttggagacgttggcgagcaatttgaattcctttttggcagcgtccctggtccggagagcaaagaggacaacagagacttgcagtggcggagccaggatctcacgacgcctagggctcaaattgaaggaactatccatgataattcatacgctgaagtacaaagtacagataaaaaaaactgcaagactgaaataacagagcaaaatcaagcctaattcaattaagagataacccattggaaaaacttgtgactatcactttttaccatctttacaacaaggttaccaaggtaagagcagcttgagaaatccaaatcaaatctcatgtcacaaataaatgtgtcaagttggtctctaaggactgtacaaacaaataatcccttctacctaatgtttacatccaattgttcaattggtgtgagcagcccggtcaacaacaatcacatttggagcaagcacaacattattttgcccattgttactatcctcagttccggctgtttctagtgttgtgatgtactcaatcagtttctgttgtttctggggttgggtggacagaaatgatattaatgtttagcacctcttcatccaggaaatcaaaccaatttctaattgactaattactatcaaatgcaaaataagaatgcagatccaagattagagaggagactcaattggattttgggaaccaagattttctggctgctgtcgtcggccgctggctcgccgtgggcccgtggctgaggaagccaggaaggtgaagtgccgccggctgttggctgctgtcgtcgggccatcgccggctcaccgcctatgtgcgcccgctgtcgcggccgatgcgcgcggacgccgctgcggagacgcaccgccgtcgctggctcgtcgccgatgcgcgccggggacgcccccttccgccgatgtgcatcggcgccgctgctgttatctggtgaggagagaggagaggagaggacgagcggcgtgatgcaacgctcctctgtgatgcgtgtgaatcgtgatgggtggcaggggaagaggagaggatgcgggagggtagggttggctttttttgggctgtgacctgtgatgggctgcctaatgggctggccaccaggggctgtgaaagtctatgtgtggggctgggccagacgagtagggctgggccatgggatttcggaaaatctggaaaatatatgggtactagtccactaaaaatttttgcacgagtaggacttgggcccaagctgccctaggcccagttccgcccctgtcagatagcatggtaaaaaaggaaacttcgtctcgtttaaggtaaactctaccgctcacccgcttgcccctcctaatgaaggtttagacgattttgattggaaatcggatgactagagttccggttgggcatagtggattctaatccctcgaggggatatcccctctgtacctttttcttctaaattcgatgcaaatagttgtgaaaaattctaaaaaaattgacaatgtagagtataatgatacctactagtccaccaaaattcatgatcaaattcgatctacacatcgagaaacaaaaaagacaaatttagatataaacagtacactactattcatacgctgaatttgtcttttttatatctcgacgtgtgagttgagtttggacttaagattttgtgaagttgtatatatgttttgtatgaatgttgtcaaatttttccagaatttttcataaccgtttagatggtttttgagcaaacgagagaacatcccctcgacagattagaatagtttccccatatctatctcctagaagtattcctacctttgatgggtttatgcaggggcggagtcaggattccaatgttcttatcatatatttttacagaagaaggacaagagacataggagtatttcttaatgctaatttaactctagatttgttttcaatatgagtaaaaaaatgatgcccgataatgctaacattatttggccattcaaagttatcaacttttaacttttaacttttatgatttagcgctaagcaaatagaatgtaccttatataatgtatggagttgactgcatatatagtccatagcctatctatgagaagggatgcaggtgtacagtcctattacccatataaaaacttgcttgctagttcattaatttctcatatagtaacacaaaatttagagaaaaattgaattagaagtgggataagcgggcgagaaaaactcgcttgccgccacttgcatccctatctgtgagcataggttctaaaatcgcatagttatttgttatatagtacaacgcaaatgtgcatatatatggttgagaattggttgtatttaaaaaattcattttcttttctacttaggcacattaatcaaacatgatgtgggtcgatccatgtatatagtagttcttttttcgttgaaagatatttgtttatttgtaatgctaattagattaggataagagagatttttgtttcctcatgcaaagatcagtactagtagttgcttatttgtactgctaatggattttattatgcttggtaggccgcacgttatacaccattagcccataattaacacatcaacaaccaagcgaacagttttactgctctagcacctgctctttggctgacgtaccttatattgcacttgtggtaaaatattgagcattagcttatattggctgggtgtcatcggggtcagatgacaacagtatatgtactgtgatccgcccctacggtttatgtaacatactgttaacgaccaaatttagtaaatcatgagccaggttcggctttagaatcgaagtggatttggcgaagagttagattcgaagaacagagtatgcatcggttgcgacgacatcggctggagtctgcatcggctgagatggatcgaacaggggacagccgatatagctgatacaaccgatacagccgattctgatgaagatggttctgagattgcttctagaatcgatctacgtacttcaaaaagattgccacgatagagataaactcttagaaaggcagttgtatctattaattaggatatgttgtgtaattttcttagagatatgtttgggcaaaaatctgccgcaaagacttatggtatcttagagtttgttagagataagagtcgtgtccggcaaggacatattttatatctcgggtataaatacgacccaaacctgtgtaatcaaacaacaatagttcaacaacactttcggcgcatcgccaccctgtcggagctcaaaactaattacttggatccaactctaattaatgtatcaatccctggatcagtagatattgatatatacaatataaccagttcttcattgcatacgttaaagtttacaacgctaggggttttacaagggtaggtacttacctaattagacataagtactaatattacacagcggaagttttagtacattctgactaggaaggtataacctttaggggttttctaaattatcgaggtcatcgtagtaatagtcataggggtcctcttgacccaaatctgaaaaaagggttatgagagcaagaatgagtattcgcaatactcagcaagttatcatgaaaatatgttatgcattggcatatagtggggttctttgcaaaaagcagtaataaacaatctggaagaattacagcaggaatttataaacatatagactttagatttctaaccagggtaccatatgagtcccggtactcaactccatgagtacggctattcgaatagtttcaaagatattctactgcagcagatgtatgctttacccgcagtccacgacttgctgataatcatcggctttagtcatggcccagtattaagtcattaacaattgtggcacctgttccatgaacttatatcctcatatgctctgaacgtattgttaacagcagcaagaagagttctggcgttcccgaggtatttaaggggaactgatcgtatgacaccacatcatctcgatcagggtttagaaatataccatatagtttatactcgagtatcacaaaccatttacctgtacatggtaatggttaaagttgcccttcgcagcaatagttgcctcctgcgcgaggacttaaataagaaccactatacagaggtgccatattgctaattaacataataactaggcctgtccccattttagaaactgcggtcgtacccgttcgttcgacataagtacctagtaaaacttatatcgatcgagacagtagtagccacccgaaaatcaaccaaatcttacgtactgtcccaatctaagtataaggtattttaaccagattgtaagcaaaataagcgatactaaattatctgggtttctatggttgaattatgcatataaaatagaatattgaatagaaggctataaataaataatttgtaaaatataggattaaatgatcaaaaggtatatggtaacttgccttgctcgatgtcctgagattgattgatattatctattgagtcagaagaatcctcaagacctagggttagacatataaaattcaaatccaaaaggaattcaaattaaatccaaaaaataagaaaaatagagaaaataaaataaaatgcaaaaatagcaaaaaggggcttaaaagatagagaatgattttagaagaatattggtccaagtttcactggaattggatctatattttaaaagatatgggcttctaaagtttgaaaatcaaataaaagtgaaatggcactgtgtgcgggtcccacttgtcagtctctctctctctctctctctcttctcttcttctacctccggccgttccccaaaagcggccagcggcgctagggttggcgattgcggcagcgatggagggaaaaaggggttgcggccaaggaggggagggagctagggttctccggcgacagcgagcggcggcggaggggttaatttgatatgtggacggcctagcggctagggcggcggtgacatagttaagccatgaaggcgattgggatggtgtgagttagacatggctcggagagggattctagagaatctacggagtgcctagatggattccgacagcttgccgacctttggcaaggcgcggagaatacttgccgacgagcacctcccttggcggcggccgtgctcacgtcggcagcccaaagggtgtcatggtagtgcaaagggattgctaaaatggaatctagggagtacgtagatggttgaaacggaagaactcaccgagatatgccgagatgaaggattgcggccggaaaaacttctcggcggcgaagaacagagcaacgcgggggcggcggtgctcagcttggtgcggcgaggtaaaactcgatgcaggacttcggttagggtctaatatactagaacatagttgatataaggtgttctaaggggtatttagggtggaggatggatggaggggtgtggagtcgatcgcgcacaaggtgttcgaccgacgggtgatggtggttgatgagatggattggtgaagcagagctttggggttgtggggctattggtgttgatgatcgatgatggacaaggaagggattggggtcctatttatagggctaggaggagcggatgagctcggacaccgtcatcgccatggatgagctcgatctttggatatggctggggcagcagaggctgtgagagggcggccaagatgaatttgagtggcgggaggccacgtttgaatacttactagcgaaggattggcttgaccgtgtgtgaattcggctggcgacgtagttgaattttttttattttaagtcatttttttgtcccaaaatgtaattttaaaattaaaatttcaaaatctataaacatgcaccaatattttgggaccctaaacagttttaattcaaaaacttttcatctacaaagttttaggtcgcgtcgagagctacaattttaatataaagtttgtcttcattaaagttcacatgaaaaaagttttgaattatttttaaatataaagtctttagaccgtcctatttgacccagatgatattcaaatccaagtttagggaccgggatgacacaactgaacaagttggaggatctaaatgagtgttctgcaagtttagggaccgggatgacacagtcgaacaagtttgaggacctgaacagtcgatttgcgagtttagggaccgggatgacacagcggtacaagtttagggaccggtgatggactttactcttttattattttacgcttgtatagttgagtttatgtatgaatttactctatccgttctgtttcatactttcatactccctccatctcataatataatatgcgcacgtattttaagattaaacctttaaaatatttaaccaattcttagtatgatatgtaatgaattttatttgttaaatattatatcattagattgagatttaaatttactttcttatggttataattttgttgctacaaaccatatagtatacgagaaattataagctaaatattagttttcgagaccgtaccaactttgaccacgctttatattataagataaaggaagtattataagttgtttgacttttttagttaatttttttaagtttaatcaaatttatgaagaaaaatatagtagtattttcaacacaaaacaaacatattatcaaaatatatattgttagaattaatggaactaatttgatattttagatattttagatgttgctaaatgtttttataaacttaacaaattttgactaaaaaatatcaaatgatttataatatgaaacgaatgaagtatttaattacggtcacgcaagctcatccacctataagttcatatctactcgagctatcgagaggtagacgaagacgaagacgccatgagcatgataacggtgaaggtgaagacgctgacggggaaggaggtggaggtgagcatcgaggcgacggagacggtggcgaggatcaaggagcaggtggaggcggcggaggggatcccgccgccgcagcagacgctgatctacggcggcaggcagctcgccgacgacatgaccgccgagatgtgcgacctcaggcatggctccgagctgcacctcgttcttgctctcaggggtggactactttgatcgatcagatcgtttgctcctgatcagctgctaatactctgtttctattgataaacttcattaattacggtcgatgttagtttgtgtgtgcgttgcaataaagtgcagctgattaatcgtcttgtagtatgcgataattttctgtgcttaatttgcattcctcttctcttttttttataaaaaaaattttggcagagctttgcttttcattcaatcagggaaatctgaaaattacagaggaaaaacgaatcggcagacctgaaaattaaaaaaaaaactgaatttgactatattgcatttgcatctaggctcaagcaagcacgaaccaccatttgactttgataatttcgaaggaaaatatccacatatttcttttcttatatatatttcagtggtccaccatttaccgttataaaggttatatagtaatagcttgtttgaaacttttgtggttgtattgataaacagcaactgtgtgctagatcagaacatggatcagcctttgtttcggtgaatttggtcaaagacgttgggctagttcttattttaccctactactttccttatcttgaattgtcacttagatttttataaacactgattccgctggttcttgaatcaactttaatattttttattgaataatttcaagtatattcccttcgtttcaatttactgggtcaaagacacatttcagttttatcctaacccaaacaattataacaacatgttactatatatgaatatattataaaagcatttctcattgtgatttaaaaacacaaaccttcctcgctgaagaaaaaaaaagaatgaaaagaatatggagcatggtagccacctggctggcttaccagcagctcgaccctgggcattgggggatgacccaaactgtcaaagattggtgggagactctagctaacacggcatgggttcgtaggagaggtttgcgcacccttatcctattcatagtttgagagatatggaagtaaaggaaccaacgaatcttgcagcacaaggaggccacgtcatctttgctcttcgtcaagataaaggaagaggcgcggacttggacgatggcaggagtaaagcatctgcgggaccttctgctcctccatgtacaatatttaaagtgtataaagtttttcacttttcttgtccctagggattgtttttccttccgctatattcaatgaaaaggcacaatctagtgttgttttccccttaaaaaaaagcatgaaccttatgacaataatctatagaaattttcaaaaactgatagtcaaagttagtaatataatacttgatttgaggcaaagctaaaatgataagtgatttacaactaagggaatttaacatttagatgtggtgtaatataagagcttcaaaattttattattataggtataattttcattgagagtgccagacatggatttttctcattttcagcatcatggtgttacttttaaaacccaaaaataaattatgacatattaagtgcacaaatattggcagaaatcagctgctactctgtttcagttgataaactataattagttactgtcgatgttaattcagtttgtttgcaataaagtgcagctgattaatcgtcttgtacgataattctgtgactccatagtcctatagatacttctctcttttaccttcaaaaaatttttgttttttctctttctctttttttttttggaaaattggtaggagctttgcttttcattgaagcagggcgaatgaaagtaaaagagagaataaaaaacaaaagctccaacttatttttgagggtgagatacaatagaataagtaattgtgtgcttatactgaattgcgatcgtgtcctggtaggagtagatcagaacaggtatccgtgtttcagtgaatttggtaaaaggcatcggaccactgcttattttaccgaatttatcctgtcgcataacttcaatttgaaattactctaataaaaatccaactctttcccgcaaataaaaaataaaaaataaaaatccaactcttcttctgtttcataaatcaacttgaactcttatcctgtttcccgcggtttttcatccggatatatatctgaccgattttaacttgctcgtcgcggcgatttccaccgatcgatcgatcgatcggtaacctgaccaagacgaagagacaatggagtccgcatggacgaatctccccggcgagatcatggagctcatcgccgacaaggccggcgacgcgctcaccggccgcgccctgtcccgctcggtctgccggtcatggcgcgccgccgtaccggagacgccgcggctcctgctccccgccgcggccgctcgcggcgccggcgacgagtacgcgctcgtgttcccgctgtcgcgcgggtggtcggtcgtcgtcgacgtccgcgacacgtcgtgccgcctctcccacctcgccaccggcgcgacggcgccgctgccgaggctcaacgccgtccgcgccaccgccgggtcccgcgtcgtgcacctcgggtacgagcactccgccgcgcccgcgcccgcgcccgctcccgctcccgctccggccaagacgacggcgaggcgccaccggaaaaacttccgggtaaagcgcaggttccacctggcgcgcggcgacgactggcaccggccgatgcggcggcgctgggaggttcggatgaacccggcgtggaagcggagcttccggctgccagacacggagcacgccggcaccggagacgaacagttctggatcaagatcaagtttctctggtattccatgttcctcgaatccgacctccaattctcacacttgctccgcttcgccgtccatgtcccggcggcggcgagcacggacggcatgctgatcatgatgtaccacccggttctggggacacgggcatggtcttctgccggcccggcgacgccgcctggacgaagctggacaaccccatcgacgacgacaagcatgtctacaacttggtcgagttcgcctacctggacgggaaggtgttcgccatggacaggggcggcaccacggcggtgatcgacgccgccacgctcgaggtgctcgacctcgtcgacgcgccgccggggacgcgcaacgtctcgaacaagctgctcggcaccgccaatggcgacgacaccgtcatgtcgctcgactacctccaccttgtcgcgctgccgagcaagctgctcgtcgtcagggtgcgcgtcaacaagtcgtcgtcggagccggagggcttcgacgtgttcgagctgggacgacaggatcatcgcgacggcgagggcaagctcgcctggcgcgaggtggccggcgacgacgtcggtggcaactacgacctgttcctcgacgaccaccacgccacctttggcggcggcggcggcggcgccggcggcgattccggtagccggatttactacgtgcacgacgggaaggaggcgtactgctacagcaagcggcatggcgagctggaatgcgtgtactcggcgccggagggtagcgaggaacagtgttccaccatgcctagctggtttgttccatagatccatagattaaagttagatgatagagatttactccagcctaacaaaaattatctcgagatatcggtacctcatggtactgtgaggtaccggtacctaaggtactttttgttgggccaaatcaaatctataaatgatataaccccgcacgttgttgtgtgtctgctatgttagaaagtctaacattatgacgatgtcaaattgatcaatactctataagatacttgtcaagattacggataaggtataccctctatccatggatatacgttgtatactgatatggtatacccgcgcgcacacgaatgttttctgtacacgttaaggcaatctatcacgtaatagaaacggagtccaccgatggaaggagtcctactcggacagaactgggtcgttaccatatcgtgtggggtctgatatctccaagttctactgggagatcgactgacccgcggtataaaagggacccccgagcaggacctaaggcatcgaatatcaccgccaacacatccaccacatcctatgaagccggaggctacaggagccaagtcaccgggtgatctagtcgaaccaactcgattacggtctcgtcggtatcatcgagttccatcattccctttgtaatctgtgatttccatcatataatcccataccaactggattagggctattacctatcaaggggtttgaaccagtataatccctgtcttttgttttgctaccccaataccctttatatccggtctacggatatccaccgtcgataatactgtatttaaacaaaatcttctttatatttatggatataaacccttaagcaaaatatcaaagaaaatattttgtatgacagggagcgagatattaaagaaaatattgaatgatgtcttgtattagaaaacaacgttgcttgattcctccaaattgtctttgcccggttatcttttgccataattactttttgtaaaaccaactagatacattgttttgtatggcaacttcaactttcataaaattaaattctcttgtagattcttacattaaaatccaaattcgcattatatataaattttcgcccaaaattacttttttactaaataaagtagtcattttcatttgacgggttatattagctggtcggtaaactgacaaggttttggtgcttatattgaactgcggattgtgtacaagatcagatttcagaacatggattgacgtgtatttcggtgaatttgatcaagcacgtcgggctagagctaattttggccaagtatctttattttgttacaaaagttcatcttgaattacttctgataaaaattctaactcttctcctgtttcctaaatcaaattgaattacttgaacctttactgtttcaaccacgacgagcttaataaattgcgcaaaatttattcacgtagattaagagtccatcacgatcagaagttgcaccgaattgtccgggtacgccacaatttcgcgaagataaataccgacggaaatgagagcaagtttaatagtatagccaactagctccaattcgattatagccaatccaatagctcattcatataataggtatatactacactattaatatctagtcccacttatcatacacacactgtgtcttagagtccgtgctacagctggctacaaatctatagtccgctgctcctctctctctctctccttatttatcagtatgtttacagatgcatgctctgagtaggccacgtaccagaacattcgggcattgccaggtccacggtacgcgtgtcacctcacatgactccgggacgtgtgccgccgcttaagcccgctctttatacgtgccctgcaacggcaatactctaccactgtacagggtagtagatctttcgtacgttggagccggccggatcgacgaccatggggtgcgacgacaagtgcgggtgcgccgtcccgtgccccggcggcacgggctgcaggtacggcgatctggtcgcccttggcatcttggcgaccgtgaaaccaactgaacaattcaagtgtatgtccacgcgtgtgggtgcaggtgcgcgtcttcggcgaggagcggcggcggcgaccacacgacgtgctcgtgcggcgaccactgcgggtgcaacccgtgcaggtgcggccgcgagtcgcagccgacggggagggagaaccggagggccggctgctcctgcggcgactcctgcacctgcgcctcctgcggctccaccaccaccaccgctcccgcggccaccacctgatccatccatccatgcgcccaaaaatgcccaacgagacgtgtttatacgtgtggttaagcgtgtgtacgtgcgccatgcttagtactcatagctgcttagctaaacagcacagctgataaataaaaagggcttgctgcttgagtcgagtcgtatcccgttgtctagttctggctagactcgcgcatcacgcatgcaacggacatggtgatacgcgagggatggagagttcggagttgggagacactgtgtactgcagtaccaggttgataagtgtgtctgtacttgtgtaaatatgttttacatgaataaaaaggttggtaactttgtcatgtttatcaatgcgaggggcaatgcttttcttcttcgggaaacaaaaatgcgaaactcagtatggaaacatacagcacagctgacattgttacctggacaaacatctctttagatgaaatgaactgaactgcaattctgcaaatatcatacacaaacgttcagagtaattcatgaacatttccacgtcaaatctgactgctccattatcgagcacagcctctgaactttaaccagaaaagaaaaaaaatggtgcagtaacctatcatgtatttgccaatagaatcccgagagcagtgcaaatgtcaaatggatagagcaaccaacagagaagacacagcactagcatggcagctgccttgtctagaacaaggccagctaccttaattaccttatgcctagaagaacaaggctgcgttatgatttatgaagataccccaaaacacaagaaggcatcaacatacatcttgaggattgggagccgacaattgcaaaggtagacccatattctatgcggtaagatccgataatttcatatgtatgtacatcaacccaaatagtcaaatacaacacggtaaaaacaaaggcatgacgaccatgtatggaaaagttaatggtgggggtgggatttctttgttttattttctcctgagactgtagacagacgctgcgtttgaacttggaggggctaaaaaacctcttgcaaaagagcggagttggtgacgttatgggcagcgtctggtacgctttagctactggccaagattgccaagaagacgctccaccgcagcattcacattcccagcagttgcgactagcgcctggatgttctctgcagtgtcgatgaaacccatctctcggagctgagtgagctgtgttgcatacagttcttccggtggaactgaatcacaagtgtaaaaccataattagtgatgatacaaaaacatggaagatgataagagttactatacaaaccattggatgtattgggtacacctatgccacctccagcaccaagcccactaagcatgcccatcaaggtgtcgaggctaacatttccccgcatgcctgcattttatttcattggcatttgccacattacttaacaaaaaggtgaaaaaaaatgcatttgtaagaatttaattatcaaatgctcagtactcgaattaccactacacatctaacattgctccacaatttagaaggcagtacagttgactacacaaacaactcgtataatctcttccataccaatatagcacagtcaagcagctaaagagctcagacacgttcaacacataacagattacttaaatggaactatggttgtgactaaaggtgtagggagctctcatccattctccaataatcaaatccacaagcagcattcagtcataggcaacccatttccatttctaagtaaggaaaaaaaatcatacatgtgtcacgcatcaccccaaagaccttgttttgcgatccccaaaacgaggcctggtcgcacggtcgcaccatatcgatcattgatatttctttttttccaatatttcaaggaaactcaaatttagaaattccaatgttatgcaccacaataaggtagtgtcaagaatcaaccactagtaataatcatcataatgtgtttatataatgtaatggccttatggaagaacggaaatcttgaagaactaatacaggtcaaccaagcagtgaaagaaaggcaactattggtgctagaacgaaccaccactaaaagataactcagtacgcactaaaacttatgtaaaacctgacatactaatccatcttaaaacaagaaaagatattagatggtgcatattaaaaaaacaatcaagagaaaatacctgtcgcattgcctccttggctaccatccctgaatcaagaaaatcaaaagataattaacaaacacataatgaaagaaatacagtataaatgagctagatgcaattcaggtactgttgaacaagagttactcactgcctaggttgattttgaccaagctgtgataataatgtctgctggaacgagagtaattgctgccaaaaaagggaaagttaatctagatagagatggagctagccacatacataaaacgtaacatatgttacctgcatagtttctggggatgtaagctggcgaataaattctggattttggaacatttccctcaactgagtgtttgattccatgaggttgcgtgtatttgggttgaagttaagcaactgtggacattttaaattacagaatgatctgaagttatgactctaacatcatcaaagttatataacaaaataagttaagaaataccgtacctggttcatggactgtggatcagacatgatattctgcatcatctgcatcataacagggttttgcaaaatctggctcaaggaagaagaatcaggagaaccaccaagcaaacttcccaaatctgctgaacccaaccctcctagaccaccagtagcaccagttcctgtattaccggcaagaccaccaaataaactgctcagatcagctgaccccaaccctccaaggcccccagtggcaccggttcttgcattgccagtagaacctgcccgtgttgctccttgcgcacctccagctgtcaatttaagtgtgaaaaaacaatagatatatagattatcaaaaacagaataaacaagaggattgagaacataccattggagctccaaggatttggaagtggattagtgtttggagcaggggttcctgttgtagactctgagccagtatttggagcatttgtagcaggatcccttggttggttagaaccctgatttccaagaagagctgagaatgggtttggagctgtgttgccttctccacccattgttgtcgcatttaggaaaggctcctggacagtttcatacatgcgtcggagcatattaaacccttcaggagaagact

SEQ ID NO: 44596 - DNA, 11436 bp, Oryza sativa
ggtttctggctgcttcaagggtctggcggagaacacttggatcattgagaacatgagcaagatctggattccggtcgatgatatcacgcatttgaggattgttcatgatcatgttacgaattaaatcagggttattcatgagattctgcatcattggcatattcattatttccctcattaagttggggttttggcttaactgctgctgcatttgatccaattctggaaatccagacccaaaaagaccagatggcctggtaccagcagttcctgtaccaccaaggccaggaaacaaacttccaagaccatctgttgggccgctgctaggagcagctgaagcttgggggctggctgcagcaggtgcagctgatccggctgggggaccagcgccacgcaccatatgaatggtatgatctgtttcaacacctacaaaatataaggagtgtgagaagcaagaaaagaattatgcttgataagtcagaaatttgaacagcgggccagcatatctacataaacaaagaatattccaatatctgatgtaatcatatacaagagaattacaaatgaaaacttctaaagaattcacatgtgagagactaaagaagatagtgcatcggatgactatgccataaatcctcatttatggcatgttaacatacttagcgtgcccaatatttcgtattacatgagaattacttggtactctctcataaaaggtaacaattttcccagaagatgtttttcttttttgttaaggcatcattgattcaacgcatttatttagcagcattccaccatgtaaggatgttcagaacatgtcttttgaaagttgttcccttcttttcctcaaatacacatgcacgattggccaattaactaactaacgttttcctcatatggaagtttttgcatagcaagaagctacaatcataatcaatgtaataattagttagcatcattacccgctgaaaataaatatgaaaccatgagctgacataaatacgagttccaaacatatatacacttcctgcgaatcagcaaacgtactaatttattgtaacagtagcactagagaaacagattcacgttttccttttttttcaaaagacagcccactgcttagttccattaaacagaacaattgtttggtttactgttctcggtcactactttgtaatcaacggaaagaaaaggatgattttacatttggtgaacccatttccatagcagggttgtgcacttaaccaaatagtgtttaagaaaaattgttcagttgcattgcaaacaacaaattgaagtatttacttgtatttgcacttcataaactacattcaataataaagtgcactctacccaaagttcacagataaaaataaagcccatatgatgcttcatgagaaaataaattaactttcactacaactccaagaagattctaagatgtcacacattgcgacataataacaacgtatgcgtaactaatacgagcagtagcttacatggccccataagtccataacatttggaactatattcgagtcgcgacaagatgagctgccttcagcttcttcatcatcttatacgctacgtaagagtaaccgttccgttcgcagtatacattatcattaatacactacacactctatactcgcatcacccaatcaccaataactgtgtagagaagcaaagcatatcgacgaatctgtttcgctagcatgcatagggcaccgaagcggattgctgcaccttgtcccccatgaacaggagccccaggtataaacaggcattgcatcgacaaagctaaatcgcggcttcttacaactacacgactgaaatcgagcacgtagcatgtcaattccaacccatcggaccaaaaatcctgacgatttgatgggttttttttctcctcctctacctaacagtcctagacactcaccatagctttctagggtttgctcgtccttgaggatccggcccttgtagatcaggcgctgctgcgccgccggcacgtcgcagctccccgccaccacctccttgaacgcccccaccgtggcgtcgaggtcggcccgcacggtgaacttggacccgttcgcgcaccggatgtgcagcgccgcggcccccgccaccgccgccgccgcagccgcagcaggagaggactcccctccgtcgccgcccccggcctcgcctcctccgccgcccatgccgtcgacctcggcccgatccgctcggagtcggcggcctcgcctccgattcggggtcgcgtcgcgtcgcgtgcgtgtgcgcgtgagctcgagttttttttttctttttcttttcttttttccttttttttctttcttcgggagaggggaagaagaggaggaaggagaaggaaggaatcggctgcgaggcggagactttttaacggcggggagcgacgcggggtggatgcgatggacggcggagatgcgttgcgtgcgggtgtgggtggagtgtgtcactgagcggtggggccacgcgtggaccgacgcggccagtgagtccaggtcggtgtgggggcggggcgcggggagaaggttctaggcgtgcgctacagggaagcttcctcctacgctttcctttttgagtaaacatgtcttcgggattttgaggggtcagaatttgtgttttatatatatatatatatatatatatatatatatatatatatgcgaatatataccagtggaatatgcactgtggctcttgagtcttgatctggatcgtccgatcgagacactgatcaaacaactctttttaacggttatgctgttgagtctacttctaatatagcttgagcaagtgttcaagtgggtggtttgttgtggttgtcatccctgtcgagagaaaccgttttgtcaaacatgatacggacaaaattgttgtactaaatatatttctttcataaaatttagtacatgtgatgtgatatttttctatctatataaaattatccgcgttgcgaaagatgctactctttttttttataacaatagtgtgtgacgatgctagtgaggctattttcatagtttactggagtgcgactttttttttatgtagctgaaatatttttcatcggtgacagggtaaagaattgtagtttgtgaacaatgttgtcccgagggaatgccccaaggcacgttggaaacgcatgacgcatgtgtaggatgggagttggtagttgcattttattaaatgccatatgtctcagcaaaactgaatatcggtgcggaatcaaaacttgcatgagaaacaacaaaacaaagtggaaatcaggcataaaacatggatcaaaacgttaaatgaactcactttatggcccaattacagatagaattgtccaagtccattgggccaaaaaattccaataacagcccaataccaaagtccccgcttgtttatgggccagcaagacctcctggactggactatagtaggccttatcctttagacttgccaatttacatgccttcggcgcttggcccagtgcctgatgtttgcgcaccagaaaaaaaaaagagtttttgtacctctctctaaaaaagttcagtttacgtttaacagaagaaaaacagagttcagtttagtttgtcaaccggaagaacacataagcaacacagagcttagcagtgttagccttagcttacattatgcagcggttcggatttttaattgttaaatatgatcggaatttagacctacaatatatttttattagttttctaataggacttcacatctttttctatcacgtgtctttccttttatctgctacacatacatactcttataagcaatatggaaaaggatgacatccctattattatttttttttgactgaaaaaggtagagagactctaccttataaccattatattaatggtagtcaaggtgttacataaagagatacaaaagaaccggataaagagggaggaagaagagaaaataaggagaaaagaagaagaagaagaagagaaaataagaaggagaaagaagaagaagaagaagaagaaatacaaaaaacaggagaaagcacggaagaactagaaaagctagctacgctagtaagtctatccatctgcatattggaggtcgacattgcggcttgatgtgatttccctataattgtagacattctctgatttgatgtgtcacatttgccgtggtaagatctcgctgctggaatgttctatggttgcgtgctttccataagttgtgtgcgcaggcgccaaagcatattggccatccaggtttgagatgtgagggcgtaactgtcaggacttgctcaacaaagtggagaatgtctgtgctttgagttgccagttcatagatgttgagtttcttccaaacctcagaagccacgtccctattattattttcctacatttgtgttcatttctttatagtgattgttgtcaaagaaaaagccttagcttacactacatgtctacattgctctgcatcttgccgtctctgtccatgccccccaactgcagagatacgtgcgacatggcgcgcgcgtccacgaagccagcgcttgacacgctgtggcgcatgcggttcgccaccgcgcccagagaaaaacgctcgcggaaaccacacgcgcgccgcggcagccgctcacgggcgggtgggagactgggagcggagctgaggcgcccggtgcggtgcggtgggcgcggtgtgaccaagttaagccaaaccaacagctccaagccaaaaaaggatcaacgatcattcaacttcaaggatgggtgtgcgccccatctgctacctaccagtaccaatacctatactatggcatgtcctccgttgattgtgtccgattcaaatgctagccaaggcaaaggatggttcgttgtttggcgtcaacgagattgtttttttgaaggctgagaagattggttgccccaagtcaaagaacaactgcagatcgtcaataacgggaaaaatgagaaatatcgttacgacgcagtggttgacggtcactcatgtatgactccattaatcgttctcattactagcacttaggccataaaaaagtcagaactgggcctggtttagttctaactttttcttcaaacttctaacttttccatcacatcaaaactttcatacaaacataaactttcaacttttccgccatatcgttttaatttcaagagtaaatttcacaaaactacagatactatgaccaaattatcacaaaactacagatttaactcggtgtatcacaaaactacacatttaagatgaagtgtcacaaaactacatatttagtaactaaattactacaaaactacaagtttagaatcaatttaatcacaaagtaattatgtttatagctccaccataacaatggtgctagggatttaaactccaaaagttgtagttttatgataagttcaatattaaatatgcatttttatgatacttaatctaaaatctatagttttgtgataaatttggtgctaaatatgtagttttgtgagacaactccttaaatatgtagttttgtgataattttggtcaaaatacctgtagttttgtgaaatttactctaatttcaattaaacttctaattttgacgtgaactaagcacacccttagagagccaaagtttagcacatggcggtgtttagttccacgccaaaattgaaagtttaaagaaattagaacgatgtgacggaaaagttgaaagtttgtgtgtgtagtaaattttgatgtgacagaaaagttaaaagtttaaaaaaaatttagaatctaaacagggtcacagtaaaattccgaaattggcttagcacatagtacactctactgacgaatgaatatgtccatgtgttctgccctggattctgaacttccttttttcccaaaacaacagcagaggacggctgccatcagagtatacaattccagtgaaaacacttttcgggccgggacagaaacacaaaccactcatttttttaattaatttttgaaaatcaaactacatattaatttttcgacaaaatttattatgattccgcgaaatctgatgattcgatatcgagattgtgaaccctaccttccattcaattgagaatgagactccaatctaacttgattataataattctattttcctccctataattaatgatgattctgatttaaattatacaaggatttcaggttggggtgctagtagtatgcccctgttaggtctggtcattttcgcattaagatacacaagtggcctacagttatgatgggcttttagcatgattgttgattgggaaccatttcaatacgtcattgtcatccataagcacaagccttgggcatcaggtgaacatgaagcaacggcctaacttgttctttaatcagctggatgccaaataaagagctataagagggggaaaatgatctgtacatacaatatttgactatccggttccttattagctcttacactgacacaaaatggaataaacagatactcctatatattctgaatcgagaagaaaacgacggaaatgcggatatcttttggaccgagcttaatcttaagccgctccaagtttggtaagcacacgcctttcacaaccatggcctactcaaactattttggtttgaatcgatgaacacatcgatctgtccattcaaagagcgagtcgtagttatccaaaccgaaacggctatcctggatggaccagaacagtgacgtgtctggatcaagaccgatgtaaacgtaatcaatacacagagatttttgtcccggcggtggcgcagcgcggcgagcccgcgactgacgccgccgccggcacggcgtggacggtggacgtgacatgactggaatgggctcgatccgcgtcatgcaaaagctaagctggtcttatcccctcaaatgatcaaatccaaatcacccaatcccatgtcacacctgcctttctttcccctcaaatccagcgccttttgaaggcataagccttccagggccaaaaagaaaaaaaaatccactaacgatgactcacccagattaattaccctgttaaaacaaatactaataatcaagatgactcagcaggattatcaaatggataaaaccacaattacgcaattaacgaacaaagctctactagtaactgccacgtggggcgagctgtctccccctgcgtcgcacgcgtgtccaggcagtcggtggcgagtcctccagcctctatatccggcacaggtcggcggccgccgtcttcctcccgagcgcgtcgcgtgtccaaaacattctgcatttctttccgcctctctctctcgacccgcggcagcacagcaccaagtattttgtgggggatacgagcggcaaaacaggtgaaagtaactgcaggccttgccgcgtggtggtgtagccgcgtaggggtggtataaagccaaagccgttgtgcgtaagcatcccctcgacttgttctcccaagtaaaccacttcagtttcagagttttcgagcgagcacgttttcgtagcttccgtcgatcgaattcatggccgttcggtgttgctcttccatggcgagcgccagcgttgtcctcttcttcgtcgtcgtcggcatgtcggcgtcgatggtctccggctgcgacaggtgcgtgcgccggtccaaggccggattccgcgactcgtcgatcgcgctgaacggtacgtacggcgagagagagggggggacagagacatccactcgcgtgcgcgctttgtgtgtttttgcttggttgattactgcaagattgtttggttgattttggttgttggattgtgcgtgcgtgcagccggttcttgcgggtacggctccctcgccgcgtccttcaacggcggccacctcgccgccgcgagcccggcgctgttcaggggcggtgtcggctgcggcgcctgcttccaggtattaacagagccacgaacaaactctccaatgcagtgatcgcgtgctgttctgcaatctaattgaggcgaatttgggttcgattaaccgggggaagtggcattattactactgcaggtgcggtgcaaggacggcaagctgtgcagcacggcgggcgccaaggtggtcgtgacggacgaggcgcggtcgacgaaccgcaccgacctcgtgctgagcgccgccgcgtacgccgccatggcccgccccggcatggccgcgcagctcagaacacgccgcgccgttgacgtcgagtacaagaggtaaaaaaaaaaaatcctcttttggtgtcggtggtgtaatcaactcaggtagtgatgatggatggaagctagtagctcatcatccgtagtatagagtaataattggagcacagcgattagccacagttagctgtagtagtacaggtcgcaacgcatttttcggctggatttatgaccgaattttgtacgatattatcgagcagggtaccgtgcgagtacgcagctggtcgcaacctgtcgatacgcgtggaggagaagagccgtccgccgcgcgagctgtccatcaggttcctctaccagggtggccaaaccgacatcgtcgccgtcgacgtcgccacggtaatcaaataaaaccaaaaccaaatcgatcgttctcactcgaattcgaggcaatttttgaaaacgagttcgaacatttttttgtgcaggtcgggtcgtcgaactggaagttcatgacgcgggactacgggccggcgtggagcacggcgcaggcgccggcggggccgctgcagttcagggtggtggtcaccggcgggtacgacgggaagtgggtgtgggccgacggcgaggtcctgccgcggcggtggacggccggacgggtgtacgacgccggcgtgcagatcgccgacgtcgcgcaggaagggtgctacccgtgcgacacgcaggagtggaagtgacacacaccgcattaacatgtacagtttttttgctttcctttcttttttctctcccctttttgggacgcattgagcagctagccatccatcgaattaagagccacagcccacaagaacaacttgccttccgttgcatttgcgttgcattgcccagtggggcttgttttgtctcgtgttgtttactcgactcggggtgcggaggtgcgcacgcggtggccggtgccggacacgatctcactgtgcgcgcatgatggggggttgggttgggttgggtttgggtttggtcgtcgacggcgagtggatttccgctttcgtgcccacgattccgagtgcgcgcatatgccgcggtcgcgaaaacgtaagtgttggcagattcggtggacgcgctttaacgcttctgtagtacggatccaccggtgtaagggccaatatagctggccaattggatgatggatgggctgcaatcttgtaatttccggggcttttcattggaccgtgggctcccaaatagggtgggacaaaattggaatgacaaaattatctgtccttatactgtgtgcagcatggccgaaatggtaaacgtcaagaagtccgacataacaacgattgttttgctgggcctgtacaagtaccattcaccgtgcagcaatagagaaaaagtctaatttggaatccctctcaccattaaaccaagcaaaacgactcatcgtgccgccttggagctccacatcctccaggctccgccctggatgtgagccgttgatgccaccatcgtggattgcggtgagagcaagattggggatcggggaggaagagatggatgggtggggggagagagagagagagagagagagagggggggggggaagaaaggggtgtaatgccacgtcagatgatgaaaactaagtcaatttaacatgtaaataaatacacgtcaacgaaaatcacctccaataccatcggagaagttattttgtacctattttaaaaattgaatgctcaagatatttgcaatagaccacaaagttaaattaaactgaaccacaaagttgacttatttgcaatagagtaggacacaacccgcagttgctacttttggaggccgattcccaatttctgtacctggccgtgtcaggcagccatttgcagttgataaggtagaaatatgtactcccaaacgcaattacgccttaccacttgctggaacgctggccacccaccagaacgtgatcgatcgactgattggcttcgaattggagccggtgcgttgacaccaatctcgcattaatggcgctgacctctctcccccggtctcggacagccactcgcgcagtcagacagtggacttttgctttcttagctacactgcagaagagatgcagcttgttcccgtgaagcggacatagactcggctcttttttaaaaaaaaaaaactcaagtttatttatagattaaagaagggagtttactggagaaaattccccaatgcatcaccgtaattgatacaacgtgcagagcgaaaccatctttttggaaggtaaagccaattaaactaatggaacaaacttcccaaataaaccgaacaacagtaatagatgtgatcgacaagagactatgatattgctctaggattgtatccacaagactctactaataacgtgcattccgcttgacagatcgatgaccctttcgactgcctctacgggaacaacacgattcgggattgatatgtgagtcgtagattttgcttcagcttcaccgaactcaacatcgattgctaaggagttcttcgttaaatatgaggagcgctaattgaaaacctgtcgataagaatcgtacaggaggttttgcactcaacctggacgaagcacttagcattggctacagttgtagattaaaattaggagaaacccctaaagcccaactagccttaatcatgagtcaattaggacagtggcgatagaactattaccttgctacaacccagcagaacctagcgaaggagatgacatgtgaccggggcatgggaggacaacccggtgcacccacaccagtcgattttgagcaccatctagtggattcgatttagagttgctgaggcactaggacatcgccaccatccaatacttgtcgcctgcgtctcagccactagccaccatggggcagcttggactccaaaagaatagagaaaacgggatataacccgagcaacaggaggacctgactacggagtaactctaacctaaacctatactatacttaaaagggaaggaggcccgacccctcctccggccacctctgccataatttttggggaaagggggggggggtaggggaggaaggatttactctgccatcatcatctttcatctatactactttaaatgatgttagtggtggtgtccgagtctgtctccacaccacaagctaatgtatatggccgtgaagtctccacatgtgaataactctagaattgttatctgatttttgcaacacatgtctttagctagtgatagagagtattacggtagtcattag

SEQ ID NO: 44597 - DNA, 761 bp, Oryza sativa
ttaaaaccactcttttaaacatcgaaatatgcaaaaccaccgtctaaaatcacctcatgtgtaatataaattagttcggcaaagtttagggggtttggtctctggttttaaagtttaaagtggtagatggtttttttttctctatataatttagtactaggcgtgttattttgttgtgctagtgtgttatctgaatgaagatatcagaaaagaacgaaagcaaagtagcagcaccgacaccatctctgcaaattccaaccgttatttttgcaagtagcactaatacatcaatcatgctgattcatcagattgacgatttttattgagaaacatgcatgtatgatgtatccttgatggctagaatggcttggatgggaggttctgattggccaggaagtacttgaacagctcaagcgcttgctctggcatgatggatggcaccatgtggccggctcctctcaccgtgacaaatgtcagtccgtcgaacaccacactccacccaccaacctgcaaacggcacacgacaatcaaaatcagccagaccaattggtctaagggtgtgtttacttcacgctaaaattggaagtttggttgaaattggaataatgtgatggaaaagttgaaagtttgtgtgtgtaggaaagttttgatgtgatggaaaagttggaagtttgaagaaaaattttgcaactaaacacgggctaagcaggcaaatattagtatatatttaggagtaatgtgcagcattggagtaatgttgt

SEQ ID NO: 44598 - DNA, 984 bp, Oryza sativa
aatggtcaaacgttggataaaaagtcaacggcgtcatacattaaatatggagataatgctttcttaatatcggtgtcaacctaaaacaaagtctacattttaggacggataaagtttataatacacacttggcacgtagctagcgttggtgctggagtacggttggcaccgccgatgacatgcgtgcatacgtccgcgagacatggtgtacaagtaggaaggaactcttcttcttcttcttcttctttcagcacgagaaagtctctacacctgtaatggcgcccgtgacccgatcgaagaagaaagatgtgaatgtatgtagtacgctgctttcgtcagagaaattaaccaacgtcaatcgaccactcaaccacttgatgtgttaacgtacgtgctgatctatcaattgatcagggtaacaggaagtagttttaaaggagtaggagtatcaaataatccgtgacgtcatcatgtgcgtaaaataggacaatcggtgataattaattgattcgaatattgatcgggtgatgcatatatagcagtagtgtctggatgttatcatgcatgttaatgaactgatttggactggagactacctggggtgcacgccggaagatccggtatactatatttctctcctgtctcctctcgtagttgtagctttcatccatgatgtgtagcctgattgggacatatcctgggacgatgaccctgtcattgatttacctaagtagcgagatcggctgtagcaaacgtcactgcaaacgctgctttccgtgaccgattagttcgtagtagtagtagcttagctgatgatactcctagcggctcgcttggtttgtcaaatgttttatttactacccgtcaaattaattcgaaacagccgtcaaacatagcagcaaaaaccatagtagtgcgagcaaatggcttacgtacgtcgatcgatccgcgagtttaatctgcctgcccggttttgaccatggg

SEQ ID NO: 44599 - DNA, 20540 bp, Oryza sativa
  unsure (1)..(20540): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaatttggttatacccttatttaaaacgactaatattatcagtccggagggagtaactacggtgaagaaggtacaggcaacagataggattgttggaccatgaagaaaaagatgtaagagctaaagtaaacttgcgaccaggtcgaaattggtttacttttgtggctcctactccagtacttttcaagatgatatctttcttttttatgttttggatatgacatagttgtttaatttacttctctctattgaagcagtgggaaaaaatatttctgcagttaattatagttaccctgtcaattgaattgggccacgtccatagtagggtggagaagtcgccttgtttatctcctctttgaagcagtaaccccactggaactggtcagaactacccctcgttccacctgaattaatttaccacggttaatactcagatcaagatggtaaaaaaatggcggtaagattaatctgcacactgtaactaataatgtaccggtggtctcgtgggaggtctggccgaagaaggcggcgagctcccgccggatgagctcggcgctgccgccggaggtgccgaacgccgggaaggagttggcggcggcgatgaaggcgtcgtacgtgtagaagcccctcgccgggcactgcgagttgtcgcggttgggcagcatgctgttgaacaccgcctgcgtgatgaccgacccgacgccctgcgccgccgcgccactcgccgccacggcgagcagcgacgccgccgcgcacgcggcaagctgaacaaacctcgtcgtcgtcgtcgtcatgtcgccgcttcacttgcagttgcttagctaagctagcgagcattgcagcggtatatatagctaatagcttctccagtgagctatgcatgtggtcaaactacgcatacatttcgactcgtcatttggcgcgtgaaccgcgcggcgatggatcaaccgcaggattagtaagtactttagtagataaaatcggcataaaacatctctcacaaagtcatcgagtcaaagaaaaaggacgatggatcactgtcagatgagttgtcgtgcacacaagttcattgacaggagaggaaattgttgatttgtttccgtggcgttttggcgtttgcacatgagttttcaaaatttccatcgtttctgtggatggtagtaagcgaggcatggaatttccaggaaggcagaggaatgcgccgctccagccaagcaggggagatggcattggcagccggttgtggtaaattgggtcagatttgcacagcgacggtgagacccgttcgttcagacacaaccacattgaaaaccagcattagatcaaacccaattggcattatttaattgggcctccagcctactaagtactatggtcttcggccttttaattcttagtagacagagacctggtccattgcagccatttgatttcaggttttagaagatactacttcatccgtttcatatgtaaatctttctaacattgtccacgttcatatagatgttaaatgaatctaaatatatatgtgtctagatccattaacatctatatgaatatgagcaatgctagaaagttttacattataaaacgttatgaaaaacgttatgaaacggagggagtactatcatacgcacaactgcttatagtaactgtatgacttcttgtcatgcacaactctctgccgcagcttcaaatgtcattgaacaccattttcatgcatgatacagatgttaggaatataatcatctttgaaaaaactaaataaccatgtacaaacaagcaaaattttagaaaaagaacatatacaaacaagcccttacggcgtgtcgaagaacggcactgcgatgcacacaaatatgtatttatatgggattggtgtacttccaaacaaatatttctgtacataggacatgttttattaactttacctacaaggacccttgtgaacaaccagcaacactctttagccaccacaaatgaactcccatgctctaactattcaacagatgttatatacatgggtccaaaaaaatgcatctcctatcgtaggaagccaaaccaaatgggttttcctttttaatcatacgacacgccggtaaacatcttctccaaataggtcttctaactcctaaccccgcaatatactacagataagtgccagcttctggaacgccgcttctctgagcctaaacaagttcttcatggaccttttatgctcttttgcctcttctcttctagctgtgatgcctcgttcaacatgtccaaagagtcactctgcatgttcagctttgagagcgccactgcctgcatgtagaaagctgtgggccaatcgggatacacacactgtgcttgcattgcgtccctgagtgcagcatcaggttggtcacacataaggtggcacaagctccgtctggcatatacagttggcgacaccattgtccccacatcaacaaactgtgaaacaataaccatgcagatgtttcaagaaggaaaatgataacgagcagaggatgaatgaactacatgaaaagtggtaattttagaacattgaaggtctcatgataaagaagaaataatacagcctcctacctgagtgtaacaatctatggcttgcttgaaatttttgtctcgaaatgcaaaatcaccacgtttcctagcatccaacatatctctcatctgttgagtccattcttggaaagatagctgcagagaggagaacaatttagacacgtccccataggaagaaaacagtcgagagggaccagtatcccaaccagctagaaaagagtggagccacagtgctctatattgtctttacctcattagtcccttcatcatctctgtaatgtgttgaaactaggatctgatggatggcagtaaggtccatcctggaacaggcctctcccatgggagaaagtgggtgctgtggggcgggaggcgcctttggtacttcttcaggctttggaactccaagcatcacataagaaggtacctgttttgtattttacattgtaaacaaggttaaccatcaaggatatatatgtatttgaaaactactttgttgctaagaacagcattaataaattataacatttttttaaaaaataacctacatatttttgcatacataagaatactgaacacaacttgatcaataaaatcagcttgtgtagcaacgcaagaaaagcatgaactgcagagatgatggtattgtttgttctgtaaatctgtagagttttgggatttgttcaaattggctaataactggattgctaaaatgttattaattgcatactactctgtgtgctattttatttgacatcatgcactagaaaaaggtgcacaactatcatttcataaaatatggcaccataatacatgattgcccagtcttaataatgtattccagacaaatatatcatagactcatattgcaatttgcaaaatctacttatatccatatctccacgacaaacaaaaaatgagcaaaagaagtgttaatacctctgattttgtttgcaaaggctgaagaatggaaaccaactttttaatatcaggcctatctcttggttcatactgtaagcattttgaagcaagatccaccagagtagtagcctcctctatagagtactttccctctaaatttgtctccattattgcttggatgcttctgcttcttatcatgtcaagtgcctgcacatgataaatgcgtaaatttatcagactatcactgcttgtacggtttaataaatggttaattgctagctctatatttgacacataaaagaattgtactcatcgcacaaggaattccaacaattctcgacttgtatgagctaaatgcgagatccatcttaggaaatgttttcattcattgaaatagaaaaaatggatgtcggatatttgtgctaaaaagacaaggaagataattgtatagaagatttcaaacaactttgtcagtgtgaccctgcaattgatgaaagtggcctgatacacaatggaaattgaactctagaaacatacttacaagggtaggaggaatgcgctttccactgagaagatcgatgagtattgtgccaaaactgaatacaacactttctagtgtgaccctgcctggaagaacagacaagcatctcataaattctgtggttcctcctgttttattctagtcagtccttgctactttgaaaatgcaaaattttcactgaacatagtttccatcgcattcacaaaagtgccaataagttggcttgaagagcactaatttaggaatccataagctgaataactgatctactggcccttctacaagaaaatccagtttgacaacatatttattgacttccactttaaggagtttagttattgttttaacagcaataaacaaaactttgtacagcaaggagattttaaaaaatggttcccccagataagtgaagagaactgccgaaaagagaatactggataatttgttttcaagactggtaagcaagaatgtgaaaaatcaagtaccatttctcagatattctggaggtgtatatgccaggtttgtactataacttttcccatccctgctgtttttcatcaaaccaaagcatgatagacgaggatcaccattctgcgataagaaagttaattagaaacttttcttacaacatgatggcatgctgaattgttgaatgcaatcaactatgatcttacaaagcctacttgactcaatacaagtttgtctacgtgatttgccgtgctcctatagtaggaactaaatttgccgtcggttttcccaatccttccagcacttggaggtgggaaaaatcaaaataggtgacaaacttaaacacccagaccctttaatcttgttggttttcttgaatgataagacacaaaatcaaggctagctgccatagtaaatatcacttttgagacgtcaactagatatggctgctctcctgcctccttcaaaatgaaattgtaagttttctgtgaaattcatgcgtaccaaatggggcctaaggtattgctacagacactgaacaccagccataaagaaaggcacttacgtcaacaaaatggcagttggcaagagacaataatcacttgcctgatgtacaatttcaggtgctacatattgaaacgtacttgacaggttgatcgcttacctcatcaaagagtactctgtatgcatttaggtcgtgatataaaggcctttcctcattgctacaatattccaatgcttcagcaatgttgtatgcaactctgaggcgcatagcccattcaatagccttgttttcccctgcacaagtgcaaaagcacggttaagatcaaaattaacttgttttccaatgctttgcttgtttatacgcgttaaccactaacaataaatgcaatccttacttgatagtactaaggccattcccaacccaaaacactagacatgattttcataaactccacatcatcaagaaactagtactagacaccactcttccaatgcaaacactattattccatacttaaattcaatgctccttatctcacatgatgtcttggatgttgtgtagaaaccatgtctcatgcaagacatggtttccttctctttcctcatttattcacttgccacatcatttttcattctaggtggcaccttatttaatgctatggacaccatcctaatcattgggttgggaatggcctaatactcccaaagattagacgaaaaggtaaattaaatgcagactgaaccgacaaaactaatcgaaaaaactgtgtagcctgataggagctgggcacctaggtggttccatttgtcaagtattatcaacttcaataacataagctcggcacaagcttggatcagatcacacgaagcatagcaacatccattatgaccagaagggtcgaatagttggcaggatcatcaaatgggaggggaatataaagacccggagttaaattgcaggggagtggagggagggaggaaactcacagtggaagaggtgcttggcgagggtgtcgttgggcatgaactcggcgacgaggagccgctcgtcgccgtcgcagcagtagccgatgaggttggccatcctccggtgccgcagcttccccacccctctcgcctcctcctgcaaaccaaaaacccacaaaaccaaactcagtttccaaatccacgcctaaccaacccgaaccccccaatcccgcggcaacccaaaatccacgcgcaagcggctggttcgttggttggttgtttggttggatggatgcatcccccctccccgcttaccgcgaactgcttggggtcgggccatgccagcttgccgaacttcttcacggcgatggcgcggccgccgcctcccgccccctgcagccgccccctgtagacgaggttgggcgccttctcgccgctctccgacacgatgttcgccgccgcgaacccgcccgtcgcctcccggagctccgccagcgagaactccgcgaacgccggggcgggagcggcggaggcggcggaggaggaggcggccgcctggtgcgcgttgagggtgaaggacgggcggcgcgggtggtgtggctgcggcggcggcggcggggggcgggcgcggcggggcggcttctccggcgcgtgggaccccacccgcagcgaggagccgcagcaacccatacagtgtgaggagaggagtttggaaaagtattcgcttcggccgcgtcgcgtgcgggggtggtggtgggtgggctgcgtctgcgcgctcgtgcgggtcggggaggagagagaggaggaggaggcgggttttgtaacttgctctttctctctcgctctccctcctccgggttctacgggtttggtttttgtttagtttttgcgcatggggctttcaaactttttggcgaaattcaactgtgagtcatgtgaccgtgtttgtactttgtaacccctggctggctgactggactgactctatagctgtgttcttacctcttggtcccaacctcacctctctcgtcatacacacacggtgtgttcctaaactgttaaatgatgcgggttttttttcaaaaaaatttatatacaaagttatggtaaaaaaatcatattaatttattttttaatggtttaagctaatacttaattaatcatatattaatccatcaatttattttacatgcgaaagagaggggttcccaacccatccaaaatactcaacctatgtatggccacactcttctctggcacaggctagaatgtgataaaggagtagtattgtttttcgatggtttagaggagagattgacgatggtggttggcgagggcgatcaatagtcacaagttgagggttcgtcaccgagtacgagaaaaaggcatgatacaaagaatgtgcaaagatttggttagactgtgctagagttgtggcaggaggggtaggataacaaatgaagtacttctattatggttagatacgatagatgccaccgatgtcgtgaaaaggatgggttgcctaatagggtggtgttgagggggaaatatagggagagaataataggggttagtgaagaggggatgcaaggtgaagtatgtcttatccaatatggctaatgccgtctcaaaactaagtgttgtacattacattaaatttgatgattagaacccccacacatatctaatggcttttcatcccgacacatacctaatattttaaatttatcaataaatgcacttaatgcattttgtcttaccatcttaggttgctaattgtgtggctatcactttcataccatgtcaatctagctaatagctacctataatgctagataattccatttttacacaagtcatattgggtgataataattggtgttccatatatgtctttttagatactagtatgttcttatcgatgtcttgtctgtacgttggatctgaatcatgtgtttagtaagacattataagcgataatataaggtagttatataattgctcagtatagaatactcaactagggtgtgtttagtttacatcaaaattagaagtttggttgaaattggaacgatgtgacagaaaagttggaagtttgtgtatataggaaagttttgatgtgatggaaaagttgaaagtttgaagaaatattttggaactaaacacggcgtaaagcattggctacacggctatacctacatctgaattgatccattcttgtgctttattttagtactacttgactcatctgttgctttgaatgtgaagaatgaagagtgacccttgacacgttcaagtcaacaagggctagaaattgaacggatgaaccgtctgccacgcaaaagcatttcactcaactaatatgcgcgtagctctagattatgtgctgcacgcggatgtgtactttgccttgtaattatgggtgttgcatggctatgttgcaaaaaccagcaggtatcaaattaaatacaatttacacatggcagaggtagtatgcagaaatttgtagaagtcggagcaagttttgtaaaggggtagtttccacatccaattttatatccatgtaagataagatgtgatatatgcaatatatgcaatataagatgtgatatatgcaatatatcacatctacattatctttagcatactatccccaataattttattttatttgtttgtccaatctcctctttcttttatcttcttttttgaaatttgtgtgaaggttgtctcttacatgaggtagtggcggagccagaatatgcttagagtaggactaaattagtattatctacataaatttgtgtcagggttacggataaggtatatcctctacccttggatatacgtcgtatactgatatgatatgcctgcgtgtatacggatattttctgtatacgttaaggaaattcatcacgattccacagatggaaggagtcctactcagatagaactgggtcgttactgtatcatgtagggtccgatgtcttcgagttctacttggagaccaactgacctgcggtataaaagggaccccccgggaggacctaaggcatcgaatctcaccgccaacacaaccaccatagcctacgaagtcggagccttcaggagtcaaagtcgccgaggtgatcgggtcgaatcaactcgactacggtttcgtcggtatcatcgagttctgctattccctttgtaatctgtggttttcactatataatctcatatcaactggattatgggtattacctatcaaggggtctaaaccagtataatccttgttttctgtttacttgatgtcgtactacgtagatcctcataccagcgtaccccaatatcctctatatccggtctacgggtatcccccgtcgacaatttgtctcttgtctttaatttttcaaatttatagtataatttcaatttatatttgggcataggagtaggattctagccctagctgtcctactcctatatccgccccttagcatgaggggtgtcttcccttctctttcttcacttattttctccatctcataatctaatcgtatgtaatatatttagaaacaatacatccaacattattatagtacttgctctcattggttgtcgttttggatacatctctccttaattacgtcgtacgtactactaagtccattgatcgaaacaaacaaacgagcacgttgcataagcatcacctaaggtaaaaagagaacgttgtacggagcaccatcatcaagtactgtaccttccaatataaacaaggcaaacatcgttggcgacacggagcacgtcggcgacgatggtgacgacggcgaagacgacacaccgacgtgcacgcgtacaacaaatttccactgttctcatggtaaagaaattgtactaccaccaccctacctgttatgccctgaaataaattcatttgttaattgttatctaccctactcataccactaaaacctactttatcaaactcaaatataattatttattttttatctgcttttaatatattattcttttacttttataaactctgatatcgtgattggtaaaaaaaacttattttaagataaataaaggagacaaaaataatagtattgttttaagatatataaatactccgtaatagtctaatacttactccctcaatctcaatttaaatgcaatcatatttttccgtgtctaattttgattatccgtcttcactgctgccacgttgaagtcctggatgtcactactcttggttaacttcttaaaaattggttaactgctgccacgttggacctgccgccactgcgtgtggtcccgggcacaggctcgcacgcacgatgacacggcaactgcacgctcgtgcgcgcgcttcgtgtgacgcaacgtacgtacggtgcaggcgctgggacactgcacgtgggtcccacgtactgctggccccacgtgccagtgtgacagagcagacggcaatgattgactgatggacagattactgacagatttcacagtccgtgtgcacggcgtgcgacggtgaaatgacccatcgtaccgtacgtgcgcgaccctgcacatggggcccacatctcagccggatcgatctaatttacgacctgtttagatcacatgtagttttcccacatgtcagatccaacacatgcataaagtattaaatatagaaaaaattgtaattataagttgtgagatgaatcttttaagcctaattacttcatgattcgataaggtggtactacaataaacatttgcttatgacggattaattaggcttaataaattcgtctcatagtttacatgtggaatctacaatttgttttgttattagtctacgtttaatattttaaatgtgtgtctgaatatctggtgtgacacgataaaaattttcaccgctggatctaaacagtaaacacaaccttaatttagatcttagccctgtatagttcacaccaaacttcctccaaactcctaactttccatcacatcacatcacatccaaaactttcctactcatataaactcccaactttttttccaaactacttcctccgtttcacaatataaatcattctagcattttccgcattcatattgatgttaatgaatctagatagatatatatgtctagatttattaatatcaatatgaatataggaaatgatagaatgacttacattgtgaaacggagaaagtaccaacttttcccaaacttctcctcaatttcaggaactaaacatagcccttatgtggggagcgtatgatgtggacgtgccctttccagaattccaagtttggtacagtatactatggccttgtttagattcaaacttttttattcgaacttccaacttttccgacacatcgaactttcctaaacacacaaaaactttcaacttttccgtcacatcgttccaatttcttcaaacttccaattttgacgtggaactaaacaaagcctagatacaactagagtaacaaaactagagtaacaagtactccgtcccaaaaaaaaactcaatccaggtttaaacccagaattaggcttttctaaagatggagggagtatgttcacatttatagtatataagttatattttttattagatttattttttatgagacttagtgagtatataacacataagattgtttttttacttctattacatggcatacgtatatgcgcacgcgcgtataaactactacacacgtgcttcctagtacatgaagatttgacccttggtgggtcctccttggtgtcttaatggaacaaatcacatattaggtagcaatattttaggatagatgatgtatctatacaatacaagaagtcaaagaatgctaggttcttttatccaaccgcaaacatagctcaagtccttttaaatcacttgtaaataattacttgtagtattctaaccaccgggagaaaaaaaaagcaccatcctattagctagatagatcatctcttttggtggaaaagcaagataattgctgggcaccgcagatcccagatggataatggagcacgagcccaccggaacacacttgtatttaaaaaccgtccttttcttggtggttgattggtgatttggtgccaatggttggcacctgctggtagctgtggatgaactcgccgtggcggcgccacctgctgcaagattttcttaaaaaaatatttattgttttcgagttttacagatctgtaccccctaatgtcacctgccagttagagtgggtcgacgaccgtttgccaggttattgaaaaaaaaagaagataatccattatatgccactgattttgtcacacgtctataatttactattgattttgtcgtgttctataatataccatcgacttttacttaacttctacgatttaccattgccatccggttagtctccgttagtactgtacaattttgtcgaaatgatctaaatacctttgggacaaaaactttcaaaatttggataaaaattctgaaataccagattttaagtttttgaccaaattctggatgtttacaatcttatatttataatataatattttgataattttatccaaattttggatgtttttgtccaagggtattttggtcatttgcataaaattgtacagtgctaacggaggctaaccggacggtgatggtaaatcatagaagttaagcaaaagtcgatggcatattgtaacatggcaaagtcagtggcaaatcgtaggcgtgtgacaaagtcaatggcatataatgaattctctaaaaaaaaaaaaagcccctacaataccaaatatcattaggggtatagaattatagatacgcaagacaaaaaaaacattataaatattaaaaataaataaataaataaaatactctgctacaactgcagcgagcactaagcacccggcccaaatagcaggattgggctttcacaatatagcccggctcaccacactttgggcctgcttggaatggttggttggtcgggaatgagaatcttttgagatggggttgcttgggagctgggacgcgtgaaccccacaacgcgtgtgccgttgcatccaatctcccgtatatgccgttcacaagttcgagctggttgccctaataagttaaagttaaaatcgaaatttaaattttcgatgttgattttaagatattttcaatgtgtttttaaatattagcttttatgtcgctaaaaatacacatataaattaatttttatttttaaataaattgtcttgatttattagagaatatggtaactgatgaggccttgacgaggaaggcagcggcagcatcacgagatcagctcgtgtccaaccgaccgcgatgcgtctcccgcgtgtacgcatattgcggcgtcgttgatcacgtgccaatttgcccaaacgcgcgcatctaaggtgggctcaaacaccaaaaaggctagcgacatgcattatctgggcccatccatccaatctccttcatctcctgggcccaaattgccacaaagcgatcgatcatgaattattccagtggttctccctttcgcatcttttcctccccttttctatcgtccttttttttttctcctagtagcaagagattggataacaaaaaaaaagctttattaacaaaacaaaagttgcctaaaaaacacttgataattccaaggttgcaaagacgaaaaagaaatcgtccgtgatgtgcatgcgagcgatcgacgagagattctccttttggtagctactcccatcgtgctcgcgcgcgtcttaaacaaaagaagcttttccactactcacaaatatactaaatccgcacgagctgtcacacgcaagtggtctcatcacatcagtctcgtctccgattaaaatgatttgaattctgtcctaacaaatctaagactaatatcatcctcgtcgtgatctcctaagttgaaatactattaagcacgcggtgtttggatcccatccccatgtgcaaaccgcaagatccaggccaaaatcatagagcaagcaaaaggaggtgccctacccaaccaacccaattatgcatgtgccattagattagattcagtattttcagtatactctggatttcagagactttcagatggtaccagaattccagaagattggggggtccttctcttttgcattatggattgcatccgtccaaagctgacttggattgcaacattctagctagccagccagccagcaaggctgtgtttagttcacacaaaaattggaagtttggttgaaattggaacgataagacggaaaagttggaagtttatgtgtgcaggaaagttttgatgtgatggaaaagtttgaagtttgaagaattattttggaactaaacatggtgcaagtgatggatccatatgattgaatctgcatatcatctctctctctctctctctctctctccattatttgagtgaggctacattgatctcctcttcatgtgatctggtggcaatgaaatccgggccaatcacaccggcgatcgatgtgttgcagcagagactactgtaccggagttgttcaggctcaggacggccatggctgcactgaccctactctacttgtgaaaaaagtgatgtgccacttttcttgttaagtttggtgttcaaaacgagactgttgctatgttgctttcgccttttcaattagtacggtaatctctgtggcaaaaaaacggcttaattattcagttgatctgatgcatggccagatggcccggatgactgtcagttgagttgtctgaattcagaaaccaatgtgcagatgttttgtttatactaataatgtaggagtatgtgtgaatgttacagttggatgcatggtcagtgtggatgaggatttgccataggttcagaaaccggtgtcagttcacgatcagaggatcatcttgacttgagaaccaagctggcaacttggcaatgttgggcaatggaatgtgaggttaggctgaaatggctggccggataaacgtcaacttcagtacagggagaagttggcgatggcaccactggaaaagggtttggtcactgatcactccagcgtggcacattaactgcacagatacaactccatgtggtgccaaaccgaccctagccctagattgatgcccaatctactcattaaacatctccctttgcaatgaatgcgtcttgaattgttgattcagccctgtgaccttttttaattttctgaaaaggaaaaattgttgatacaacactgttcccatgcatgcaaatgagaaagagatagctgaatgcctgaattgaaatagtaacattgttcacttctcaatctagcagagtagaattaatacaatgttcacctgttcaaatagaaaaaaaaataagaggaaagaaaaaaaaaagcaagcccattgagcaatcttgcagaggcaaataggcaatgcagagagaagggatgaaagatgcgaaatttgacatgtttttgaacctaagtgggggatcatcttctttacatcacaaaagtatttacatcatgtacacacgccaaacgaaacaaaatgaaatcttttggcaactaatctcacagcctttgctcaaaaaatcagttgatctctctgaagaagatgaacacaggggatcgaatcgaagagaaatgtgtggggattgtggagtcaaaatgtgggcgtgagcaggttgagcagcgacaccctggcattgacgagcgcgcggtacacctcctcgcagccgctctcggcggcggcgacgcactcctcgaggccacgcaccctcgccatggccgccttcctctcctcctcctcctcgttgcagtagtcctcgaaggagacggtccgccgccgccggaggaggtcggtcaccagccacatggggctggccggcgtgcgggcgggggagtagggcgtcggtgtccgtggcgacggcgcggcgctcgccgcggactcggcggaggcggacgacacgccggcgaagacggcggcggccgcggccgccacggaggaggcggcggccgcgaaggcgtcggcgagggtggcctcgtcggcgtcgtctcccggggcggcacggtgggagaggtcgcgcgcggaggaggcgagccgggagacctcccgcgccgagcgccgctgcgcgcgcagcgccgcggcgaggcgcgacccgtcgcggcgccggagcgcggcgtgggtctcggcgaggagctgcctgagcgcgacgagcgactccctgaagcagccgtggaggtcggtgaggaggaggaggtcgtcgagcagctgctccgtccacggccgccgcagcgcgtcctgcgcctgcgggtggtggagcaggtcggcgagcccggcgagcaccttccccgccctgtccgccccgtccgccacccaggccggccccgtctgcgccggtgcgtccgcccacttgagcagcgccctcgccgcgtcgtgcaggccggcgacgagcgggtggaggcggacgggcaggctcgtcgacctgacgcgcgcgtaggacagcttcttgggccgcgcgcagtcgagcaggaacgacggcgccaccgccttgtgcgacgtgagcgtcgacagcgtccgccggaatcccaccgccatcgatcgagaagcttctctcttcttgtgtgttcggtgatgatgctgcggtggtggtgaggtgactggatgcggtggcgggaggtggagttttataaaggggcgggaggcggagcccgcacgggtgggtgcgtgagctgagctcgtgcagtggaacacgtttgactcttgcactgcagtggcttgctgctgcagctgagctctactagtataaaattactagtactactcccttgtattttaagtacatttatacatttaactatttatcttatttaaaaaattcagacacgcataaagtattatttgtgttttattatctaataataataataaatattaattataaaataattttaaataagacgaacggtgaaacgttggacactaaaactcacgattataagatagagggactatttctttttcttttttctatgggagagtatgcgaacgagccgctggggtttgttggcttgaggcggaagaaagatgcttgcaagaggagacagcttgttggagaagctagattcttctggggctagccggaaagggattggaggaggaaaataaaccgagcaatgtgaagttgctggctgttcatgttgagggtaggggttgtttccagcaagagagaatgttttgtgcagttcgacaacttggaaagaatacgaatacgatgatgtacatatgaatctagctcatatactgccaaaaattggtataaatgattaaatgaatagtagtagtcatcagtgaggaaatcaataaacacttatagatgccgatttgttagaaaaaaatataaaaaaattagaggattttaattatataggaaaaaaatcctaggaggctaagcaagcatccattgggagttatgatcgcagggatgcacgccattagggcatccacaatgtagtgtaaaagtagtccataagcaatagaatattccattcagccacctattaccattgtgcaactagtgcatatatagaaaatagtaaaagatatccacatgcatatggactacctatatggaataaattatactcccccgtttcgaaatatgttgacaccattgactttttagcacatgtttgaccgttcgtcttattcaaaaaatttaagcaattattaattcttttcctatcatttgattcgttgttaaatatatttttatgtaggcatataattttacatatttcacaaaatttttgaataagacgaatggtcaaacatgtgctaaaaagtcaacagtgtcaaacatttcgaaacggagggagtattatctatctctactcctctctcttgtcctaatgataccttgtatccatgtacattgtggagattgctataggaaaaaactatttatgtgggtcctatctatatagatcactttacccatatatattgatgatgcccttagtatttagtaggctagtagcacttcccattcttcctcagttgaagctcaaccgaaatttgatcttttttaaaaaaaaaatgaaaaccaaccgaaagtttggtgactcacgcataggagtacagtccccatatgaacgaacataccatcatcaagacatcaatccatccaatcatatatcgatcaatcaatcacagagcacgagccaacgcaaaaacggcaatcgatccaatgcaaagatccgatcgctccaccatcctggcactgcaccgcgagtaatgtcgcgcgcgcccatggtccatggacaacggccccctcctccctccgagcctgacgcgtggtgctctctctctgctcccacccgcccggtacgcgcgtgtaggggacaccgcgccgcgcgcccgcgcgccccaccgtccccgcctccgcccgccggcaacgcgccgcgcgcccgctcccaccaccgcgcgtacaccgatcgatcaccgatggcgatatgcatgggacgcgcgtgcatgcattgcaccgcgcggcggcagatcgagttttcaatgcgtcgcgcgtccgcgtgactgcgcccgcccgggccgctgcttcatctgttgtactagtacactgtgtgggcgcgcggttgtgatcgacttgtgagcgcgtgccggtgcgctagctgccgtacggcgatggatccatccatccatcgatccgcacccgcccgcgcgcggctcgccgatttctccacgtgtagtatgcacgtagtacgggtacatgcatgaaccggcggagtttgggcaggggcctggttgcgttcatgtgacgaacagacatgcattccgaaggatggatggatcatggattggggcggggcgggcaggtttcttcaatgcgtgcaataactgatcggtgagttatatggtcctctaggaggaatttggattgatcggtcctctgggtttgacaaggagtcaaacagctactagcagcctgctcttataatttcccttctagaagctctattggctttcatcgaggagtacggagacggtgagactgggcctgttggaagataagcccaggactaattttgagagctaagagcatctctaacagtctcttcaaatcccactctccaaatgtctatttagccaactctccatttaatttggcaagtcaaattcgtttttactccaacagcctctccattcatcatctctattctgagtgtatgatagcgggacccatatgtcagtctctatactttttttttctaattatcctgtcccggccgcgcgcgggcaggcggccggcggcggccacggctgcgcgcgggcaggcggcggccgggcgccggctcggttttttttatatataatttgtgtttcactggatgtataattttttagattttgtgattcattgcatcgcatggatctaagatgtataatttgtataatctgtgatgtatttaatttgtgtgtagtttttaggatttgtgatgttgttgatctgtgtgtaggatttgtgatgtatttgacttgtgtgtataagtaacttaatatttgggatgttgatttgggatgtgcatctcattcgattcgggagaaaatacatatattaacactagccattagcaaatcaacaacaaaataataataaaaaaaagatctcgatgaactgtcgcttcccctcaaccgggactaaagatcgatctttagtcccagttattataaccgggactaaagatagcgatctttagtcccagattcgtagtctcggttggaaaaccgggactacaaagagttctaaaccgggagtaaagagcatttctccaccagtgcggggaccgccgccgcgacgacggggtggcggcggtcgggcgcgacgacgacggggcggcggtggtcgggcacggtgacgacggggtggcggttggccgggcagcggccttcgtgcgcggcgacggcgaggcggcggcggccgcgcgcggcgatgacggggcggcggcggtcaggcgcgacgacaacgggcggtggtggttgggtgcgacgacgacggagctggagggagaagagtagcacgggtagaggagggctggagatgggatagccagcctaggaggctggccaatattggccagtgggtgggcttggatggagatgcagttagcttggagagttgaatagagagtctgttggaggagtgtttttggttcatttgccaaatttttagcttggagagctgagtagagaagctgttggagatgctctaatgtttagtcttgaattggtaggataaacactagtctagggtgacatgttcagatctatgg

SEQ ID NO: 44600 - DNA, 897 bp, Oryza sativa
ataagatactgtgggtgtgtttagttcacgtaaaaattgaaagtttgattaaaattggaacaatgtgatggaaaaattgaaagtttgtgtgtgtaggaaagtttcgatgtgatggaaaagttagaagtttgaagaaaaaattgtgaactaaaccagatctgtgttaaaaatagttatattttgatagggaggtagtatagcgtatcagccggatgctgacattcaatacaggatgctgatcaccctagcttataccgattgagagatattgtttgagatttctgtactatacgtacactactcacgtcgtcggtcgagccgagtcaatctctgcttcacgggaaccagctgcctctcttctgtaggagtagctgacaaagcaacggtcacgcggtctactgtccgatcgactgactggctgtccgagaccgagggcatgcaagaggtcagcgccattaatgtgagatagatatatggtcaacgcaccggctccaatcccacgcagccgatcgatcacgttctggtgggtggccaggtagcgttccatcaactggtgtagtaaggcggagtaattgcgtttgggagtacgtttttctacctaccaactgcaaatgggctgcacaactgcaagtggtcgggtgacacggccaggtagagaaggaataagttttctttaggtccctcatctaaacttcgagtataaattacatccttgaagcataatactagatataatgtgtccctcaacttatagaaccggtattcctaagatataacgtgttcctacttgtacaacatctcgtgaatgtacatatgcatgcatatccaccggcggtgccgactgtactccaacacgaacgctacgtgccaagtgtgtttcatacgtcgacctttaca

SEQ ID NO: 44601 - DNA, 6919 bp, Oryza sativa
ccagccgtgcacagctgcggcagatgggatcacacgaacctgcacgaccaactcctcctccacagcctctctctctctctcatcaaatccacgagctttctctctctctctctctctctctctctctctcctcctcctcctctccttctccttcccatcgccaccagcttctccggccgtccgccatcgctgctgaccgcagcatccgcagccacagcttctccgacgccggcgacggccgtttcccccccggaggtgagcgctagctgcttcccgttgttcatccggcctctctgatctgattctgatcttgcgttctttgggttggattcctgattgctgtttgggggaaaaataaataaataaataaggggatcttttctggtttcgtagtgggggcattcttggctttgtattcgaacgcgggagctgcgaaatggcgtggttcttggtgatttggaaacggatttcatttcatttcttttcttttctttcctgttattgatgcgattgatgtttctatttctcgctcgatttcgtctcggtacggctcgaatgatgaccaatcgaaaaagtactgtttctgtgttcccaaaaaaaaagaaattataacgatttttttgctgatcgttcttctgtttacagggccaatgaaaaagctgcatcttctttttctttttttctcctctttaaaatggtttcgtttccgagcagaatacgaatacggaagagtgtgaatcatgagcggaggcgtcgagccggagaccccgccgggtagcagcagcggcggaagcacgccggtgggcggcaagccgccgcgccaccacctcacgtccatccgccactgcgccagcagcgctcgcatcgccgccgcaaccgcagaattcgtaatcatcctcgctacctacctatcgccctgtccagagaatttggctcccaatattgtgtttctgacattttctttcgttgctttgtttgcaggacctgggtgcggggacgctgagcttgatctcgcccacggacattcgccctggcttcctgccggtgttccgttccgggagctgcgccgatatcggtaccaaatcgtacatggaggacgagcatgtgtgcgtcgataacctcatcgagcacctgggagtgcgtacacctgtgatccctgcaccgggtgccttctacggggtgagttggtttgcatttgcatcaaagttttggaggcttgctgttcagtattcagcaatatatgtgctcattatggaccaatgatttattccgttgccagtggtaatattgttgccatgatagtttcttggtgtgctcatttggtcgtacacatcatggtgcaaataattgcatattagtgtggttgatgatgatgtactcgtggtgggaatgattgcatcaggcgaatcagctcattatgagcatttataattcctcttaaattttcttattaggttgtgcaaatgtgcaatagcctttgtgacccccaaaaatgttaactaatcagcatataatttcttttcatggaacactaaaatattatcggtaaacggtagactgtcaagcatagtagagtgggcaagatgttgaattttaatatgctaaactatgcattgtatataaaaggagcatgcatgttgttatttgagattttcagttaactatttttcattctgtacgggagttttcacagcagatgtttaataggttcaactttttgggggtaatttacaggtgtttgatggtcatggtggtacggacgctgcttgttttgttcggaagaacttactgaggttcataattgaggatggtcacttccccagcagcatagagaaggcaatcaggagtgcatttgtgagggctgatcatgcaattgcggattcccattctcttgaccgcaattctgggactacagcattgacagcacttatttttggcaggtaaattctaacgccagtatctcaaatgtttattccagtggtacaatgcactattgagtcattaatcgatgctactttaatgcgaaaagtttctcaagtctgtactgaaattttccattcatgacatcatattgtaatccagtagcctctgctagttagtatccaaaccactagtggcagagaaatgagtattagcatttaaagtcaagctgactcaattatgaggtgtttctgcaacttcaattagttattagatactattttagctgatttgtgaatggaaataattttttatccatcggctatttcacatttttttagagaacaaatcatatattaacccggctttgcaataaagcccaacataacaaggttcgacaattttagctgatttgtgaatggaaataactcctttctcatttttcatccatcggctagttcacttttttttagagaacagatcatatattgacccagctttgcaagaaagctaacataacaaacagaccatatattgacctggctttgcaagaaagccaacataacaaggtttaaaaaaaagcgatatcgcccaccgtggggcttgaacccacaaccacaaggttaagagccttgcgctctaccgactgagctagacgggcttttggctgttacattttctttacagaacataccatatattgacccgactgaactagacgggcttttggttatttcatattttctttagagaacataccatatattgacctgactttgcaagaaagctcaacataacaaggtttaacaaaaaagcaatatcgcccaccgtggggctcgaacccacgaccacaaggttaagagccttgcgctctaccgactgagctagacgggcttttggctgtttcacatttattgcttcattgtccaatatcacaacaaagcgcaaagttctttcctgctccttaataagttggttgtgttgccttagttgcttgacaatctttagatcaattatatcattttgcatattatggtgaatatacctcatttgaatggcaggacattgctcgttgcaaatgcaggagactgtcgagcggtattagggaagagaggccgagctgttgagttgtcaagagaccataaacccagctgcagaagcgaaaagatcagaatcgagaaccttggtggtactgtctttgatggctatctcaatggtcagctgtctgtagcaagggcgattggtgattggcacgtgaaaggttccaaagggtccataagccctctcactgcagagccagagtttcaggaggttagactcaccgaagaagatgagttcttaataatcggctgtgacgggctttgggatgtgatgaccagccagtgcgctgtcacaatggtaaggaaagagctgatgacacacaacgatccggaaagatgctcgcaagagctagttcaagaggctctgcgacggaactcatgcgacaacctaactgtagtggttgtgtgcttctcatcagacccaccacctcagatcgaggtcccaagatttcgagtacgaagaagcatttcgatggaaggattgcatatgttaaagggagctcttgacagtaatgcctgagttctcaaaaccagctttttgtggtaactatggttgaatgatcttgttgttctgttgggtccttgaaagttatgctctgttcttcagctataggttcgcaataagtggtgtataatgagtgcaatattgttgaggtgtaggctaatcattttgtgaggcgatgatttatctgtaccggcgccagcatttggttgttcacaatgtaattgaccaataccagcattcatattctggtacaagtgccagttataatagttgatcagttttgttctacttcagacttcagagttttcactttgtcttgtaaaatctacttcctgctatgcttcctcttgagataccaaagcaaagaaaaaccaccttctatgttcagaaacaacttatctatgggaacatatgcataacagaagatattctgaactttttcatctattagtttcggtttagagaaactcgaatactacagcatttgaaaggctttggttgctgcacttccacttatcattgcattcttctttcaattaaatcctagaggcaatcatgtatgtttttccttgtttgctagcatatataataatacagttcagtaacctgagtacattaacttgcctgaatatttgaccaattgcaatggatttgccttgccaaattattggtgtcaattaactcaatcagcagcttcaagacagaagattctgaaaaaaaaaacaagcgattcctcagaagttgttgggacctgacctgatctgaggaagcttgtgcccggtttcctcgcatcctgccgccattgttggtggagcacatggccatgtgagccttcaaggagcaaccaaaggggtcgccgccccaaccccccgcagacgccggcgaccgcggcggcggagcctgaggtgtgggaggatctctccggcatgccgctcggagccgacctgatctccggccgccggagaggatctgatggggacggaggggagggaggcaaagcggcaaaagaaaaaggactactttgtaaatctcaccataactaacaagggtatttctataaatttatggatcgctatcattcctggcttttttgttgttgtaaaattaatcacagaaaatctacgactagcgactcaaaccagcgaattcctcgcaaattttgaattttccttaccgatcaggctgagttgtaaagagtagttggagaggctattctgtcctttttcatcatgggcatggtttctaaactattaattgatgtatttttatattaaaaaaacatttcatatgcaagtttttctaaaaattaaataaattcattttctaggtttacactggctaatatttaatcaatcatgcgctaatgactctttatacttttcgggtcagaaaaagatctcattccaagcctttctttcaaaagcagcctaaatacactgctgaatcatccctcccctcatccgagaaccgtagttaggttataggtgctgatgctaagatacaggtgctcctgatgctagtttgtattctctgtgtaggttcgtattattaggatgtgtctcatctgatcaaaattgtgttagatttaattgggtaattgatccatttaaatcaattaaatcaaataaattccaaggctcattatgctaggaattcatgtgaattcattcttttataggatatcaatgggatgaagagttttgagaattaatctatttgattagggaattggtaatttatatcaattagtcctaattgatggatggttgatggttgtatagtggaggatggttcatggctagttgatgacaattagttgctctattcctcttcctattccattggtgatggttgtgtagtggaggatggttgatggctaattgatgagaattagttattctattcctcttcctattccatgactcttactctttatcttccattcctcttataaaatgagaatggatttgatctcccgcgaaagaggaagacacactttcatccattttccaatgctgttgctgctacggtaatcccatcccgacgagtgtgtgcacatgcgttgggagagtgggcctccgaaaccacgcgttgctgcgacgtttgcacagacgggcgggcgatcaggtttttgggagcgcaaggcgcgactactcactgttcgtcaacatcaacttcaccttcaccaacatgtcaaacactagagacaaggagaaggagactcccgtcaacaccaacggaggcaatactgcctcaaactccagcagaggaccattgttggggtataaccttattacattatttcaattagaagttttactgttaatgttcatcgcaatgtcaacattgtgttattatgtgattattgatgcttattcaacgttaagcatgctcatgttgattacattcaccactatcactggatcaaatcccattgtaaatatcatgtttattatcttgttattttggattaaaatatgccgaattatgaccaaatttccaacaaattgtttatattttagaatatatgaagtaatcctatatacctataaagttgatccccactaactgcaattactactatttttctgttttgtggtgcatccacgttaccaaaattgtttaccaccgttagattttatttccaaggctgtgattagtctagatatagcttcagtctgcagaccacaatctatcaagtgagtctagcccagcgaggaggcaggccccaaaccaattaactcccatgataattgtgttgtatgcatcgcttaattttctatgttaattactaccaccaataaactaaacagttacatgcatatattcatcaattgcatttcttgactcgacctttcctttcatctaccctttcacctcactatttatatgcctgatctccacaatggcatgtcttagccatcgtataggatcaaaacatattctttgtgataccagtggatgcaatggctgtgatctcttcaaattactgatggttttcttgatgtattatgctgtcaatgccatgctacagtcatttcttcatggtaatttggtttgtggtgtgttcctttcctcggcctacaatttaaattattttttttattttactcataaatattcacgttgctattttctttctttctcatgtgttctttgttgattggtttttgctcaccgtgatctgaagttcttcagtttttctactgcttatatggatattgatcctgttgatattgcttcatggcaatgagcaactaagctccctatacgaccactattttttctatgatattcattcatacagcaatgattctttaagtttattatcgggtattaattaaagtttactgcaattttatagcaggcctatatctttgttagcatcggaatg

SEQ ID NO: 44602 - DNA, 1601 bp, Oryza sativa
ttgtaagttttttaatagttgcaaggtgtatttaaataacaacaatcaagtgtacctggcgcttgaagtatgtataaatttagatagtacaaatgtaggtatacaactgactagatatatgttgtgcctaaagttttcttttatcatataaaagtatcgcagcaacgcgcggggtactcattccaattttcccttaaataaatgatccattcatgccaaaatcgatgtgataaaaaaaatttaactgggccgggctgagatctacaacaaccggacgggccaagagtccatgacaaaatttccacttggaagtggagactcaagcggcccaatacatacattacaccgtctcttccaaatttttctagctacgagtagctgttagctgctatgctgtacgtacgaacattcatggacacgaagctactaggtgtacggtcacaaggacaggtccaagctgacgacgctgctaagcatggccggagtactccgccgcgagcagccaccggcgacgaggctcgtcgtcgacgacggcgacgagatcagccagttgctgctgctgccttcgctgcagcagtatgcgccggcgccgccgctgctccggcaactgagccccgagtccagcgtcagtgacagcgagagctcgtcgccgtcgccgtcacgctcctcctcctctgccgccgccgtcgtacgcctggccttcctcccgtgcctgatcgcgccgttctccggtggtggcgtcgccttgtgctcctgcagaaattgcacttaatttgagtgattgagtctagctaggagaggaagatatgctgcagtgaccaaacgataaacaagagaaacatccgggggttttctggctagctgcataaggtggtgagctagatgacttgaactcgaagcctcaccccttctaattatttaatattaattatttaatattagattattctctaatattcgtgtctttaccaaacgacaaaaaaaaaatgcacacacaaacactttttcagtgatgagctagctatatacttcctccattttaatttataagatgttttgactttagttaaagtcaaactgttttaagtttgtagaaaaaataataacattttcaacccaatttcaacccaagataaatttattatgaaaatatattcaattattgatttgatgaaattaatttagtattatcaatattactatatttgtctataaacttagttaaatttaaaacattttgaactgaaatggagggagtagctgtaaatatacctcgcgagagccacgccttgtcgtcgtcgccatcacgacgaggcccagcagccttggcgggtcgtcgtgtccggcaccgtctgcggcggcaggtggtgcgccgtgcgccatgggcgtgtagtaggagtagtaggcagctgggacagggaggccggaggacacgtccctctcacatattccttggcttctgagaaagcctgtttgggtgctcgcctctgctcgtctcgtctccatctcatttggcctgcattggtgcaaacgaaattatttttcttatagtactattctagtatgaggttacactgcacagtgtttaagatgatatctcg

SEQ ID NO: 44603 - DNA, 9024 bp, Oryza sativa
acctttaactctatcgagaacaatagtgtactgacattggaatgaaatcaagtcaaccacacatggaatgcacagaaaaaaaacctacacattcagctcacgggcacatcgaatcgaaggaatcgactaccttaccttgatttgggctccatcccttgcagtacgtgtccaaccccttcatggaaagaaagagtcgtcgccgctgacgccgtagacgccgtcgtcgccgccgccgaatacgccgccgctgccgccgtagacgccgtcgccaccgccgtcgaagacgccaccgcagccgtcgtagcccgcgccgtctccaccaccgtcgccgccgtagacgttgtcgtcgccgcggccgccgtagatgacgttgccgccgtcgtcgctgctcctgctagggttaggtctaagagaacgagaaaggggataaaatgtgtgctgctcctgctaacccgactccagtcagtatagccggtcaaacgggggcattttggtcattaagaacaaattttagtcacacgtggtcaacaatcgcggatcaggcgtagaacgtggcatgtttccagtatcgtgcgatttgtaatggcatctttacaatttgtcaaatagtaatggcatttttccaaaccttcaaattagtaatggcatgtgtctaattaaccctacaacttttggggattttggactatttgccatcctcttgagtggcatattcttcccaaataactttaatggtttgccatccagatccactgatttgtttttatgttaccacttttcaccatcaacttagcaaattgagtagaaaataaccttattgtccctcccatctctcattttccttcttccttcttgctctcaggcatcaatgatgtggcagagtagtcttgcgcgtcttctacggtggtggcattgctcattctgctgctcccctacaagaggctcaacagcacacacattacacaatttgagcctgacgccacacgccttgtggcgatgatcactctcgccggtggagtggcaccagcgcgcatggacagacagccagagaaaattttgaaacacagcggccattttttgctgaccggatgctcatccccgtccaccacaagtcgagccaaagaagcagagccgactatgaagcgacttgacaagctagatggttggtggtgcattaattgaacatgacgttaattgaagccggtgagcatgatcaccccaaggtagcacatgaacaggacgtcgacgaggctgctttcctacgctgacgtcggcgtcattgtccttttgatggctgtggcggctccattcctcagaggtaatgagcgacgaggtcgaatgccttggaatgagggaattggcaatgcatagaatgccacgagaaagctagtcagctgaacatgcgtgcgttgtgtatggaaggaagaagaaacaagaaggaaaatgatagatatgaggggcagtcaagtcattttctactcaatttgctgagttggtagtaaaaagtggtaaaatagagacaaatcagtggactcggatggtaaaacatcaaagttatttgggaagatggcatttgggaatacgtcattcaagaggatggcaaatagtccaaaatccccaacttttgctgctaaaagtgaaaataaataaatataaatttctgtttttacttatagctgtccaaatggaggattgagatactctgacgtaaaatcaaaggaaccgtgtggtggctgacgtgtggcccaccgctctcggacccacccgtcagtgacgacccaacacggcacgggcctgcaaatggcatgatgcatgcctgtgcctgtgctgtgtcgatgcgtgtgctaaactgctgaggaacaagttcacttttggtcccttaccttgtcgtcgagtcagaaattcgtctctaaaccacaaaacagattcagtgtatcccccaatatacataaaaccaatgcaaacgagattcctcgacagtattattcctagttttcacgttagctaacatgacacctacgtagcttctttaactaggtttttgtcttacatggcattgatgttgacgtttacgagttacgtgtcagtgtgattcaaaataaaaataaaaagagcaaaactgaaaactaaaatattaaaacaaaatatgtgggacccacatgttagtcaaacaagaaaataaaaaatagtgggacctacatgtgggtcccactttctccacctcaccctcgctacctattatagatggctaaatgggccgcccgccacggccgggcctgggccgaagtcagtcaggccgacacggcccgacttatacgccggggcatgccatgccagcccatgggctgcacacacaacccaggcccagtaagactcgggtcgtgttgagctagcccgaaggcacgacagcctatcgtgtttcttcatagaataagtctatttgttcttcctaaacctctgtgggctgtgtccatatggctggaaaataagtctattttgtattcctcttgtcttcggccttgccttatatggttaattaagtctattttacgttcttctactattttttttcgatcgtgccgtgagggctggatcggcccaccatgccgagggagcgacccaagcacagggtggctgtcacccaatcggactgtgccgtgtttgggccaggccaaattggtatgccttggaccgggtcgcgggccctaggccatatgaccatctatactacctatatctctcctctctccgcaaacgagcgcgtagagagggacgagttggggagttcagcgaactgggcggggagggaggctggcgagtggcgaaggaggcctcccacggtctcggctaccaaccacaaatccgcaccaaccatgcctctcctcgcccgcctccgactcctgcttctccatcaccgcggccgcctgctgctccacctcctccagggcccgccgccaccagcctcgtgtgatccacgtccgcgtccacgcagcagcagcagcagcaagaggtcaacatctccgtccaactattttttaattaactacatgtataagtaaattttgagagaaaattctgtggcaataggaacaattttccatttcttataaatatataaattacattaccgaattacatatatatgcaaataaatagagacacgacacacatatatagagcgctctggaacacgtattatttctcctgaaaaccaacacgcttgtgcactgaagtctccaacacataaatcgatcgttctcacacactcacactcctcacatcacaacttttattaattctgcacgaacaagctgacctggaaattaattaatcacgcaagaaccgaacgataaaattaaccatgcatgcaatcaaacagaccatgtgtgggttgatggaatggatgaatttttcagtggtagacaggcggagagctgggagacggcgcagctccgccactgttcccctcggcgccgccatcaccgtttcctgcaccgccaccaccaccgttcgccggcaatggcgtcggcttggggtccggcttgggttcaggtccttggggtttcttgtggaaatagtcgaagaaggggtgcttgtggaagtagtcgtacaggaacgccgacgtgcactccgctggcgacgtggaggagtacatcctcttgccggcgacggccacgaaggtgttagccttatcgacgccgttgtccgttgttgacgacagcggcacgatcttggacggctcctgcccggggcacggcgtgctgctcgccgcgctgtgcagctgcgcgaagcagtcggcggcgccgtggaggtcgtcagcggcgaggggcacgctgaaggcgccgtcgccgtcgaggtcgccgatggccttgctctcgtacacaccgtcgctgttcttgcacttgatcgccacctggagacctgaacatcaccaaaaaattaatcaacgacggtgatatatcgttcgatcgaactgaccacgcaattaattagcgacgaacatatatatcatgatatatatacccttgaaagcatcctgcgccttcatgttcttcctggtgcactcgccgcacttggcctggccgacgacgatcgccgccgcctcgccgtccgcagcggcggtgacagccatcacgagggcggcgaagagtagcgctcgtgctacatctgccattgctgaatcaatcctcaaactctgttgttatttggactatgtggcaagaggctagagagctgtgtgtggatgagtgaagaaaaagcaggccaggaatgtggtttatatagatcgataaaggctactagctgggagtgatctgaggtcagctaattactccatccatctacttttgatagttatattttcatcttggcacacagatcaaggataagtaattctacttatcatccattcaaacatgctactccctccattccaaattgatctacatatagtatttttgaggttatttctaaatgatctacatatttgtgttcattcattaggtttattcgttgcttgtacattggagtaaatggacattgatgcatgcatctatgcacacaagtatttataacccacatgcaatatcttgatttgctattggctaggaaatagtggggatggtgcctgcattgagtttgttgctagagtaaagatagtataagagagttattagtttttcttggtcttggtgtacctatgaaatatgtagatcaatttggaatggagggagtactagtcattcctcgtaaacaaacgatttattaatatttacatttctcgatgcctatgcagccaatcttatatggaagaatggtgagtcacacattaaatccgagaaagttattaagaggataagttattggattgaaatatgcctatcgaaaataaattttttagatttagaaatataactatcaaaagtagatggagggagtatattacattatgattagcaatttgcgccgattttgcaggtttaaaatcattaacgccgtacgtgcattttatttgattagatcagacaccgatagattaagagtagcaaatcatggaggcactgtgaacgtgcacactgcatgcagtgttaactgttgatgctcttgccaccgattggtggtgtttaacaagcaaagttaagctttaatcgactggtactcctacagctagcgcacagtactactagtctgttttataaaaatggagaatagttctataatttaggacagctccaaccaaattgcatgattgatactatttttaagtaaatgcgtaaatttcacaaaactacatatactttattcaaactattgcaaaactattgatttaaggtgttatatcataaaactacaaatttaatgttaagtttatcataaaactacaggtttagtgccaatttaatcacaaaaatgcaacttttatagctcaaacataatggtagtgctaaaaatttgacctccaaattttgtagtttcgtgataactccaatattaaatatatagttatgtcatacttgaccttaattctttaggtttctgataaatttgatgctaaattaatctgtagttttgtgatagttcgatcaacatatctgcgctattaacatatgtttggaacgcagtcatgagtgtataagtgtggtgtctgtatttagtggtgactacatgcatgttgtccgtaaaatggtagagaatatacttgttgatagtatatatccgataacagtgtttgttttaaagtatagaagacgttggtatcaaagtatacgcgagattttggtaaagtagacgagagacaaggatttttatattgattcaggccccggtgtgggtactagccataatccaatttatatgaacatctctaggatgtatcaaactgattacaataggagagcgagctagctaatatagcttaccaactagcattcaccgagaataaatccgacgacttagaatcattggctagctattgacttcctcttgattgatattcgatgtgacttgtggctatggcttatgattcgatgctcttctctcctaggggctatatatttatgcggacaatcaatttcttgttaagttgaattcgaggagttaatatgggatacgagcaggtaagagtcttgtcggatcctgtagtcaatggcacacgagcataacccaagagtcttagcgatgagattgccaaatctttcaaaaacgctttcggcatagatacttagggttaaaaagcatatatatcaaaaactctattctgaccactatgataatgttccatatcatcaagggtttagattgcctcaatgtgtaagttcattggagaagatggccagtctactatagaggatattgaccaatttattattcaatgcgaagaagctagtgctagtattttgaaacttagccttttcgcattgtctttatttggtgatgcatttacttggtttatttcacttgcaccactctattcatgattggtctaagttagaataaaaatttcgtgattacttctttagtggtgagaccgaattaaatttgtcatacttaacattggttaaacaaaagtataatgagcctgcttttgaatacattagaagatttagatatacaagaaacagatgttatagtttaacactttctgataaggacttagtagattctggctaattctggttaacttgccatatctatgctagaagtccatgagacttcctacaaatactcctaagacgccacgtgtcactcatacaaacactcctagacaactacatggcattatctaatctcacagtcgattttcagttaaattggtggacctggtattttggaccattagattagatctactatttaataaaaataccttcctatgctgtgggccaaaaaaaaaaagaacgtacatagatacatataactttgtataactgtggtatacacttaataaacaatgaagtatcacatggaaaaaagaaactcgtgtacgaacttaattacgataaaagcggtaaaatagaaaaaaatacgtacatggtgccattgaaagaaaacgatggtattaaaaataggattttatattatactatttaaaatatcactctatatttttgcgcaaacatacacaattaaaatatattttctacaaaataaatacaaaatattctttcaacactctttaaacgttctatctttaaaatttaaaaattatataccaaaagttcatcgagctacaattgctaacaaggtatttgtgcatcatatcgaatatctaagatatgatgaacatgtgtaccattagacgcataatacagataaaagacattttataagggacatttgctcatttaacccctttggaaagcttaactatcaatttgatccttttttaaaaaaagtttgctcatttgtccatgtttttcaaaatcgaagttgtcgtctgaccctactttcactacatcgtgagtttttcatttaaaaaaaaaagaaaaacatgtatttacaagcccaaatgactaaaatgacactgaatacattaaccttatcctcaaccactcatttgctcattctttatcccgctctctctcctctctctgtccaaagcgcgatgggcaggaggagcggtggcggccacatggcagcagctgtggagggccctcggctgcttcgcggagggtaggagcgatggcaaagaggcaacattgagtcgccgacaaggaggaccgctggcggtggtggaagaggcggtgacaactcggcagaggggaagcagcagctccatgaagggtaggagggtggcgtcggctcagcgacgaggaggattgccggcggtggcgaatggaggcggcggctgcggaggggtggcggcaaccacggatatggtaggaggagaggaggaagagggatggtgtcggctcgatgacgaggaggataggcggtgatggtggaggggcggcggcacggtgacaaggaggaccactggcgcccacgcacatcttcgccattagcttgctacttgcattttcttccgcacaaaattgggcctaactttggaaaaataaggtcaaataagtatgggtggaagtggtatttggggcttttgttaacaccgattaatgctcttaagagaagagggtcagagtgtagcttcggttttgaaaagaagggtcaaatgagcaaagtgaccaaaacagggtcaaatcggtagttagacattcaaatagggtcaaatgtgcaattgctccattttataatatagattatatcattttgtttcattttataaacatacatagccaaagacacgtgtgatttactttaatctatctaaaaaaatgtctacggtaataagaatcatagaaatttaaaagacagaaaaactcaagagcatatatcctaataataccctaaaagtaaataaaaattatcaatggctaatccctatgatatataaaattataaagtattatttcatcggtttattaaacgccctaaagaaccctcctagagcatctattaaagcctttaacaaataagaggaaactttaaatttcttctgtaacagataaagcatctaaaacttaatcctcgttaatttaatgctcccattaattttagccattgggttatttcaatgggtatgtgtatacatacattatttaataaaaaaacattcatccaaacatgttgtctaacataaaattatttgagatgtcaggtgaggttgtattgcatggtttagagggttgttgtcaggatgactagcgttgagttttactaggttgccagccatccaatgcatcacaaaaagagcccataggaggtattgtgttttgttgatcgagcgaccatcaagagaaggcaacaagggaaccccagtacaaatattttttatgagtaaatcttctcttaactcaagtatctatgtaatattatttaagtcgcattagcttgaagcatgcataatttgataacatgatatatctagaaggctacatgttagaacattcaattaacccatcttagaaa

SEQ ID NO: 44604 - DNA, 778 bp, Oryza sativa
taaagctcttttgaactgcttcaatttcgggaaatattttttaacaatttgaatttctcccgatgagatttttatatgtatagtgggtactgctggattttcccccgaaactgagatgaacacaaactagaactagagttctacttattacatagaagcgtagctcacgatataagagatcatgacaacggcgacaacatattgaattgagccggcatttaattatacatagccaaagtacatactactagtatgcatacgtatatttatactctatactctatactatctaccatttcatcactgccagtgagatttaattcgctggtaaattaactaaacaaaatgtagcttactgtagcactcctacgctatacgtacgtttgacattaactcttttcgtggcacatcttaactccatggatcatcatatcgatcgagctgtaaataaatagataaaataaataatcagtgctgaattattaacatccagtaatgcaattatatatgcaatgatcgcctatataagcagttcattggacgcccttgctcttcacctgcaaacagtgcaactactattgagagccacacacaactgtagcttcgccatgggagcaagctggctgctcctccatggcgcggcgctgatgatactgatggcggcggcggccgccggtgagacgacggcgacggcgtcggtcgtcgtcggcgcggccaagtgcgccggctgcggcaggaagaacatggacgccgagaccgctttcaagggtaagtgatg

SEQ ID NO: 44605 - DNA, 8680 bp, Oryza sativa
ataaaccaacgttcgttcaccctggcaggtgggtgttcgttgggcgcaagttgcacataacgtgctaagatgtggtgttgtgattctacgtcaacatgaaaaatcttaaaaatatataaagagattacattacgtagaacacataccgcattacatatgcgaataaatagagacaacgacacacacaggagcactctgaaacgcgcattatttttcacctgaaaggcaatgcttatgcactgactccaagtctccaacacatatatcgaccgatcgatctcacacacagtcacactcctctcacatctcacaacttttatttattcttcacgaacaagctgacctgcaaattaattaatcacgcaaccaagtgtggattgatggaatggatgatcgatcgattcagtggtagaccggcggagagctgggagacggcgcagctccgccactgttcccctgggcgccgccaccaccgtttcccgcaccgccaccaccaccgttcgccggcaatggcgttggcttgggatccggcttgggttcggggccttggggtttcttgtggaaatagtcgaagaaggggtgcttgtggaagtagtcgtacaggaacgccgacgtgcactccgctggcgacgtggaggagtacatcctcttgccggcgacggccacgaaggtgttagccttatcgacgccgttgtccgttgttgacgacagcggcacgatcttggacggctcctgcccggggcacggcgtgctgctcgtcgcgctgtgcagctgcgcgaagcagtcggcggcgccgtggaggtcgtcggcggcgaggggcacgctgaaggcgccgtcgccgtcgaggtcgccgacggcctagctctcgtactcgccgtcgccgttcctgcacttgatcgccacctggagacctgaacatcaccaaacaattaatcaacgacggtgatatatcgatcgatcgagctgagtacgcaattaattagcgatgaacatattatcatcatcatcatgatatatatacccttgaaagcatcctgccccttcatgttcttgctggagcagtcgccgcacttggccaacccgacgacgatcgccgccgcctcgccgtccgcagcggcggtgacagccatcacgagggcagtgcagacgatggcggcgaagagtagtgctcgtgctacagctgccattgctgataaatcctcgcaaactctatgtagcaagaggctagagctgtgtgtggatgagtgaagaaaaagcaggctatgcatgtggtttatatagatcgataaaggctactagctgggagtgatctgaggtcagctaattatattacaacatgattagcaatttgcgccgaatttgcaggtttaaaatcattaacgccgtgcattttatttgatttgatcagacaccgatcgattaagagtagcagctagtagttcatggaggcactgtgaacattcacactgcatgcagtgctgactgttgatgcacttgccgccgattggtggtgtttaacaaggaaagttaagctttaatcgactggtactcctacagcgcacagtactactagcctgttttataaaaagggagaatagttctatagtataggacagctccaaccaaattgcatgattgatactatttttcagtaaatgagtaaatttcacaaaaactacagatactttgatcaaactattgcaaaactactgatttaaggtgttatatcataaaaactacagatttagtgttaagtttatcacaaaactacagatttaatttgaaatatatggtcacaaagctatagattaagtaacaaaattatcataaaactacaagtttagtgccaatttaatcacaaaactacaacatttatagctcaaacataatggtggtgctatagatttgacctcaaaattttgtagttttgtgataacttcaatgttaaatatataattaattacgtgatacttgaccttaaatatgtaggtttctgataaatttgatgctaaatctgtggttttgtgatagttcgatcaacatatccgccttataaacatatgattggaacacagtcgtgagtgtataagtgcggtgtatgtatttagtggtgactacgtgcatcttgtctgtataatggtagagaatatacttgttgacggtatataatagtttttttaaagtatagaagatgttggtatcaaagtatacgcgagattgccgtaaagtaaacgagagacagagatttttatattgattcaggccccgatgtgggtaatagccataatccagtttatatgaatatctctagaatgtatcaaactgattacaatgggggagcaagctagctaatctagcctaccaacaagcattcaccaagaattaatccaacgacttagaatcatcggctagctattgacttcctcctgattgatattcgatgtgacttgtggctatggcttatgattcgatgctctttgatctctcctaggggctatatatttatacggacaatcaatttcttgttaagtagaattcgaggagttcatatgggatacgagcaggtaagagttttgccagatcctgtagtcagcggtacacgagcataacccaagagtcttagcgatgagattgccgaagctttcaaaaacacttttggcatagatactagggttaaaaagcgtatagatcaaaaactctaccctgaccactattataatgctccatatcctcaagggtttagactgcctcattgtgtaagttcactggagaacatggctgatctactttagaggatatcgaccaatttatttgtcgggtcccaaaattaaaaacttggatccggctgagattaatgtatcaacccctggatcagtaaatattgatacataatatgcaactggttcttcattgcatacgttaaattttacaatactaaggttttacaagaataggtactcacataagtaagactattacatagaggttttatacattctgactagggaggtataacctctagggattttctatgttattggagtcatcgtagtaataatcataggagtcttcttcttgacccaaatctgaaaaaggggttataagagcaagggtgagtattcacaatacccggcaagttaccatggaaacatgttatgtgttggtatagagtagagttctttgcaaaagacaataataaacaatctggaagtattaaagcaagagtttgtaaatacatagactttaggtttctaaccagagtactatatgggtctcggtactcaattccatgagtacggccattcgaatagtttcatgaatattctactacagtagatgtacgctttactcgcagtccacgacttgccaatattcattagcttagtcatgacccagtattaggttattaacaattgtggtacctgttccatgaactctagtcctcatgcgctctgaacgtaacgttatcagcagcgagaggagttctggtgttcccggggtatttaagggggatctcgtatgacaccacgtcatctcgatcagggtttagaattataacataataatttatactcgagtatcatcgaccatttacttgtacatggtaatggtaaaaattgcccttcgtggctatagttgcctcttgctcgaggacttaaaaataagaaccacgatacagaggtaccacattgctaattaatataatgactaggtatgtccctattctagaaactatggtcgtacctgttcgttcgacataagtacctggtaataactatatcgatcgagacagtactagccacccgaaaatcatccaattcctacgtactgtcccaatctaagtatgaaatatttagaccagattgtaagcaaaataagcaatactaaattgtttgggtttctatggttgaattatgcatataaaatagagtattgaatagaaggctataaataaataatttgtaaaatataggcttaaatgatcaaaaggtagaatagtaacttgccttgctcgatgtcctgagattgactgatattatctaatatgtcagaggactcttcaagacctagggttaaacatataaaattcaaattcaaaaggaattcaaataaaatccaaaaataggaaaaataaaataaaatagaaaaatagcaaaagtagactcaaaagatagagaatgattttagaagaattttggtccaagtttcactggaattggatctatattttaaaagatatgagcttctaaagtttgaaaatcaaattaaatgtgaaatgatactgtgtgcgggtcccacctgtcagtctctttctctcttctcttcttcaacctctagccgttccccatttacggccggcggtgctagggttagcgatttcggcggtgatagagggggaaagggggttgcggccgaggaggggaggtagctagggttctccggcgacggcgagtggcggcggaggggttaatttgatgtgtgggtgggctaacggctagggcggcggtgacatggataggccgtgaaggtgatcggggtggtgagagttaggcatagcacggggagggttcctagagcatctacggggtacttagaaggatttaggtagcttgccgactttcggcaaggtgtggaagaacttgccgacgagcacctccattggcgacggacgagctcatgtcggcagcccagaaggtggcatggtaatgctggccgattgcgaatatggaatctagggagtacgtagatggttaaaatgaaagaactcaccgagataggctgagacgacggattgcggccggaaaaacttctcggcggtgagaaccagagcagagcaggggcgacagtgcttagctcggtgcgacgaggtgaaactcgacgcaaagcttcggttaggctccaatatgctagagcatggttgatattaggtgttctaaggattagttaggatggagagtggatggaggggcgtgaagtcaatcgcacacaaggtgttcgaccgacgggcggaagtggttgatggtatggtttggcaaagcagagcttcagggttgtggggttatggttgatgatgatcgatgatggacaaggaagggattggggtcctatttatagggccagaagaagtggatgagctcgggcgccatcaacgccattgatgagcttggaaattgagcacggcaggggtggcagggagctgtgagagggagggcaagatcaatttgagtggcgggaggccacgttcgaattcttactgacgaaggcttgacttgaccatgggtgaaaacgtctggcgacgtgttggcgccaatccgggctcgacgcgcggcagcggcgagggttaaaacggtcagcatggcggtggtcggtttgaattgtgataggggaaaccaccgcttatcttcaatccaacagtgcggcaagaattggcgcgattcaccccgggtagaagcgaattcggacttggcggcggctttggacgggcgtgcacagcgtcgagcggcggtaacttgcggcggaggtcatcctggcttcgtcttcatcacgattggtgcggtggcggtggtcttagggcgtcgaacgactagcggcgcgccaaggcggtcgggcacacgcgaacggccctgaagccgacgcgcggcggctcggcgtgcggcgatggaggatgccagggtggcgcaagtaaagggggtggaaaaggcaaagtgaaccacagttttggatgggttgtggtccccaaggatcaaacttagactttgcaaaggtttgggtagatgttgggctgagatagttgggctgggcatttcatcgaacaccttgagggcaatgaatagtgttttcagaaattttgaatatttttcctagaaaagaatgaatttaatctataagtttgaaagggtttcactagggtttagagtatagaaaattctcactaatgaaagggggtaaactaaagaaatatactaaagttcgaaatttgtgagaatttgctaaaattcactaagttttaggataaagggaataattagggtaagttaaaagagttctaaaggaataatacttgaaccaataaaaggattcaaataaaattttaaattgtactaatctagtcaaaaaccagcatgatgcagtcaaattttagtttaaaatttgaggatgttacattattatacaatgcgaagaagcctagctagtagtattttgaaacttaggcttttcccattgtctttatttggtgatgcatttacttgggtttatttcacttgcaccaactctattcatgattggtctgagttagaacaaaaatatcatgattacttctttaattagtggtgagtccgaattaaatttgtcgtacttaatatcggttaaaaaaagtataatgagcctacttttgatctacattagaagattttatatatacaagaaaccgatgttatagtttaacactttctgataaggtcttggtagatttgccttattctggtttacttgaatatttaaaagaaaagctagatggtcatactttcttagatgtaagccaattacttcaaatggctttgactcaagagagccaagttaaagaggccaaaatctcatagaaatttatgtctgattgttcccatgttaatatagtttatgaacaagaatctttgaacaatgagacagttgatgtatacatagacgaatgggtttggaactccaactctaaaccattcgtttgctccgttcttaagctggttagtcgtaagaatcgacaagaggaaataacgttcacttttgatgtggccaaatgcaattagaaacaaaggtagctcatccacctgcattaccttttcctatacagactgctgaattgcaagagaaggagattcccgatggcaaggagaagaccacattgaagacttcaatacttagggggcaaggtgacaatctggagatatcaaaatatgacaagcaaccaaggagatcaagttcatctaccaagcgagtatgcaccaccggcaactaacttctccttcttcatggtattacacttggagaccacattgaagacttcaatacttaggaggcaagatgacaatctggagatatcaaaatatgacaagcaaccaaggagatcaagttcatctaccaagtgagtatgcaccaccggcaacttacttctccttcttcatggtattacgcttggtttgcattatggagttttaatggtatgtggatgatgcctatttatataccatattatcatccattatgggcattgccggttgccacattgaccgattttaaataatcaaccacactcatctcatagccggttgagagaaaataatcagtcacaaaagaatccacacaagaaagtggcgaggcaagagtggaggctaaagaaaaacaaaatacaatctgaacaagaggggcctctcgtagctttcttacatcaccattaaacatttaagccttagaggcattcatggccggtattggtggatatcgcccttagatgatctcatgcatagtattttttggctcacaagtttgccgaaaagacaggggggcatgtgttgataatcaaatttggcagtagagtcgagttatagcaagtttgagccaaatttataaaatgccagagctttcccgcgaagactggtgtgaccgttattatgtggccggtcaaaccggacaatgcactgtgattagaccataggtatccaggcggttagaccttaatcacatagtccgagtccaatttaatttagatacttctcgtgttttcttgttttacaccaaaatttttgagtcctagttgatttatatgcctaattgcatatgaaaaaaccccaggaagcaagtccacccctcctataaatataagggggccaaggacggggggccctaatgggcgatcgatcgccaggcgatcgcctgggcgatcggatccagcccccctccccctatactccctcctctcccctattcctcctccccttctcctctttatactacagtagactacacaaatttttttgaaaaataaaagttagaaaaatttatgtatagaaatactatatataaaaaatttgaattcaaattcaaatttgaatcgagtatgtaaacttttgacttataaactttgggtctataaactttaggtgtataaactttagatgtatagaaatactatatatagaaaatatttgaattcaaattcaaatttgaataagatataattcaaattcaaatttgaatcgggtatataaactttaggtctataaacttactttaggtctaaagtttaaactttaggtgtataaactttagatgtatagaaatactatatatgaaaaatatttgaattcaaattcaaatttgaatcggatatttgaattcaaattcaaatttgaaacgggtatataaacttttgacttataaactttaggtctataaactttaggtgtataaactttagatgtatagaaatactatatatatataaatatttgaattcaaattcaaatttgaataggatgtataaacttttgacttataaatttttggtctctaaactttagatgtgtaaactttaggtgtataaatttactaaaataggaaagtaatgcggtgccaacaaaggaaacaaggtggagagatggagggaaggagggggggggggcgcaaa

SEQ ID NO: 44606 - DNA, 11644 bp, Oryza sativa
  unsure (1)..(11644): unsure at all n locations
tatggtcacaaagctatagattaagtaacaaaattattacaaaactacatgtttatagtgccaatttaatcacttcctcctgattgatattcgatgtgacttgtggctatggcttatgattcgatgctcttctctcctaggggctatatatttatatggacaatcaattttttgttaagtagaatttgaggagttcatatgggatatgaacaagtaagagtcttgtcagatcctgtagtcaatggcacatgagcataacccaagagtcttagcgatgagattgccgaagctttcaaaaatgctttcggcatagatactagggttaaaaggcgtatatatcaaaaactctatactggccactacgataatgttcaatatcctcaagggttttgattgcctcattgtgtaagttcactggagaacatggccggtctactttagaggatatcgaccagtttattattcaatgcgaagaagctagtgctagtagtattttgaaacttaggctttttcccattgtctttatttggtgatgcgcgcaattttttgggtttatttcacttgcaccaactgtattcatgattggtctgagttagaacaaaaatatcatgattacttctttaattagtggtgagaccgaattaaacttgtcgtacttaacctcggttaaacaaaagtataacgagcctacttttgaatacattagaagatttatatatataagaaactgatgttatagtttaacactgtctgataaggtcttggtagatttggcttatgctggtttacttgaatatttaaaagaaaagctagatggtcatactttcttagatgtaagccaattacttcaaaaggctttaactcaagagagccgagttaaagaggccaaaatctcgcaaaaagttaagtctgattgtgcccatgttaatatagttgatcaacaagaatctttgaacaaagagacagttgatgtatacatacacaaatgggttttgaactccaactctaaaccatccgtttgctccgctcttaagctggttagtcgtaagaatcagcaagaggaaataaagttcacgtttgatgtggccaaatgcaataggatttttgaataattactagtaaaagaagaaaattaaattgtcacatggccacgccataccttcacttgaagaatagagcggcgagcatattataagtgtcacaactccaattctcatgccacaaatgattgcaatgtattccatagacaagttcaatcggcaattgacgaatgacgattgacttttacaaagatgcaggtggatgagctaccttttcctatacagaccgttgaattgcaagagaaggagattcccgatggcaaggagaagaccacattgaagacttcaatactgtcggtgaaatgggcccgggggtacgcacagtagagggaagtatccttcccatctagtcgcgtggctacgtggcctcgcctccccccgcccctcgggtagcgctgaggtggccagagggacctcggggtgccacgtcgcactcctcgggctttcggggcgtgctaccccgaggccctcgcctgaccacctcgtggcggggagagcgggcggggcgaaagacactgctccgcgccttcaatgcgcggtgcaccaaccgccccaagcagcatttaatgcggcgtggagggatgtgcggcgccgctcgattgacccatgtgttggtatttcttacgtccacagataaatccgcaagcgcacggaatactgttgtagcacttcaccttcgggtgaccccaaaaagatatcgaactcagggaacgtgtgtaatttacctaaggctaagacgatccaatgacaacaactatagataggctaggcaagctagagaggactttctatgtgttttaattatctaagctaagttgaaggtaatttcctatttgttgcttcgggcaccgacccctgctggtctgccagcgtggttccggctatagctctatgatgtatccgaacgtggagaattattaggacgggattcagggctgttaccacttgtcgcctacctctgacaaatccgtgggatacacaacaaacaaaggtaatctctaacctagacaccacgtctaagttattaattactactctaatacttgtacatgaacttccttctttatccagagtcctagtactagagcacttagtatgaatactagataaagaacccgcaaagatgaaaatctatcttacttagacaaagtaattaaataatataagaaaggaacacgaatgcttactttatagaagaggttctccgaacccagagcagagtgtaccgacagctccggtactccccccgaattcctcctaggaagctacactcgtcgagatagaagtcggatgagcgccaaacttccgggcactcctccagagcttcccctcactctctaccttattataatgtacaaaagatacaatagagcctcttataattcagctcaaaattgtgtgtcttggaaatgagaatgtgacctccttatataggctccaaatgacggttaggggtatgggaaatgaccaaaacaccctgcaactgccttaggggagaaatccgagccgtccaggtgaaagcagatgatgggaagcgccaggattggtttgtccgaactggtgggttcggccaaacccaaaaactctcctcccggcctctccttcagccgggaggttgcttattgggcccccaacaacctgggctatgttttggcccaattctaaatggtttttattgacttattgggcctctaatccgtgtaaacgcgtcctgaatgcgcggaggtgcattttgtcacatgacggatgtgttttctcctcaaattacttgcatacacatatttcaccaatactagtggaaatgattagtaataatacctaccactaagttggataccatgttttatttcattatatgcaggtattgacggtccgatattatgatttaaggaccgtcaacaccatatcaatcgagcttgaccggcctgtgaccggtcacaggcgacgggacgggggcagtgcccccacgttccgccctgtgtcaggcggagtgggggcaggtatgccctgtcccatcggcacgcttccaggggcgccccacgcgcgtggtgagccgccgaagtcttcatacaataatagggaatgacagggatgtcccccgtgtcaggcgggggcggcgctgggccccacctggagccaggcgaccatgttgcttccagttgaagcaaaggatagcggtatgattagggccatgtgccccccctccgatggaggggtaggtgcaaacagtgcatgtggtatccccttggactataaaaggaggacctcgcccaccgagaaaggggacgactctcagagaacttgagctcggaggaagaacagctaggtttcccttagagctcaaaacctcatgtaaaaattcaccataatcccatacacaagagtagggtattacactcaataacggcccgaacctgtataatccttgatctcccacacagccacgagagcgatctagcgattagaccgcaagcggaagtaggcccttgatcatcgtgccatttcccccggccgaactcacaaaggggggggtctcacgaccacctgctagagaggatcattcctcgacaaatacttaggaggcaagacgacaatctggagatatcaaaatatggcaagcgaccaaggagatcaagttcatctaccaagcgagtatgcaccaccggcaacttacttctccttttccatggtattacgcttggtataaatgtattatagatttttaatggtatgtggatgatgcctttttatataccatattattatccattatgggcattgccagtttccacattgacccattttaaataatcaaccacactcatctcatagccggttgagagaaaagaatcagtcacaaaagaatccacacaagaaagtggtgaggcaagagtggaggccaaagaaaaacaaaatacaatctgaacaagagaggcctctcgtagctttcttacatcaccattaaacatttaagccttagaggaattcatggtcggtattggtggatatcgcccttagatgatctcatgcatagtatttttttggctcataagtttgccaaaaagacagggggggcatgtgttgataatcaaatttggtagtagggtcgagttatagcaagtttgagccaaatttaaaaaatgccagagctttcccgcgaaggctggtctaaccgtcattatgtggccggtcaaagcagacaatgcactgagattagaccattggtatccaggcggttagatcttaatcacatagtccaagtccaatttagatatttctcgtgttttcttgttttagaccgaaattttcaagtcttagttgatttatatgcctaaatgcatatggaaaaaccccaggaagcaagtccaccccttttataaatataagggggccaaggatgattgaaacaacaagcaatcaatcatgcatcaaaatcaatttatttatccaaaccctctatattctacatctctctccttcttgctacctatccaaattctaaatcctcaaatcctcgattacttgtcatctctcgtctctacggtattagaggacgtcctagttggcctgctgagcctagaacaaaccgacgcacgttcatcctgatggggtccttcgcgggtggtcgttgggcggcatctacccactccctatgatggcgcgtctccgagtgctgccgcgagttacacataacgtgctcaaggtgtggcattgcgattctacgtcaacatgaacaatcttataaatatttaaattacattatgtagaacacatgtcgcattacatgtgcgaataaatacagacacgacacacataagcactctgaaattatttatcacctgaaagccaatgcttatgcactgactccaagtctccaacacatacatcgatctgtaaaatcaaaggtgtttttgataattattctgtgatgaacaattgagcattagagattattggttttgttatttggaatttattcacgaagtggtttggagatgattggatttcacaggtgaatctacaggttatcattttatgtggaccggtcagaccgggcaggtgttgccggtcagaccagcggtgatcaagcggtcggaccggccagcccgcggtctgaccggccgacactgtgtcggtttcggtttcgggttgtttatttggatatccgagtttatttcatgattatgacttctagatggatattatacgtatgtaatactattgtttactgctaatgagtcaagttggagatagcttggtctcggaatatggtttctttgtctattccatgtgtaggtgactcgatgtctcgggagagtatttacggtgatggaccgggagttggcttggggataagacgacgtccgttgtggtcagagatcatgcgggatactaaggctagagttgatgcacgtggttgatggagattccatatggcatacgatggagttattgtgtgcgtatgggatgcggagtcgaaattggaaggagtccaaatttggtacgattggttatgtaaagtttctttcttgtactagagggtttcctaaggtgtttaggactcctagtatgagtttggttcgtggctttaggctgcctacctcatgtataaatagagggggagcgtgaggcttcccggtatcgctttagagagcaatagaattgagttttgagttagggtttcgagtttagtcgaaatttttgtaaggagtgttgttggtgcactttgtaaacatagagagaattaataaagtcgtcattcactttaagagttcttcgatttgtgtttcaccgggtttcggcggtctaaccgacaactcaccggtggtcagaccagcggcattgcggcggtcagaccggcgggagcacggcggtcagaccgacggcggcgacagtaggcggcaggcgatcacggcggttagaccggtagatcaacaccggtcagaccgggggctacgcttcggtcagaccggctaatctacttcggtcagaccgatctccatcgatttcgagggtaacttttatttccgctaaaagttttcggtttttgggtataccaaccattcaccccctctggttggcttagttcttgtgattcgatcctacacgatcgatcgatctcacacagtcacactcctctcacatctcacaacttatatttattcttcacgaacaagctgacctgcaaattaattaatcacgcaaccaagtgtggattgatggaatggatgatcgatcgattcagtggtagaccggcggagagctgggagacggcgcagctccgccactgttcccctgggcgccgccaccaccgtttcccgcaccgccaccaccaccgttcgccggcaatggcgttggcttgggatccggcttgggttcggggccttggggtttcttgtggaaatagtcgaagaaggggtgcttgtggaagtagtcgtacaggaacgccgacgtgcactccgccggcgatgtggaggagtgcatcctcttgccagcgacgacgacgaaggtgttagccttgtcgccgccgttgtccgttgttgacgacagcggtacgatcttggacggctcctgcccggggcacggcgtgctgctcgtcgcgctgtgcagctgcgcgaagcagtcggcggcgccgtggaggtcgtcggcggcgaggggcacgctgaaggcgccgtcgccgtcgaggtcgccgacggccttgctctcgtactcgccatcgctgttcttgcacttgatcgccacctggagacctgaacatcaccaaacaattaatcaaggacggtgatatatcgatcgcaattaatcaatgatgaacatatcatcatcatcatcatcatcatgatatatatatacccttgaaagcatcctgcgccatcatgttcttcctggtgcactcgccgcacttggcctgaccgacgacgaccgccgccacctcgccgtccgcagcagcggcaactgccatcacggcggcgcagacgacggcggcgaagagtagtagtgttcgtgctacatgttgaaattgtatcttcagctgtggccccatcgtgatccattttgcagttgcaacggtgtggagaataagtcgccagcaggttgttagcaggcgcgggtgatgcggcgatctgggagttgaagaccgtgtcgtgtgcgtgagtttagcgcaggggagtgtgtgtgtagcgagtcagagaattgcggatcgtgggatggcacgatttttgcctcggattcgttctgttatgtatggagtataaatagtttatttagctcagttttacagttgtaagtttattattcagttgaatgaaaaacaaccagaaaattccccaaagattgtgcgatctagttcagagttctgaaacttctctgttcttcactctgctctgaatttctcctctcagttccttgtcactgttgctgtgttgtgccgtgccggacgcgtgcagtctgcgcgcaaggtgttcgatcagggaaatcttcgccaacacnnnnnnnnnnnnnnnnnnnncaatcctagcaattagcaaactctattgcccctcctccttactatgtgtggatgagtgaagaagaagcagaggccatgcatggtttatataggcgccagcatgcatagcatcatgtagatcgataaaggctacctgggagtgagctgagatcagctaattatattacatcatgattagaaatttgcgccgaatttgcaggttcaaaattaatgccgtaagtttgattttatcaggcagtaccgatcgattaagagtagtgcactgtgaacgtgcacactgcatgcaggttcacccttgatgctcttgcttccaattggtggtgttaaacaagcaaaagttatgctttaatcgagtagtactcctacagtacacagtgctactagtccgttttattaaaaaggaggatagttctatactataggacagcttcaaccaaattgcattattgatactattgtgctttcttattactgtcttggttaatttggctcttggataattacctgtttaaatttatcagcatatactgcctactagtatttgcagaaatcgaagccagcataagtttaagtaaaatgttattgtgtcttcgtctattttaataacgtagtgtacgtgagtatatgagtgtggtgtcaccgactacacgtgcatcttgtctatgtaatggaaaaagaaaatctctttgcttccttaggctgaatccaccatggcagtccagcgcatattctagatgccaacctgtatgcatgacccgacatgagcatatgtcaactaggcctttttctttacctcttcacccaccttgcgtctctgcaacacacaacgccacgggctgagataaagacgagaatgctccagccagacgctagatctagcccaaaaaatgggtagcccatgtccaagccaccccatgaactcctccatgaactcttttgtacacaatgctatctttttatctgaattttaggtagtttcaaattgtatttctatatggactatttcttgtagttttaatttttattccgacttttagattgaattatatttatacatataattttatttcaatatttattttaaatttttaatccgaatttcatatttttcagcctaaaaggtatttctacgttgactcttgtcttaatttaatttttaaatacgaatttaagttttcttttcaaaattgcatttctacatgtacttcttttatccttttattattattccgaattacagatatttttaatctatacacttggactctatttttttcttttttattaatatgggaaattctaggtcatgagagtgaatatggtggcttttatattgttttattgagttaataatagatcgacagttacaggtgttcctttttctgttacttcatgaatatttcaataactagatgaaactctgcgcattactgcggaaatttagtatgataacaataaaaaaaataacgtgtaagataactagataacatcagattaagtaaattaatgtggtttacgataatttaaatttaaatagtatgtagaatggtgattcaaacgtaaaaagtaaggtggtatgactttatggaagaagaaaagtagggagatagtttgtaccgtagattaatcatctaaaggctaaaaacaattgatgtgatatgacttaattagaggaaaaaaagagaaagataatttgaaccatagattaatcatttaagcactaactaagtgaggatgaactatataagtatataggatatcataaaacataataaagatatacattgaaacatgatgtgaattcacataattatgttagattataatttaacatgtttgtatttgaaaagctcttaaattataaaaactataaagatatagcatgtttgcatgatgtttaaatgtgatgattgttagtgaatgatgatgtggtatcttgttaattagtggatgatgatgtggcatcttgttagtggatgatgatgtggcatctttgcatgttaagcttaagaagttagtgggggataactttatagtaagataggatatatttgacatttacagctagctctttttttcttttacttaatttaattttttttatagtaagataggatatatttgacatttacagctagctctttttttcttttacttaatttaatttaatctaataatatatttacatgttacagctaactggacaaaaaaaataagggctaaaaaggaatcgaagtctggacctatagagtgtcctcgctagtggaaaccactgcactagaacagcatattgttatttttagtgcaggatgctaaacaaatatttgggtgttagcgtaaacctcatcagcacaaaatcatttatttgtccccaaaacaactcacctaaaagaaatacttagcttcttcatagcacagcaatattttgtatatagtacaaacaactgaacaaataagtccatttgaacacacgacgaaaaaattcattgagaaaatagttagagaaatatatcaaggcagataacaaaattagtgataaaaaatacttcaaaagtgtatgaacatatcacacgatcgaaataacagacaaatcccattaaataatgaagtctatcacaacaaaactagcttgttgggtcatcctcatcactatctgatggttctgtacccatatcatatagatccctcggcctatatggttgtgcaacatgccatccttgtgcttttggttcctgcacatagaacacctgtgatacttgtgatgagaacacaaaaggatcatgctccatcttctctcccttatcttcctctgtcacctccttatcacaacaacaactcaagcccgctggtcaccgcgaacttgttctccttcgagcccgatgtaagtacttttttttttaactaacgtattagtattttttaactaacatatcatattcaatggataaagcactgtcgctatttagaggctcctactgtgtatatattaaatatatataattaaaaaagaaactgtatagatctcaatgcatgctgtctagccattctataatcggaaaaagtacgaattaccccttccccgaactatcgcgatcgtccgaattatccccttgaactcgaaaaccagacattttacaccctcaactactaaaaccgaacaaataacccccctactcaatctctggagtggttttgatcctacgtggcatacacgtgtcagccaagtcagcaatcctttaaaaaaattcggtggggcccacctgtcaatctctctcctgtattgctcaccttctctctcctcctggattcatcccctcccctcgctaaagcacgcagcggcggggcgagcggtggcggcgggcgcggctgagcgagcggaggtggctgcgggcgcggctgggtgagcggcggcggctgctgcgggcacaattgggcgagcgtcggcggcgacgacggcggctgcggatgctagcctcgccggcgagctccgccacgggcccccaccctggcaccaccgcccaccgtgtccacctccactatgccgacgtccacgtccgtcttggtccgcctcggtgcgtgggcgagcgcctcgtcgccgtcgccttcgtgcaccaccgggagcaacagcacggtcgtcgcctccgccaccacgggcacggcggggcgcgagacggcggcggaggcgctgtcagtgtcgtcgtcgtccatctcctccccggcgaccttcctccctgcacggtcgatctccagctccacacgcgccctcgcggactccgtctcgaccacctccaacgcgcgctccagctccgccacgtagttgttaacagtgaaatttggtaagcccggagtagtcatcggcgtagagtcagcatcggcttcgaagtcctgagattagccgatgagagttgtcaagtcgtcagttgtcggattcttgctatattcggttaaggaaattgatctactaaaggaagcttatccagaagagaccgagtttaaagagaatacggcatggtaagttatctattaattaggaata

SEQ ID NO: 44607 - DNA, 1669 bp, Oryza sativa
tggtcaatgcttgcaataagagaaaaagggaactgaagtgaaaataagtagccatatattcctagaaaatatactacaacaaggtaagaagtgcaagcagtaggcaactagtcattgataaatatttcacatgtataactttcatcatttacagatcagtagatgccaaccattcaaatttgctataaggttttaaacctcagtaaccagtactccttgtttgattaccttgtagcaaagcatacttgaatcaggcttgtacttagccttataagcagtataattacattttgggtttctatattggcaaatctaaaatttggtttatggttttttgatatttcatagagaattacagttgaaaaacataataattttaagcaactatttcacaatttgcttaacctttaagaaatagtatctaaatctagagaaacttgtcacaaataaaaggaacacgcatataaggaaataaacacaacttagaaagaaacaaattattctagtcccgtctatggttcttcccaactaacattgcactgtggcgggataaacggtgtcaagtaacacagtactactacagcacagtcatgcattagaagatgcatacataaaatgtcttgaccaatatatccactttgaatggaccgtttcaggagattactcttaatatgctgatttttagagagaactaacttgcaaatatacataccaattaaaaaatttaacaacatattgtgtgccatgttcatgtaggtataaatcttaaagtaagtggacatgagaaaactatagaaaagaaacttcgcatatagcagatttcttgatgttttgatggggattgcttgactttccatatataggaaaggataaactataaatgatacagtagttcaccaaagtagttgttgttctaacggtgtcttacaagtaagacccatgtgctgatagtttgttcagcacaattataggagtaattccactatttcacaatatatgtttttttctcgaaaacgcaagagaattgagtttcatttcattaaggggaagaaaataaaagaaaaatacaaagtagaagagaccaatgccctcctaccgcaaaaaacacacccacaccccggtcaaccccggctatctagctgcctaggtttgccgaaccactaaaaaacttttggcggggcagatgctcccactagacaccaaagattaccctcattccctaccacctgcaagactgtcgcaggtggaaaaattttcaatagctacatcttgatctcctcaatggagaaataccttcttaagcaatgcacaaatattgtaggtggcttctacctgcaagattaccctcattccctaccacctgccttccaccgtccttaatcaaagtttttgaaagttaggtggccgtattatgaatttattagggagcagccatggtttcttactctcttaccaactttttcttagattttgtgcttctagctggcttgtgcgaactgtgggcattacaaatattttgaaacagaaggaacaattggattggtacttatactagtaaccacctattatgctggttggacattgaaagtgttccaaaaactctccaaaaaagtggatattggagcatttgctgaacacatgtacgcccgcaaaattatggggacaaatg

SEQ ID NO: 44608 - DNA, 2128 bp, Oryza sativa
accctcaatgagatgaagtagcccagcatcagtaaatgaggttgggttgacaccatcactgccattttctttctgcgtatcttcgcttagtgtggaacactgcatatgttgctcatctaacttggggttttcggtatcccaaccctgtgcctgtgacaaaaatagtgcattagtgacttgcaaaattgatagacaaaccacatcaagaaaatagtttccagagatctaaattatatgcagctctggcaaaatgctaatttctcagggagaccaagaaaacaaaatcttaaccacggatttagttgttgaaccaataaaacatcggatcattcattcaattccacaggggaacacaagagatgcgagaatttcgcgcgattcccgaactgcagccagagaaggactcaccctgctccgctccgcggcggcggcggaggcgccggcggcaatgtagaggccgtggtcgaggaagacatcggcgaggcccgggaaccggtcggcgacgcagcggacgacggcgtcgccgtcgggcccgtcgacggggaccctggcggcgcggcgggacgcgcgctcgacgccgcgccagcggcggcacacgagcgcgcagctgtcaaggtcggccttgccccccgcggcggcgacgcggcggaacacctccgcgagcaggtcgtccgggagggcggcgttgacgaggccggaagcggaggccatcgcccgaggcggcggcggcggctatcaccggaggtagggttccatggaatccctaagattggaatgaaatggaattgaagcggaaggaagaggggggttttagagcccaagcctttgcaactgccgttacaactttgggttaattagacacatgccattactaatttgaaggtttagaaaaatatcattactatttgacaaattgtaaagatgccattacaaatcccacgatactggaaacatgccacgttctacgcctgatccgcgattgtactcgtttttatgcgtaccgtatttacgtatggaccataatgcccttgtgtatgagtatgtagggaccgagtggaatcagtttgaccaagtgcattcacagtgaaccgtaaacctaacactaggcttctccggcggcggcgggatttggaggcggcgtcggcggcgtcagcgatggcatcgggctttggcggcagtgtcggcggcagcggcgggctttggcggcaatggcggggagaggcagcccgattcgttcgacgggctcgagcggttgtagctttcagcgcacacgggccgcagcgtcgtcggcaccatggttgagatgtgcttgcgccaaagccgctgcagtgaacaaatccaacacctcgagaatttagggcggcggtggattcagtgtgggaaagaggtaaaccccattgtttttcattttcttttgttaaattcccttccttttttgtttcgttttcttgattgatgccattgatttgagatgtgttgtgcagccaaagtgttgctcgttgtgaatatgggaggatctgttgaacgaatatgtggaggaaatggttgcttattcccatgctggtgaggacgatggtcaaagagacatgttgcgacagcttgcagaagagcataaggaagagaggtcgaggatgcagggtttggttgaggcaaaccataggcagatgcaatccatatatcagcagctgaatgattctaagaaaaagtgtgagcagctaaagaagatgttgaaagaagagaagtgtagtcgtagtagacaactttatgtgatgttgttcttgttggccataattatgtatttctatgtatgttctgtaaattttgtggccatatttggtacaagtaggtaaatcagtgccattttgtgtaatgttaatcactgtctataaattatgtggattcaatttctgagtaatgacataggtgtgttaattatatggatttaatttcccactctgggtgctctgttaaggataagtctggcagctcaaggtacaagctgatattgtgtgtttgcagcaagagctaactgctgactcctgcactaaaactatgctaatatatgttcacttggtgtaaaaaaaaaaggaaggtataggacattgaaatatcttttggtgtgaagtat

SEQ ID NO: 44609 - DNA, 1327 bp, Oryza sativa
gaatccttcccaacctttgctagtgtggtgtcaccaattttctgaagaacagtgcaggaccatgaggggaaaaatcaatgctttaattgctatgcatgaaggtaggaaaacaaacatgacgaattctataaacaatttctgaaattaactaagactagaggtcattttagaacaagaaaatcaatatcttctatcttatgatgttgagagagagaggggagaccttggtatcacttatattcagatggactagatcatggcactctcttataatggtagtaagcccataatcagtaatttgattgcacccacatatatctaacctctcaaggaaacgacattgatcaaccgtagcaagcccggtatcatttaacctgtaaatgaaagccaaatgttagcagatctttgtcataatagatagaacaaaagtttttatactcaacaaaaaaaatgtttagaacagaatgatgtcagaatgctttgaagaaaatgttataaaatggaaaaattaatgacatgcaactcaactgtatacctttcactttgaactcaggaagtcaatttaacttttgattggaactatcatctaagaaaggctaacgaattaaagttatctttgattagaacatgtaaaaaagtgaatcatggattcaagtacttacctcccaagaccatggagggtcaactctctaagttctttacaattctcacctacagcataagtaatggcttcataccgccgatcctgcgagtagtgaaagacattcaagcttacatatagtacatagcaaagttacaatgaaataaaataaaaacattttctcattccgtattccggtttgggagcagccgaacagcaaactctggtgtcggcttgccacatgttggtcttgggataaacattagcctaattggcaaatatgaaagacaactgtaacctggcaaatgccagagagacaaagcaggagaacattaccacatcgaatgagggagaagggatgtggttaagactcaagaaaagattctactcagagtcatgtgctaaatcctcatcaacaaagccgttatgagaccatgatgactcagcattccttcatcgctctttggatctctcccttcaacaggaggggggctcaggaaatacttgtgcttgtggacagaaaagttgctacttgctacaaactgccagggaatgtggagtcggcatgtgacagttttgcctcgccaaagggattctttgattcatcagcaaggatgacaaaaatcctcgtccatgagatcggtggcatagtctatgacatcaagggccctacccagcaatgacttt

SEQ ID NO: 44610 - DNA, 829 bp, Oryza sativa
tgagaatattttaaacaatgatttcctggatgatggttgaactggtgggtttttattgttggaatgttttaaggaaactctttgctcgttgtagtttacatacatttaaaattccagaatgtttttaaacaatgatttgctggatgatggttgaattggtggggttttttttgttgttgggacgctttatggaatgtgcaaggtcgggacatactaatgttgtgatttcctaaactttatgatctagcaataatcaaaggaaacattttgatatgattcttaatataaacttccttgcctcacaaaagtttatttggaagttctttaaattgcaaaaaaggagttttcttttctaaaggttgagttggctttgagccttgattattatcactgtatgaagattggtcattctttaatttgaactgtggtttcatttgagacgacattgtctaattaattaaggctagtacgttttacctactaggaatagttattaatataggcatagtacttcaattcaatcttataggtatcggtcgtacttaaattcaatctttttccctttgggaacatgtacttctggacctgaagcttaaagggaattatggattagaagggtttaaataaatgtaggctgtgtttagatctaaagtttggatccaaacttcagtccttttccatcacatcaacctgtcatacacacataacttttcagtcacatcatctctaatttcaatcaaaatccaaactttgcgctgaactaaacacagccgtagatctgtattattggagatcaagactgtacaatgcgtacatttacaccaacttg

SEQ ID NO: 44611 - DNA, 989 bp, Oryza sativa
gacacctctcataaattaaaagtagaatatacgcgatatttgggtacaaaataaccatcgagttgattatataaacattgttatgtttagatctaagagtgcgcacatcctctaccataacgacagatgttgtaacagacacctattgacatgtgtgggcctgttatcacagatgatattgcttgggccaaaaacttactagcaggccataggattatgctttacctaggctcaagaaaattcttggatcagtcactgtaaccgattcgctttgattaaaagaaactgtgtcatctaactgtgcatttgcatgatcaccaatcaaagcaactattaaatgcacaaaaatgttgtgtttatttttgttcattttgttgacaggacttaaggtggcgatcaagtgcaagaacggcagcagcgaggagtacgagagcaaggccgtcggcgagctcgacggcgcgggcgcgttcgccgtgccgctcgccgccgacctccgcggcgccgactgcgtcgcgcagctgcacagcgcggcgaccgacgcgccgtgccccggccaggagccatccaagatcgagccgctgtcgtcggagggcgagacgggcaccttcgtcgccgtcgccggcaagacgcacctcccgtcgtcgacgtcgtcctcgccggagtgctcgtcggtggccatctgcttcccctgccacaggcgccatcgcatgttccacaggaagcccatgccggagtaccagccgcctccctcgccggtgtacggcacgccggcgccgggatgctcatgctcccctcccagcacgccgccgggatacggccagccggcgccggaatgcccccctgccgacccgggttacggccagccagcgccggagtgccctcctcctcccacgccggcaccggaatgcggccagccggcgccggaatatcctccttccacgccggcatacggaacgccggcgccggagtgcccaccatccacgccggaa

SEQ ID NO: 44612 - DNA, 4579 bp, Oryza sativa
tatataaagaaggtgaaagttcaagttgcctctctaaacttatgtcgtacgatttaccccctaaactaattaaaataccaatatttcacaccctgaactcttaactctaaacgaattatctcctaactcattcgagagtggttttcgacctacgtgtacaagttgcaatctagtcagtaaatacaaataaaaaatcggtgaggcccaattgtcagtgatgcgtgtttatcctcagcctcaacggacgataattggggccgcgagtgcgggcgggagtagaagctagaggagcaggacgattccacctcaccaaggcttcagcaataacgaaggcagtgctcccgttgcggcggcgaggtagctgccacctctctctatgccgggacagaggaggctagatatctgaccgttacttcctccgtttctaaatattcgatgccattgacttttttaaatatgtttaaccattcatcttattaaaaaaaatttaagtaattattaattcttttcctatcatttgattcattgttaaatatacttatatggatacatatagttttacatatttcacaaaagtttttgaataagatgaacgatccactatgtgttaaaaaatcaacggtgtaaaatatttagaacagagggagtaatttgcaagccacagctgccagtacaggaacccaggatgggaagacgaggcagcggtgactacgcgatatatagccgacaaggaggtaatccccaggcgacggctggccacgatggcgtctccggcgtcgcatgcctcaatcacacggggagcatgcacgagacggattcggacagagacagtcgtcgtgaagaaaaaagcacaagacggacatagcagctaattaaatcaactacttgcatgcatgctagtcatcatcataaatcttcttcttcttcattggtaaagctcgttgcaatgctacgtgccagtggcggatccagaaaatcgattcgttggtgtcatataacatatctatcgatgtcttaatatgctaattatgcttagatcataatgttataacatatggataaagagtttcactataggttttaccaaaagtgttgggtttagtcccacatccactggtggaaaactgggactacgaatccgggactaaagatcgctatctttagtcccgggtgaaataaccaggagtaaagatcgatataaagagagggatctttagtcccggttaatgctaccaaccgggactaaagagaggataggggcagtcccggttggtctattttctttttattttctcccaagtgggatgtatatacccagatcaaacaacaaatccccaaatcgagtgtcatgcatatacctaaatcaaaccccaaatctccaaattcaaagtaacatcacaaatcattcacatcacaaatacaaatcctaagttacttacacacaaatcaaatacatcacaaatcttaaaaaaattacacacaaatcaaatgcatcacagatcgattatacatctcatatccatgcaatgaatcacaaattctagaaaagaaattatacatctctcaatcacaaattataaaaaaaaaaagaaaggagagccggcgcgtccccgccgcgcgcgccgcgcgctaccccaccgcccgccgcgcgctgtgcctcgccgcccggccactgcgtgagggcacgcgaggccacctccgtcgccgcctggccgctgcgtgagggcgcctccgcgcttcccggccgcgcgaggccgcctccgcggccgcccggccgccgccgcctgagaagtggggaagagacgggagggggcggatccagaggaggttgagaagtggggaggagagggaaggaggcggatccagaggaggtagaggaagagatgggaggagaaagaggaagaggaagagatgggaggaggaggaagaggaagagatggggtgagtgaggagagaaggagataaatgtcagaacttattaactgatcctcccgtgcgccttgatcctctcgatctcgcacggtgcatgtcgattggtgttaggttggtgtaaaataagttaataacttattttatttaaataagttattttaaataacttattttgttttataagttattttattttatcttattttattaataagttattttatttacacacacctcccggttggtgtcaccaaccgtgactaaagataaagaggggtctgacaccacctgccgtcttttaaaccgggactaaaaataatctttagtcccggttgatgttaccaaccgggactaaagatcaaaaagtagctctaaccttttgaaccgggactaaagatcatcttttgaaccggtttttagtggaaccgagactattgtggatttcggccgaccgaccaaagatggtttctccaccagtgatcggtaattgatgatggggagtatgacttaaaaggtgggagcaatcctcacccaagagactagtctgttgggttgtgtaggtccaggacctaaaattgtggctccggttgaatctggggtggagcaagcccaatgtgatctgggtggtccacggttggtgggccgagctgcgaactctaacataaagtcatcggtattacttaacaccggtctttttactgtagatccacccctactacgtactagcatagctagagccctttaactgtagatccgctcctactacgtactagcatagctagagtgcgacgacgccgatgaagacgactgggctacgaaagggtaaattgtactactgcataatgtagagggtgatttgaactttacattaatatacaatataaactttgtatatacacttataaaaatctttgcatatgtataaactttatataagtatgtatacactttaaatgtaaaaaagatttatatgtatgtgtacagagcgaattttctaggatttatccgtcgacagcgaggcgcctgtggtaacttggtaacttcgtcaatcttaaggatttgccggcccagtattcaaagatgctcataggggtagggtttacgtgcgtgcgttcataggggtgagtgtgcgtgtgctgtgagtgactacgttgttaaaaaaaactcggtaagtatacatacaaacctcgtatatatgtataaaaataaaaaattccatggacccataaacttaaggcaacaacatgtgattttttttgtttccgttgttattctatttgtaattaactaaacaatttaagatcatatcacccatattttaaaaatatgtatgattagcaaagatcgttagtgcggaaattatagcaaagaagccgcatctgtttattattatttttttgtgaggtgcttaattagtcaaggcaattagtagcattagagccgtatatatatatatatatatatatactggtttattattttttgatgtgttgcatgtcgatcggtggttggaattgatatgacttgcataattggtctagcccttacctaataaattagttcacagttcgttttgtgcttttcgattttgtcgagtgggtaatgagttgccctcaggcgatattaattcataattaattattaataggatatgtcaggtttgagttcgtcgtgtccccgtatcttttgtgcgggttcgtatcctctaacatcaagcagtaatgacagagagtgagcagtgatgtgatataatagtatatgtattcccgaaaccacgtgttactactcttaggctgcattcgagcgcaggagaaagagagaaagattgtttcgtttttcacgtgcacgcttcttaaactactaaacggtatgtttttttcaaaaaatttatgtaggaaagttgctttaaaaaatcatattaatccatttttgaagtttaaaatagctaatacttaattaattatgtgctaaggctcacctcgttttacgtatctttccaatcttctcgatcccctccttttcaaacacacccttattctggtcgtgatctcttgtgatacaggtcgaagagctcatctcaaatcattgagcgtgtttattatagaacaatctttaccagttatatttaataaattgtgagaattttttttcatgttacttcctccgttttataatgtaagttattctagcatttctgacatttatattgatgttaatgaatctatacagatatacggatgtctagattcattaacatcaatataaatatggaaaatataagaataatttagatggtaaaacggaggaagtatctggtacgtgaaagagaagtaatcgatcgtccgctgctcaccaccctctcgatcgtgtcaccgggagcacaactttttaaatttgccttgtggagagatggtgtgagtttttacggtcctttggttgagtttttgatttaaactatatctatgcaactattcatggtcggtttggtttggttataattattgaacagtgaacagtaaatgaaatgatcagaaaacagatgggatatgtcagtcacgtgtcaattatacgggatgattctaaacttttcagaccacatcattcattgtttatatatcatccaaataataataaaacaatttaaatt

SEQ ID NO: 44613 - DNA, 1847 bp, Oryza sativa
  unsure (1)..(1847): unsure at all n locations
tctctccccaaccccatctcccctcccgtctcacacataggcgacggcggcggcgcttcacaatgcaggtcgccagggcacggcggtcgccctctcggcctctcccatccccagctcccctcctctttcctcccctcctctcccctctccggttaccctctcccgctctccctccggtctaccgagtgccgacgacgcacgtcgcacgggcggtgcgcagggcacggtggccgacgagccgcgcggcggtcggcgcaacgcacaggcgctgtggtcggcgagccgcgaggggaagcgctgtggccggcgagccgcgaggggacaggcacggcggccggcgagccgcacggcgcacaggcgcggccaccgttcggagagtcaattatgtacaattatgctatttttgatggtgtgtgaattttgtaccatttttgttcttgccgaattgatagctgtcttgtatttcttatgctgatgggatggagattttattcaatgcgggccccagtcagggtgcggggccacggaggggtcggggacggggctagatttagccccgcatctccagtcgggaccgggggcgggggcagggggtgaagtcgggggtcgggagcggggccgttccagcccaacccggccccgccctgcnccgttgccatccctacagacagtccagatttatagtagtaaaatgtactccatttaaccaaaacttcttatattttgagacggaaggagtagacccttggtggcgggcccaactaatttcagtacaaagacagccactccagatattaggtggtggtagtacttgtcagtactgatagctaaatacagtgacatatattaactatttctttatgtcttattcactcggctctaggcatcattggtattctgatctagacatattgtaaaaggaaaaaaggaaaaagaagcattgctaaggcctagttcgcgaaaagaaaatatttgagtgtcacatcggacgtttgaccgaatgtcagaaggtaatacacgaatgaaaaaaaataatttcataactcgtctgaaaaccgcgagacgaatctgttaagcctaatttagtgcagcacttatagctaatcatggactaattatgctcaaaagatttgtctcgcaattttcatgcaaactgtacaattaattaattagattttgtttttatctatatttaatgcttcatgtatatatctaaagattggatgtaatgttttttttgttaaccaggcctaatactgatattctggccttgaaatgtactagcccatgctgcacagtgcacagctagcacgataaaatataatcttgacacagctgcacgttgcgccattagccatggagtccggcggcttccttgcacgtcgtcccgagccatgcgccgccgccgccgaccccgacgacggcgacgcccgccgcggcggttggcgcgccgccttcttcctcgtcggtaagtggcggcttctcaggctttagtgatgacatcatctctctcagccaggcttaatttgttgctgacgtgtgcatgcatggccatggcgcagtcgtcgggttcttggagcggattgggttcttcggcgtgcaaggcaacctgatgctgtacctcaccggcccgatggccatgtccacggcggcggcggccaccgcggcgaacgcctggggcgggacggtgctggtgctcacgctcgccggcggcctcgccgccgactcctccggcctcggccggtaccgcgccgtcatcgtcgccagcgcgctctacctgctcagcttggggatgctcacggcgtcgtcgtcgtccatggcggcgcagcgagccacgtcgccgccgt

SEQ ID NO: 44614 - DNA, 18601 bp, Oryza sativa
catggcgatggcggcaggggattcttccttgtgaagcttcttccgatctggctgagcagcatagtgttcgccgtcgtcgtctcgcaggtgtccaccctgttcaccaagcagagcagcacaatggatcggcgcgtcggcagcggcggcggcggcggcctcgtcttgccgtcggcggggctgcagtgcctcgtcagcttcacctacatcgcggtgctgccggtgtacgaccgcatggtggtgccgctcgcgaggcgcctcaccggcggcggcggcggcatcacaatgctccagcgcatcggcgccggcatggcgacgggctgcctcgccatggccgtggcggcgctcgtcgaggcgaggcggctccgcgtggcccgcgacgccggcctggtcaaccggccgggcgcgacggtgccgatgggggtgtggtggctggtgccgcagcacgtgctgatcggcgtcgcggaggtgctcgccgtgatcgggctggaggagttcttctacgaccaggtggccggcgagctccacagcgtggggctcgccgtgtcccagggcgtgatgggcgtcgggagctacgccagcggcgcgctcgtggcggcgatcgactgggcgacggcggcgaggagcggcggcggagagagctggttcgccgacgacctcaaccgcgcgcacctggactacttctactggttgctcgccgcgctcgccgctctggaggtggccgtgttcgtctaccttgcgcagcgatacgactacaagaacaaatccaagccatgatcgatcgtattcttttctgattttgtatcttcttattttagatatgaacaatggcgtgacgttatcatttagaaaaaatatcaaacatattcttttaattgtatatccctactattataaaaagagtaaagtgcacaggtagtccttaaactaataatggtgtgtcatctagatccttaaactcttaaaatgtatatccaaattctagaacttgtcatagtgtgtcatataagtcccaattcaccacagcccctttctacatggcgctgatgtggcatgccacacggacataacgtgacaaacggaacccatttaaaaattttcctttttcctttttcttctgttcttctatttttcttctcctttttttttctttcttctcctttctctgcgaccggagcataagaaaggaaagaaaaaccgaagaatgacaagaaaacaaaaaggaaaaagaaaaagaaaaagaaaagaagaagaaaaaagagaaaatgacacgtcacgttcatgtggtgtgacacatcagcgccgcgtaggatcctaaaggggctatatcgatttgggacctaaatgatacactttgacaagttctgggacctgaatctgtattttgagactttggagacctagatgacacaaccttacgagtttaaggaccacatatgcactttacttttacaaaaattaaagatatttttgccggtgttttggtacgtcattcgtgtttgagtcggtttttaaatcactcgcttttggaaatacagatctgtgtttgagtcgtttttttaagttcgttcgcttttgaaaatacaaaaagagtcgtataagaaatctctttaaaaaaacatacatgataattacttgagataatcaaacttctaattacagctcataattttgtaaaagaaacaaatccaagtgaattcccatagtaaatttcaccttaactaaaccgtataataataagatgattaacttatctaaaaaataataatatgattaaaataacctttccgttgcaacgcacggatattttttctagtgtagataagagagagagagagaagagtaaatgatgccttctgtttattagcatacattctaataggaggagactatatcaaatggtgtgcgctgaattgtcctaatcagcgaccttgttactaaaaatagcaggcatgtcgatgggtacgtgccaaataagcgattgcatagggcctccaatttttttcccatataaacatgaggcccacttccaattgcccagctatagcttgcaactgccaatagcccaattaggcagatcgatcagcaaggtcatgctagattgccaggggtggggcactattggactgtgcgatggcctaacttggccctgctgctagctggctgctctgcgattctgattccgcgccgtgacaactgctgagacgtccatcccaattccatgcacagtgactggcgaggcggcgacacaacttgctgcttgtgattccgaggctccgagcggcaacggtgacggcaaaacagctgcctcgcctcggctcctgccttccccctcctcgtccgctcatcatcctcgactcgactcttgacagcttgacctcggaccggtaagattagacagtgattgagtacatatatgatagattgtaaattcataatatgcatcaaattaccatgagttcatgattgtagtttataatttgaatgatccattaaatcaaattacaatgtttgaataaaattacttgtattgtacattacaacacatattacatctatataattgagcgaaaatatgttttatttatattagacataactttttaaattatagggcatttgcatttcaccctagggccccaaatttctagagacggccctaaaaaatagtaccactgcacctttcactctctaaaaataatccgctcatgaacagatcatgcttttaaagttttccaacctaccaatttcatgtgttgcttggccaaagagcccacctacttcctaacacctaaacttcaaataaaattttctcttaaattactaatctgatatacaatcagattgtatcattatgttcattgcaacttaatttttataacaagatctcacataattatattttaatggaagaagaatatgtgtagtaaattacttttgtgtatctataaattacttttagattggattagattacttcttagacattctcataatattgtgaatatgttacttttattgttgtttttagttagttctataatttatgttgattcaatttaatttctagatagacacatgtttttaccaccacaactgatttactttaaattttaataccatgataacttacttttattttgtgttaagttacttttataatttgtgtgaattattttcaggctttattgaatttactttcataaatatctaagaagtaatttattcaaatctaaaagtaattataagtagttatatttagaatcatgcaaaattatcccacatcctttaaacatgtgccaaataatgcaaaagacatataaacaaaacaaactgtaccataaaactgtcaaatcgacataaattttatcattatttttaactcctctaagaacatagttacttctaatactgcgaagagttacctttctctagtagtatagctacttctaataatgtgaagagttacttctattttttagttacttccctctagcatcaagtggtacttaagttacttctaataccatgaaaagttacttctattttttgagttatttctctctagcagtctagttgcttctagtatcatgaagagttacttctgtttttcataatttcttccctctaacaatgtattacttctaataccttgaagagttaccttccatatgttgcaaaattacattttttgaaaaaaaaatatagtggttacttcaaataaagaaaatatttgtatttacttaaaaatcttcgtacattttacttgtgaatttacttcacatagttattacaactgacctgctacgtaattagttctattactatggagagttatttctattgaataactaagttacttctaaaatttaagtaaattacttttaaatatttgaatatattcgatattttgagtgtagtaggatggttcaaacgaattttaaaagtaatgtgtggtttaaaagatataaatcatcaaaagttctataagaaagatagactagtataactaatcttgttggttggtggtggcctcaatacgtagcaggtgaaagggcgcacgccgtgacagtacttaatgtcaaccttaaatgcatccgtcgctggataaagacaaaatagtgtgcacattacttgttgactcgcacggatggatggctggtagacgcgtcgcgctataagacgaaacgagagcacgcacgatttagattttgcaattctaaaagatatcttgatagcttatatatatcctataatatgcctatataaaaataacattcattatactatgtcatctagatataacatgaaaatatttcaaaaaaaatatccatggatatctaagttatatatgtattattcctatcacttataataaaatctattttgggtgaatcagtgaaaaaattcattgaaaatgctttagtgaaaaaaatgcacaatacaaacatcgcatgaaaaatgcatgggttgataaaattaatcaaatctaccaggttttagcagagtaacgacattgctttgtgaagactctacttcctcctttcagactaaatttgtgcatgtggtgcttgcagttggtcgggtgactcgtcacctctgtacgtgcatctatctcgcctacttgtcgcagtacccactcagtagtcaggagaagctattgtggcgcctccgcgtgagaaatccatgttgctaaagcataaaaagcccatcctgcaggcgtgaacaagctatatattcctgatgcatacgacgatgctgcatgtgttgcgggtaatagaactgtgccgctctattaatgcaggtacagcaaggattgttactcctctatatacatatccgatgtatagaggcaaccaatgttataaaaccagcaccgaaatcgacatcggtagctaaatgtggaagaaaacaccgtagtagatccaaacacgatgacgacaccaaggcactatatttgataacggagttcagccgaggcttacatctccgaagcactgattacgggcgctcctccccgatccagcatattacaacgtatcagagtgacaacgactcacgaccggtcaccgccggcagccgctccctctcgctatgctatgtcgccatgcggttacaacaggcacgcccttctatttatgagagatcctagaatagagtccgactcatactctagtcctacacctaatacaactccaagtcctaaactctaaccgactacgtacacatattcgacacaaactctaacaaactccaccttggcgaatatgccacgccaatccaaattcgttacttgctcgaatttcagtgtaccaggacttgagttgatcctttttcgccgctcacaccgagccgccctgacaagcctccaccaggctcatcgtaacaagatactccagtatccctgtaatttcttccttctgactccacccgcaacaatgctccaccttctctcatatcaccacagtcatcttgccaagcgaattgaattcttcctagctgtcacatcatagacttctcgaagaccatgttcacctctatctaccgtcttaagtatgacttgatataatccatggctagataaccgatgtcataaccaaatagataaatcaaactcaccagacatggagaaaaccctttcttccttatcatcttatgaaccgagctaataaatccaacatccacactttttcgcatccgtagactgaattcctgataatttgagaaaatcaccgttgctttgaatcattcgaagaaattaccaccatagcgcttgctcttctccttcagtgacgcagattctatatatccccatcatgcaaaccctgcagattatggatatattctgtactgccaaacgattttcacccgctgttgcccgggacgttcttcacgcacgcttgttgtcacacacctacacccgagctgcaccttttgcactgatagcttggccacaattgatcgaagggctccccgaagtgctaatgtctaggtgttgttgcttttccacggcctcggcatccatcacagacactgactcggctggcaaaaatcatggactcgggttcggagtccctcctaccagtctccgtgttcatctcgctccaacatctatccgcaccatcagcctcttctcttggcccactcctgatcttagcaccttgcaccaccacgtctgcccaccacgcccgcgacatgcactaatccgagtgctaatgcactagtgccgctctgtcgcctgtagattagtccgtagccctgcacaccatgcaaaaacttcttttatctgtacgtctcatgcatccttcccatcatagccaccgtaagattaccaagccaacaagctcctgcatcataattgataccttgcatatacatgcaattaatttaaccaatgcactttggatttgctcctgtacatgactggctatgactcattgcacgagttccagacaacttctgctcgttctatattgtgtgatgttcctgcgcgtgccgctgccgcctcctccgaccggagctggcccgacgaacttcgccggcacctgcacgacgactacaccaagccgtgctcctaccactcgacgctcgtcgtcccaaatcaccgccgccaagaggtcccaatccgatctccttttgccttggtgatttgttcgattgcaaagcaatcccatggaactcctttgctgacttcatgaggccaattgcatccgatttcttcaaatcagagtccgcatcgccgcctcttctcgtgttcgacttggcttcgtcttctacaattgtgccgcacgcgctgtgaccggactccgagtccgcatccgctactgcgccgcgaaccccatcagaaaagataccgcgtaatcaccgctcaaaccgagcctgctaccaatgacgccgctttggtctacgccgccggcttgaccacaacgcgaggatcgctcacaccgccgcggccctgaccatctccaagcttcatgtacgcctccacgacttcctacaccgccaccaaacacttcgggtcaattccattgacagcgaatgccgccgatcaataaccagtgcctgccacaatgcaatgcttgtcgtgcgtacgtcgtcactgtagcaatccatcacgcactgcctcgttatcaacacctccacatcagcaccaaggatccatctgctccgacttccaattgaccacccctcaatccagtcgcgagccgaagccgacaaatcacatgccgtcttcccagtcgccgaacaacccgagtgctatgtctagccatctccctgtcgaacgcaactcatcgaaaggccccggccaccccaccaagagtgttcgattccaccgaccgagaacgccgatcgcctccagtttcaatcaaccccgagcgtgtggccacacgtctccctgttgagagtagctcaccggaaagttcgagccacccgcttgaagtgtccgacccaccgattggattgccaatcgcttccgccgccatcaacccgagcaccacgtctggtcatctccttgttgattgcagccatcaaacggttcaaaccgccgcctgaagtgtccgattccaccgatcaaattccgttgatcgccgccgtgctccaccttgcatccatgtccgtccctggacaccctgtgtagtcgtcgcggcgtggagcacctccctcgtacctctaccatggatctcccgtaggctctgataccacttgttataaaaccagccccgaaatcgacatcggtagctaaacgcgaaagaaaacaccgtaggagatctaaacacgatgacgacaccaaggcacgatatttgataacggagttcagccgaggcctacatctctagggcactgattacggacgctcctccccgatccagcatattacagcgtatcatagttacaacgactcacgaccggtcgtcgccggcagccgctccctctcgctatgctatgtcgccatgcggttacaacaggcacgcccctctattcatgagagatcctaggatagagtccgactcatactctagtcatacacctaatacaactctaagtcttaaactgtaaccgactacgtatatatattcgatacaaactctaacaaccaagtgaggatcgcgtacgcatagcacggccggcagcatctaagagtgactgagcgagtgcatgcgtgcatgggccgctcggtgcgccgctcacctcggtgacatacaaaaatcagacaacagataaagtactattagccgaaacaatatctacaatcataatcatgaatcattttaatcattgttcatgtactacaactgatattgtgtatttgtcatcttctaaactgtaattgccatctgtcataaagaaagctgattgagaacttatatctagaaagtacttattggcccatatgccaaagagcccctatttgatgaacatccatgtgcaaacagaaatagcaaacaccttattttctctctatctgtcaagtacattagttcatcacttccttacttgcttcgcatggcttgacaccacctcgtgcctttacacaagccatcacgtcacatgttcctgttcctcaccatagcaagacaccatagctacccttcctcctcctccctagtgacacggcgtattacaagaaaaatattttgtagagacatttttctaatactatagagacacttttcaaaaaatacctttacataggcattcaaaaaaatgtctaataagtgtcttatggtgaattatctctataaacgaagagacattttacaaaatgtctataagatggtagagatattttctagagacattagattgtaccacaatcatatgaaaccaatgaaaaaaacaataaaatattttcccttgtttttgccaatcctcgaaacttatgatcaattgcacaaatcattcttatcttcaaggtactaaccaactcaaccccaagtcattacttatatgttgttgccttgagttacttatatttagtcatttagtatatatttttattgtaagaagtgtctttacagagtttaaaatgtctcaagaaaatgtctttatatatcaggcacagtttaaagtaccgaaagaatgcctctacaagataaaatctaataaaatgtgctgaaaatatttctaaagtgttcatagagtaaaagttttctaggaaatttttaaagtgcctctataaaatgtctctacactataaaactcccgatctaagaggcaatttgcaaaatgcctctacaaaagtgtctttatataaaacttttgttgtagttgcggcaagtgcgaggcccttctttcttccccaagttgtgctagtagcaatcttggggtccttttcctagcgagacgaccattgccttctttctctgcacccccttactttatatcttctccggtgatgagctctgcaaccggttgaaagttcaagatttgagcaaaaactcagagattcaattggaagaagttaaagattttgaatataaagatgttttagattttggtataatgtttgtgatctcagttgaaagtttgaggagttaaaaagttttatatgtttcacttaaattatttgaaatctaggtatgaaaagcaattgtgaactgaagatttgtacaaaggagaaaaacgtatggcatataggtagagtggaagggaaccagtcgcgtatcagcatatatgcttaaaacaacagaatatatgagtaaagttggcaaatgcgtctttatcgtccaatattctgtttagatgcttcctttttttagaaacgtttagatccttctttgagctgtaaagtgacttcaaactgtcataggtctaacatctcatattatgcacactactaaaaaaatgatttttctggacaagagccccccgtaggttgcaggcggatcatcgtaactagttgtgcctggcaaacccggcatgcatttttttcgtacggctccttaaaagacccacatgcaaaaatatatttcgcgggtggatctgttaaccaatccatccctataaaaagagcagcatctttgcatccaacaacaaccaatcaaccaataatagacatatatcggcgagaaattttaaccaataatcaactaatccatccctagaaacaccaaccaatatatcccaaaaacatgaaccaatcaagatcgggagaaatttgggatgccttacacacaaatcgggagaacatgcggcgccgctgaccgctatgctccgcccccgctactgtacgtcacacctaccatcgtgccccgccttctcacacttgtcccgcttggcatgcctgagctcgccggacacgttggcacacttcttgaccgtcttcccctcgggccccgtggtcgtggtcgtgatcgacgccacctccgacttctcaccagtggcatgctccgcccgaccgctcaacacgccctcaccctaccataaacaccaccaccattcaccctaggcaccttctcccctcctcctcactccaccgatgggcaactcatctctgacgcggcctcgccctagcgttgggtgcagaggtacctcctttgacctatttctcctccgttggcagcctcccggccaggtgggggaagaagagggagggagcgagggacgaagggggaggggtagggttgtgcgagagagagagagagagagagatgacaaggaggaggggatgtgcgactacagacggggaggagcggttgcgagagagaggagaggatggcggtacctatgagttgatacctatgaggagttttgtagcagtgacactaccaaaaagcgatttttatgacaattgagttttatttccagtggtggatctaaaaagctttgcccctgaaaatggaagagtggtctaaaaacctagccctgccagtaaaaataatttttgcaggtgggattttaataagagcaccgcttgtaaaaatacctctatctttgtgagtggtgctcttaacaccctgccattaagaattgattttttaatggcggagtaatgaacaccacctgcaaaacctactactgaaccaacagttgcatcgtattatcctctcctctcccttctctctcttgatgtttgttgcagcacggggaaggggtggctaggaggcccaggactgcgcgaactcctcgccgtcctacggtgcacacctcgcgaagaataagtggcggggaaggggtggcggccggtttgcagcaaagggtgggggcgatggctactcggtgaaggggagaggcggtggcaaagcgtaggggacacgactgcttcaggttgaggatggccctgatgaccatgacggctcgagttggcaaggccgggacgacaatggctaccacggcgatggttcgtcttctctgcctactctgccacgcagaacctcaagagctccatcaacatcatgcatgtgcatcttggacaacgaagacaacggtaatcgagaccggaccaccagatctagcggtggcggtgcttgggaccgccagatgtctagctatatctggtggcggtggtagtccaaggagatggctgccctcggcgacgacggctccacgtgtaagctcggtgacggtggccctcggtggcgatggctccacgcgtagttcggcaatggttaccctcggtggctagggttgcggccagctcggtgatggtggcgacgacgacaacttcagcttgggttcctgcttcctactgctcggcaataacaaatttgggaagcttgtgttgatgcatgtgaatttgggataaggatttgggacattaattgtggatcctgattttaattttttttccattttaatttttttcctcctataagaatattttcgttggcgggtctctttacctattgtacagtgaaactagtttttttcgctagcggccttcttagcttggccacctgcgaaagtcaatttttgctggcggtcggcaaggccaatgaaaaccagcaaaaacctgatttggacgctagcaaaaacctgatttgtacgtagtagtgttagtacttcataaaaatattactatccattattcttgccaatctcatttgataagttagtaactaaattactacgagatctggtcgataaaaagattacttccattatatgcactacaattacaatatgatccactagtaatgttgtactcaagtcctcgtaggactctggtatttttactcacgtacggtttaattgaatcacaaaagatcgagcatatgctttctcttttgcaggggcaaaatgatagtaggagtatattgtttacttagtactccctccgtttcaaaatatttgacaccattgactttttataacgtgcttgaccattcgtcttatttaaaaaatttaagtaattatttattttttttatatcatttgattcattgttaaatatactttcatatacacatatagttttacatatttcacaaatatttttgaataagatgaacggtcaaatatgtgctaaaaagtcaatggtgtcaactattttaaaacggagggaatactatatataattatatattgtttcattgaatcacatcacatgagtaaaataattaggagtaccatgtgtacacgcacagttacacacgtccagtgcggtgcggacaataaaattacaaggtacggtgcggttgcgatgggccctggccggcgactttgccggcgatgaccaacgcaactgccgtgggatatcatcaaccgggtcggcggggccgccgtacgtcctcctccgcacggagcacgtacggtgcattgtccaagcggcgtcacacgagccgcaagcccaccatcccctgaacagggttcactctatcggttgagccgtttatatcgggggtcaccgaaattccgaaatttcggaaattttaaaaatttcggtctaaaatttccgaaattttgagtaaaatttagttgaatttaaacaaatattacctaaatttatgaaaaaaatttaaaaaataaaaaatttcagccaaaataatatcgtatcggaagtgaccgaaatttcggtccgaaatttccaaccctgccctgaacacactgtcagatgggctaggctgggttcggttctagaggatggaccgttaaacgagccatggtagaaaaaaatctaggtaaaataacccaacaaatggacaggcagttccatcggccagctcaactggtgggtagactattgctgcaaaagacttgtaaattaacttcttattgcagatcattttctttatgaaatgttatttgaaattttatatttgactttaattcctttttaaactattttggcaatggcacaacaggaacaggaaaagaaaacccaataaataccagcatgataaaattttgaaaaaagattttagctgtttcaaattttgttacacgttaccatctaaactccttgggaaaagaaactgttgatttggatatatattagtatatatggtcttcaagataaaagtttcaccgtcaatttctattgcaaggtatttaaaaatgctgataaaattatactaacagtattttttttaattcattctaaatatttaaaaggacattaatatcgaaaacttttaaagtttgccattaaacacatctaaactgcaatgagattccattaaagtcaacagtatagttgttccttcaacatatatagcagattgttaaagtaggaaaacactttccagaaattcagtaaaccactgagaagttcatttggaatatctgaattaatataattgaattaaactgaaatgttacaataaccctctttttgacagcgacacaataaataaaggttagttttaaaatattaacagcaagaggaccaacagggcaacaggacagagggcccaaaaccaagcaggatcaattgataacattttggttaaatttcattataaactgttggatctagcagtcaaatttgaggttaaaaaacaatatatacatgaatacccagaatccaccacatctctttaatagtacctacatatactgctgaactgaagacatgaatacctttctttctctatggtgacctacagaatgtggcacagatgtagcagtgccacagatgtaacagttattcaacttgaacaattcaagttaaacctgggaccaaattaaaatctccggccatgctgcaaatacaccccttgtacttccaacacaatctcaacaataactgttctttcaatgcagccaattgttgttgcaaacttgcagttaattgttcatgcatctctgcatgcattgccctaaaggaaagataattaagttgcccagtgccagatgcacaatggcaagaattgcagatctgagaaaacagagagaacaaatatcaacttttaacggcacatttactaacaatctgcaaagccggtgcctgattgaactggtagctcagctgatcactactatctactacctagctagtcgcagtttaatttaacacaccatctacctagttgcaatttaatttactctctcctgcatatgccaaatgcttctgttgcacttgcatggatatgaacataatattgcatgtagctttgcatgcatatgctcttcttgatcactatataaacccatcactgcctctcttcttgctcatctcccaatccactacttcttgctgatcatcatatatctcttgtgagcttcagcaatgggggctctgccaagggctctagtcctcggcgtttgcgccgccgtcttgctggtgaacgtgctcgccgttgccgccgacggcgacgccgcggcggcggcgtccatggtcgtcggattggccaagtgcgccgactgcaccaggaagaacatgaaagctgaggccgttttcaagggtatgttgatatcataaataatcacgcaatatggtccaattaatcattgtcatttatttaaactactacctgaaaaatgcttgttctaagttctcataaatgcaagacgtttttggttgtcctaagtcaattttttttaaattaaaccaaatttatattaaaaatatatatcgcaatatttatgacaccaaattaatttcattaaatctatcattgaatatattcttttatattgggtatatattttgggttgaaaatgctgctgcatttttattcttgattttgttcaggtgttcgcgtggcgatcaagtgcaagaacagcaacggcgagtacgagacgaaggccaccggcgaggtcggcaagtctggcgcgttcgccgtgcccctcgcggcggacctcctcggcgacgacggcgagctgaggcagcaatgcttcgcgcagctgcacagcgcggcgtcgaaccagccatgccccgggcaggagccgtcgtggatcgtcaacgccgccgccgacaagaagaagaccctcgtcgccggcgccggcgacacccacttcccgtcgtcggagtgcgcgtcggcgttccctctgcgacccgttccacaagaaggacttcttcttccactacaagaacccgtcgccgccagcgccggcggcgtaccacaagccgccgccgtcgtacacgcacccggcgccgccggtgtactcctacccgacgccggcgtactctcacccgacgccggtgtacaagcagccgctgccgacgccgtcgccgccgatctaccacccgccggcggaggagaagaaggtggcgatgcaggacgacgcggaggctgaccccgagctgttcaagaagctgctgccattgatcaagaagaatccattcctcaagttccccaagctcccgcctgtggaggtggaggcaaagccatagatggtcgccggcttcgccgcggcgccatgatcgatcgatcgaagcgaggaaacatgagtactagctggtttaattgcttcgtttctttgtgtgtttttcacaccggctactcgagctagttaattactgcccttctagcgttgttgaagcttggtctgttgcctgcctgctagcttaactattcagatataaataaaagcttctgttctctatgatgtgattacatgtttgccggattgaatggatacctagctactagcttagctagcttaattaattttattggatgcatactaaaatcttgcattttttccatacaaatatttacttcctcgtttcatattataagacgctttgattttctttatttttaagtaaagtgtacgaccggtcacttagcttgtatcacgtgtcatctagaacttgtgtcactgtgtcatctagatccccgaactctaaaaatgctaattcaggtcccataacttgctaaagtgtgtcattctggtccaagatggctacggaccattatagcatgctatgtgacactggtgtggcataccacacggatgctgatgtggcatgccacttctgcttgtccaactaaagaagagggaaaaaaagagagagaagaaagggaaagaagagaggaaaatggaaaaaagaaaaaggagaaaaggaaagaaaacttttccaagtgggccccagttgtcagtcaatatagagatattgctggtgccacgtcagcatttgtggggattttggattatttatcactctcttcgatggtgcattctcaaatgccatcattcccattaactttgattatttgccattgtgacctaccaagttgtttctattttaccattttttaactaacaactcagcaaaacgatgagaaaatgaccacattgcccctctcattcatcttccttctaccatcttcctctccgacatggcatgaaccagtctccaacatgggacaagccaagcagtagggacaactattgccatgaatgagctggggcagcaggacgagcaatggatgtgacgatgcttgatggttcgccgttgggtcgtcggggcgaaggcaatacatctcggttgcaggccctctacctcgcataaatcttgtgaacttgagagaagcaacgcaaatggaggtggggcacccgggggggaggtgtcagggttatggataccacatacctaatagtagttgactaaatctcggcatgacccaccacttaccatgtcctatacggaaacaacctgcggatataggaggagttccggataagaaaagacaaccagagttctacatggaaacgataaggactactcggattgtatccatattggtttccctagttctacttggacaaggggacacctatgggtataaatacaaggccccctaaaaggagaggggatacagacgatcaacacacacccaccatagaagacacaaaacaatatatcaagacacaagatcaacatacaagccaacatacgccaagacaagatgccggatatcgatttcagggataagcacggctagtcccctacggtgtctccagatactgtcaggagagacgaaagcgctatctttgatctcgccgggcacgaactcgaggaggaaggctaccctgttgtcaactacgagtcagaccttcagaccgccatatcgacaacagttagatagactaccccaaatattgtactagtgtgattatgatgaataagagcaatgaccggcatcagccaacaggatgtagggttattacctgacaattcaggggcccgaacctgtataaaaatccctatctccatctcttttacctcagtctcgtgtatatcctagtaccaatgatccccataccatgcgaataccggaatcgcgacatcaaacgtcgacaggagggcaggagccagcgtgggtcaagctgtcaagttgtatgctctctcaccagcacgagtatctcgcttgtggtcaaggtggcctcgacatatcctcgctcatcaacgacctcaccgtcaaaaataccggaggcttgtgtcatccatccaactgcaactgtacctgggattcccacgccggagaggaagaagagaagatatgagaggggcagtgaggtcattttctgtttcttttagtatgttggccgtcaaaagtgataaaatagaaacaatttggtgaatcacgatgacaaacaatcaaatttactgggaaagatggatagcatttgagaatgtgccattcaatagagtggcaaatagtccaaaatctcgcatttgtatggcatgtcacatcaacgccacgtagcaagctaaaatggtccatagctatcttggaccagaatgacacacttttgctggaatggtccgaacagagtagaaaattggagagcaaatcgaatcaaaaaaataatatatgacaaaatgatcttgaatggctctcttggcacttaaagagaaatgttcagacttaattttcactcttaagcaaacggccggcgagcaggtgcctgcctttcactggatatttcggattgttgggccgggcattaccgggccaggatttggctagcttcattcgatgggctatagcccagtctaaaatgcctctcgttgagcactgagcccattgggtttgtacatcgctggcactttcgaagcgcgcgcacctgcgccaagagaggatcgatggtgtgcaccgccaacgcggcatcttcaaagcgtgtaacgttaatcgcctcccagcatgcttaatgctaatggcaattagcgatagacatatttttaataattaaaatatttgagttgaaa

SEQ ID NO: 44615 - DNA, 2744 bp, Oryza sativa
tatgaggattaagaatcgagtcccatgcttgggtgcttcttgacgtgttcaagtgattcccaccagtgatgtgttgtggtcaattgcgctcagtttatcagcatgatgggttcacaggcaacccaagtagcaatggcatcccagattttccttgtatatctgcaatccgccagcagatgtagggatgtctcatctgtgcaccggcaaaggggacaaacgccgttgttttgccagcccctgatcgccagccggtccgaggtccagacccaattttagattattagccatgcgaaggttttatacttgcgtgggcccaagctttccaaattaaggtgtcaaagtttgtttttagcgaccccaagaactgcaccttgtaggctaaggatgccgagtattctccatgactcgtgaacttccaggtaatttcatcattctcgtgttgagagttttatatgtaaagttaaaagtttaggatttgagttggaagtttgaaaagttgaacagaaaattttaattttttagttaaaagtatttagagattaaaaatcaagactccacatcttcgtttggtacacttttagcctcacaaaagcctagcgggccacgtgagaaaccagcctatgcttgtgggctcatgcgcgagcgacttctttaagttgcatgtctgtgcgaaaacgactcctctcgccactattttatacgtaaaatctaattcgagagcccctctcgttttagcgctattgcgcgatgctggcagagccgtccgatctccaaccacacgcacacgcaattcctgcttcaaagagagtcacagagagaaaggctacagttttctctcccatgtcatttttctcttcaaacaaagttttctctcaaattatttatccgatctacaatttgattacaccattgtgtttgttataattaaatcttcacaacaagatcttacatgattatattacgatgaaaaaatatttatatttgtaaattacttttattatatacgtaagttacttttatcatatatataagttacttatagatttcactaaattacttcttagacatataaaagtaaattcaataaagtctgcaagtaatttacatatattataaaagtaacttaaaacaaaacgtaagtaactttgtcacgacattagaagtaaattcgttgtagggataaaaatatactttatctagaaattaaatttaatcagcacagatcaacacacgtaagtttaacaatttttaaaagtaacttcaatgttaattggaagtaacttttgcatggttcaagttgaaaggagatgctagatagagtacaaactagctaccactagctgtgtagtcacgtccaatgaaaaaaatgtattaattagagttactttctttttgttataagttacttctataatatatgtaaattacttttaggctttattgaattacttttatatgtctaagaagtaatttagtaaaatctaaaagtaatttagatatattataaaagtaaattattatttttcatcaaaatataatcatgtgagatcttgttataaagatttaattgttatgaatacaacggtgtaatcggatcgtagatcggataagtagtttaagagaaaattgtatttgaagtataggtggatagtgcctcttatagattgagtggtagctggtttagacaaaccagctaccacttgctgtgtagtcacgtcctattttatactccctccgtattttaatgtatgacgctgttgactttttgacaaacgtttgacctttcgtcttattaaaaaaattatataattattatttattttattgtcacttgatttatcatcaagatgacataagtatttttatatttgcataaaaaatttgaataaaacgaatggtcaaacgttgattaaaaagtcaacggcgtcatgaattaaattacggagggagtactaccttgaaaagcaatatgcgtttttgagattaataacgccttctaagaaaaacatcatattcaattcatggaatattgatatgaaatattgcgcatattattatttgatactaactaaatcgaggtaaaatacactgcttaaccaaaaactactctatcggattgcaaaacacattttgggatatacttcgtatatttttttaaggaaactttgaacacaaaatgtatttttaaatacttggtttggctgcttgaatatcatgtgtagatgtctcaaaaggtactttcaatttcataattttatttttagtttttttcaaatattagaataaaaatgcacaaatgtgtaaagtgaatatatacataatgttagtgctatgaaacacatttatagtcattatgatgtatttactacgactccatggtaacacaattacagtgacagaatgacgatattaacgctcaggtgaccactagtccattattcctgtggtattaaattctattattcctgcaagtgcgatgcacaaaaagctgaggacaagaattggtggcctgggaatttttccctcctttttttccacaccagctggccctcggagattattatcactttttccagctggctctccaaagtaaagcggattttttgctgtgtttaaccaatttgttattggcttaatgctaggcttcacttctactttgtgtgttggcaaattggtactggcagattctttttttagtcaccacgtgcaatgtactagtactatatactgagtgaaactctatg

SEQ ID NO: 44616 - DNA, 2230 bp, Oryza sativa
  unsure (1)..(2230): unsure at all n locations
aactatacattgataaagactagggaatcattagttataaatgattgcgatatggcctctgtcagattgtgtacgtgagcctctcgatcttggatggaagatcaaatgcatgcggggtgttatttattgacatataagaaacgtgcaagttaattaattggattagtggtttctccaagcttaatgatgcatcgaaaatagtttcttttcagaactaaaaatttgtttgttcaactcctctttagttgagatgataacatcagtagtagtagatgagaacaggacatggcagctgacaaatcggatcaaactagatcagactattaagaattggtcacatttaaaaaatatagatttggccagttcattttgttgattctatcaattctgaggctccgttcatttattatgagattcagattctacatcaattttcgttagcacgtttttaaaacagctaaatggtgctaaacaactaaacttcctatatagaaaaattacttcgacaagtaaatccatttttcaagtttatactaattaaaacttaattaatcataagctaatttttttcgtgtgcacttacttcatcataaccatcatccatctcaaacgggacctataatatatattgatcaaatatatggtaaaaaaagaatcatctcctattcagaataaggtaaaaataatgggcatattccttgtgccataagaccatatagagctagtcaaatgtaatatagtgacatgcatgtttggccatttttagggagatatccggttgatgctcttatgctcctactaggggacaactttgtgctccccaccatgaggaactataggctctatatattatgcatcaatccaaaaccgcgaaagaaaatttttgccaaaacagaaagcccctggctcttgcaaccgataatttttttctccaaagccatgaaattccttagcatggataaatgtgtccccttttagttatctcgtggtgtaactcgttttaagaccgctatatttgatacatatcgtactataaaggctatgtttggaaggagtttttactatctactgttttttttcaaaatctttagctccttaaacgatgtttaagatttttactcaaattatgagaatatatggttgtatcacactaaaaagccataaccatggaaacccataatttccaaaatctcattggccacaccccagttattccttgttactagaatttatcagtttccagaacaggaccaaatacagttgtacattccccctggataactacaatccaaacccaaaaagaaaaaaaaaacaacaactgtcaccagaaatattaaaaaaataaaaagtactagctcatattcatggtcaacgagtcaacggtcgtaatccccctcgccgaagaaancaatataataataaagaaataaaaaaaaagaaggatcatactccaaagaaggggtattttgcaaccggcccgaatcggacggccaggataacgcccaccttatcttccgggaatctccagagaaaccccggcgaaaccaagaacagcaaacacacgcggccgacgacacggtcaccgccagtgggccccacgtcccctatcccctcttttttttccactcgactcgactcgacgacccacctctccaccaactcgcaactccaccaagcaaaccaaaaaccccaaatcccccaccccgaattcggaattcccccccaaatccctcgccgcccgccgattcagccccgcggagacgcgattctcgaaggaattctggttcccggaggcggagcaggcggagaatcgtttggtttttcttttgggatgggggagggggtgaaggcgatgctggcgcggccgatccagctggccgacgaggtcgccaagcagtgcggcgcggcgcggtgcttccgcgcggagtgcggcgagctcaaggcgcgggcggacaagctcgcggcgttgctccgacaggcggcgcgcgccgacctgtacgaccgccccgccgcgcgcatcatggccggggcgcagcaggcgctcctcaaggcctcctccctcgccgcgcgctgcgccagcggccacccgcgcctcaggcggctcttcacgctcagccccgccgcggggttcccccgcaccgtcgccctcctcgacaccgcgctcgaggacgtcgcgtggctgctgcgcatctcctcgcctcgctccggtggtggtggtggtggtggtggt

SEQ ID NO: 44617 - DNA, 17715 bp, Oryza sativa
cccaatatacaagacacgagagatggaaggcagataaaaaagggacgaatcaatttgaacaatggatttgttgttccatacaacaaagatctcctagtgaagttccaagcacatataaatgtcgagtggtttaaccggtctaagtcaatcagatacctatttaagagcatctacaatggagatgaccaagcaacagcagttgttgaagaaactgataccgcaaaagataacgatgagattaaaaggtatctgggatgtagttacatgacagcaactgaagcgtgttggcgaatattcacatttcctctacactaccaagaaccatctgttcagaggctattcttccacgtggagaatgagcaacaagtgatttttccagactcaacagacctacaggaaatcataagacacccaagatcaggggtcactatgtttactgagtggatggaaacaaacaaaaagcatgaagatgccagagaattaacatattcagaatttcctacaaaatggacgtgggttaacaaagtgaagaaatgggtaaggcgaaaaggaagaaagaaaattggcagaatctacaatgcccatccggcaagtggagaaaggtactatctcagagttatcctcaacactgcaaagggttgcacaacatttgaagatatcagaactgtcaatggattcgtgcactcatcatacaaatcagcatgccatgcactaggatttctaaatgatgacaacgagtggattgagtgcattaaggaagcatcctgttgggcatctgggatagaattacaacaactgttcgcaactattttatgccactgtgaggttactgacccaaagagtttgtgggaatccatctgggaggaactctccaaagacattcagcatacacaaagttggctcttgaactttcctgcctcctgcctcacgccttcacataaaaggaaatgtgctttaatagaaattgagaagaacatgcgacaagcaggaaaatcacttaaggaatacactggaatagagcccccaaatgtggcaaagttaagtgaaattgagaacagtcttataaatgaagagatgaactatgacaaagagaggttgaagcatcagcacctgcaaatactaaacactctaaacatagagcagaaaaaggcatttgatgcaataatagaatcggcacaccaatcactaggcaagctaatatttgtggatggctatggtgggacaggcaagacatacctttggaaagcaatcacaacaaggttaagatcagagggaaagatagtaattgcagttgcatcaagtggcattgctgcacttctgcttcaaggaggtagaacagcacactcagcattcaatattccaatcaacctaacagatgaatctacatgcttcatcaaacaaggctcgcgtatagctgatctattaatgaagacatcactaatactgtgggatgaagctccaatggcaaacagaaactgtttcgaggcacttgacaagagcctaagggacgtacagaggtttagaaatgagaatagttaccaaaagccctttggtggcatgacagttgttctaggaggggacttccggcagatcctccccattgtgccaaaaggaagaagggagcacactgtaaatgcatcaatcaaattctcgtacctctggcaacatttcgaggtgttcaatttgacaaaaaatatgcggctcaattctgtatccaaagatcaagcagaacatcagaagactgcggaattcgctgagtggatactacgaatcggcaacggtgacacaattttattagatgaaaagggttgggtgagtatgcctagtgacctgctgctacaaaagggagatgatccaaaagctcaaatcgtcgatagtacctaccctggcctacaatacaattgctgcaagccgaagtacctagaagagagagcgatattgtgtccaacgaatgatgatgtcaatgagctcaatgagtacattatggaccaaatccaaggtgacaaggtaacctaccttagccatgacagtgtgagcaaatcaatgtcttacagccatgagatggaaatgttgtatcctacagagttcctaaacagcttaaagcaccccggaattccaaaccaccaacttaagctcaaagttggtctaccagtaatgcttcttcgtaacatcaatcaaaatgcagggctatgtaatggtactagaatgagaattacgcgattcgggaaaagggttattgaggcagagattataaccggaacacacataggtgatatggtatgtatcccacaaatcatcatgtcaccaaacgaacgaaaatggccatttgtgctaaacagaaagcaatttcctctctcggtgtgttttgccatgacaataaacaagagtcaggggcaaaccttaaacaaggtcggcctctatttgcctaggcaagtttttactcatgggcagctctatgtcgcagtctccagagtcacaagcagagatggcctgaagatcatgatcgctgacaaagaatgcccaggcgaaggaatggtgaaaaacatagtgtacaaagagatcttccagtaattcctactacttgcggttactctatgcagtgttcttccccgtactgaggttgtaataaaattggccgtgctgttgttccggccactagctagttttacctactgatgttgtatttttcttactgttttgcagttaatttatgcaattttcctactgtttcctaaagcatgatactgagactatcaatcaatggacttgcggcctaattaacatattgtgttctcatctctctaattgaattggcattgaaatctcttatctcaaattggttagggttatcacctatcactgcagctctacaccaaatcgaggccgcatccaggtatccaactatgaactatccaagggcacacgcacgcatagcgcaacaggtcgaatgagaagaacaaatcaacaaacacagtacagggtggtggttcatcgtaccggcgcgttggagccagtccacccggtgccgccgccgccgccgctgcatgccgtgttcaccggagtggatggaggaggccccgtcgacgaagcccatcgttcgcgcttccggcgcggcaatctgcgccgcagcgctggcggcgacggccacctcaatcccgtcggtccggtgggtcgacggcgacggaggcggtgactcctcgccggagaacgcggcggcggagcaacctagcagccctcctcgcttctcaacggcaagttttggagaattttttattaaaatatttataaaaagtaatttttattctgaatgatctgcagatcaaaatgaaaattactttttataaatattttaataaaaaatcgagttttggatgcaccacgatggcccatccatgtgtatgggccgagttatgggcctaaattccggcttgtttacttatatgggcctagcttccggcccattcaaaagtttgtttcgttgtgcaaaaatctcggcttagaggaatggaaccatgccgtttacttgcactgacactgatataagtttttcattccagtttgattcgcttaactgttcgaatttctcaactcacactatatatttccaactagaatcatgaacccattccattccatttcaacgaaaaaccagagtcgaatcttcagtctcaattcataggacaaaaccaacgcatcaggccaattcaattcagaagatacatacacccatttaattctgaagtacgtaccagtttcattagaactataataattaacactaagttgtactgttgtaatccctgttgtgtgcatgccttgtgtcactcggtgctgcatgcatcttcatactgaaatgtttgcattccaatatttgtgacaacttaaacaactccttttatagggagcatgatcatatacaccatcatgaaaaaacactatgacctaatgctgattataagttgtacggcttattagaaaaaacactacgagtagaacttttataatgtatccttagcgatttaaaaactaatgtttataaataaactttaattaaaaaagttctaaaattccaattttggaaaggactcataaaccgtaggacaaaatatggaaccttagagggagccatagttaactgaaatttatagccaagctattgtagaggttttctccaagaagcttgcaagaagggaaaaagaacaaaaaaagtacccagatgataaggttctagaatttgttacagaactgcacatagcagtagcaaatccattatccatatgaaagcaacagactcaagccgataatattctaccattggcatctcactgctggacagcatcactcttgccgctttccacgtcttcttcttcttcttcttgctgacttctgcccatgatcttcagcttgtccaagtgattctcttgtacctacaccaaataaaatagctcatattttttttcttttaaagaaagtcctagaagcaacaattacggcattatctgggatcaagggtaagagcattcatgttgtcgtcggcaagtacaataagacagacaaaatccaaagcaatacagcagtataataactacttgtttcgaaattggtttggtcaatatcttattacttgcttcattcccttcttgttttgaaattaacttggtcctaatgcaatttgattattacttttttatagttaaattaaccgcatgataacaatatagtataattagaagcataacgaggcagaaataagatttgacaacatgtttactgatattaatatctaatgcaatttgattattacttttttatggttaaattaaccgcataataacaatataatataattagaagcataacgaggcagaaataagatttgacaacatgtttactgatattaatatttatgacgaatgcaaacgatgttataccttggtcaaaattttagatatattaatcacaggagaatggaagtggcattgagacaacaagaaattaacttttggccaccaccgaaggcattttaatacttacatggagctgcatttgtctaagaacaggtcattatcaaactgttttttaaggaaaaacatttcctgcttaatgaatgggcagtaatcctgccattttcccttaaaaaaacaacagtttggttgttcctacaagaatccactgcacagactgcaacagtgcattctaacaaagttcaagtttcatttttacttttggaacagattaagtttcattttccatctatggcaagtagtctaagatttatcttcagacacagtgcagactcttggtagtactctaccattgcaccgcaccaacattaagtttaccgtcctgaatcaaggttaccaggttgctatgttcatcgaatggtcattcgtcagaccatccaaaagcaagaactgtcatatggatcaggccctaaatctttaaaaagaaaagaggtaatggggtcaaatatcccaggaaaattatcattacctagttatgtaaatggcaatgcagattggaagataggtttcaaaaaaaaaaagcagattggaagatgaactaggcttatggcaaaagttgttgatcgacggccaaatatatactccctccatttctaaatatttgatgccgttgacttttttaaatatgttgatcgctcgttttattcaaaaaatttaagtaattattaattttttttcctatcattcgattcattgttaaatatacttatatgtatacatatagttttacatatttcacaaaagtttttgaataagacgagcggtcaaacatgtgctaaaaagtcaatggtgtcaaatatttagaaacggatggagtatatgcaaagctatgtagttcgtaatgtgaaatgtgtacacaatttgcgatctgatctctatgtctggtggtgccacacattttttggaagatatacaagtgactgacaaatagtccacatagcatcttatatcccatcttgtacgagttatgtgatgagaagaatattatggtgaaaaatgtggcatccttaaaatttgtcttccattataggagatgacctcctgttatgctgatcagagacctgaactttcagcatactgatctttctcattctgtcatgtggtttcggtacaaacatagaagcagatttactgtgaagcagattttcggtacaaacatcccctcgagggattagattagtttcccatttactgtgaatcctatgtacaaacatttgacctccagtgatgctggacctagtcactaatatacttttgaatagcaaaagtacctaacaaaaatgagacctctatgtgtggctattagacaattggacaatataactaggcaaaaaaaaatgaaatacttaaatttctacaacagttttgctgtcctctaatgtcagtcgctgcactgaatgcaatatcctcctaaattaagtcagcattgctggtaatgatgcatatactaccttgctgtaactacaggttaattagcaccacaacacacaagcaaatttcaatcattatcagaaaacataaatggcaacagggagcagtaggtgcgaagtacctggagcgctgaaaaaatgtttggagatcccaacggcaaggtagtaacgcatgaaaacggcgctatcaagcttggccactgccagcaccttcttcctcctcacatcaacagcagtcagaaatgccgccttgccattccccatgacgggttttgtcagcacgtaaatgacatcgtcatcgatgctcatggcagggtaagccatgcccaggcgtcccaatggcaacctcgtcgtggttgtcgttgccgcctccatggccttatcatcatcatcctctttaagactttctttgctcacagcacacagcaactcataagcctttgggttgtcagtgctgagctcggcagattcaacagcgcagtcgcggcaccaatcgtcccatgaggtgaccgggatcggcatcctccatgtggtggccttccagcggccatggaccaaggtgcgtttcaggtccttgcattctcgacggcgcagccattcgaggaacgggtcaggatcacagtcacctggtggcgtggcgctcacgatcttgggcgtgacgatctccatctcgacggacttgatgaagctcttgtctcggctgacggcgacgtcgccgcagtactggtcggtggtgttgaggaaggccctgtggctgttgctcttggccggcagaggcagcggcatgtcatggagcttggggctctcctggagcacgtcgcagaggaggatgccgcgccagatatccacccaccctaccatgccatttgcacctgttcccagcctgatcaccttgctcgtcacgtggtgcacttgcctgtgcaccgtctcagggatggggcacaccaagtccctcatcagtggtccctccacagacaccatctgcgaagtccatctcccttgctcgccgttcggtttggagcggtacagatgcagcctgtggatggttttactgccggggatggtcctgagggcggtcaccacgtactgctcgccgccatcggcacagctcagtatggcgatctccttgtctcccagggtatcgtgcgacgggttcgggagcagatccagtctcgggcggtgagggggagaccgcgccatgtagacgaagtagtcgttgtgggtgagggacatggtgccgacgcggtcgatcgggatacggaagaggaagaggtcgccgtcgacggcgatggccttgggcaccatggagggataatcggctggttcttgcagctgcagggcggggcagtagacgtagaagtcggagaggaccggcgggagggcggcgcggaagctgacctcgatgggatggccgttgctcgtgtaggacgtggcggtggtggcgtcgcggcgggccgccctgtagccgcggacgttgagcaggacgcagctccgggtgccctcgtggacctcggccgaggaggcgacggcggccatggcaaccgatcaatcgaggatccaatcagaagaggagcttgatcgatcttggtgaggattggatctgggatcttcggtttgatagggttacgaagggaagaggattttgatccctcgaggggatatccctcgttgtttgcgtgtcactcaaatggttatgaaaaaaattaaaaaaatttaagaagatgtattaatatgtgatatattactccacaaacatgcaagtaaaaattcaacttctacatctcgcaatgaaaaaaacaaatttgactctgaatatacattaactagctgctgttcaatttgtttttttcgttacgagatgtacaagatgaatttgaacttacatgtttgtggagtgttatatcacatgttaatacatcttcccatttttttaatctttttataaccatttaagtaacatgtaaagaacgaggagatatcccctcgagggattaaaacagtttcccggttacgaggtaggggaaagggaaagtattacgctacgacgaggccttacgcttgcaggatattggaaccatttttgccactcttgccatcggaccatgcgaaaggtccattttacccctcctctctccctccatcccaaaatataatcatctattatattattaaaatagctttgaacgaaggcaccacgttcgctgtggaggctagaaattcccacattaatcggagaaaaagagaaaaaagctacaccgttagattacaatgaatataaattaaagggtgtagatttatcaaaaaaaagaaattttatcagtacgaaacaaagtctattcaatacataataggaaagttactctaatctttcacgtacgtgcatacatgcatgttggattctcgacgtcgcagccattcgaggaacgggtcaggatcacggtcgcccggtggcgtgccgctcgcgatgatcctgggcgtgacgatctccatctggacgtacctgatgaacctcctgtctcggctgacggcgatgtcggcgcagtactggtcggtggtgtttttggaaggccctgtggctgttccccttcgccggcggcggcagcggcacgtcgcggagcttggggctctcgtggagcacgtcgcagaggaggatgccgcgccagatgtccacccaccctaccgtgccgtctccgcccgatcccagcctgatcgccttgctcgtcacgtggtgcacttgccggtgcgacgtctccgggatggggaacaccacgtccctcatcaatggcggcggttcgtccacggacaccatccgcgaggtccatctcccttgctcgccgcccggcctggagcggtagagatgcagcctgtggatggttgtgctgccggggatggtcctgagcgcagccaccacgtaacacggctcgccgtcgccgccgccatcgccgccgctgcagctgagtagggcgatctccctgtctcccagggtgtcgtgggacgggttggggaggagatctagggtcgggcggcgagggggaggccgcgccgcgtagacgaagtagtcgttgtgagtgagggacatggtgccgacgcggtcgatcgggatgcggaagaggaagaggtcgccgtcgacggcgatggccttgggcaccatggaggggtagtcggctggctcttgcagccgcagggcggggcagtggacggcgaagtcggagagggccggcgggcgggcggcgcggaagctgacctcgatggggtggccgttgctcgtgcgggacgtggcagagaaatttcacgagaaactagttggaataagttcacttgaggtcccttaacttgtcaacgaatctgattttcatccttcaaccagaaaaccacgtacagcggatcactcaactattaaaaccggtacaaacgagatctttcagcggtttagatggtggttttagctgacgtggcatctgggtttctggtttgacttggtcctcgtcctacatggcggtgatgtggcactgaaagcaaaatataaaaatttaaaactaaaacaaaaatatgaggcccacatgttagttagacaaaagaaaaaaatagtgggacccacatgtcagtgggtcccatcctcctctctatccacgaacgacggcacgacagcgcttccttctcctctctccctcccggccatcctttctcctcgagctccctcgcggcctcgccggcaggcaagcgcacacagagggggagaagggtggcggccgaccaggaaggcaaagacgggcgtgaaagatggagatgaccatggccgtcatgagggacggtgctacgctggtcggccaccttggcgtcttgtagaaaagggggagagcggtgagaaggacgatcggccggcgggctctgccaccaaggatccaatgggacgccgcctctagaggcggacaacgatgcgccctacccgcgcgcctcaactcctgtccctagtgttgtcgctgcctgaggttaggacaagatgacaagagcatgggaagggggcggcggtgacgggtccaagatatgcgcgaggttgggacgggacactgcagcgtcgtcatcatcctcctcctcaactccggatgtgccgcagatcgagatggtctgacggcgttgtgcggctgcagcgacgagaggaagaggaaggggccaccgtgagcctctaccttccaaccaccgtgagcctctctcaccggccgtcacccttgccggtaaccacccttctcccttctctctgttgtccgtcacccgctacgcacctctccctctgcccgtcgccgtcgagcccccacccacgacccccggcctttgctggcctccatgcctcctccctcccctcacgcctcgccgcgcaccgctcctctcccgtctcctatagggcgccgcgcgccgctgcctccccatggcacgtggagagaggagaggggagaaatgaggaagaagaggagggtgagccaccatttttaattatttttttgtgtaattgacatgtggagtcataatttttattattttccaaatcaaattgccatgtcaataccatgtcagattaagaccgagtcaaattagctacgtaagtgccacgtcagctaaaaccgtcgtacaaactgccataggacctatgttgcaccagttttaatagttgagagacccgttatatctggtttccgattgaaggacgaaaatcatattcgttgacaattaaagagacctcagatgaacttattccaaactactagtttatacggttcgcgtgaccatatagatggccaaacagcccggggcatggcccgggccatgccacgggtttttggcccggtccagacacagcacggcccgaatggtgtcgggttcatggccgacctttgggtcatgcctaggcctctgcctcggcatgatgggccagcccggcatggcacgaaccaaagagataagggacacaaaatagacttatttcaaggagtagcacggtgggatttcgtgacttattccaaggaggagcatggtagaatatacttgtcatggatgagttgtaggtttagcaatagcattaacaaatttatcttgattcgtagttaacaatagtacgaccacatttaataatttaccatgttttcacgcccatcacctccatcattgttaatttttaaatgttccatttattaatatgaaataagcaatttttttgacctggtgaaataagcaatattattataataacaataattagtcatgattatgtcaaacttgtaaaatgtatcacaaagattatattcttatgtcaaagcaaatttattttaaaaaaaagatactatgtgcatgtcattatatcgagtttactgtctatatattcagtaaataatcccagcacttcacgtattgacgtatatcaatctcaccacctggctggcaagtggcaactctcgctactgacttgcatcagtagttacttttgaaatttgaaaatacgaaatttcaatggctttctaggtaaatactactatgtatctttatcgtaaaaggaccggagcaaattacctgtaaaaatattatttatttagaggaccctaaaataaaagatctttataggggtgcatgtgtaaaactggtgggagactaaaaaacgcaggtgatatttccaaccgaagaagtcacgtgaacacactatagtcccttatttacaggaaccttaattcccattattcatccttcatccaacggttcataatgatttcagctagatccaacggctattattgactgagtgacgtggcttattctagaatcatatcaagtttcacttttcacttgtagagatttgataatatgccatttaatttgcatgattatccttcgcctcgggtgaccagcgcgggggagcaaaatcgggcgctcccccccctccttggcgacgcgcatgccctctgggccccaccatttgtcatgcttccacctgccacgtgtccctaccaaacatgtttcactatgtatagatctaatgttgcagtgaattgaaacattttttttgcaacgaatcattcacatattttgaaaaccctctattaagagaattcgttttattttttgttccgccaaaaatgtttcacccagtgtactcacaatgtttcactatgctcacaatatttcactatgcatagatctaatgttgcagtgaacgaaatattcttttgcaacaaatcacccatatattttggaaaccttctattaagggaattcgttttattttttgttccactaaaaatgtttcacctagtgtactcagaatgtttcactatgtatagatctaatgttgcagtgaattaaaacattctttcgctatttgctgaaatattgtttttatataaggtgaaacaacgcccaatttaaacgattgaaacattttcgatctacttagtgaaacaattccgatatacttggtggaacattgtgcaacatttaaaaatatttcaataacaagctaaaaaaaattcgtcggaatatatccatgtgtggtcttgttttgaagatttagttgcaacgaatttaatggtgcaatcggatcatgatttggataaataatttaagaaaaaaaattagtttaaagtggttttgcacgcatgggtggcgctgacatcatgctaacatcagcgcccgatttttgtacgtctagatcgcatgcccgatcggtagtcccctcctaattgcaatgctttcaaacaaatttctcgtcttggcaagggatggatttttttttctctagctcgaggtttgggtgtccgaatttgggaactccaattccgatttccataaaaaaatttatggggcaattgcatctgtgcccccactttcgaagccaattgttgttttacccctattttttagggtttgcagttttaccccaccttttgaatctgaatcagccgcgtacccccacttctaatagccagtttaacggtgctagttgtagaaaaattgacatttatacccttggtggttattgcatttttgcccctatttttttcagctttgtgtgattttgcccctattttgtgatttcagcttgtgtgatgagcatcgaccaaatatgagcatctcttgtgatttttttactttaacaaaaacaattcacaaatactaagaaattacaaaacttgaacaaaaatcacaaatactacccttcatggtcgatgctctggaccatgaagagaaagacgcatgcgttagtgaggaactgcagcggcggcgcgaggtagttgaggcggaggcgcatccacccgacataggaggcggcgaagaggccgtcgacggcgaggagcaacgccacctcctcgaggtgccacccctggaggtaggcggcaaactcgacagcgagcagcagcagggacagggcgaggaacactcggatgcagccgtaggagcgcacccgcagcgctatgctctcccccaccagccctcgacgcggccgccgccgccgcctccgcctcgcccgcggccgccgccaccgcctctgcacgcgctcgcggccgccgcctcgcccgctcgttcacacccgcagccgccgcctccgcgcgtgcccttccgctggagccagaactgtcgcctccgcgcaaggaccaatccggtgggagaggagagctggttggatgcttatccattccctcaaaggtagaacggtaaattgatatttcataaatcatttttcatttccatttgtttttcttaacctaaaaatgtgggacccatctaacgggcgttaaaactaagggcaaacggttggttcgtttttaaaaattgggggtaaattgcaaaccctaaaaagtgatattaaaacagtagttgaggttgaaagtggaggcatggatgcgattgtccctaaatttatttaaccaagttcgagataacatttgcacattggcctttggaggacatgaacgatcatatatgttgcaacatatttatgcacaaaaaagttgctcaagaaccttttcacggtgcaggaagaacccagaaaggctgtagaaaaacccaaaatttctgtgttccagtgtttggtttctactctaaacttaccagtaagcttctcttcctatactttttagataatggatcgataagatcttgcctctacagtctacactcaccgtgggtgcacacatccaaaggataatacacgagtacttagctcgaacacctcataacgagttgaaacattacacacaaggttccgaacaaaacataagaggaagactaagcttcaatccctgtttctaaagttccaaccacacttagccaaaaaaaaaaaaaaactccctttactctcgcttctaacagcccgcaatacatatcaacgccatcttccataaatagcagcagcgaccattgatctgtccaatatgttcccttgaggacgacctgcaaagaaaactttatctccacatcatttttattcaaccatatcacgcgacaaagagacaaaaacttgtagccttaagttgaaaaccattcgtggaagaagagcaaacaatgcaaatgcataagaatgtaattacctcgatgaggaacggtacaatggtgttgctggacaatggatagcagcatcccgcaccattcttatgcccaaaggtaacaactagtaaagattttgcagctcaagacagtgcaatggtgatccaatcccatagtttctagttgcagccatggtattaccagaagatggaagggtgcccaaaagtaacaactcaagatttttcagctttcttccagcatatagccaagcacctgcagactacagctatgttgtgatgcaaaatattggaagctctgctcaaccattcaacagatgtgcaacagtgcaagtattccctctgttttttaatagatgacgccgttgacttttgaacacatatttgaccattcgtcttattaaaaaaactttttttgggaatacgcaaaaggattgcgcagctttgtattaagaggaataaaatttacacaaacggcaaacaaagaagagagatgggggagagagaaaagggaggaaaaaaaggtattgtgcaaatgtataagatcgtcttattaaaaaattatatgcaaatgtataagatgcccctttttaaaaatttgagaaccatattctcagcttttgcactgctataataactccaggaatatgttaagtcacatacttaaactaaaattatggtcagataaatttcaggatttcgcttgttccaagtgaatcccagatttgagtagaaactccaaatctccaacgctatgctaccatacaaataactcggttcttaaacacagtctgacagtgacagccatgtgcgcatatatgattaatgccctaacatttctaatagaagatcatataatgcagtacggtaggctgaatatagtcataaagagtagcaagaataaaacgaaaataagtaatggaaacgaacatgatagaggaactttgatattgaggatccaactttgaccatgcgtcatgcccatcttcaacgtactcaactgcttaagtttttactaggaatctaacatcatgcagtctctttaggacacagtcacacagcataatagaccaaagacatgtctggaaccacttgattgaatttacaacaaagatctctgactaagaccatgtgcattagttaaactgtttaaagatgttcttgcatttgataccatttctacgttgcagtttagttcttattcatcacaaaagctgaatctcattcaaagataaatgtactcatttggaaaacgaaactctttatcttaaaatcctgactgcagaaaatatttcaaagacatgagtttaccaacattaagatttattcccttgaagtttatctatataccactataatacagcttttactgatatctatcaagaaaaaaacaacacagcgaaaaaggtacccccaacagaaacaagagaaaaaatatatatagactacctcaaacacatcttacatcctaggggggaatcactagaggcagagcaaaaggtcagacaagacttgtcctgatgcacagctcaagcggtgggaatctcacaggcacaggatggagagaatccaaggaggtgtgcatactatagagcgtgtacatatctttgtgaaggtttagacgctacttgtattggccactttgtaggagagagggcgccacgttcagagggaagattttgcaatgctgctgtaaaatgggcacgtacctccgctgcagtgctgctgctccagcctccattacttggcatccttctgccttgtgctccctgcaccgtccactgccttcaccgtggcttggcgaaggtgtgcatccactgcggtgaaaaatccaaaatcaatccagagttctcgcatttgtcagtcaagaaaacggcaacactgtgtgcagtttgatctggaggaagaagcttagtagcagtctagcaggtaaaggcattatacttctcttttacccttctgctgcaacatatatatgtatatatatactgtttctaccatgaatttaaccctactcttactcccttttttttcccatcatgtagtgtcaagagttcagggactgcaactccatatacaggaaacgacttggaacagctagaggtatttcctttcagtagtgttcagagataacattctgagcattgaattttgggctggaggttttggctgctgtttattagatggtgatctcactgtttccttgcttaccatggttgaggactacccttgctgctggtgttcttgattcagggtataatggagtgttggaaacctgtaataggtcagttctagtttgctggtatccccagccccaaaactgtgtatctcaactatgctttctatagaaaggtccggtcttttctctaaaagaacattctcagaatttatggaaagatttcaactgatctaatatttacggtttgagtttgttcttaaggaaatagatacgtggaaaacattactacctctgtcctagaataattgcatttttaccattcaaattttgtcccggaaatattgtatttctagtgagatagcatctaacaaattaattagatggaagatatccttttaattaagtttatgtatggaatgtgtgcatgtccagtgtggtcattacatagggttattgtggttatttgtgtatgctgctaatctgtctctaatttcctacaaatgcaattattctaggacaatagtttacattgctcctta

SEQ ID NO: 44618 - DNA, 1293 bp, Oryza sativa
tgtatgcaaagtgctatatattagctcggttctttattagttgacgtcccgcaactcttgctacgtctatatttcaatatagagcctggtcactcatgtttggacgtatctacagttcatgtatgaatattagatcattcggtttaccgtttaaacaattataattttatcattaggttgtaattgattttgaagatttttaaaaaatacaaccaaaatccatatcgtgaaactgtctctctctccatatatatttatacttatattaattaggcactttaatttttacatcatattatcatcaccttagatcttaatctgttttaatattatgggcattgtttaagctgatccaaggggctctaggaaagcccatttaaagttggttgcgaccaccaatccaatttgtcacgctcgtcctagttgggcactttgactcctatattaaccgggaagatttttgtcattggttcaatgaatcatgttattatagatcttaatttgttttaatattatatggtctttgaagtgaatccaagtgcccatttagagttagttgtgaccacccattcaacctatcacggccgtacgtttctcatccccatcgtacctaagccgacagctatgtatatggtgtaggatcgagatgtcgactaggaggggggtgaataggcgatttaaaactaaataacacctaatcaaatctaacctaagttgctaagcttggtgagggtgaattctaactaagcaactaagttatgttttgtaaacctagggtgatagtggctcaaatatatctctaggaaagtaaatcacgctcctatgtcgatgttttgcaatcctagggtgatatgatctcaagtgtgtctctagaaatgtaaattgcacaaatgtaaatgcgacaattaaatgagacaatgagacaagagatttttcaccgaggttcggaaactcgccggtttcctactccccgttgaggcgagcccaactccaccgctcaaccacgaagccaccgcacgcccccttcgtcaaggggtgggcaaggcgggagccggcccacggagaggactacccaaacctcgatcactcggggtagttcttccttcactccgaaggtggtgaactccaaaccactcacaaccggcgccgggcctcctccacaatcttctcggagaggtcaccgggcaactcctccacaagccgtctaggaggcggcaacctctaagagtaacaagcaatgacccggtgtggagatgatcaagtgccacactagctctacaatggaagcaaatg

SEQ ID NO: 44619 - DNA, 3054 bp, Oryza sativa
tagaaaactagccgttgtagccctgtcagagggccccatcggcctggccggtcagaccgacatggggtggccggtcagaccggcctcggctcagtcagaccgccatcggctcggtctgaccgactacggctccgtcggctctgtatcggccatcccgagcagcatcatctcggcctccaggaggccggtctgaccgggaaagtgccgccggtcagaccgccactatgtagccggtctgaccggccagggcacgccggtcagaccgaacccagtgaatttgtgtaatgaaaaagagagcacaaatgaaaatgcaatgacctaatgtggcaattaaaatcatctctttgctaggtcattacccctcttaatagtacagcgaaactaaaattaaactagcaaatttgatcgccctacacctcgatcaattctaaattaaagcgctagttttaccgtcttctttccctttgctttgcgccgtcaattttaatccatcgataatcatccatgcgcatatgacgtggacttaacttaaaatatagctcaaagacaacggttagtccacaattagtgcttgtcattaattaccaaaattaacaccgggggcctagatgcttcaatctccccctttttggtaattgatgacaaacaccacaaatatatataatcaaacatagagcacatggacatatattgtattgacaagcaaaagctccccctaaacatatgcataacaatcacaaatagcaaatatgaagccaatgcacaattcaatttcacatttcaacatatcacaaacacaagagcaatatctcaatgtgaacttcaagaaatattcattcatgagcataagatggtcacaaatatatcaatgtcacaccaaccatccatcatagcacaagttcacattaagactacataaagggctcacaaataaatataggctattacaagaccacgaagggtccaaatgacatagagaacaacaaaacgaaaaaggaacacacaatatagagtaatagcccatacccataccaaatatagcccaatcctccttaacctattaaatatgaggtgactaacctcactactactagacccaacccacaaaacataaaacacgctattctcccccttttggcattaagcaccaaaaaggtcttcactcttgtggaggagaaggaggacgcgccgaagtggaaggatgagaagcatcacggcggcgatgatagacaaaagcttgggtactctccaaggtttggacgcgagaatccaatacacccaccctagtatgcaatcttcccaccgaagtattcaagttgccaacatcggtgcgcaagccacgaatatcctcatgcaatgcttcatgcccggtggataagcgttgaatgctttcacttagggtattaatagccccaaggaccgggttgaagaagtcatttggttgcattccaaagtaggcatattgtggatggaataaagtacttggatcatacccttgaggaggagggggggctgcacttgagcttgcaccttgatcaaaagttggttggcgcacacgaggagctctaggggaggagagttggagacgaggcttgtactccttatgttcttttaaattttgaccaatttgtcccaacttgctttgaatcaacctcattatgtaggaagcataatagattccttgtccaatagtcccctttgagatggcaatctccttcatcataaggttgataacatcaaaccgacgaccatccataatggcatcaataacatgccaagcaactccgcgtatatcatcattgttgccgcatcttgggaggatggtggcccttactatgcggttgatcacacttgggagagcccttaaacccgccacctttccatatgtgtgccttcccccttcttcataaaactgagaaaagtgatcaatggggaagggattgtgggtgtgctcatcatgaaggtcatccccgttgttgaagcgaatgtgcaagagctccttgaattcacggcggttgatagagcatcggagggtccccgacatccacttcattgcatcacaatcgccggacacccatacggtggcatagaattgccggatgagatcttcatcaaaaggttgcttcatggtgacaattctatcaatcccaacggtccggaacatctcttgcaaattctcaaactccggtgtctcaccaatgtgcctccaagagatccatttgtgttcggcgaaggctttgttggcatacacttgtacatacacggacttttggaaccgtggatcattacaatcgttaggcctccggaattgatcatgatgacagaggatagtgtattgttgagcattcctcaaattaagcacaaattggatggaggaatcgagaggactcccatcatcacttgcctcatcatcttcaccatttccactctcattgtcatcaccatcatcacttacctccatctcatcaccctcaacattttccatattgtcctcatcactttcaacatactcatcttcgcttgattcctcattctcactaacgggatcgggcgtgggagcacgacgaccatgccgagtgcggggaggcatagctgaaaaacaaggagcaaaggatggatgagcaacaattttagaaaccacatagtgaagtgagaggaagggcaagtgctgcctgtcaggggcggtcagaccgagagccacggccggtcaaaccgacggctcaaggccggtcagaccgacggctcacggccggtcagaccgcgtccggtcagaccgccactgacacaagcatacccaaatccttccacaatccacacaaatgattctaaaaattgctagaacagtgttgcacaagattggaactagaacatcaaggtgtaggtctattgaagcaaaggggaaactacccttaaccctaaagattgaaatagaccgatttgagagcaatgcacaaaagggagagggatttaccagttgaaggagttgaatcacaccaagaaactaccctctattggtgcaaatcgatgagcacctattccttcacctagggttcc

SEQ ID NO: 44620 - DNA, 1627 bp, Oryza sativa
gagttggagaagagaagagatgagatgggatgaggaggggtcgggtagaaggaggaggaggaagaaaggacaaagtcctgggcccaccaaccctggccggtcagaccggctatacgcgtccggtcagaccgccagggtgcagccggtcagactggtccctagaggccggtcagaccgccgccaccaggccggtcagaccgcgcatatagcgccggtcagaccgcctggcccccagccgactgtgcacagcccttgcacagttcggctacccccacacaataaaattcaacaaaaatttgatttttggagcaattttgaaatatgtgagttgaaatattgccaaccattcataatatttgaaatttatgaagatttgcaacaaaactcacttgagtgctaggaggtgaccatttatggtctataggggtttttgggcgaatttgattttcaaacaacttttggaatatttggtttttgaatatgatttgaataccaaaaacatttcaaatcctcctctctaccaactttgttttgaaacttttctcagattccttctcaaactcattttggggtttaatctcattttggccaaaaacaaaaatctagattcttcaaaagagagccaaaatagcatttttcattcaaaaatcatttttctagcaaagtgaggcttggaaaacatatagggacccttttgaaacattttccaagagatagttttcaaatttcattgattttgcaaaagttttgacttatattgacttgggcattttgaaaacactactagcacttttagttgatttgctcacatataaaaggaagtagagcacatgcaagagtccaaaactgccccttaatgtgacatgctccattttcgcaatgaagaaccaaatgtcaataagtccaaagcataagagcaaataggagcaaatatacaatatgcaaaagaagcaaccatggtgcaccatctcaagccacattagagaagtctatgacatttaactcattcctcaacttgcaaaagcgggtttcattaagaggcttggtaaaaatgtcggctagttgatcctcggttcttatgtggctaatgactatgtcacacttggtaacatggtctcttaggaagtgatggcgaatgtcaatatgcttggttctagaatgttggaccgggttattggctatttttatggcacgatcattgtcacataggagtggggttttggtgaaggatataccatagtccaacaaggtttgtttcatccaaagcaattgggcacaacaactacccgccgaaacatattccgcctcggcggtagagagggctacggagttttgtttcttggatgaccatgacacaagggatctaccaagcatttggcaactaccggatgtgctctttctatccactttgcaactggcataatccgaatcggaatagccaacaagcttaaatttagcaccttttgggtaccacaggccaatagtagaggaatgctttaaatatcttaaaatccttttcacggccactaagtgacactccttaggagcggcttgaaaccgtgcacacatgcaaacactaaacatgatatccggcctagatgcggtaaggtaaagcaggctaccaatc

SEQ ID NO: 44621 - DNA, 728 bp, Oryza sativa
ttaccgaaagggtgttagactaaccaaagttgaaagtcggtgtgatgaagggtttcttctaggttatgcctcaaatagcaaggcataccgggtctacaacaagaacaaaggtattgtggaagaaaccgccgatgttcaatttgatgagactaatggctcccaagaggggcacgagaatttggatgatgtaggtgatgaaggcttgatgagagctatgaagaacatgtctattggagatgtcaagcctattgaagtggaagacaagccatccacctccactcaagatgagccatctacttccgcctcgtcaagtcaagctcaagttgaagtggaggaggagaaggcacaagatccacctatgcctccaagaatacacaccgctctttccaaggatcacccaattgaccaagtgttgggtgacattaataagggtgttcaaactcgatctcgtgtcgcttcgatttgtgaacattactcgtttgtttcttgtcttaagccaaaacatgtagatgaagttctttgtgatccggattggatgaatgctatgcatgaagagctcaacaactttgcaagaaacaaggtgtggattttggttgaaagacctagagaccacaatgtcatagggacaaagtggatctttaggaacaaacaagatgagaacggattggtggtgagaaacaaggcaaggttggtggcgcaaggtttcacacaagttgaaggtttggact

SEQ ID NO: 44622 - DNA, 14016 bp, Oryza sativa
  unsure (1)..(14016): unsure at all n locations
cttaaactcattgttctcaacaacaagtgaggcatcacaaatagaaacacacgagctagaactagagcaagggctaggcatatccataagatcatcacaagaggtagaaatgctagatgatgcaacatgagcaatatggcaagtagcactatcatcaagcaaatcacaagatatgccaacatcaatgtgagctccatgttgagtagtggaaaggaggttgtcatgagcttccttaagcttctcatgagaaatggtgagtctctcattagaggtctttagctcctcatacaagacatccaaagaagcataatccttgtttagggccttgaacttgacaatctccttctcactataagcatggagctcctcaaacatactcacaagctcttcataggaaacatcatcacaatcatcatcactctcactatcactaagagatgttaccttagaggaaccctttgccatgagacaaagtggagcgaagagtgatggagcctccttgatggcaacaacgaccatcttcttcttcttggagcttgcatcatcaccaccttcttcctcagacccggatgaggcggagctctcctcatttgagtcccattccccgatgaaagcctcaatcttcttcccttccttcttaagcttcttcatgagcttgtagcctccactcttcttcttggatgacttgtctccatcatcatccttggaagggcacttggaagcaaagtgtcccttctcaccatactcaaaacacctcaagttggagagagtcttattgagtcttctatttcttctcctattggagttggagccccttcctctctcctttctcctttccaagagatcattgaaccttctagcaagaaggatcatctcttcctccaagtcctcattgacttcattcaccttactcttgctcttgtcttcaacttcggcttggagagcaatgcacttcttagagggtgaggcttcctccatctccttcttcttcaacttgtacatgtcattggtgttgatcttccccaagaggcttgcgggtgtcattcttgacatgtcggagttgatgagcatggtgacaagggtctcatacttctccggtagggctctaagcatcttttgggcaacctcaagatcggtgtagtttgccccaagccccttgagatcattcacaatgacattgagcctcccatacatgtcattcacactctcatgaggcaacatgtagaatgtctcatattggatcttgaggaaatgaagcttggcatccttgtactcacttgtaccctcatggatctccgccaacttgttccaaatctcatatgcggtctcaaggttgctcactctatcgaactcctcttggctcaaagagttgaacaaggcattcatggcttgggcattgagttggaggttgcggtgatcaatctccgtcaagggtgtgccggtgatggcaaagcctacatacacaatactccaaatatggaagctcatagctttgaggtgagtagacattttaattttccaagtggagtagtttgtgccattaaatatgggagccttccctacatggttcacctcgttcgacatcttctctctaggcggtgaagcccaatcaagagagaccaagctctgataccacttgtacgatcgagatgtcgactagagggggaggtgaataggcgatttaaaactaaataacacctaatcaaatctaacctaagttgctaggcttggtgagggtgaactctaactaagcaactaagttatgttttgcaaacttagggtgatagtggctcaaatatatctctaggaaagtaaatcacgctcctatgttgatgttttgcaatcctagggtgatatgatctcaagtgtgtctctagaaatgtaaattgcacaaatgtaaatgcgacaatcaaatgagacaataagacaagagatttttcaccgaggttcggaaactcgccggtttcctactccccgttgaggcgagcccaactccaccgctcaaccacgaagccaccgcacacccccttcgtcaaggggtgggcaagacgggagccggcccacagagaggactacccaagcctcgatcactcggggtagttcttccttcactccgaaggtggtgaactccaaaccactcacaaaccggcgccgggcctcctccacaatcttctcagagaggtcaccgggcaactcctccacaagccgtttaggaggcggcaacctccaagagtaacaagcaatgacccggtgtggagatgatcaagtgccacactagctctacaatggaagcaaatgcacttgactcttggttaaacaaccctctaacacactagatggatgaacacaaagctcaagtgagtgtgagagaggtgcaaggagtgtatgcaattgaattgggtgccaagagagcccccttgctgctggtgggggagtatttatactcccacccaccaaaactagccgttgggggcgaaatcccccaactctgtgctctgccggtctgaccggaggtatgcggccggtcagaccgtgctactctgcaacggctagaaaactagccgttgtagccctgtcagagggccccatcggcctagccggtcagaccgacatggggtggccggtcataacagcctcggctcggtcagaccgccatcggctcggtctgactgactatggctccgtcggctctgtatcggccatcccgagcagcatcatctcagcctccaggaggccggtctgaccgggaaagtgccgccggtcagaccgccactatgtagccggtctgaccggccagggcacgccggtcagaccgccactatgtggccggtctgaccgcccctggtcaggccgaacccagtgaatttgtgtaatgaaaaagagagcacaaatgaaaatgcaatgacctaatgtggcaattaaaatcatctctttgctaggtcattacccctcttaatagtacggcgaaactaaaattaaactagcaaatttgatcgtcctacacctcgatcaattctaaattaaagcgctagttttaccgtcttctttccctttgctttgcgccgtcaattttaatccatccataatcatccatgcgcgcatatgacgtagacctaacttaaaatatatagctcaaagacaacggtttgtccacaattagtgcttgtcattaattaccaaaattaacaccgggggcctagatgcttcatatggatgaaaatgatcggaaaaacggctcaaccattttcataaccatatttttcttagaaacgaaattggaaacaataaattaaaaacaaaaacggtatcgaagatataaaaaactataaacaagactatatggacagaaaaatgtcggcatcaactgaaaactagtaatacatataaaaaacattaaattgtaaaactacattttaactttgcaaaactatataatataacaaaataaatataatgttacattgaataaatgataaattgtgtacctttctaccatacactcaagttcattatctggttgaggtgttgatggtcctctaaaccatgggtcaaatagagaaatgaaccatagatatgataggcgtatttagaaatacaataatcaacataataaaaagtattttccataatacgctaaaattcgggaacggtcggtaggacagcaaaatcgtttttcgcttctatgtccatatttcttaccattaattttcgttctcatttaaatacacttctacatataatgatacatgtagaaagaaattttcaaagttgtatattaaatctaactccatgcaaaactacgtggggaaatcccctagttaattctattgtttggttggtgaatgtgtgagttttaagaggtattgggaaggaaagtttaagagtaaactcccaccttttaatacctgtatagggataagtaattgggagggaattttcctcctatgtacaacgaaataaaagtcatacatccatcactaaaagttcaattcctatcatacaccaatacgaaactgaaaattcaattcctatcatactcatctgtatgaaactgaaattaattaaaaaataagacttccatgctaggtacatgcaaggaaatagccgaagatgggaaacggtaaagaaatttcaggatcggtgaggccatatgtatttaattccattataacaaaaatttcgcgaatacataaaaggattgcacgtcaatatattagaagaaaaagagtttttgttacacaccgcaatcagccagaccggtttatgccagggaaaaaggagaaaaagcaaaacaaaactgaaattgaaactaggaaaaagactactacggtagctaaatgcaactccaaacagcgggaaggtgtatagctacgctacactccctcaaaaacgggaacgtcaactaaagaccatagatggccctccgagaggatggactccagaaccactgagaccgaagagagcgcagagttgaaaacctaagagtttcgttcctttcacagctaccactcgaaacttaaagctggcgcggagatactcgggtaagcagtccctacacgatggccaccagttctaaaaccagctgccacgggggatttaaaaagaattaaggcaatatgtatatcgtcataattgctcggtgaagctggcaaaatgtttttcctttctttgtacagaccatcggtagcctcgatctttgtgtcgcatcttcatggagggatcgaggcaatgggacggttgcccctgtgggctgtttcgaagcaagcggagcccgtgagattcatgggccggaatctcccccgatcctggtcgctgatgctttagactttggattggcgcaatgtcccgtggatgatgggccgaaatttcttcttagcttcaggtgggctgggttgctatgcggtgaatgctagtgcagcttgctttgttaaccggaggaataagttcactagtggtccctcaacttaacatcgagatcttttaagatcccttaaccacaaatccagaaatgtgcacatatcaaggtcctatggcagtatatatgggtggtttcgctgacgtggcatcctaatcagcaaaaaaatttaaaaaaaaatgtggagcccacatatcagctgcacatcgttttccttctcttttcttctccttctcttctcttttctgtcttctctcttctcttcttcaacatcgaactgaacaagttgaaccacgagatcgatcgatcgattgatcatagtgttggcagcatcatctggagcatgggagccggccgggatcggccctgccgcgacttgaacttcctgatcgccgccttgagcacccgcctcctgaagaatccaaccagcagaagcctcgtcgtaatggcggatatgattcatgaagcgtaaagatggggggatctgtatgcagaaagctaccttggctgggagaggtgatggcggcggcggtgagaagtccagcctcgcgcggcccgtcttgtggaggttcaggaaggagccgtcctcctaccacagcctcggccgccggcgctgcgacctcaacgacctgcccccaatggcggccctcgccctgcgcttcgggttggcgatgaggaagtccctcgagccctcggccccgcctccgccggagtgcggtgacgacgcgcagggcaccttgttcagcggggactagatgccgctctgggagcagtcgaagtcgaaggcaaaggagtccgagaacttgccgagcagccccgctccaggtactccaccgtcaccacgcgctccaccaccacctgcggcttgacggcgggcagagcagcggggggcgagcgcagcagcggagcgacggcggcggtagcgggacgcatgaggcggggtcggaggcgaagtacggcgcgaccggcgaggtcgaggcggggctcgggtaggctgaggccgacgacggcgcggcccacgacatcgaaaacaagagcgaggagaagggaggcgtgggaacgggcgggcacggcgaagttgaggacgaggacggggcggccggcgaggtcgagacggacgacgactggtctgcaccgccggccgccgccttcgcctcgtctcatctctcccaccgcctatgctgctcaagatagatgagtcgaggtggccggccaccgcccttcccctctccagatgcatcttcggcgaggacttcgaggacctgatgccggtgatgactgttgggaatcaaagcaactcacgcgaacacagtggacacaaatcacacttacgcgtgaagagcacaagaaagaagaacacagaacactgagtatttgtggcacaagcacgcaactggtgccttttctcttgcttttcttcttgttaacaaaatgattacaatgagcagctatttataacacagcacatacacaaagctggttgttccgcttctcaagccacacacgacgcccacgtcccgtttacttggccgcaacttcacaagtactgagtcttcgccgacgttcgttgcttgaaccaaccaactaacctgcatgcatgcaaactgaccacttcctactcctaatcttgtgcaagactcggctaatcactagcccataattatgcatggctaactaactaagctacatacatgtgctctcatctactggctctttattggctcactactcactgccaaccactactcactaagccatgcagcacccacgtacatatagctagctctccagaccatgcaacacacacatatgcatatagataaacatgctgaaattaagaaacaacaagattaatttctaacaatcaccccctaatcttgttgtctttatttgacaccttctcacttggattcaaagcagcgtcggctcgtcgtcggcatccgcaaccacaaggtgcgcctgatggttcttctttgtttcatggcacttcttctcccaagagtagtgaccatactcctggcaattgtaacaacggacctttgacttgtcaaacgtgtcgccgttcttcttgcgatttctcctacgctccagccactgctcttcggtgaggagcaagcggccgccatcaacgccaccatcattgtcaccgggcctgtaccgctcctccacagttcggaggcgccccgtgacctcctcgatggacagcgtcttcaaatcaagcaattgctcgattgcaatggccacctgcacgaaccgagaaggaacaacacgaagaaatttctgcaccaccttctcctcctccagtgggtcaccgagcatgcggaggttgttgacgatggcgttgagcctcatcgagaattcatccacagactcactttccttcatgcggatcaactcgaactcattccgcaaggtctgcgccttcgcttctcgcacacgcgcaacaccaacgcgcatggtcttcaccgactcccacgcctccttggccgtatccttcaccgccagagtcggcaacatctccggcggcacggcacggaggatggcggagagtgccatcctgtcatcctggtactccgcgtagccgggctcaattgccgaccacaaaccttgagcctgcaagttcacgcgcatgacgagagcccagtcggtgtagttggtgcgcgtcaacatggggtagaccaccgagccagccgtctccttcatcaccctctgcacgatgatctgctggccgccattgttgccgccatcagtgccgctgccgtcggcgccactgccgctaccgctaccgctaccaaatgttgggaatcaaagcaactcacgcgaacacagtgaacacaaatcacacttacgcgtgaagagcacaagaaagaagaacacagaacactgagtatttgtggcacaagcacgcaactggtgccttttctcttgcttttcttcttcttaacaaaatgattacaatgagcagctatttataacacagcacatacacaaagctggttgttccgcttctcaagccacacacgacgcccacgtcccgtttacttggccgcaacttcacaagtactgagtcttcgccgacgttcgttgcttgaaccaaccaactaacctgcatgcatgcaaactgaccacttcctactcctaatcttgtgcaagactcggctaatcactagcccataattatgcatggctaactaactaagctacatacatgtgctctcatctactggctctttattggctcactactcactgccaaccactactcactaagccatgcagcacccacgtacatatagctagctctccagaccatgcaacacacacatatgcatatagataaacatgctgaaattaagaaacaacaagattaatttctaacaatgaccgggcggctggacgacccggcgagcggcaccatccccgtggagacccctgtggtcgccggtcctgtccttctgggctaccgccaccgccaccgccgggcacgaccatcccgggctacttctcgacggctgggcactcgagtgaatgcctcatctccctccctctcctgccttcgcctcccgcgaaagctgatgctccgttgcggtcgtcaatggccacggcgctctccgctctgcaccgagggagcgacggaggtctgtgctgacgccggcttaggaagaaaagaggagagggcagctgacatgtgggccccatgtactattttatttatttttttgctgactaggatgtcacgtcaacaaaaccaccaatatatactgccataaaaacttgagtatacggtttgtgtaagtttagaggtacacatttctgattttgtagttaagggactttaaaaaatctcgatgttaagttgagggatctccggtgaacttattccttaaccggagttccttaacgttgaattatgtgcagctcaacaacgtcgactattacgtgcagtgaagaggtacaaactacttcctccatacattaagacggtttggtatcttcatcactcatctaaattaattacgtacatataaatctaatcacttatatgaaatgtatttaaaatctaaaacgtttaataatatgaaacaaaaaaagtagaaaacgggtacaaaagacacatagagggaaagagagagcgttcctatacaatatgtaaccagagctactatctcactttctataagcataaacggtacgtctttttaaatattcttttatataaaagttttctttaaaaaattgaaataattttattttttaaatgagagtagctatatttatggtgtcatatttttcacaaaaaatagttaacatgtatttacattataagttcataaattatatatgtaaatttagtgtatttataatgtataagttccaaaattttatatgcaagtctcaaaattacatatagtaattacatgtgtaagtggggtgtaaatttaaatcttactacattggaaaagttaaaaagcaaaagcatgagcagtataggagatgattttgagaagaaatcgaacggtccgaacaagcacaacctaagacatgtagtctcgtgtagtcacgtagagcaatcgtacgcacggtaaaaccgactgagattaggcaaaaaaaatatcgacatatttttagcagtccgttttaaatttgtaatcgttgatccttaactaattatattgtaatgactcgtctgtttttcatgtcgttaaaaagctcagctcatgatctgattcaaacgcatcctaagttttttttttagcttatgaacctcacatattgcagtgtgtatctcgaatgattcccccttctttcccgattgatcgtcgtagtgccaaaagtccaaaatatgacttagcattcataaaaaaaaaaactttcgttactcgttaagatcctctcataatctctatttcttcatcacttagttattgcccaattttttttaaaaaaaaccttagcattcataaatctaagggtctctttgaatcaaaggatttatatagaattttatatgattcaaattctatagaaaatttttctatttggcttttgattcaaaggattgaagctttccaaatcctatgaaattcctatggaatgacacattgcatgtggattttggagaaaatttagcaagagctccaacctctttgagtaaatttcctttgagtctatctctctcatctgatttatgcgttttcctgcgctccttttaaacgaccattcctgtgtttttcctgtgttttgtaattctctgttttacacttcacttcctgttagaattctatgttttttctatttctctgttttttttttctaccttgcgaataaaaggggccttaaatgtgcatttaatggtttggaacaggttgcacaaaatccggagttccggacttctgtcttgtttatttgagcattcctaagctcatcaccgactagttaatgccccttgctcggttaatcctagattcctagtgtgagtggtacactaatcgcccttagagatccacgtcgcgtttgaccatgtccatgaccacctgagcagtgagtgagccagtcagccagtgagctactgagcagtgaccactagtaggttctactcgtcggcaaccgatcttgcctcgccggagaagacaacgcccgcggcggcggcggcggcgacgctctccttttgatgctctcatgaagcggcacaacgcggcggaggtgccggtgccggtgagctacggcggcgagcgggatgagaagaccggaagcaaggtggataagatgggtggtggagcggctaggcggtggcggagcggcggctgctgctcccgcctctggctcgtgctcgtcgtgttcgccaccgtcacgatgctgctgcgccaccgctacgactccggcctcggccatggtgccgccgccgtggtgcgcatcgagccggtgcaccggaaggtgaagccagccgatcgcggcggcgccaggccgtcgttctccgattccggcagcgcgaagccggtcaccgtcgaccacaagtcggcgacgaccgattcttctaccggaacggagtctgacggtggaggcgagccatcgtcggcgtcatcttcgctgccggcggcggcgcacccgttctcgcgcgcgctcgcggcggcgggcgacaagggcgaccggtgcggcgggcggtacgtgtacgtgcaggagctgcctccgcggttcaacaccgacatggtcaagaactgcgtggctctgttcccgtggaaagacatgtgcaagttcacggcgaacggcggcttcggcccgccgatgagcggcggcggcggcatgttccaggagaccgggtggtacaactccgacaagtacacggtggacatcatcttccacgagcggatgaggcggtacgagtgcctcaccgacgacccctccctggccgccgccgtgtacgtgccgttcttcgccggcctcgaggtgtggcgccacctctgggggttcaacgccaccgcgcgggacgccatggcgctggaggtggtggacatcatcacgtcgcggcccgagtggcgcgccatgggaggccgcgaccacttcttcaccgccggcctcatcacgtgggacttccggaggctggccgacggcgacgccggctgggggagcaagctgttcagccttccggcgataaagaacatgacggcgctcgtggtggaggcgagcccgtggcacctcaacgacgccgccatcccgttcccgacggcgttccacccggcgagcgacgaggccgtgttcgtctggcaggacaaggtccgccgcctcgagcgcccatggctcttctccttcgccggcgcggcgcgcccgggcagcgccaagtcgatccgttccgagctcatcacgcagtgcagggcgtcgagcgcgtgctcactcatggagtgccgcgacgggccgagcaacaagtgcggctcggcggcgagctacatgagactcttccagagctccaccttctgcctccagccgcagggcgactcgtacacgcgcaagtcggcgttcgacgccatgctcgccggctgcatcccggtgttcttccaccccggcacggcgtacgtccagtacacctggcacctgcccaggaaccacgccgactactccgtctacatctccgaggacgacgtgcgccgcaacgccagcatcgaggagcggctgcggcggatcgcgccggccgccgtggagcggatgagggagacggtcatctcgctcatcccgacggtggtgtacgcgcagccgtcgtcgaggctggacacgatgaaggacgcgttcgacgtggcggtggacgccatcgtcgacaaggtgacgaggctgcggcgcgacatcgtcgacggccgcggcgaggaggagaagctggagatgtacagctggaagtatccattgctgcgagaagggcagaaggtcgaggacccccatgagtgggattcattgttcgcgttcgcctagctcaccatttctaccaattaaatttgaccttcatgtttgtgaagtgatctatcacaaattaaattatcttgttgtgttttaaaaaaattatttatatttatagtgacatgcaacaacgaaagaatatctcctcgaaaatttagaatagttttcgctatttgtagttttgtagagcaagatgggaggtactaggatagcttctttcttttctttctcctatatttgcttgtcaaccttttgtactaggaagatctctaactaaattagagttcaatctatcgcattcttgccttttagtatgtactctctccgttttaaaattgaagtatttttagtttctttagaaaaactaaggcatagagaaaatattatttctagtcacttttattgccaaattttattttttaaattatttatatttctttcccaagaatcccattagttgaaaatttatgattttcgttgttggatttagtgtcctaaaagtatttatattatggtataaattttatatcacataaatgcttatattttaaaaccagggagtatgttttaatctgttgagcacactcatatcacctctatttcccaagtatatctatgctttcacattgcatactttttaagttgtcacccagtgcgatagagaagctgacagtaaacagattaatattcctgcaaatgtagccatgatactaatggaaagtctattcatcttaaagggatgtcgtttttcatgtctcttgagaagtcatcgaaagatttgaaaataaaactaattagatagattaatatgtgatatgttatttaaatttataaattgaaataaaaacaataaatttgactttgaataaaacgtgtaattcacgatcaaatttggctctgaataatgcatctctctactactaattcttgattaggagtactgtcatagtgttatacacacggcttataacgttctttttggatatatatgatgcaacgcgatgaataatttctaatactttaccaaaagataaacaaacttaaagaatttcatatgttacctgagccgagtcgaagcggttctaggctcaaaaaacttgtgttagggcctccatcctactgtacgcactgctcgcctgggccaagcctgctgctgcccgctaagctagcttacagcccaatgacaaagccgaaaggaaaatcagcaagctggcccttctcttctctgttttcttctactttttcatcagttattccagggctttagctttacacgcgcgacgggcttgatcccaatttgatagtacgaactacctggcatcattttcctaatttttgtttttattatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 44623 - DNA, 6720 bp, Oryza sativa
aacacggcaaccggttgcacaacatttgcaagcatatcaggactgtccaatggaaccgtgcactcatcatacaaatcagcatgccatgcactaggatttctaaacgatgatagcgaatggattgagtgcatcaaggaagcatcatgctgggcatctgggatgaaattacgacaattatttgcaactgttttatgccattgcgaggttactgacccaaagaggttgtgggaatccagctgggagaaactctccaaagatatacagcacacacaaagttgggcattgaactttcccacctcctgcctcacgccttcacacagaaggaaatgtgctttaatagaaattgagaagaacatgcgacaagctggaaaatcactaaaggaatacgctggaatagaaccgccaaatatggcaaagttaagtgaaattgagaacagtttataattgaagagatgaactatgacaaagagaagttgaagcacgagcacctgcaaatactaaacactctgaacatagagcagaaaaaggcatttgatgcaataatagaatcagcacatcaatcactaggcaagctaatatttgtggatggttatggtgggacaggcaagacatacctttggaaagcaatcacaacaaggttaagatcagagggaaagatagtgcttgcagttgcgtctagtggcgttgcggcacttctacttcaaggaggtagaacagcacattcagcattcaatatcccgatcaacctaacagatgaatatacatgcttcatcaaacaaggctcgcacatagctgatctattaatgaagacatcactaatactgtgggatgaagctccaatggcaaacagaaactgtttcgaggcactagacaagagcctaagggacgtgcagaggtgtagaaatgagaatagttgtcaaaagccctttggtggcatgacagttgttctaggaggggacttcaggcagatcctccctattgtgccaaaaggaagaagggaacacactgtaaatgcaacgatcaaatgctcatacctctggcaacatttcgaggtgttcaatttgacaaaaaatatgcgactcaattatgtgtccaaagatcaaacagagcatcagaagtctgcagaattcgctgagtggatactacaaatcggcaatggtgacacgatttcgttagatgaaaaaggttgggtgaggatgcctagtgacctgctgttacaaaagggagatgacccgaaagctcaaatcattgagagtacctatcctgacctacaagacaattgctgcaagcagaattatctagaagaaagagcaatattgtgtccagtgaatgagaatgtcaatgagcttaatgagtatattatggaccagatccaaggtgacaaggtaacctaccttagccgtgacagtgtgagcaaatcagtgtcttacagccatgagatggaaatgttatatcctacggagtttctaaacagcttgaatcactccggaattccaaaccaccaactgaagctcaaagtcggtttgccagtgatgcttcttcgtaacatcaaccaaagtgcagggctatgcaacggcactagaatgacaattacgcgactaggcaataaggttattgaggcacagattataactggaacacacagcggcgatatggtatgtatcccacaaatcatcatgtcaccaaccgaaccgaaatggccgttcatgctaaacagaaagcaatttcccctctcggtgtgttttgccatgacgatcaacaagagtcaggggcaaactctaaacaaggtcggcctctatttacctaggcaagttttcacccacgggcagctctatgtggcagtctccagagtcacaagcagagatggcctgaagatcttgatcgccgacgaagaatgcccgggtgaaggaatggtgaaaaacatagtgtacaaagagatcctccagtaatttcctagtgtttgcagttaatttatgcagtgttcttccccgaactgaagctgtaataaaattggccgcgctgttgttccggccactagctagttttcctaaagcattgctgctatgcaagtaatgctgagactatcaatcgatgtacttgctttctataagcaatcaattatgttctgttatatctaattgaatttgcatttcaatctctgcactcaaattggctgggggttagtatcacttatcactgcgtttctgcaccaaatcgaggttgcatcccaggtcccatagctaatccagtggcaggcatagcgcaacacaaactgttcgaatcggaagaacaagcagagaacgggggtggtggttcatcttaccagcgcattggacccggtccgcccggtgccgccgcccgccgcgcgccgcgcgccgcgttcgcccggagcggacggaggcggccccgacgaagaagccagcattcgcgctcgacttgggccacggcggcgagttgccgccggcatgggccgacgctgatggaggaggacggcggaccagccgttcattttgctggaagccgccgccgccgccgccgccgccgccgtcgccggagtgccgggcgacgaggcgggtgagcaaccacgtgtatgggccaaatgatgggcctaactttcgagcattcagagcatttcgtatgggctcaaaatccggcccatatacgggtatggacctaaatttcggcctattcacagcctgcttgaatgtccaaaaatcccagcccatcttggagacatacataggttcgtccgctgttttttttttttggttacagacaaagaatgcaaaatccagcttcacttttgcgaatttctcggaggtacctccaaatagggccggttgctatcacgtatcaaacattgagtattaacagactgaaacatattttcttttatcggaacatgatcatgcgatatcttgttgtgaagattaaattacaacaaacacaacggtgttatcggatcgcagattagataagtagtttaggagaaaattcattttgaaggctgctaaatccatgcatgcatgcatggataaagaggagatagtaggggcaaaaaaaattcgtccgtcaaatgttacagttgaccactagtgaaacattaagttatacacagtgaaaaaaatcagtcactgcaacatttaaatatttttttgaaacaaagtgaaaacacacgttgaaacatgttgctatcacgtatgaaacattaagtattaacagactgaaacatatttttttcatcagaacataatcatgcgagatcttattatgaagaattaatataacaaataccacggtgttatcgaatcttagattagataagtaatttaggagaaaattcattttgaaggttgttaaatccatccatgcatggatggatagaggagagagaaagttggggcaagtagtgaatgcacactttaaaacatattgctctatttaggaaacattaagttttaacagtctaaaccatatatttttcttttattaaaatataatcatttaatatctcattgtatagatttaattgtaacaaattcaatggtacgatcggatcgtaaatcgaataagtagtttagaagaaaatatttgaagtgttgagaaaaaaagaaaaagaaactagttagtactcatcttgcatgcatgcagtagcaaggagcccgattgtttctcttcaaatcgggctaccgagcaagaggattcttggaagatatacatggagtaacgagcagcagcgccctacactggagaagcttgatagagttctggtcaaaacttgagggcttcatggatgttgtaaaagaaagctggcaacaagaagtggatgccaccgacccttacttaattctgcatgtgaagctcgctaggctatgtaagaaactatcatcctggggtcagaaaagaatcagcaaatacaggcttcagctgcagatcgccaatgaaattatcctaagatttgatgttgcccaagagtcacggttactatctgatgacgaacgacatcttcgtgcagcctgcaaaggacgatgtctggctttggcgtcgttagaaagaattcggctgaggcaaagggctaagattaggaatttgagggaaggtgatgctggcacggctttcttccacatgaagataaaatcaaggcgaaggaaattactgatcccacggttggaacatgagggcagaatagcttcaacacaacatgacatgcaaaacctagacagagaatactttgaatcagtgatgagtgcggaggacagtgctacaagaaggctgctgtttgaacaaattgggctggctgctgctgatttgactgagcttgatgttcctttcactgaagaggaaatctgggcagccatccgctgcttaccgaacgaaaaatcacccggcccagacggttatacaggattgttctatcaaaagtgttgggacatcatcaaacccgagctcctcaacgcactggcaaagttttgcaccggcaatagtcagaatctagaaaaattgaacacggcaatagtcacgctcattcccaagaaggaatcgccaactctactcaaagactacaggccgattagcttggtgcatagtttctctaagctggctgcgaagattatggcacagcgactagcgacgaagctggatgttctaattccttattctcaaaccgcctccatcaaagggcgctgcattcatgagaactttgtttatgtcaaggggctcgttcagcaattccataggcaaaagaaggcaatggtactgttgaagcttgacatttccaaagcatttgacactgtatcgtggggttttctgctgtctatgatggagttcaggggatttggcccaaattggagaccgtggatctcggctattttcctcactgaacaaacaagcatcttgataaatggggcactcaccgacccaatcaagccagcaaggggaccgaggcagggagaatcgagcgaaactagctggtttgctgtcaccactaaatgcaagaaggcatttgcctcccatctcagtgtacgctgatgatgccgttctgttcttcaagccaacggctgctgaagcaagcgcgatcaagggactgttgacgttgttcggcgaggcaacaggcctcaaaacaaatttctgcaagagtgcgatcaccccgattcagtgcagtgatcaacaacgggcaatggttgagtccattctctcctgcagagtagaagatttccccatcacctacttgggcctcccgctaggaacaagacagccaacaaaagccgaagttcagccgatccttgacaaattagctaagaaagttgccgactggaaacctaagatgctctcgatcgatggcaggctatgcttgatcaagtcagtgctcatggctcttcccgtccacttcatgtcggtgctgcaattgccgagatgggcagtcaaggacatagagcgcaaatgacgcggtttcctttggaaggggcaagaggaggtgagcggcgggcattgtctagtctcatggcggaaggtgtgctctccagtggcgaaaggcggtctcggagtgaaggacctgaacttctttggtcaggctttaagattaaaatggctggcgaaatcgctggagcaaagggagagaccctggacgatggcatctttcaggcctggttgtgatgtggaggccatatttcgctcggtgacagagtacatcataggcaatggtgaagacaccgatttctggacagcaaactggactgggaagggatgctttgcatggcggtggccgatcctgcactcttatgcaggccgtgtcaggctttcggttgccaaagctctcaccaacaatcgctgggtccgcacactgcagggggcgctgtccaacgaggcgatgggcgagttcttccagctttgggacgaaattcatgatgtgttgttgctcccctcgacggatgaaatcaggtggaaactggcgaacgatgggcaattttctgtggcgtcggcctacgacatgttcttcatggctacggaaaattgtgcattcggcgagctgctgtggcactccagagctccctcgcgagtccgcttcttcatgtggcttgcgctaaaggaccgttgcctgcggacaacctcgccaagcgaaactggccacatgatgatctgtgctcactttgtcagcgagatgatgagaactgccaccacctgttcgttgcgtgtgattacacggcggcggtgtggcgttctatcaagcgatggtgcaatgcaagctttccaataccggcagatggggacgctgccctcgctgattggtggctggcaactagatgccgttttcagaagagctacagagcagattttgactgtgctttcatgctaatatgttggctgatttggaaggagcgtaatgcacgtatatttcagcacgtgtccaagctactggatcagctcgcggaggacatcaaggatgaaattgccatttggagggtggcggggattttctcccaatttcgcgagtaatccccatggatgtttgcggggtttagcctcgcctttgcttttcattcttggctggctagggaccttccttggccgccacgacattgtaatgtcgttgtaaacttttactatgtttttcctcccaatcttaatgaaattggtcggctaacctttggctgacccggcaaaagaaatcgtatgtataataaggtaattaataagacaaaggggcaggaagtaaagtgcatc

SEQ ID NO: 44624 - DNA, 1423 bp, Oryza sativa
ctacgcaaaagaaaaaggtaacctttacaaaagtataaaatgtgtaacagcaatgacttgagtaagctaacaacaagtcatttgacttcaccttgatctaccgtctctgtttagcgtctcccagactaatatcctggccacattctgttgcaactcgtgctgcatccaggcttggtgccttggcttctcagagtaagcaagtggctcaggttgttacacttcttttggttgtttgaagtgatcttaggctgctggggttgccggcttcttgaagtagctttaggtggttgtataaggctgctctctgttggaacagtacttggttttctctcggcgtcatgtgtagctttcctcggggcaacttctagcaacttgttgtagcttaaccatgccatatcttgctcctccttggtaagcctttcttcttcattttcttgcagaagggtttcatgttcatggtaacttgcgatccacctgtaaatcccaaaaacaaagattaatgtttggcaaaggcgagcatggggggaaataagcactacgagtttgacaagttttgagttatatgatttttatagtttatacgctataagatttatagaatgacatcctgttaggttgagtagcaaaaaatataagcattaccgggagtggtcatgaagtaggttcaccatgagcctgtccaaaggtaaatgttcagtggtttcactggagttgggagtaggtggcttctcagtcccaactttactgtgaccattcatggtagaaccgctctgctccagtagttcctcatcaccaaactcgaaaagatgcaacatctcttctttagagattgttctagacacttgctgtctatccaccacccttgctgcaagcccttcttttgtcacctatattaataatactaattaatgaattaagtcaataacacaactagagttttaaacaagaaaaggcaactgccaattacctgccgtttatatattttctcttccattgttgcatgagccattaggcggtaagcatacacaggcttggtctggccatacctggaaagaacatacggtgagtaaacaaataatcacatgattgttcaacttactagtaaaaatcaagcaacaagttcttgcctccaaacccgatagatggcttgcaaatcatgggttggattccatgaaccatcaagaagaatcacacggtttgctgaatgaaggttaatgcctagagatccagcacgagtagatatcaatgtgcatttcactctaatgttttcagggtcattaaacctctccacaagattttgtcgctcagaagatggagtgctcccatcaatcctattcaacatgacagaaaacaagatcacatttgcagaataagataagcttcttttaaatataaatatcgccgttgcaaattaaatgctggt

SEQ ID NO: 44625 - DNA, 8988 bp, Oryza sativa
actagctgatctgttgttaaaagaaagtagagtgaatttcagaaaactacatatactttggttaaattatcacaaaactatagatttaaagcgttgtatcataaaactacaaattttatgtcaaaattatcactaactatagatttaagatggagtgtaaaaaataacttcaatattaaatctacagttttgttatacttagtcttaaatctgtagttgtatgataaatttactactaaatatgtagttttgtgatacggtatcttgaattagtagttttgcgatagtatggtcaatgaagtttttaaaattctactaaaaaaagtattgttttgtaaatacaactatatctttaaaagtttatttgtctatattttctctctctaattaaattccggcagtgctcctgccgttggtttcctaacaataataaataaataaaagttattcatggttaaagttgagacattgatgatcagaaatgacaagtaaatgaggacgacgggggtaatttagcacgaccgtatattgtcgattggatgcccatgctgttaggtagaggtaggcatcagcgaaacaatttatgaaggcaagaacgcggccatcaggccgactgtgacgcaggccaaggcacacagacacgggctcagtttggatgtaatcatgtaattaatcagtccgatttggaccttacaccaaaccagccttaacttaatcacgtcgatgactaataaagttttgtgttttttttggtaatgctgccaatttggacttgatatataaaagcaaattatatatataaatcctggctgattgattatatatatctatgttacccattcctttttaaatatataacgttattatcttttagacagatcatttaaattcttttgggacatatcatttatttattttgttatgacttatttattactacatcctattataagtcacattgattttcttttctaattgaacttttttaagtttgatcaagtttatagaaaaatttagcaacatttataataccaaattagtttcattagatatagcattaaatatattttgataatatgcttgttttgtgttatagatgttattatttttttataaacttgattaaacttaaaaaaactcaaaacttaaaaaatatgtcgacgcctgtggtgacttcgtcaatctcaagatatactaccctagtcattcagaggtgctcatagaggtagggtgtgcgtgtgtgcattcataggggtgagtgtgcgcgtgttgtagacgcctgcatttgtactgtgtttctaaaataaagcttaaaattgctttactatgaaaaaatgtcaaaatgacttataatatggaacggagtattataactactttaaacataacttatatcatttatatatgtataatttgttttagtaatataaatggttcaaatgtcatgtcatggaagccaacaacgctatacatagtactatatattataacggagaaaataattcataacgttgctatttaactaacaaccgatctggacaatataatgtgccacctgaacagttctgatcatacagacaacaaattttgtagccatgtgctctatcttttttctcaaagaaaaaagatagcaccaatctgaactgaaaaattgtatgttctatccaatgacagcaagataaatcaattgatctatgtgccattaaccgttttaaaattttccagagctatagattccgacataaagctgatgagaattaatctaaaacaaactccatccatctcacgaaaaacaaactaaaactgaaagtggtatatcctagtacaatgaatctagacgacggaaggagtagaccacaccttttctaggctcgaacaacttaattatttctagaatctaatctatactgtacgaggagctagagattactagggctatgatttattttacaaaaggtatatcattatagatttgttgctggaaatggattcataatattattgttgtcttataattacaattttatttatttttttttgaaaaacataccggtcaaattcatacctcgaagaccacaaaactaaaatcacaagcattaagtgaaaaagaacaagaacgaaataaagtagctagatagataagtataagataaatgtgtaggtaggtggattgaagataccttgagtatacatggagtgatgtcactagagatatacacctatataaatgttgttaatttatatgcatttatttataccactaagaacttactacaacaacaaaagggtctgatttgatatgatttaatttggtcatttcttgtccctacctagtgtatatggaattgtatcgtagattagaatcccttctgattttagcatgattccaacatttaaagatatataaactagcttttactaattaagtactactactaactaatggtgtgcaaatcagtagattaacgccgtgtttagttccagaataattctttaaacttttaactttttcatcacatcaaaacttttttatacacacaaacttttaactttttttatcacatcgttctaattttaactaaacttttaattttagtgtgaactaaacacaccctaattaacacaacacagccacacaggctacttgacccactagaccatagaccattttctgatttgcctatatcatccactgaccttctcttcttcctctctgccttcgcaaagttgacaccactcatgcatgaacacgtcgctgtctacacgacgtaattagcacgcagctgcgatctccgaaacagggagctcgccgcgcgcgacgccgacgaggtcaatgaagccgccgcccaccgccgccgctacctcggattccgacggcggcggcggcggcggcggtggcctgatccggccgtcgcggatatgctacatggccatcctctccgccgtcttctggttcttggtcttctccctcctctccggcatgccgggcggcggcgacctgtcgtccgtgctgttcaggccgtcgtcgctgtcgctcccgctcctgaacagcttcacgttcgaccagaacccttcgccggagcagcagccgccgccggcgccggcgccggcggaggatcgctgcgccgggaggtacatctacatgtacgacatgccggcgaggttcaacgaggagctcctccgcgactgccgcgcgctccggccgtggacggcggaggggatgtgccggtacgtggcgaacggcgggatgggcgagccgatgggcggcgatggcggcggcatattctccgagcgcggctggttcgacaccgaccagttcgtgctcgacatcatcttccatgggaggatgaagcggtacggctgcctgaccggcgaccccgccgccgccgccgcggtgttcgtcccgttctacggcagctgcgacctcgggaggcacatcttccaccggaacgcgtcggtgaaggacgcgctctccgaggacctcgtcgggtggctcacgcggcggtcggagtggcgcgccatgggcggccgcgaccacttcttcgtcgccggccgcaccacctgggacttccggcgagaacgcgacgagggctgggagtgggggagcaagctgctcaactaccccgccgtccagaacatgacggcgatcctcgtcgaggcgagcccgtggagccggaacaacctcgccgtcccatacccgacctacttccacccggagaccgccgccgacgtcgccgcgtggcagcgccgcgtgcgcgcggcggcgcggccgtggctcttctccttcgccggcgggccgcgcaagggcaacggcaccatccgcgccgacatcatccggcagtgcggcgcgtcgagccgctgcaacctcttccactgccacggcgcggcggcgagcgggtgcaacgcccccggcgccgtcatgcgcgtgttcgagagctcccgcttctgcctcgagccacggggggacaccatgacgcggcgctcgacgttcgacgccatcctcgccggctgcatcccggtgttcttccaccccgggtcggcctacacccagtacacgctgcacctcccgccggaacgcggcgggtggtcggtgctcatcccccacgccgacgtgaccggccggaacgtgagcatcgaggagacgctggcggcgatctcgccggagaaggtgaggagcatgcgggaggaggtgatccggctcatcccgacggtggtgtacgccgacacgaggtcgagccgcgtcgacttcagggacgcgttcgacgtcgccgtcgacgccgtcgtcggccgggtggcgaggcggcggcgcgacgagcccgacgcccggaggtgacaagatccaccgggtgattttgtatgctttgattcgatttgattgggccattggattctccatgaatctggggcaaagtgcagtttttttttaccttttgtaattttagttttatatatacttttattgcctcgatatattggcatgtaagatcttgattgattatgtatgaaacaaagcagaattcctcaaagctgggctagctgaaagattggcctgtcaaattaagaaacggggggatttttttttttggagaattaattttcttgtggatttctctaaatctcacgcttgtgaaatttctccgaaatcctttgttccaaacaactgggggattttttgtgcttgcagaatttctcaaaaatcctctgttccaaacagcgcagagcatccagggtgaactgagattcgaataggatgaacattcgaaatgtgttcggcctgcatgaatctccaatgattttggtagcatcaatgtataaacggcattattggctttaatccttgcaataaaaaagtgcaaatgcagtgacgaacaaatatatgcttgcttcgatctggtagaagtttagaacgacaacaagttgccctgacaactcgtgatggaaatgtatatattttcctttttggagaggagcaaataaattatttttgagagaacgaggaaattagaaaatcaattagctgagtaccctaacaagatagatcgcctggttagcttttttttttttctacttacaagttgaatgtccgggcattgaccccgataaaagaaaccacactacacaatcatatatcgccaattacaatatttatctttaaatatatgaaagattgtactcacctgtgaatgtgtccctgaatcacagcaaatatatggtggaaataattacaacgtaggtgaatgacaaattagaaaacaaattggtggcgaagtgagcgtagctgtagacccccgattttggaaatcggaaatcatctgtgtttatccgtaccaatccctggatcagtagttggtacacacatacatagttgaatcacaacatatcacgaatgaattcaggctaaaagagttaaatacttacattagggctagataggccaacaactatcagagaacaacaatggaagacaaaataatataagggtccagttgacatgccacaggcagtcgactagggaacgagacctagaacaggaccgcactccgatcatcttgttggatacgcaagcgtaccgacaaaggcttctcttcaacactctcctaaaagatatataaatagcaagggtgagtaccaaccgtactcagcaagccaccacaacaacaatgcatatgatagagggtatttcaaggaatggcttcaggttcttttgcataaagctaattttacaattcttttcacaagtctaaaacctagcatagactgatcaaattttagtaccagtgttcactttaaacaacgacggttctgtccaccatccattgtgatcccaaggatagcttcccgccattgaatcgtcatggttttctgaggatgtccaccttccctcctctcgggaagtggctccatcagcataaaattcatcatgcaatatctcatcccccacaagttaagaatttagagtctagccaagtgtaatacatgtccctgtgctcaataaccgcgagcacggctattcgaatagacttggtttactcacactgcagtggatgtacactttacccgcactccgcgactgcccaacacatgagcctcgtcccaacacatgagacgcgtcacggcaaagcttttcgataaccttgcattggcagtacccgctccatgaactttacatcctcatgcactctaggcgtacaaggtttctagcagtgagaggagttctggcgtacccgggaagggaagactcacacatgcattaagttataattatgtttagattctcacatggcagtcctaccaatggcgacaccactgtagacacccgcctcgcggtcctatcaatggctgccccaccgtagagcccctgcctcacacatcaagaaaccactatgcatggatactgcctccgcttagctatctactccgctaggtctatacccatacgagaagtgcggttgtacggaggtcatttcatgcttaacttcatgactcggtccttaattgaccggggacggtactagccttttccggataccacccaaatcctccgtccgccccagtcgaaaacagttgtttaattttatttctcttttcacaaatcatgtcatcaacatcatggcaatgtggcgctcatgtctccacataccgcatctcaattaccttcccaaaggtaattgcccaagcatatagcatttgataaatatgagtatgcatgattctagagtagcatctctaagcatttgtcatagttgactggggactcatacgtaatcatggttacaagggaataagggtaaacaacaataatcaaggtatggcatattcaaaaataggatgttcatcattgcatgcattcttatttgtaaataaaaataatttcgcaattgggatcaacatgttcaagggatagtgatgacttgcctgctcagaattgtccttattctttatacaatcttgatcaaccttcacctcctggaagttgcagacgttgcctcacgactaactgatacacaaggtctattatatgcgagaaaaaccaatattcaaacaacaatcaaatatgcacaacaaaatatactattcggtttgctaatggatcccaatcatgctaaggctaaagtttcttaatctttctattgtcatcgtggcctatttaggagttaaccaacatagcatttatgggatacatatatatttggctaatcggtggtttagtctatcaaatggctatggaaggattatggctatgtatgcatctatctaaataggactgttatatactagaggttctgttgttagatggatttaggatcaatcaaataataaataattacagtgaatcatttgtattattattttattgatggaagctttgaacatattttacttgtcaaaataaattataaaaggttaataattatccatgctttgtatgttagagttgtttaggttaatcatattatggttacagattatcccatcacataattttacaatgaataatcctaagttacagttgaactataattataattatatgaggtcaagatttataactagcatttatctaatatacatgtttgtcatatactccctctaatttaatatatgcaacacgcaaattaatactataccgtacaactataatgggatgtatagtatatgtgtaagcaacaatatcttattattggatcatatatttgagtagttgctttttactgtaagctatacaatacatgtcgattttaagatggctctgtttggttaactaatggatatcaaccgactatatatatatattctacttcacatgacattgtatcgactaatttttaagtggtccaaatacagctagctctgtgattactctcctaaacaagttaaagattcacctatgtgtgtttatattttagttacaaaagatgaggctaaactttatgtaaataatttataagtcatggatttagttatatttggacatagactagtaaatggcactaatattttcctatacacccattaatttgaaggattgattataactaatttatttggttgctatagtgacaagacatattaaagataattatgctactgtacaatatccatttttatttattggcacactatttaggttaactattatctaatcatttgatattaattaatttataattataaatatattatattaaatagtgaattatatatcattggaaagcttatgaatttagatgaatttaggttcaagtttcactcaaatccgagctaaaacgaataagttacgctagtttaaagattcaaatttgaattaattctaataattgcgaaatggtactgttcctaattcatttatttttaatacaaccttatccacaagctatagtgactgacatgtggggtcttcctattttccttttcttttattttatttttctttctaaaagaatccatatgggtaaatgacaggtggacccggctcctttgactagggtcaaaccggccattaaacccggtagggcccgcatgtcatagactcgagaccataaaacttctataattagatttttaaccacccggacccacatgtaatagacacaactaataaagattaagaaagggattactattcaccaattaggtggggcccactctaatctctcctctcctttttctctctttctctccctcccggcttcttctcccttcctctcttcttttctctctctccctcccggctgcgacggcggtggacgcaagggggaaaaggcggcggcttaccgacagcggcggtcggcggcgacgacggcgacggcggcgcaagcctcggcgcggcacatggcgtggtgcagcggcaccgagggcggcggcgcggcggcacaatggcagcggcgctgcggcacgaaggcggcggcgcggcggtacgagaacgacggcgcggtggtgagggtagaggggaggaggagggagtggagtggggagaatgggggaagg

SEQ ID NO: 44626 - DNA, 5552 bp, Oryza sativa
cggtggctcgggcacgaggcgcgagtgcgacaacgcgacggcgacgacgatggcacgcggggctcaaggcggcgacggcgcgacggcgacggcgatggcgcgcggcgcggggcgcgagctggcgcgcggcagcggcgcgggcgacgacgatggcgacacgagcggcagcgggcagggggaggaggagggctaggatggctaggaaccaaatcgaacacctagggggctaataaacagtgctagccggctatttttgtttttagaaggtattttgcaattaggaaaaatatactattgccactaattttgtcacaacataaaatacaccaagtctaagttattccatcgaaatttatatttaaatttaatattgaacatattcttattattattatatatttttcaaagttttcctatttttcttcttttagggttttggttgatttataaattgagaaaagttgcaaattaaatttgtatttactcctaagcatttgggtgaccgtattaagtgttcaaatgtgaatttgcccaaaatttaatattgtccaatatttaaggtttattaaagattctataattttctaatgagaccgttattaacacattagcacattggctcaatttatttatatgttagtttattttatatggaggggtttaatatattaaatttcaatccctaaatgcaattaggaacttggtgcaatatcgatctacatatcgaattaaatactcccataattctattatatatagagagagctcagtttatttgaatgatcatcatttcatgtgtactcatattatggcacccacctatattattcaaatattttaatatttgataaaataggttaataataacttttcttttatttgattttaatatcttgtgcataattatttgtaggattaaatatattcttgtaaatcatatctattgcttaaatgtagttcttttctttactttcttggtgatcatttatggtttggcaagtaataggaatcataacaaccagcatgatgcaaaagttttaaaaagttcaaaattttagtgatttttattgttgggaattttcaggatgttacagtagctcaactggttaggtttttacggtggaaccaacttaggcatgttcaaattctagacttgatatgggtgtccgcatttatgtggtgagcggctgtgatgggatcgttttcttcctcaaaattttatacctcacaaacgaagttaaatttgatttagatttttacaaggtttccttccatcatctgatctacacttggattttttgcgtgactttagtttgtcatggttttcacgagttttcagcaaatttggggtttctaccatgtattttacctatttagtaacactcaaagagatagaggcccaacattaaatctgcgagtctagctaattttgttttttgaaagtccatcaacatatgtgttactggtgggcaccaatatgcaatccggctttttaatcatgaaattgtatggtactatcactatatagagcctcatcggttccaaagttttgttataagtcgtaacgacttattagtgataaaaaagtattttgtgtttaaaatttttatatatgtgttcttagcagtataaaagctaatgttgaaaaaaatacgtcaaacttcaaatttagtttgaaatttaaattttggctttacttattttttttgtctaggggtctataaatgtaaaagcttcttgaaattcatacaataaaataatatttctattacaaaaggatttagaaaaggttgcatgttcctgggctcaacacgtgtagagaacggttcaacattttatgaacccgatgcttaaacccaagtagaggttttcagaaaagtggacactcttccgttaaaaaaagaaaaaaggaaaagtgggccgggccaaattgggccgttccgatgttccaaggtcgggcttcttccagtcctgcgccaacatttcaacagggctacaaccaatgcaataagttcaccctccatcccttaactttacaccgagtttgttagatatccctaaattatacaaaaccgtgcaatttagatcccgtagcagtatagatgcctggtttcgctgacgtggcatcctagtcaataaaaaaataaaaaaaaagcatgtggggcccacatgtaagtgagagaaaagtgggaccgcatctcttctttcttctcttctcttctcaacttgcttctcttctcaggacgtcaccagcggcagatgcgggagaggcggccgaggcagagcttccacagtggtgacggcagtagtggatcggatgttgttgacgtcgaaggccagcgccggggacgcggcatggacggatgagttcgccgagttcaaggtggggcacgcaatgctggtttttgagcgactccgtggcgttcatcgagggcgggtcgtcggccctagggtccgacaacggcgtctgcgacggcgatgacaagctcgccgcgacgcagacgcgctgcttcactgcatccagctccacgcccacgaacctgttggtggcgttgccgttgagggaggcgttggtgaggccaaggaacccatagtggctaccaatcactctcttcaccgcggcgccgggtgagaaggaggtggaggtggaggcagaggcggaggtggaggcggctcccgcctcgggagtggcagcgactgagggggcaggcaccaccggcgcgtggatccagcagcccgccgccggccatccccatctaggaagagaagaaaaggaagaagagaagagggcggctaacatgtgggacccacataattttttatttttattttgctaactaggatgccacgtcagtgaaaccagagatccatactgcaataggacctaaattgcacggttttgtgtaatttaggagtgaaaatttcttgtattgaggattagatgtcatacaaactcgatataaagttgagggacaacgggtgaacttattccacatccaattaacagcgggcacaagctagccctcgatccattaaaaacgttattactaaattttacttatttatttactagcactatgccctagcttggtcattgcacaacacacaaaaaaaagtctaggtcactaatcaattaggtcaacttaatcacttttatttactaaataaagaaagcatcacgatgctcataggacctcgcattccagccagttttccattcttctagcaagctctctgattctttatttcttatgaacaccgtagaaatattactcctaccttgcttaagctacactgctaatctcctagtacatcacccacactgtcaagctagctacacacacctacgtgcgcacgtccgctccgatggcggcgagtgtcgtgtccgacaagtccagcggcggagcgagcttgctccggccgtcgcgggtcttgttcctcgccgtgctctcgacggcgttctggtcggtgatattctacgcgcaccactccgccgtgcaaggtaacgcgaccatggcgtccgtcttgctccggccgtcgtcgttctcccgcccgctgctgacgtcgttccggctcatcggcggcgggcttgaccggtgcgccggccggcgggtgtacatgtacgagctcccgccgcggttcaacgccgagctcgtccgcgactgcaggctgtactcgaggtccatggacgtgtgcaagctcgtcgtgaacgacgggttcggcccggcgctccccggcggaggcgcgctgccggagcgggacgtgtacgacaccgaccagtacatgctggcgctgatctaccacgcgcggatgcggcggtacgagtgcctcaccggcgacgcggccgccgccgacgcggtgttcgtcccgttctacgccgggttcgacgcggcgatgaacctgatgaagagcgacctcgcggcgcgcgacgcgctgccgcggcagctcgccgagtggctggtgcggcggccggagtggcgcgccatgggcgggcgcgaccacttcatggtcgccgcgcgccccgtctgggacttctaccgcggcggcgacgacgggtggggcaacgcgctgctcacctacccggcgatccgcaacacgacggtgctcaccgtcgaggccaacccgtggaggggcatcgactttggcgtgccgttcccgtcccacttccacccgacctccgacgccgacgtgctccggtggcaggaccggatgcggcggcgcggccgccggtggctctgggcgttcgccggcgcgccgcggcccgggagcaccaagacggtgcgcgcccagatcatcgagcagtgcaccgcgtcgccgtcctgcacccacttcgggagctcgccggggcactacaactcgccggggcggatcatggagctcctcgagtccgccgcgttctgcgtccagccgcgcggcgactcctacacccgcaagtcgacgttcgactccatgctcgccggctgcatcccggtgttcctccacccggcgtcggcgtacacccagtacacgtggcacctgccgagggactaccggagctactcggtgttcgtcccccacaccgacgtcgtcgccggcggccggaacgcgagcatcgaggcggcgctgaggaggatcccggcggcgacggtggcgaggatgcgggaggaggtgatccggctgatcccgaggatcacgtacagggaccccgcggcgacgctggtgacgttccgggacgcgttcgacgtcgccgtcgacgccgtgctcgaccgcgtggcgaggcggcggcgcgccgccgccgaggggagggagtacgtggacgtgttcgacgggcacgacagctggaagcacaacctgctcgacgacggacagacgcagatcggcccgcacgagtttgatccatacctgtagctggagtagctttaatttgtagcttttgctcctactaggtgtattatttcgaattgaaaatgtacttgatttttgttaagatttcatcgcataggtgaaatctaccagaaaaattaaatgtcatccgaaagtctaatcttcagagaaaatcacacacgataaaatagcttacgtacctttttttcagctgctagttagcggaatcatgtttcgaagtactccctccgtttcgaaatgtttgacgccgttaactttttagcacatgtttgaccgttcgtcttatttaaaaaatttaagtaattattaatctttttcctatcatttgattcattgttaaatatattttgatgtaggcgtataattttacatatttcacaaaagtttttgaataagacgaacggttaaatatatactaaaaagtcaacggtgccaaacatttcgaaacggagggagtatcaatcaatgtagtgaacatatcacacggtgaaatctacctaaaaaaaaaaagcttcctaggtgtatacgcctaaccttcagatatcgatcaagtgacgaattctaaagagtagagacagccgccacaaatttggtcgcctatccatgtacacgcagtgtgctttgctagcactgcaatgttagtgcatactctactaaattacatcata

SEQ ID NO: 44627 - DNA, 15984 bp, Oryza sativa
aattcctgcagcccacttgtgcatttcaatcctaccacgtacgactgacaagccattttataacttattgaaaataatttataggtaaaacttttatataagtctttagcgatttaaaatctaatgctaaaagataaacaatgattaagaaacctcaaaatgaactattaaaaagtttcaaaattttaattttgacagcggttgataaaagctataaggcaattcctttaagcccggggaaacctctttttcgtcttccccttccactcccactctcacttcattcaacactggtccctatcccgaaacctaaagtctaaacttagtgttacgcatgggtggagctacatatacttaggctctgttcgcaagagctggttcccaactcgctactctcatttttcgcgcgcacatttttcaaactgctaaatagtgcgtttttaaaaaaaaagtttctatacgaaagttgcttaaaaatcatattgatccatttttttaaaaaaatagcaaatacttaattaatcacgtgctaatggactgctatgttttccgtgcgtactgtttgggtcaggaaccggctggagcgaatacaggctttggggggtgcccaagaatatataccccatccgttcaaatttagcttaaaatttttttagctataatttatctattttcaccatatatatatcccatgcatccaaatttagatacccatatcaagctaaattcgatccaaaccctccggagaagacaccattaacattgccagagcacaaatctcggcgtggattataaggctagcaaatttgactaaaacaattgaaaaattataggcgcctgaaatctaacaatttcattttcttaaaaatcccattccccctacccggtggaccatggcaacattagaatgccaacgacaacaaattcaaaaataaaacaaaaaaatggttcattttgctgcggccaacgttaactttctcaacgttcacggaaacgtcatccaaattagcaaacgaaacacaccaccctgtgaaatttcttttcctcgtttcaagcaaaagtagtgcaaaatcctcccctgcccccacgtgaacggtgcagttgtcccggccgctctgctctactgctttttcacctcaccgacttaaaatccttctctgaatttctcaccaacgccaaaaacgccaaaaatcgcagaaatccccagaaaaagaagagaaagaaagaaagaaaagagagctcttctgcgggcccaccggagaggaagcgatcgccgccgccgccggcgatggtggtggtcgacgggctccacgacggcggcggcggtgacctccaggccttgctggatgacgcggtacgagatggccatggcccgtggggttttggtgattttcgggttttggttagaaagtgtttggttctttcttgcagggggtggatgatgtcgcggcaaggggcggcggcgaggtagaggaggaggtggagcggccgtcgaacgaggacgcgttcccggcggtggagaagatggcgacggcagcggcggcgaaggggttgcagtgccggcactgcgggacgacggagacgccgcagtggcgccatggcccggagggccaccgcacgctgtgcaacgcgtgcagcatgcgctaccggagcggcaagctggtgccggagtaccggccgctgaggagcccgacgttctcgccggagcttcactccaacaggcaccaccgcgtcctccagctgcgccgccgaccggggccccagtcagccgccccgtcccccgcggcggtggcgaggtacggcggcgaggcgaaggaggaggaagaggagctggcatgggtgtcgaacaaggacgcgttcgcgacggtggagaccaccatggcgccgtcgccgcgggtggtggagacaccaccggaacacgaccaccggccggcgaacaccccgaccacctctccagagccgcactccgacagaccccgccgcgtcgtccagctacctcgccgcctgcaggagccatccgcatcagccaacctcgcccatgcagtggcggcgacggcgagggcggggcgagagtgcgcgcactgcgggacgacgaagacgccggcgtggcgccttggcccggacagccgccgcaagctgtgcaacgcgtgcggcaacaagtaccggagcggccagctgaacagcacgaccttctcccagaattcccaagaacagaagaagaagagcaagagctcggcgtgttccagggagaggaagcgatcggcggtggcggcgacggtggtggtgggtggtggtctccgtgacgacgcggcggcgatcgcggacgaacacctcgacggcggcgacctccaggccttgttggatgacgtggtatcgtgtggccgtggggttttggtgatttggcgaggggttttggggggttttgccttagaataattggctctttcttgcaggcgttggatgacgtcgcggcgaggggtggcggcgacgccggcgaggcgaaggaggaagaagaggagctggagtggctgtcgaacaaggacgcgttcccgacggtggagacgatgtcgccggcgccgccggagaaccgaacgaaggcgcccgtgccgccggcggggtggcagtgccggcactgcgggtcgacggagacgccgctgtggcgcgagcgcgacggcccggcggaggcggagcacgtgaggaaggaggagacaccaccgaacatcaccccggcaaccaaacaccgccgcatcgtcgacctcctccgctgctccactgctcttaacacggcggcgaaggcggtggagcggcggtgcacgcactgcgggacgacgaagacgccggcgtggctgagtggtccggacagccgcggcaagctgtgcaacgcgtgcgggaagcagtacaggaaaggtcggctggtgccggagtaccggcctctcaactgtccgaccttctcgccggagctgcactccaacgcacacgcacaccgccgtcgccgagagtcgccggtcgccatcgccatcgccggcgagaagtgagagaaaatgtttaaccccccgggattttgtttagggtagggatggcaatttccccgttgggggcgggacccgtcgggtacccgcccctacgggaacagggacggggtgaaatttcaacctgcggggctgcggggacggggccccggaactatgcgggggcgggggcggggccacaagctcacccgcgggtgacccacggggccccggaatataggatctaaaatatggcatacagcccataatcaaatttaggcccatatagcccaatatatatatacagatcagtaaagagaagccaaccctaaaatcaatcccgtgagtttgtcaccgccgccaccaatctctattctcgttccagtagttttgacttttgacgctatcccacaaatcacgcaacacatcacacgctgcacgctacttcggcgcttcctcacctccacaaatcacgcctcgcgagttggtcccgcaccatcaagcagcggcggtcggcgctcttccacgctgcccgtatcgttgctctcacggacgccgtctccccatcctgccatccgccggcgcctcatgtcgttctcctacctctccagccgccggctcctatgctgttctcctccttctccgaccgttcctctccctccggctgctgcaggttctccacatcattattcccttcctccacccggctgctgcaagtttcccagaccattctttccttcctccggctgctagcagtcgccgctcgcatctgggtgcggggccccggaggggccggggccggggattgattttgccccgttcctcactccggggccggggccgggtgaacccgcaaggatgcgggggcggggccgttcctatccaaccctcacccgccccgccccattgccaaccctagtttagggaggcgatttagttggcccgcccaattttgttagcacactgaatgtttatgttttttgctcttgctaggggagtaggggtttttgcctttttggactaagtagacttctctatggtttttgaaaggatttcccattgactatttgccactcttatgagtggtgctaaattatttgtcactggacccacatgtcatatatatgtgagggcacacatgacatagacaacgagtggcaaaaaaattaattgccatatcttaaaagtggcaagaagttaaatatcccatgcgcatttgtgattaaggagtctagaattattgcttttgaaatgtaaggagatactccctccaaatttgtgcagacatacacgcacatgccacactcacattctcgcaaatacgctctctaacacatactctaagaaacaggaaaacctgtggcatatccgtgatctcgctaaagttctattgaaactttgaagcctacctacatatgcgtaatattaatgggcatcaagatttgaaccctttgtgagaagttatgcacccacaactataccaccacgtcactagttcttactcctttcattttaaactaaccaacatcatatataaatgaaaatgggaaatggaaggggagtgttaaggaagacaacaaattggggggtttctttttattgttatcatttctttcattttctggatcaaacaaggctaacataaaagacctttgcattttgaagatccgcggagttttcaatttcattcacaagcctgacaaaatggagcttatagctcagtttacatgcagatgctttcgtaggtaaagaggccaaacttggttcttagccccccaaaaccaaaacccaacacatggcaaactagcaattgcatcatcgcactcaatcagttcatcgctgccagtctactaacttgggcaacgcctatgtgaaggcccaagtagtgaagcttacaccaagaataactagctggagctcacatagtgctccaaaatgaggcctggtaactcaagtgttcatcatcgaggtgtacccttcacacggatcatcttcaacaggttactgcaagctggactcccagaggccagagcagcaagatgcaaaacataggtctctggttgctaattagttagctacatatattagttactcccatcatataggtctccacctgctaattagttaactacatatactagttactcccattatctagaagggttatagccggagaaggctagccatcgccacgctcctcagagaccacaccacctgcagtatgggttttattcatggttatgaaagcatgtatgagaattggaaagaaaaagaacaagtaaatgtatcttactggaaagagtaatagctatgtttgcttggcgatctgcctcggcattccattccttcatgcagaaacagaaagtggagaaaatcagcaataccaaaaagtatcagtgccttagagatatagctgttgttttagcttgcccaaccaagcatacgctagagacaacttctgtacagaaacatcagatatgcagtgaaggtctaggaagaatgagatgccgctgatgcaaaacgagacaaaataatgttgtctcactgttcatgcttatatcaaatcatcaacgtaaaaatgcaatgcaggaaggaagtttaaataatacccgtcgaatgtggttgatctcaaatgagacgaagttttctttgagctttctcacttccttgcacagttccatcatgttctggttcttcgtttgccatgtacctttcacctatttgagaaatatatgagaaagctgttagcggagaaaatgatactcttgtctaaaatatgtagtttgaatatgtgataacggtatgagaaaaactttctatgaaaaatacttatatgaattctttcttaatttactatattgtaatgggcattgggctgaggtccgaggcccatgactatgccaaagagaggaatggcagatcattttcagtttctatatgtgctttgttcatgatttgatttgaaacatgatcttaaatgtttgcttctaggaacatttagttcttatttcataattgaaagcacatcaagcagcatgacaatcccaacatgccggacaggcagacaaccataaaaaggaggtgacttgattagtgatgaagaagcaaagaacaaaatatacctgataacagactagttgagagtcgccatatactatgattttcttgaaaccatgcctaatagcatatctcaatcctaagatcaggccccggtattcagcaacattattggtaacaataccaagaccctcgcgaagtcgagatatcttcaaggataagtaagcacatgaaataaaagtgaaaaccaaccattaaactttgaagtgcattaagtacttaagtataccactctcccatcttcagtcataagcacagccccagcacccgcttttcctggatttcctttcgatgcaccatcgaagtgaagtaagcataccatctgaaaaaacagataaggtgcaaaacatttatacgagtaaaatagcatgtattaatgaccaagtagatgacttctatgcaaggtgaggtgaggaggtaaccctatggcaacataaatttctagctccacagtttgcctgtagatgtgacagttggattaataagtggaaaacttacatgcaggatctgagcacaattgaaacaactttaagggttaatggcctcaagtacatagattattaaatttattatttcatcatccatttacaaaagattctgcagtaaagcatcctaaagagatgcaagaaataggcacagttgaatagtaattaaggagttaacagtcttaaaagaatgtcttactgatacgacagccttatcaaaacgattctgcaaagcacacctttttcttttggagaatacacaggagataaatttttttgtgattacatggaagatgcacatgcacaaacaccaccacacaagcacagcacacttgtgcgtgtaccccttaacgcagttcaacaggcagaggcccatggtaaatctgtgagcctgagtgtgtaagtggggacatcaagatttgaaccttagtgggcaaagccatgcactcacaacgcatcttttctataaagaagcaacaggtactacaagcttgaaacttcctatcctaatcatgtaatacttattcatgttggaaaataaaaaacctgttatttccttacagataagatgtcagaagttaattaatgaaaaatgaattagtggcagaacatgtttgtgatagtaggcctacctggtcaaaacaatagaaaaacgaagctagtgattaagagcattcaatacaaaagcatattgagcattcatatgtttttctgtttaatatcgaacttaattaacacaacaccttgaatagcacattttttaagaatgcattatagctttagaaatctgataagtcaaaagtattgtagtagatgcagaaaattaatcagcaaaacaagaccaaactttacatattgtttcgagagaggttgtgcatcaacagttccactctgatcaagattattcggtgagaaatggctggaagaactaggtcttgattcctgcaatataaggccatcatattattccaagtaataacaagtgtcttgaggatcaacataaaataacttgaagaatcagtgtatcctttattaagggttgtcaggaacatatgactacatgcaaatgcatttcagcagaacatacatatgcattgtgataccatattaataagcatgaacatgatgccctgctcaaattaaaaagaaaaacagaattaaatctctttatgcatgtgtatgcatgatggaagccacatggtaactcatgattatgtgctcacgcgaatggacattatacactttaaatgtgtatgtactggtgccaccgtcctgcatttacatgtggttaggaagcacttaatcacatgctctgaaaatgaagtgtgtacctaatttgcattatcatcacctgtgccaaatgttgctaccagggaaagtataaactagaaataatgttcattttcctcatattcactcgttatgtctagtggcatgctaggcacatacatacgcacactcgcagtctcaccatggtacttagcttaccagcctgttaaatgcttgtccccgaacagagtagccttggttaatacgctggctatagtgctcagctgaggcttgaccagatcccacggcatcctgtaataaagcaggatgaggttttatcactgatatcttgaatgcttgcaatagcaaaacttacgtagttcagatccacggattgtgccccaggctgatatcttgtattgttaaggacacctgtatgatttagagctgattgatttgaactagaaacagttatctcctacaaaggaagacaaagcatgagtgaataaaaaaacaaagctagttttttttttaaaaaaaattatcccattacacaatattggagcttatattaactttgtcagattcgacatgtcatccagagatggaaaaggcacatataagtgtgttggcacattacctgaaaagtacaggggataagggtaccaaatagatcttccctaagttcagctgcattgattacatatgtagcattacttaacccacgcgaagagaggtattcctccttttctctgctccaagagttacccttgtaggcacttgcagcaggaccagataccttttgaaaacaaatcagcaatctcaagagttactgtccatatacaaagaaagaagcatgaaatttacagtatttataatcccagaatgtattacagacggtgggagaagtagttttcagaggagttgtgcaattcttacttgatatttgaaaatagaagtaaaattcaccaaaatgttgatagttttttagtagaaaacgtgaagagggctaacgttgacttgtttcatctcccttcagttaagctaacgacatggcaagatagaaaaacaatccattcaaatgaatatagaaaacaaaccacaaatgaatattcaaatgaatatagaaaacaaaccacaaagttaaccctttgatacatgaagatacgcaaattgtgttaggaggttgagggagcaaggataagtgcaaagttgcataaacaacttatcctttaccttatcaacaggtaggatcattgtgttctttttttaaaaaaaaaaatttcacaacagcaaaaccaaaaacttacactataaatgagaaaaatggatgaaaacaggaaaacttaatgtacaatcacaataacattagtacaaatacacataccgatgagcaaatttgagcctggcaatcatttaaagatttgtaaacagctaccatctcccccttcctgacaagataatagttgctgccctcttccatcgtaccaaatgcaattctgtcaaaaagatgaagcacaaatgaagaagatcatttcagtgcaaatgtgtcatcaagagaactaattctagtagctacataagtgataagtattgcaatggtcagttacgatgccggcatagttagagaccagcacgaacagcagcagcaggcactcttgctacttacccgcacagctgcacctgcaggaacgctagtggtcaccccgcacgaccgttgtcggcgtgatctccagaagagagtgctccccagaggccagtgatataagagatgccttatgtgaaaaaaccagtgcacaatagtcttttcgtatatgtatttaagttttagaaaaaaaataaactaaaatggggaaaatacctagatatgagcctattgtagctacttttacgaaaacaggtgcgaatcctcaattcatacaaaaataggggcaaaccctgaaggtcccctaaaaatagaagccctaaaaagagaagcgaatactcaattttcccctggaaaataagcctaaactccatcagatcatcataataatgcacaaatgctaccccgaaacgttacatatcaacaaaaacggctttctctaactttcacatattttaacccacttgagaccaaatgctgctgtcagtctaatagtatatcacattacattcgatctccaatggccaatgcaggtgcagctgtacaacagtacaagcattcgaatagatctcctaactttcataggattctacgcggaagggatgctgggtttaacaaccaatcggaatcggcgaacccttgatcctagggaggattaggatacctgaaccctgccggagagggcgacggcggccagcccccgagcgtgagctgccggagcgagggagggcgacggtggagcaccggagggggcggcctggaggagagggcgacggagaggagagcagagggaggcggcgaccggctcggagcccgcgagcgccggccgccggagcgtcgcgccgatgagcggcggcgcagtgagcgagtgggccggcggagtcggaggaggaaatgcgagggtttggctcctcgtgggccggtcaaaaaaaggcccaatctgcacggggtcacgggaatattcggtcctgagtcagcacgccacgtcagcattattgaaaaatatatatatatataaatctaagcttctgttaaccctttgcctataagattaattagttctcaaatttagaatttttattctttttgaatttaattttaaaaataaatgtcaaaaacttatttccatcatgaatgttttgtcacgccaatacttgcatgagaaacaacactaccatattatgagaggttggtcttgcaatattgtttggctcaaagattaagatttagaaataagttttttgattggtttatttttaaatcaaaaaagttgttttaaaaaaactcaaagtgactcaaatatggtctaggtcaagtctttgtatttaaatcgtgaattgaaaaggactttctctaaatctttttatataaatcatggagctaatccgtaaacaacttccatgcatgttgcactttcaaccgtataaataataagaacaagtttaatgatagagctcattacaagctataagcttattgtaaagctatagtttatataagtctaaaacttaaacctaaatgggctgattttaccactagaaatctaaccaattgagttatgctcactcagtgcataagaatagattggagatgcagaatgacaaagttgaatgattttgtcatatgttgtggtcatacgttgttgattggtgaggtcctcaaaacacaaaaaggaatgaaccaaactctctaagctatatatgttgtcggtgatatgggcccggaggtatcgtgtacacagggaggaggccgcccccaaacccccgtggcacttccccaagggggtcgggcccaggatggagcggcggctatcctctcctagttgggggtcgggccgccgggggtcgggccgcccagaccctcttcacgcacctaccaacgtgcgggggttaagtgggcgcgcccaatacccaactaactacatttatggtggatgttgtggccgtgctgcaccgcatttaatgcggcatgcgggaatggctgacaggccgagtgagcttgattgaccagcgtggcagggtgagtgcgcctgccacgctgactgcctgtgtactggcccgttgtcaagcggcgtatggccggtgccgtctagtcacatcaccataataagaaatccctcgccccatgtgcaagccggagataatttcctactctaatttaaatcagggtatccaatccctagtgggaacgggtacctaaagtcttaagatggtagatggggaatgacgcacacgtaccccgtgtcacccgccgtgatttgatagggccatgctggagcgctgaaggcatgatttcctttgtcagaggaataagacgtgtaataaatgtataaaggatgtcttccttcttctctaggtagaccgtttgggcccatgtagtaaccccttgaggtataaaaaggaggtgcaggcctggtgagtgagcgatcgaacacattctgattgaaccaactagtacactgtgtctctcacagaaatcaagcacacgcaggagtagggtgttacgcttcttagtggcccaaacctgtataaacctcttttgtctcatcgttcttgaggggcccgaccccctccacatcactcctggcaccgaacctcgattctaacccgctgcccccggtcgaactgaaagggggggcccttagtcccctgctccaggagttcaccctctgacatatgtgaatatcctaaccctagaatagggagatgaatccttttttttaaaagataatggatagaaattcgatctatatatccaaaagtggatatacacagtcaaatgttacacaagtgcatatgccataaatctcaaagttgagataaatgaaaaataaacaactgaaaagaaaagaaaagaaaagaagataaagagaagactaagcctcaatcttttccttcatgcttcaaaatagggaaaagcgacagctagcccgcccttctactgccacaccttctcaatgacactacatacaccacaaaagctcattcatttcatcataagcaaaggaatgggacggaactagtccactcagcccgccgaccagtctcacgtccctcggacaacctatgaccccacatcacaaacaagtccatgcggccattccattatcatcagagagcaccaccttaccaccattgatgccaaataacatgacatccatcacccccgcaacgtgaatgagcttgccactaccctaccattgttgccgtagagcctcacatctgccgagccgttgaagcttatctcatgaaaaaaccgatgccaccacgctatcgtggctgcaaactacaacctctgttgaactatcgtagcttatctctccagagagccattgccgccactccatcctcgcataccgtgaactccaatgggctgccaacatagccaatcgccgagtccaacgtgcctagctcctatccaacttcttcaccgctagccgccgcccaaccggcaagcctctagctgcctgcaccgttcgcatccaccaccagtgctccgcctgccagatccatatgagccacctgcgccgctaacatctccacaaacgaaatgaaggagaaggcctcgccgccgccgtcctagcggcgaggaaggtggcggtggctgctagggttttttttttaggaggggaagagttgggagggcagccaaggaatcacagtcgggagaggaatccatgttatctcactgcatttcttgttcatgaatataactatttctaacatttaaaatttatccacaaatataagcatttatagagtacaactccctcgggccccggcccaaccaccctcttgttatccaaattttgctgaaatttgtgtcgaccttaacattaatttctgtttaaactcttatgaatgcttatatttgtgaatggaaggagtactaaattacacctaatgggactaggtggactacctttcagagatgacagaattgcttctggaatggaacaaccaactcaccaaacaacgagatgaacatggaaacacgccgctacacttctctctctcacaggaaggcgagaagcatggaatgcttcccctctacgcagtgccccgttaaaaggggcaaagccatcgcaacgctcctgaacatatcagaaccaccactggagctcaccaggacattgctggaagcagatgcagactcagcattccagccggacagaagagggtccttcccaatccacatcgcggcctcggctgcaggtaaggatgcaagcgggctttttttttcccgcttatcccacttctagtttatttttacttctaaattttgtactactgtacgagaaataaactagcaaatgggtttttgtgcgggtaacgggactacccacttgtatcccctagctgcaggtcggctctcggcggtcatcgccttgctcaccatattccccggttccgccggattgcgcgactccgatgggaggaccttcgttcatgtcgcggccaggaagaagaggtacagtgttgttgcacacgcttgccagacgccggcattgtcagggatcttgaacaagcaagacaacgaagggaacactgctctgcacctagctgtagaagctggggattggtggattttcgcctgcctgttcgtcaacaagcaggtggacttgaacttaccaaacagtagtggacataccccgctggaactctctattaacactatcccgacaggactctactgtctcctggtaacacgtcgaattccaaaaattgaatgctttgttctcacatgtttggtaaaatttgagaaaaaataagagaaactaagatttgtacctcctctctgcagaactcgcggattttgatacaggaaacactgatagccgccaatgctacccgcggcatttctcggatggatgctgctggtacggaagaacacggaccccaatctgaagccgagaatgaggaaaaagggtcagaaatagtactacctctatattatattttaatgtatgacgccattgactttttgttcaacgtttgattattcatcttatttaaaaaaaattatgtaattattatttatttaagtgtgacttaattcatcatcaaatgttctttaagcatgacataaatattttcatatttgcataaaaaatttgaataaaacgaatagttaaacgttgataaaaaagttaacggcgtcatatattaaaatacagagggagtcaaattcgacgcaatttctcagcgttggcttggtcttgatcacgacgatggcgtttggcgccactttcgcgttgccagggggttacatagccgatgaccacgccaacggaggaacgccaactctagctcgagcgaagcaattccaagggttcgtgatggcaaacacgctggccttcttctgctcgtcgttggccgtcctgagccttgtgttcgccgggacaccaacggtagagttgccgatgcgctacacgcactacaatatctccatctggctgtctctgaacgcggtaggatccttgccaatagcctttgcaatagctgtttatatcatgatcactccggttgctgccaagacctctcctgcagtcatcgtggtgattctctcggtagggatcctccattccccctcgataaccgagaaatttactaagcttttgttggtgctatgtgttagaccaggagtattgccagtgttaagatctagcatatttaaggtaatgttactcatgttttggccactcatagttatcattggttggcaagagttttcatcgatgatttgaacaagaggactcaagagtgatactgtgatatatggacatatttcttgtgcattctgtaagttttttcgtctcgtttgaaatggacatgctttttatgaacaatgcataagatcaaggagaggagggatgatttatgattcttttttccctgtttccataagagaatatatcatagctcacaacttcgttttctctgagacactctgctgtgcaactataactagagcagtgcctagcaaatagcaagtgtggatataatacagaagaaatcactgacggttcaggacagtaaaattcatgttctaagttgcacctttcaaaaccttcaagtcctaagtgtacaaaatcactaccaagatgcacgttaaactagagtatgatttagtcttgtttatcaataggggccacagaattatagacacacctggaattagaataataaggcaagtcttccgcaaaatcaagcatctcgattctcgataaagagcaatggactgcacttgagacttgacaaaaacagagcatcaatcaggctatcaaacttgctctaaccctcttcctgatttccatcaaacataagttactccaagttagagataacaagaagaaatgcttgcatatctatggaatgcaggctacacaaaagaaagctttaagcttcaagaggatatggacgatcaagagttgcagcatgtgaaccagtggctgaagaat

SEQ ID NO: 44628 - DNA, 784 bp, Oryza sativa
  unsure (1)..(784): unsure at all n locations
nnnnnnnnnnnnnnnnnnnnnnnnnnnnnnnnnnnnnnnnnnnnnnnnnnnnnnnnnattagagagatagactcaaagaaaaattacctataggattgaaatcctccaaaattcctatgttttcctccatatcaaagggtcccttactttttttttacaaaagaaaaaagataaaaattgaagaagacaaaaaaaacttgaaataaacaaacctcccgtatttgtatttttttggatgaaggaagtaggattatctcataggcatcaacaaatctgacattgtgccatttttataagtaggtcttgaaataccactttacaaaagtggactcgataaaatatcactcttgacccatagctacatgctgcaataccatccatgagcaaattaccgttggcttcttacattcccatcctcttttccaactccggtttatcccttgccgtgtgcccaccgtgaggacgcgccctttcccgagcatgtccgtcgtcgtcgccgcctagctcacctccaagcatgcccgtcattgttgttaattgcgctgttattaagctcggccatcgctatgacggcggctcaattcggaggaattggggaagaattagggtttttacttggaagtcggaactcgaagttgattggagagagagaccaggattgcgacgaaagatctaagggccccttagaatcgcaagattgagaaaacgtaggattttgataggagtgtaagtgtaaaacataggatttgtaaatgcacgaaaaacacaggaaatgccgtttgat

SEQ ID NO: 44629 - DNA, 16827 bp, Oryza sativa
  unsure (1)..(16827): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctgcacctcagctccttgcccggcgggagagggacgaagcgcagcgccggcgcgggggcgaaggggtcgcaagtgatgaggcaccaagagaggtcgacgaaccagagcctcccggagtgcgagacggcgccgttgggggccaactgccggggagggaacgggtaggcgacctccttctcgacccactcgccgacgtcggaggagaagcagacgagcgtggcgtggtcggcgtggaggatgggctggagctcggcgaccacgtagcggccgccgccgtcgggggaggcgaggagtcccatgtggcccatgtgcatgacgagctccgggtcggggagagcgaccgcggtggccgtggcggcttcaaggacgaagtagcccgggacgaactggcgccacatgaactcctgacggccggggcggtcgatgacggtggggcccttggcgcggccctggtcggcgtggaggaggaggaggccggaggggtcggcggccatgacgctggggaagttgtcggacgtggtggcgctcgggaagatccgctaagggatggtgagcagcgagacgcgcgggggcgccttgagcgcgagggagagatcggcgcccgcagggatcccgcccccggcccccttctcgtcggcgccgcagacgcgcgggatgctgcccaggatcacccacgtcgacggcggcggcgacgcggacgccatcgtctcggctggcgacgaggcggaggaggagaagggcgcgcgggtgaggcctagcggttccgcgtacgcgtatgccgcggcggctgcggcggcggcaacggcggcggaagtggtgataccgtgtcgaggcgtggaggtggaggtggtgcagaggcgcagcagcagcagcctttgtagtttgaacatcgcggcgcgtcgagtcctcgggattctctcctcgcgtcgtggagcgtggccaaataatgatccgagccgtaacgatcgatcgatcgatcgatcggtgccgcgtgtcgggtttcgggagctgagaggatctctcggccgtaggggtgaaaacggagcggatagtttccgtccgctccggtcaaaaacggatacggatagtgttcggagcagatttttttcggatagttcgaatacggatacgaatacggatattttttctccggatacggatacgaatatggtaacgcagtttccggcgaattcgaatacggagccgaatatccggagattaagatgcgcggatatccgcgtaacgcttgatgtctctccagcctccagcccatcccttcaatttcagcacatagttttctctcggctatctaaaccctagctgccagatgggcgacggcggcggcggcggtgacgacggcagcggcaagccggcgacagtggcggcggctgtcttagatctccttggctccttgctggagttgctgggcattggccttcaatccccctagtgcttgtttgtgcttcctatctccctaaatcgtgggacagtgggaggctaggagccgtcaccaccgtgattgtagaggagtatgctaaatataaggtaagcaagaatgggtcaggtgacactgtgattgtagaggagtatgctaaatgcaactagtgctcatataaacgtcggtgtgagagtaattgtggcacttctgttttctggaatcacttgaataacaagcacaacatcaagtcaggtcaacaacatctacagatgaaaaagagtgaagatggtactgaaggagctgttgagacatacaggtatgatgagacggttagcctgaaaaagttctataggcaatcatcatgcatgagtatccctttaacattgttgagcatgattactttgtggattttattaagtctttacgccctacttttccaattaagagtcgcattactgtgagaaaggatattctaaacatatatgaagaggaaaaaagaaattgtggcagcatttgcttacactctcatgccgttttagcacaaccatggacatgtggacatctaaccaaaataaaagttatatgtgcatcacagttcattggatagatgacacttggaagatgcaaaagaggatcattaagtttatgcatgtagaaggacatcattcaggaagtaatatgtgcaaagagttttatgacagcatagttgattggaatcttgatagaaggcttgttggacttactttggacaatgcatcgtctaatgatgtttgtgttaaggatgttattttaaaactccgtaaaatctctcctttaatttgcgatggcatcttctttcatgtgagatgtttcaatcatatcttgaaccttgttgcacaagatggtttgaaacaaatcacatgagctgtattaaagatcagaaatactatttcaattctaaagcactcgccactgcagtttgaggcatttcagaagtgtgccttggaagttagtttggataacacaaagggcctttccatggatactcctacaagatggaactccacatttctcatgttgaagaatgctatctactacagaaatgcttttgataggttgtttcttcggcatggtagaaagtatgcaaagtgtgctcccaccaaggtagactggtctatggcaatagcactatgcaagtgcttgaagccatttcatgaagcaactgaactattctctggtactacatatccaacagcaaatcattttttcggtaagttttgttccatcaagctttatattgctgattggtgtaacagtacagatggaacaataaaaaccatggcaaacgccatgcaaactaaatatgataagtactgggagaagtcgaatatggctcttgctgttacatgcttccttgatccacgttacaaaacaagttcaatagagtactatggtatgaagatttatggtttagaagctgcagaaaaatttgatgagttcaatggggttatcaaaaaattgtttgatgtttatgctactagtgcgtgtgcaacatcaaagaagaaaggtgctgaaatgcatgtgcatcaacttcaaattcaacctgatcctgttcataatactgatgagtttgatgatatctttaatgagaatgacagtagccatgatcatgagcaacattttcaaagatttttgcttgagagaagtcagccaatttgtagtgataaaactgagttacaaatttacatggaacaaccactgttactatggacttccaaagatccatttgatattttgtcttggtggaagctcaaacaagcagaatttcctatcctctgcaaacttgctcgtgatttcttatgtattcaagtgtcaactgttgcttctgagtcggcatttagtgctggtggccgtgttgttgatccatttcgcacccgtcttgatccagaggctgtgcaagctttagtttgcaccaaagattggattaaagcagctaacaatagtacactttgtgtctgtgttcattgcttatttggccattccttcttgtatatatcaatatatgtatagctgatccatgatctgatctggcatcattcttaggttataagactcaggctatcatcaatgaattggacattgaaagcgtagagaggcatctggcaaacttattgatagtggtgagctattttcttattttacctctatgaatatttttcttaatataacaacaatattattcgactcctgtaggaaaaagaggagaataatgatgacatggaacaggatgatgttctgatggatgaaatggatgaataatgatgttgcagttttcatgcatcggactgcaagtgtactgaaaattgctttgggctaattactattttgatcttatctgtgttacctatagaactcgaactcaatatgtgttgaacttttcaacgtgtttcgatttgaacacgatacactttgtttaatctgtgatgcgtcctacaacgatgatatttatattaaattagataaatatatgtggtgcatttgtatctacgagcagtttgagtggtctctatattccgagaaatattcgttttcgtattcgtgtccgatcatattcgatccttattcgtatccgcgataattcgtattcgtttccgtatccgagttattcgtattcgtttccgtatccgcctaacaatatgaaaatggatacggtaagagcattatccgtccgtattcgctccgttttcacccctactcggccgtagtcgtcatctccgtgatcacgtatcgctcgctgctttttctccctttctctgcgctgctttttctcccttcctctgcgcctagtgctcccttgaccagacaggaaagagctgaatacgagtagtaaatacatggaaatcaaaattgtgtgactagtagcggtactctacttaaattagagcttctttaaaactgtggattttcaagatgcatgggaaatacccctgattagagtgctctaacatcttttattctacattttgaaaaaaatatagaaataactatttgatggagcgtatgaaaaaacacataattaaaagagatatagacaaaatatttatccatgaggaattcctcgataactcctatgttttgagccaattcaaaggtatttcatacgatttttggatagttatccttcgatccaaatggctatgtaggaaaacttttataggactaaaattcttcaacctagcccttatacatactctgacccccttttttctaattaagatacaaattttattttgatttccgttaacacattttaaaccgctccacgataaacttcgtgcgaaaaatttgtatgtagtgcctgtttggtacaactctaactcctaaatttagcttcaggagttgagtctggagtagagttgtggagctgcctaaagccctaaacctagctccacaactgtagttcattttatgagagagcttcacctagctccgctcccagttttggtggagctgaaactatttggctgagctgtagctccaggatgggtggagctggagctagagctaggggtgtaagtggctaacccgcgaaacccacttataagctaaaataagccgcgaacccgattatttggacctacaagtgggttcgtggctaacccacttacacctctagctggagctgtgtcaaacaggtccgtataagttgttttaaaatattagataaatcaattttcaagttcataataattaaaattcattaaatatgaactaatgaattattttcctgtcgtaattttatgttttcgtgtcctagtacctctgtactctgtacgcggtagaggtgaacaagggaaaacaaacatgtgtagaagcaagccatgtgtagagagtggcttgctactcctatacagtactgtacaccaccagtacagtatgcacagcagcaagccatgtgtagaagttgcacaggggaagagaatcctctctgacatcggggaaattaaagacaaccgcgaagtgctcgcaccacagcgctccgggcgtttttgggccggcgtgttcgcacctgcttgtgtccacgtcgccctatttggtgtggctgtgttgtgtgaacccatggctgtgttgtgtgaacccataagcgtactcgcaccgtcactgctatgtggggcagggagggatgtgggttgctgttcatggtcctatcaatgctttcgttgcctgtgcgcttagtccattgccttaggtttctggacctgtctctgcgtgccccacttgcagcttctttggttcacagtgcacatggagtacagggtttttaacaccctgacatgcttgaccaatggtgcagtttgcacggctccctaacggcatgactctgctcctgcctacctgccatgcgtgctccgccgaatgcttatatgcagcacctggtctaccgtgctccaggtagagcccttcggcctacggtgtgcatgcgtgatggaccaggcccacggctattttggtctgctacatcgctttgatccgctgtgtattccgttgggcttgcattgaaaaaaagtcaccacacaacgtctcctctgtaaaccctctgcgggtgggctcgctgttttgcgctgtcccacatgccatatgctctggtgcgccaaatagattgcctccctgctgcacggcgccaaatagattgcctccctgctgcgccatgttttaatgcccaccgcttgcaccggcccgctgtcaggtgaggtccaatcaacgtcggcgtccgccataccagcgtgcgtgatcatcaatggggcaatgtcctgttttgccttcagcttcttcctccccattgtgaggccctgtttagatgggactaaaacttttaaatccctatcacatcggatgtttgaaaattaattataaatattaaacgtagactattaataaaacccatccataatcttggactaatttgcgagacgaatctaatgagcctaattaatccatgattggcctatgtgatgctacagtaaacattctctaattatagattaattaggcttaaaaaatttgtctcgtgaattagcttttatttatgtaattagttttgtaagtagtctatatttaatactctaaattagtgtctaagacagggactaaagttaagtccctggatctaaacaccacctgagagatttgtttgtctcctccgcttttgctttgctctgctctgctgtttccctctcctgctgacttcttcagccatgccgacagcttggtgggttgctacctccatacctagcagatgtcttcctcatgcgatttggttggttggtttgacgctacacggttggtgtgcaggtctgcgtgtgggatttccgccagcattgctgcgtaggatttggtgttctcgcactggttagttgcttccttgatgtgctgtgtcctggatggtcgattcttcatcctttcgttttgcttgctgtgggcaggggcaggggaggcggtcgcattgctctaccgcctgttggtcgctggcagttcacggtcgagggcaagttgatctccttccatcagagtgtgcctgcaccggctcgaagaggttgctgctcttttcttcgctgattttccccctgcttttcctttctatttgttcttatgtttgcccttgccttttcgtctgggttcttttctcggtggcctctgttgtgtctgccatcctgctatgttgtgtgcgtgagaaaataatgccagttggtgcctcacagattactgtgcatgggcccgtacaggcccgcgtaccagtactggctgcctccctcttcttatataacccaaacttctctgggcacttgccccttgcgtagaggttgctcttgctggtttttgaccaaccttccagatcttcctttctaccactcacctaggccccatctagcagcgccatggttaatgtgggggtctcatttgtctctctgttgaatgccgttgcttggcattgtcagctcccgctggtgtcctatctttgggaaatagatgggaatggcatgctgctagcaggtgttgagcttgcgctcccatcggaagacatggccggccagattgttagcaagttcttttgggtctgcgcgtctactcaaacaagtgactcgcatgaaatgggcgcgcatcaggctgttaggttcttgcaggctaggtacggctttattgtccacgattacaatcttcagatgttactttcctaccggagaatagcagcgtctacagtagatgcagctgttacagcctcagcgtgccttgctaggttccagtcacgatatgctccgacagatctatcgtgtgctggtgttgtccagcgatgtaacactatatggttcaattttcttcatgaggaccacatgtttagcaacatgcacaacctttaggggtattttgtttcctttagagggtgttagtgtttttcgctactgagtttgtctgcaatgagagtgtgcctttatgatgttattacataatgttttgtattgtctgctttcgatcttatgttcttcttttgtgcattgctttcggttagttcggtgctctctttcttacgactgatctgacgacgaaaaaacagctccccttttatccgctgtgttgttgcctctgagctatgacgagtaatccctctccgcgagttcaacgggcccgtgagagccgtttgcgacgccgtgcttctattggccagggtttgtgcttcttaacttgatttagaggcgcttcttgggttagatcgataagtttgatcaaccagatagttggggtttatagcatttttgcaggctcctctgttcggcggcgtaaatcctgtggtctctaggggaccaaatggttcgccaaatgctggaatagatgtggagcagtcggttcctgaacaagctctggcttctgatgttcatgtgcggtctcaggttgcctttgttgctggcacaggtcctttgacccagaattccataaccaccgctagcagtaagttgagcgatagttgtcccatgggctccataactcctgacaatgtcgattatgcttagctcctttgttctcctcattgcgattaggaaagagaaccctactagatgtgccgcgccacactgctgcagcaaacagggaaaaacgacgcctcaagaggtctggttctcagccagaccacctggtaagaaaaatcctagaaggtatggttaaatataccttttgtttcccctgtgctcgcttagtgtggcagttatgtctgctaaccatttttgctttcaccgatgcttgcttcctgggatttcgaatgcataggtcccgttcctacagtggatgacatcttgcctttacctaaggattacattgcgtccttaaaaggtttgctcggtgtctgctgtcttacatagcttcctttctgtcaatcaatgcagttgttaatgcttgcaaacaatgcagctttgtgcccagagcgatcatactatggtggcccttcgcatgagtgtccttattgtggtgccgttttttggtaccaggagagggtaaagagagatagtgctgtttctcagagaaggattgtctataatctctgctgtaggggtggtaagatcagcctgcctgaactaaaatacccaccggatatgttagcgaagcttctgaaatttgatggtgatgcacaatcaaagcgtttcttacgccaaattcgatcttacaactcgctttttgcattcacttcattaggggctgatgtagaaaagtcaattaacaatggaaccgcaccatatgtctttaaaattaacggcgttgtgcaccatcgtattggcagcctcttgcctcagcgtggtgcgaagcccaagtttgctcagctatacatatatgacaccgagaatgaaaccgctaaccgaattaacattttcgatagagaaaactcaaacgatgagcctgacccatcaattgttacaggacttggcgctatgctcgaccaacacaatgatctggtcaaatcgtttcgctatgctagagatcgtttaaacgagcatggtaatgagcagattgcacttagactgcttgggtgcaatgctaaagatgaagtccaatataacctgccaacgagtggtgagatcgcaggaataatagtgggcgacagctcaaacgatgcgtacacgtatgatgtggttgtccagtcttcggataataggctgagacaagtctctgctttgcatccttcctacatggctttgcaatatcctttgcttttcccctacggtgaacgagggttccacctcggtataaagtacactgatttcccgagtattgctggaacatcacggcgatacgtgacaatgcttgaatactatcgatatcgctttcattataggctaaacaaaccgaatccatatacatgttgtggccgtcttagtgactcgatatgtgtggatgcatactcaactgttgagggatcgaggctgaaatttatacatgaccaccaacctgagttacgttcagagtgtgttcaagggattgtcgatgccattgaccatggcctcgaatctggtgattctgttggcaaaaagtacgtcttgccatcaagtttcactggaggtcgtcgctacatggtccagaattaccaggacgcaatggctgtttgccgcgtgttcggttcgcccgacctattcgtgaccttcacgtgcaactccaaatggcaagagatatacgatgcccttgtgtttgaaccaggccaggtgccgagcgatcggtctgacatgattgtacgagtctttagcatgaaggtcgatgaattcatatccgatattaaggagggaaggaccttcggtcctgtgctggcaggtagacgtcatctagacatgttttttcctatatcattttgtcatgttagtactgttcctgctgatatccatgcttccatgtagtgttgtataccgtggaattccaaaagcgtggtctcccgcacatacactgtattgtgtggcgtgcagcagctgacgccgaatttagtgctaccgctgtggacagtttaatttgtgctgaaattcctgatgtgtttagtgatcctttgggctatgccttagtcgatgagtttatgatccatggcccttgtggtgacaagaataaatcatgtgtctgtatgaaaaatgggcattgctccaagcatttccctaaaggcttccaagaagagacgaccatggatgagtttggctttactgtatataggcgtcgaaatgatggacgatatgtggttaagaatggaattaaacttgacaatcgatgggtcgttccatacaacatgaaattactgaaaaaataccaagcgcacattaacgttgaatcatgcaacaaatccaacatgataaaataccttttcaagtacataacaaagggtggtgatagaaccaaactatactttgaaacaactggcaacacaccaaacaagactgttgatggtactgttttgccaccaaatgagattgatgagtacatcaatgctaggttcctctcaacctgtgaagccttttggcgtgctttcgagtttgacatacactatagagttcctgctgtggaacggttgcctattcatcttccaaatatgaattttgttcagtacaaaaaaggaaccgacctaaaaaaattgcttgacagtcctgctgcaaaaaaaacaatgctaacagagtggttcgagtgtaataaaaagcatccaaatgcacgaacactgacctattgtgatttcccaaaacaatggacctgggacaatagcgcccgctgttggcgcccaaggacaccagtcgaaaaaattggtagaatttattatgtcagcccagccgctggagagctatactacctgcgcatgctgttgatgacagttaaaggcgcaaaaagctatgctgatgttcggacctttgaagggactgtttacccaacttttaggcaggcatgtgagtctagaggccttcttgagaatgataacgattggcatttgttgtttgatgaggcgatagtttctgcgtcgtccctgcagttaaggcaactatttgtgactgttgtaatgttctgctctgttggaaacgtccgatcattgtttgataagtattggttatactttactgatgacattcagcatcgccttagaacagcgctctcaaaccctgcttatgttgttccacatgataggttgctgtctcttttgattaaagaattacactctgcatttgcaaacagcggtggtaacatagatgactatgacctcccgcgatcaacgatacattcagatgatgaatttggaaatagaatggtcaacgaagaattggctcttgatactgctgccttggctgctcatgccagcctgatgataccacgactaaactctgaacaacaaaatttttttgacacaatagttagccgtgttagtgagtcgaggcctggatttttcttcgtgtatggccatggtggcactggcaaaacgtttttgtggaacgtgctcatttctaagataaggtctgagggaaatattgttcttgcagttgcttcctcaggagtcgcttcgcttcttctccctagagggcgcactgcccattctaggttcaaaataccgattgatatagatgaaaatagcatatgcagtataaaaagaggaacaatgcttgcagaacttattcagaaaacgtcccttattatatgggatgaagctcccatgacacatagacgatgctttgaggccttagaccgaacgttgcgagatttgctttcagaacataacccttcaaatagtgtgctgccatttggtgggaaatttgttgtcctaggtggtgatttcaggcagatattaccggttattaaaaaggggacacgcaattctatagttgacgcatctataacaaattcaccgctttggcaacatgttgtccttcttaaactcactgttaacatgaggctcttccagtccggtctttctgagggacgccgtcatgatcttgaacaatttgctcgatgggtcttagcgcttggggatggtatgctaccagtatcaaaaaggatcgatgagtctgaggcgacctggattgatatccctgatgatctactaattagagcttcggatgacaaaatatattcaatagtaaatgaggttttcccatgttatgtgcatagatacacagattcttcttacctagcatcgcgtgctattgtctgcccaaataactcaacagttgacgagataaatgactacatggttgctatgatacctggtgaaatgaaagagtaccttagttgtgacactatttcaaaaacatccgaacacatacctgacttcgacattttgtacccaactgaatttttaaactccatcaatgccaacaacttcccgacgcataggcttgcactgaaaaaaggcgcaacagtaatgttgctgcggaatctaaatcaatcccttggcttgtgcaatggaactagattgttggtcctttctctcgggcatcgtctcttagaatgtgtgatcttgactggatcaaacgttggcgaaagagcattcataccaagaattgtgctcagcactacgagttctaagtggccttttgtacttcaaagaaggcaattccctgtacgtgtgtgctatgccatgacaattaacaaaagccaaggacagacactttcaagggttggggtctaccttaaaaaagcagttttcacacatggccaattgtatgttgctgtatctagatcgacctctagagatggccttaggatccttattaaggacgacgatggcgcgtgtagttctaagactagaaacgtggtataccatgaggtgctggaggcagtcagattaatggtatattctcgattgttgatttccacgtgacacgaaccatgtttatccagagtgctgggatatattttaaggtgctaatttcattttaaaatgtaggattctggtacctagaaccaagtgacaacgtccatgtttgctgctgctctgttgttcttggtggctattttatcagctctgttatcgtgttcttgtgcaaaaatgtttctctatgttctcaggatcttttgctgtaagctttgttctctgtttacatgcagctcctacttcttaggagggccttcacactaatgagaaacttttaccttgctttcagatggcctacagcatgctctctaagcttgagttaggtgctgacaacccacgcatctgtgttcgtgtttcaaggctatgggagttcgctaatccaaatgatgagacacaattgctccaccttggtttggttttgattgatcaggaggtcagttcttcagagcactgagcacccagctttctgtagaaacagattgctttactaatgtgcttttgaaacagggcactagcattgcagcacagatataccctccctgcgatctgcagttcagagaaatcatcactgaaggcaaagtgtactatcttgagtactaccgtgtgagggaatggagcaggcgatacaggccagtcaacaacagcctgtcaatttgttttacaaggtggactaaagttgaacaggttgcagatccggcagctgatttccctttgtacacttactcactcacaccatatggtggactccgtcagcgtgtcgataggaaagaagaattcacaggtattctcattgtgttttgggtaataaaagcatgacgtacaatgatataatgtccttcagatcactgacaagttgcttcctcttattgtcaatacaaaaaaaagatgtcattggcattattactgaggtaacatctgttacgacagttcagacgcgcatccgagatggtgatagcctgaagagaagcatttacatacgtgatactaagttagcctcaaaccttatctattatcttcattcatgtgaattgcatttccctagatttgttgatctgtttatgtattatgtcagttgactaaccagctatctccagctgtactgactttttttcttcaacactacacaaatcatacccatagaaactatatgctctaacataatcatcgtgtccaacaaaccacacatgcgagatttttatgcacttttttactacatccattccatagcgatacaatcttaaatgtggcgctatggggagaacgtgctacaagctttcctgtcgatgaagtggttgctgctggtcagaaagaaccacagatagcgatatttgtgggcactcttgtgaggggctatggtgagtgggctctcaatgtgtccaaatgtgtttntagactatgactccaattgttttacatatcgtgcactgacacatttctttcataggcgacatatctctatcagcaactcagcttgcaaatggacattaatgtgaacactcctgaggtcaactccttcaaagaaaggtttgttctaactttcatataattcgagtagatttggtccactcttttacagattcccatctaggctcatctgtgtgttttttacagcatacagggaaaatatgaacctatcaaaatgattgagctcccagctgttggagctgttcgtactggcgccgaacaaaagtcaattgcccagatcaaggacctcaacccttttatgtttagggtatgttatatgttctgtgtatttaactttgctatcttatagatccatgacaataagctccagctaacatataatcctttttacacctagaaaaatgaattcatggttactgtcgtcattaagaagatcgacacagaatcatcctggtggtaccctgcatgtgatacctgcaaaagaacagcaaaaccatatggaaagtcatacaggtgtggcaatacatcctgccctgctgtggtgtcagcatcacctaggtgagtactgcatgtcatgagaactggatacctaaaaccaatttagagtctaaccatgtttggatccctgcaggatcaaactcagcctcattgcaggagacgacacaggtgacactaagtttgtgctctttgggcgcacagcacaacgcattatcggtcgaccagtcgagatgctgatacagaacaaccctgctggcattgagttcataccaaaggaaattacagatcttcttgagaaggagtttacttggaatgttgccttcactgaaaacaccctgtcttccagcactgtttcgttccaagtgaatttgatcgttcgaggtcctgacaatccctgttcttcagccttgcaatccccatctgcatctcaggcatcgtctgcagtgccttctcaggctttatcaccagggctatcacatggtctctctattgggcagtgttcggcagcggctgatccatctattggatttgctgatccaacagctggaatagacagcccattagccgcttcaatcaagcacaagaaaccggagactgagtatcagtcaaaacctccagctgagcttcctcaggacgaagcagaggtaatcgagcaggcatagtctgaatttttgtcataaagcatttctatgttaaaagttaacattgctaatattgtcgtaatatatataggatgatgacaaccttccactaagccagatagttgctgacgatgctactaaacatagcacgtccaagtcctacaagaaaaggtaccaagctccataaacatgtttatgttacacataaggagcaatagtttgttctatatgttctaactgaatttgccaaacagggctaggccatctcccggtataggagctgctaagaagttgttcaag

SEQ ID NO: 44630 - DNA, 12545 bp, Oryza sativa
cacgtccaagtcctacaagaaaaggtaccaagctccataaacatgtttatgttacacataaggagcaatagtttgttctatatgttctaactgaatttgccaaacagggctaggccatctcccggtataggagctgctaagaagttgttcaaggataatggtgatggtgttgctgatggcaggtaaactcagcctgtacaacctgtgctaaaagaagttcgtagaatgtatgactaagctattttgcacttacatttcagcggagacaacaatgcctgatgcattgtgggaatatgaagcttttgcttgatacagttgcaggagagtacaccgtcaggttcagtggccttacatgctgcctccagcttcgctacggcttcactgggcaatgtgttatgtacctatgcaaactgtgctattgtgttgctcattgtgtgtttatgagcataatacttttgtaacggaccacgaaaacatctacccatgcgttctgtagttagctaggattctatgttatcatagatgcactgtgataaccatgaatgctggctgttcattgaacgttctatgctggacctcctaagattaattagactgttctaatgttataatccagagcaatcgaactcgatgttgattctatggttgcttggttttagaatccctccatacagctgtttactgaaacaacaatgcgttccatgctcacggcatggcgcgtacaacgtatcacattgtgtcgtggtactgatttgtaccacaaatacatctatttaaccttcaacagccagcgctccacgcaaaatgtgcagcccatgcctgcacactgactccctttttaaagagtgacatgccagcctacacagctagctactcctatgaagggacaacacgacctgctaaaaatgcatcccacactctacacttatttcatttcagctcatcctcttcttccaccacagctcagcactcctcgccgagtctcacagattgaatctgaagaactcctgctcgaggaagaacaactcttttcctaccatcgtttctacgggtaagggtgctcttctctacctctgttccagggtatctctctatgccttgctatgctatgcagtctatacgaaatgcagccttctgtttcgacgtgattgcattgcctgatgcttcggtaataatacatccggttctattttcctagccgcgcatgctgcctgcgcttggcgataggaacaagagctatttttagaaaataaaacatatagcaagaaaaaacctagcaaaacaattaatccggtctaatactattatggatgttctttattagggatgcagtttgattggagcgctgagctaggcgtggggcagccacaacgcccttcttcctatggaaccaatcgtccattactagcaacaaaattctctaggcgcaaggagatatcgcatatgctagctgacatcatatacacaagagctgttgttgttaaggtgtctggagctggaaatccgaccacaacaagaatatcagcgatgataagcgccgtctgcaggtgtcaaattgatgatttcgcattgctccctttccacccaaagatgttcattgccatcttcatggatgccgatctgcaggaagaactgtctgaaagagctttcaaaaaggtatcgttcaccttcaaggcaactcgcctcacatttgagcctttcaagatgaatcttggtagcactgtaaatccactgcgccagcgggttatacttgcgctagaaggcgtgccaccagaatcatggaacaaagaagctatatcagagctcatggacagttgttgttttgtagaggagttgtatggagagcaccatatccaagaactctcaatttttaagttagctgcctggacaacagattgtgaccttatacccaaggtgataagctggaacattgagactaaagaaggtcgtcgaggatcagcaaacattagttggatgcacaatgcagctctgtcagttgtgctggttcatatagagaagctgttcgactacactgacgaagacagcgggagtgatagcgatggagaagttcttagggaatatgagcagcaaaggccccgtgtccctgttgtcaaaacatttagctgggtgcccttgaagattgatctaaacaacggaccagttgaaggcggtacaccagccatagctccacgccgtcttcctcttgaagttcgcaggcgttgtcgcctaccttaattacataaaacactgccctctgttatgtatgctttaaagcctaacattttcacctgcctctccatgctcatggatcatgcgaacagctgcttagtgttttctctacgtgttctgtcagtttttgttttcctaacaattagcctgctgagcaaggcctaaacttccagttcagctaaaatatgattcgtatattcctcttagcaatttactccttttacatcactgaatatgagctgatagggcgccgcgaagcgcgccgcaagttctagttggataaaggacctgtgcagggtggagtgtgcaggaggggcagggcttgaagcttgcagagttgcaggggcgcagtgtccttcgagcgcttttctccatacacggacaaaacggagcccttcccatagaactactccgtaccttccatggtttggcttggccttggtgctgtgttgcactagagctttgttggctttgcaggacttctgcttttcttctcaccgcggcagagattgatcaccgccagatttttgttgggatggtgaagcaaaggatgtggactggaagttgaaaaaaaaaggggacaaatacctttttgagctctctttggagaaggaatttgtcttttctagtatatttttttctttttcgtacttcatgtggcatcatattttgagttttttttgtgtatgtgtgtggtgctactagtcgtagtgttgcacgtcttataatttgtttcacatttttttgtgtgttgatttgatggacgttttgagtttggtagcacggtcgccttgtgcaatctcaaattctcaatactagcaatcgtagcatcggaacgggtagtgggcaacttgcccagccttgttcacctgtcatctccatggcagcctttgacaagaaaaagatttgctcgaaacgcgaacctgtggaattcccttctcaggatgaaaaaagggtaaacacggctaaagtatcgggacgtacggcgaggagcacaccgtgcactcgattctgcaaattaaatggcagtggcaccacgacgcaccaccacgacatacccaacttaattacttaatcgcgactcttagtgatccagcagttgaaaatttggaatgctggcactcgcatgacataacgaattaattacacagtgaaccgggatatgaattaatctctcgaggagatttccacttgtatatatatttttgtctcagattcgatacaaaatggttgtaaaaaagtttcaaaaattaacaatatagagtataatgatgtctatatctgtttaccaaaatcaagttcaaaatcgatctaacacattgaggaaaagaacatattctaaagtgactgcctgactagtactaccattactattttggatttgtaggatttgcatttttttccttcttgatgtatgatttgagttcaagcttaatttttttattgccatttccatattctgctaatggtgtcaacattttaagattttatttaagaatttaatggtgtattcgaacaaaccttgagggactaagggtgtgtttagttcacgtcaaaattggaaatttgattgaaattggaacgatgtaatggaaaagttagaagtttgtgtgtgtaggaataatgtgatggaaaagttggaagtttgaagaaaaaattaggaactaaatcaggcctaaaccagtttccccattaaaccatgcaatgcatgaaataatagacaataattccacttagctaacaaatgagagagttttgcaaagagtgaaatacatgggtgttctctctaaacttatgcaggtgtatcatctatatccttaaactcccaacatgtatttttagaacactaaacttgtcgtatgtaatatataggtccaaacgggttttaacttgcatcccgaacacagtctactctgcttatctaggtgcctgaatgcctgaaaatttaatctgctctcccattcctagacgcgtacgaatccggacgacatcctggacggacgggcggggcaggcgacggtggcgacatggtccggcaagcacgcgcgcgctctatatatattgcccgcgcgcggcggcgtcggcaaccgcggactcgcgagcggcccgtggcacagagacgggcgcaggcgtaggccacctcgcaggccgcgcggcacgcgcgcgtgcagccggcccgggaggtgtcattgccacaccgacgtacgcacgcaacgcaccgtgggcttgatttgagacgtttttcgccatgaacgccgtgcgggctagctgcccgcgcgatcgccgtttcgcgcgcggccgcgtagcggttgtacgcccgcgcacacgtgattcgccgtgcgcggtaaagacgtaactcccccggttggacgatgctccacctaatgcacagtgcgtcagttcatgtgacgtagccgatcgatcaagctggagggcgacgctgctacgcctacgcactgtgtgctgcatactactccgtatgtatgtggagtactcgcctttggagtcgactagagagcgtttctacaggtttggccgtgacgccgtgtgggtccaccgcattggcgagatgctgtttctacagcatgcatcccgtttctttcatggttgggccgttggactaacccaaaccattaaattatgtcttcttaaacttaaataatcgaatttattctttctgcatacatgttcatctctcttgggctaactgtgttccaacttcttatatcttccatatataaaaagaatcagtcctagttttgaaatttttgaaattagatatatgcatatccaaattaatactcccgtcattagatgagatataatagctaggagttactcccgtcattagatgagatatatcagtacaatgcatctagacagagtccgtgtatcagaatatgttccatccaattcggttgctatattttgggatagagagaatattttttttactgtaggtgttaatgagccctattatatatttgttatcggtcacatctgaatgaaaaatgaagtactagtagagtactacatttatttgaaaataagttaatctattacagaatatgacatattataatattataaatctggacaagtacatgaatctgtccaaattcattatattaggatatgttatatccgatactagatcaattcattctaagactaaggagtactctttccatcctaaaaaaaacttaacccagtatgaaatgagacataatttagcacaacgaatttggacaggaatctaactagattaaccaggaatctaaccaagattatatgccactaattatatttttttttggggaatgagggagtggcatatgccaccttccagtcaaacaaaccaagattcggacatgcaacagattcagtgtcgcttattgttcggacatgcagcatatactccagtagtactccttttttattataagtactccgtataaaaataagaaatgtaaactgggaacagattcattgtccaactatacgaaggcaaactagtagtactaatttattaggaaaataatgagcatttcaaatgtacccaagaaaatgtcaagaaaaacacacataaaatttgaccaaacaactcagtcatgtaatctgaccggtatgtgctgtgcatttgttttaaccaagaaatagcatggtggcccgcttagattgcgcggctagcatcattatattttctctcatataatagcatatatgttttttcaatgtattattcaaatatattaaaataacaacataattttaaattttatactaactttacaaaactactaatgtgtaatattcatattgtattttatatacgtgttggttattaattatttttaatattaaattttagtttttttaaattatattcctatatggactctagactcgtctttcaatatttcttttttttaattccgaattttcattatctgtaaattgtatttctatatagagtctagactcttcttccagtattatttatttttaactctgaaattttattatttctaattgtatttctatgtgaactctaaactcatctttcaatattcattgatttttaattttgatttcacctacttctaaattgtatttttatattaactttagactcttcttcccatgtttctttttaatttcgaattttagttatttataaattgtatttttatacgaactctaaactctacttttaattttattatgtttattccgaattttagttaattttaaatttctatatgaactctatactctacttctaatattccttatttttaattccgaatttctattatttcctaattgtatttctatatggactctatactctacttctaatattctctatttttaattccgaatttctattatttcctaattgtatttctatctggactctgtactctacttttaatatttcttatttttaatttcgaatttcaattatttcctaattgtatttctatatggactctatattctacttctaatatttcttatttttaattccgagaatttcagttctttcctaattgtatttctatatggactctatattctacttctaatattccttatttttaatttcgaatttcagctctttctaaattgtatttctttatatggactccagtatcctcttctaatattccttattttttaattccgaatttcaactatttctaaattgtatttatatatgcactctagtctcctcttctaatattccttattttttaattccgaatttcaactatttttaaattgtatatctatatggactctgctttttctttttctccgattaatgtgagaatttctaggccatgagagcgaacgtggaggcttctttttctattcctttaataatataatagatagatagccaataacttttttttccttttgagaggaacattacaccacttctttttttttgtgaggaacagtacaccagaattttttcccatggaagtgcacttgaacagagcaaagatcaatgaacatcaaacttgaaattcagtatcaatatagactagagaaaaaaaagatgcgagtatgatcatcaaggatgctggtgcaactactgatcaataaaacagccatgatgagcatgcatatgagcagtaacacattgcaagacagtgaacgttaaaaattcagaaatgaagaacaatggatgaagtaatccggtcaacctattctgaatgcagttacagtgtttagtgttagcacatcagagcgcatctctcccgccattgccaacaggaggcatactatctaggtgaattctttggcaggtaattcgcttgctgaagacatacgtgttccatcaaatttgccgactcagttgctcaagatagagtagtaaaccccccacaaaaaatcaggcacgattatgcaacaaactcaccagaagctagcacctagcaccggaaggccggaatgttcttccaaagacgcacgaatcgggacgagtggtaagccatcggcgggtgcagcatctcgaagaactgccactccaggaccctgcactggcccagatgcacgccgaacagccgcgagtgcaggaagaagtaggccacatcgccggggtgctccgggtggatgagcgccaccgtggggatctccggcggcagcatggtcgccttgtaaccctcgtcggcccagatcgccttgaagctcgcctcgcagtcgaagctccacgtcccggcatcctcgtcgagcagcgtccacatgctgacgatcgggccgacgccgtcgcgctcgtcgatctccacgtaccgcagctcaccgaagttcaaccccacgcaccggctcttctcgaggtcccggccgcccgtgcccggtggcagctcgcggccgaccggagcgggacgaagcgcagctcacggtgggcgacgctgagatccaaggcgaggaagccgtacgagagatccacccaccagatctccttgggccacaccaccacgccattgccgccccatggacggtcgcgcggcgggtagttgagctccaggttgctccaggctccagaggcagaggagtacaggagcagcgtggcgtggtcggcgccgacgaccgtggggtggagatcggcgacgaggtaggcgtcgcgcgagatgctggcgaggcaggcgttgccggggtggaggatggggaggccggggtcggggaggcgggtggacttgtgcgtgcgcgtgtcgcagatgaagtacgccttggggagcaagccatggcggtgatcgccgtcgccgagcggccgacgatggtagaagccgtccaggacgggcggctacggttcgggcccctgcgtggcgcagaggaggaggcggccatggcagtcgccgccggcgacgtaggggtggtcgtcgatggtcttgcggcgcggggcgatgctccggtgcacgacgaggcgggtggcgcccgggggtaagcggaacttgaacccgttgtcgaatcccggcttgaagtagccgtcctggacgacgtgtggcacgcaagcgaggaccatccatagctcgctcccgtcctccgtcacccactgccccttccaccgcttccacgccgccacgtcatcatccattgcaagcgtgggtttgggtcgttggagaggcgtgtgcgcggagcgtggagaaggggcgaaaagaattttccggcagtttggtggtcacgttttgtgctgcggctgtccccgtcactcgtgtacttatatagtggcgactcagcgtgcgtggcgtggtggtttgcagcttgtgagatggcgtccgtggacgacatgagacacggccgtacacgatctgtttcgtttcgaactgaaagtacagagaacgcagttggttgcagctttgtgagatggcgtcgtgcactcgtttggaaccccgcgcgcaccaatgcacgagtacgagggacagcgccgctgaggcgcacgcgtgacaacgtgagtagtacgtacctacgccacggcgaaaaatgcgcgcacgggcacggatagatcggctgatcaagttcttctccttgcaccgctgcaactgcgtgatggttcaaagacggaccaacgcgccgcgccgagcccatcgcagcatgtgacgctgaaatgatcagcgcgtctcccgtactggagcggggatgtttgtgacatcaacacgctgcaccagatgtaacgtttccgacacaaggatgtaagtggatagttccgctacctgcataaaaacccgtttgttagtctattttttatatggtaatataatttttttttaaaaaatgaactagaagtgaaataaatgggaaaaaaaaggtccggttgcccgctccgcttgcacccctctggacatagcaacaattaattgggcataattctcttgagcaagtggcaatctatcacccagacttgtcgataatggatctgcagactgcagttgcacgatactacgatgataatccacgagagagagagagagagagagagagagagagagagatctcgcaacggggattcggacaacatcgttgcagctttccaccagctttccaagagattagatgcaaacaatcgaagaaccaacaaatttaagacgattgacaatctacatttaggaaaaacaaatggtgctatgaaatatcccaacataggtccacgaaatacagaatgcataaatgttccacttaacgatactcatggtcattagatcatttgttcaacgatcagcaaatcatcaggacaaagtcatgaccggccggtgagctagacttagctgaattcctcgtactcaccggaggagcacctttttttccccccttttaatcgtcataaccttcaaaacatgcacaaatgatggaaatgttacaacaaggtaaatttacttccatgaaactaattatcaatttttaggggaaaaaactttcatgcatgtgtagtttaatcgagagttatttacactaattactaaggtagtttacacgttgtttgttatctaaaaaactttcacacgtccttatctaaaataaaatggttcacatgcatctgtagttacctcctcaaatacctagaaactttcttgattgaagaggtaccgagaggtgtggtacctcgtcaaagtatctttaaaaattaattttcttgactgaagctagcactataaactatattttagaaaataaacactgcaaactattgcctcacaaattcccttaagttagataatgcatatgtacatgaggcttaatatatgagagtagcgtgacatacttaagtcttcaaaaaaaaaagcgtgatatacttgaatatgttcacctttgtctaattaagacgcgcggatccctcgttcgctgggcgcgtaagtaccttttttctgattgttagaagcttcaagacaagcaaacagatggaaatgttaattcaacatttccattactcttatttatatttacttaatcaccttaaagagttcacaagcagttagcaggattttattgctactaggtaagaaaatgcatcttgtcatataacaagcatgtgcagagttgaaaaatgattccaatgttcaagtatcttgaaaaaaaaaatcttcattagattgtttgtggatgaactccttaaacctacacaatacatacgtacgtacgtgaagcttgattatataagagtatcatgtcaaacttggaagtagttgtgacattatccctacattcaggtttaaactgcctttgtactcggtccaaacaaaatgcataagcagattactttgtgcttggctgactaaacacgaattaaaactgacaaaaaaggaaatttgtaccacgatatgataattaatatgacgatagagaatcttgcagctactgatcattaaaacaaagacatgaccagcatatatatgaacactaacacagggcaagactgggttggaaaattgaatctagcattcaccgaagtactatatcattatatgtcgcaatgagtgcttaatccgcaagaaagaacttgcaaaactgtgaactgcaaagtgccatatagtaaattcagtgaaacttatcgctccaaaaatttaagaacactagacagagtaataccatcaaccgcgtgcatgaacatgaagttgtaaagctagctacttatatcacagagtgaatgttgactaggcctagctaagtgaatccttaattaggtgttccatttgcatgttttttttttgagcaaatttgcttgcttaattaagagccaagacaggcatgttccatcaaatttggcgcgattcatgactgacaccaaagtactagcagctcacaggggtagttaacacaaatatcaggcaagattatacagtcacgtaccagaatttgagactgggagacgccaggcacgcacgaatcgggacgagtggtaacgcatcggcggattcagcatcgcgaagaactcgcactccaggacactgcacgcgcgcaggtcgacgccgaacacccgcgagtgcaggaagaagtaggccacctcgccggggtgctccgggtggatgagcgccaccgtggggacctccggcggcagcttggtcgccctgtagccctcgtcgttccagatcgccttgaagctcgcctcgcagtcgaagctccaagtcccggcaagctgatcgagcgtccacatgctgaccgccgggtcgccgtcgcgcttgtggatctgcacgtaacgcagatcgtcgcgcctcagccccacgcagcggcacttgtcgaggtccgccgtgcccggtggaagctcgcagccatcggggagcgggatgaagcgcagatcgtgatggatgccggggacgacgcggcggagttggtcgaaggcgaggtccgcgaggaggccgtaggagagatccacccaccagatcatcatctggtgcacgacgacgccgttgccgccccagggacgatcgcgcggagggtagttgaccacacggtccttccagactccagaagccgagttgtacatgaacaggatagcctgttggtccccgggcgtagggtggagatcggtgacgatgaacccgccgctcgcagtgccgacgaggcaaacgttcccggggtggaggatggggaggcggcggtcggggaggcgggtgcacctccgggtgcgcgtgtcgcagatgaagtacgccatggggaagccgtggtgcacgccgagcggcccacggtagaaggcgtcgaggacgggaggctccggttcgggcccctggctggcgcataggaggaggcggccatggtgatcggtgctggcgacgaagtaggggtggtcgtcgatggtcttgcggcgcggc

SEQ ID NO: 44631 - DNA, 15894 bp, Oryza sativa
ggcgtcatctattaaaaacggaggtagtatatcttttgatgattttccagatagttgtatgaatggacatttggttgattgacttgatatttgattttgaattcgatattcgaattggtagagacattacaaatttaaggaaaatatgtgtttgagatttttttatatttgatatgaggtttggatcttgaattgaatttgaataagtctagggggatggtgaactgggatgaaaattagattgaactttgaagagcggatgcatttgaattagatttgatattttggaggacttagctatggagagattaatagagagacttgaaaataggttttgcttttattttataaaatacctccttgagggatatcaattcctaaacatggttcttacataacctttagagcaattctacggtccttgaggaggtaccaaattttggtacctcatggtaccgaggtacttcatggtatctcctcaaggaccgtaaaattgctctaacctttaattcggatttagaacttggtggatgcacctggacagatttgtagggatttttgctttttgagaaaattttgtaaagaatggaatggatagagaattaaaaggatcaataaaggatatgaattcggataaaactctgaatagtggtttaggatgctattcgaatttcaaaattttgaacatgagaacttttatatgggagaggattttttttaatacaaattttaggatcataggaaagaattaatttggccattgatttttttagtggataaaaatggtagggaataaggagatttgattaaagcaagagttgaatcttagcaaaattgaggataaaaaaagaatgtgtacatgtgatacatttttatgagtaaagtataggaggactgttgattaatttttgtaaaggatttaattgcaaggacttcaactacaaaattcgaataccatgaatttaatttagaagaaaacaccaagactttgaggtcacaaagattgatctaattgagatcgtctttggcaaaaaaaacctagatacaatcaaagaaccataggatttcatcaaaatagttttcgatggttaaacgaaaaccgaggcttacacattagtatataattagttctggttttgctatacatttgttgaaaagaatttctccaacaaatttatcaaatgtaagtacatattgtaattacactgtagctttttttatataaaactttcatataattttgaaccattagattttcttcaagattcatgaaagcggggaagggaaaaaattatagtgcatgcatggatgaggtgattaatttggtcctccgacctccgctttgcaaaaacagtgtgttatgctcgatttttaaaagttacatacaagttatattatgggagaatagctaatatggtccctaaagtttcactcatgggtcattttagtccttaatctttcatattgtccaaacaagtcctttaaatttgtcatgtgggctaatatagtccttggtcccaccaaaatcgccacatggatatgccatgtcaccttcctatacaaaatctatatgatttgtccaacttacccttacgcataggaaaataaaaaacaaaaggaaaaagttaaaaaatatatggtatatgcaagagcaaaagtatacctcaaaatggtgaaaaaagaagtatttttttcctatggttatgtctaattcacccttatatttatttttctatgatatacgtaaggataaattggacaattcattatagattttgcatgaatgatgacatggcatatccatatgatggttttggtggacctaaggactattctaggtcttatgacaaaggttaaggatttctttggaccatttaaaaggttagggactaaactgatcctacagagaaactttagggactaaagtagatattctctcttatattatattgtaattacatgtgaattatactatatttatgtctaacaaattttatgaaaaaagatattgactagaccctatgtatcacctattacaaaattgaaaatgagttttctatttgttaaagaaagttctatctatatagaaagtttttttaagaaaatatgcactgtttagcggtttggaaaatatattaatggtaaataagaaagtagcaaaatcgaaataaaggaaagaacacacccttaacaatatgtgattattatcgaaaagggtagtacacaaacgttcgtggttacctaatccagcgaataactcagaagggacacgcgaaacaggaggacacgccattttcttccgttttcatctttttcccttctttttacgtgattattctgtaatccattgcatcttttacgtgattcttctataataagtatttctattttttttcttcacttctgtttatttctcagatttcttttttcgttatacatagtatattttaatatcttcttaacggaaattttctatacaaataatttccgtggaaactttctatatataatgagactttatatatgtaaactttatatacgtatatataggctttgtatatcatagaaagtttatagaaactttctatatatagattttatatagaaattacatcatagttagaaagtttagtgcagaaataacaaaatgctaatgggaaattttttaaatgaataatattcttggaaaatttctatatataggctttctatatagagagatcgattttatgtatgtaaactttatatatatggactttgaatatataaactttatatatatatatatatatattgtatatgtatactttatatatagactttgtatatgtaaactttatatataaattatatctataattcgaaagtttagtgcataaattttactagaaataaaaaaaactaagatatttttcaaaaaaaaaatccaatatgaacaaacctcctaacagaaaaacgataaaaggaaaagtttatcttttcccatcgcgtgataggtaaacgagaaaccggaaaacacctttttttttgtggctccgtttttctttttgtcgttttctgttcgctaggtttgtcgctagcgagcgttcgcgtattagacatacccgattattatggtagtagccattgaggcatgaaatcaatagcactaataaatttgttatactccgtacgagttaacggtgaaagaaagtacacgttaagagcaggtacaatagtgagctaatagcccgctttttagtacatgtggcatagagctaaactgcagagagagaaaagcgagcgactaaatagtcaccggctgagcacgcgcgcatatgtaaatctacatgtcgtggggcccatgcatgtcacagcaaccagtaaaaaaataggagagcaacatgcagcattagaacaagagaatagcacgattaaaaaattgaaagctaatagcctgcattgtatgtcaggtagattatttatctattgaatgagttggcaagtttttggagccatcagtcggcgccgttattaaacttgctctaagtgctagagctatactactactctgcctcgtcagcctcgacctcaccttagctgacatttgcataaaacctgaagctgtgaagaagacccatcctaaaggggaaactcttttaatcacacggtggacgtccacctgtttattatatgccatctaaataattattaaaaaaataagattgatcaatatgtaatatatccacaaacatacaagttcaaattcaacttctataaattgtaacaaaaataacaattaaaacttaaattagtataagtatatttgcagttgaatttattatttttgttacaacttatagaagttgaatttaaacttacatgcttgtggggtgatatattacatattgatctatcttatcaagtgttctgaaatttttttaaaactatttggttgacatgtaataaacgggtgaacgtccaccaagtgattagaaaccatcctaaagccactagatgcgagattgttaaggggcgatcgatcgcccctagcgggcccccctctcctccatatggtttctttttttggcaccgcattactttcctattttagtaaatttatacacctaaagtttacacatctaaagtttaaagacccaaagtttataaatcaaaagtttatatatccgattcaaatttaaatttgaattgaaatatttttaaatatagtatttatatacacctaaagtttatagatccaaagtttataagtcaaaagtttacatacccggttcaaatttgaatttgaattatatccgattcaaattgaatttgaattcaaatattttttatatatagtatttctatgcatctaaagtttatacacctaaagtttatagatccaaagtttataagtcaaaagtttacatacccgattcaaatttaaattcaaatattagtttataggtccaaagtttataagtcaaaagtttacatatataccgtttcaaatttgaatttgaatttaattttttttatatatagtatttctatacataatttttttcaactttatgttttttattttttttaaaattatggtgtagtaggaagagaaggagaggaggaaggaagagagtagtatataggggatgggaggtgattagccggcccccactagatgcccgaatctgttcccgtggaaaatcttaacccgagacgcacggagatgttggggtcgtccacgaccacgagtataccacgtaccatatactgattgtgaaacgaactatatatacgtacgctcctgaagtcctgatcactcctaaatgagcctgaatgtatatatatgtatagattgcaacgtacgctacgcatacacaagtcgatcgaggatccaatcgaaacaatgcgtcttcgcttcaagactacggtcgacatctcgctggcggcgtcgatggcctacgcggccttcggcgccgcggtggcctacccggccagcgctccagcggctctggcgcgcgccttcgcgctcggctatggcgcgctcctcttcctgctcccgttctccgtctacgcgctcgagttcctgcggccgccgtacccaatcgatcgcacgccgctgtcgatgatcacgtgcgccacggccaccccgtcgcgctatccgtcgccgtgctgacggtgctcaaccaaggaagagccggcggcgatgtcgccttcgccgcctgcgtcgtctggatcgccgacgtggccgccgtcctgtccctcgcgtggtgcctcacgcacggtggcaccatgggcgtggctttaaacaggagaggacagtacggggaaatctgcaaagtacaggagcggatgaaaaagtccaacaaccatgcccgccttgacgtccggtacgcgatccgggatgccaagattcgctttgcggtggccgtgtcggccgcggtcgcggtagctggcggcgttgtgatcggcggcgtttcattcaagggtctatcctacgccgccgtcttcttcgcgctccctacgaacctcttgtacttccgggacacgtacgcttatcctacggaccacatgccgaagcagctcgagtggtgctacgtctcggtgcctatggccgtcatgctgttgtcccgcctcatgttggcggcacggcaggcaaccacgctggacatcaggctcgtcgccgtcaccgccgtcatgttggcaatagactttaccgcaattggttttctcgaatggcacagcaggagggagatgccgaagcctcgtggtacacgtgcgagtgcggcggagatcgtcacgtcgtttgtgatggtttgcttgcggtattggttgtatctacacgttttctacgtcattggcaacggttctcagagatggttcaattaatcagcatatatacaacggtaaaagctgtatatatgctgatatatatagcttttaccgctgcgagttgctttcatttagacggtaatagtccacttgtaataactatgtaacccacacttctccttctaatatatgcggacatttacagtctcgaagactgtaaataatactcttgccactttcacgtaaaaaaaactattagtaacaaataatgtaataatgctctattgcttttgttttagagacattaccattagtcaacatttttttagaagaaactcttaatcagcatagcggtcgaggaaccgaattttattcaaattgatcaagtgatagcagaatcaacattgcgacacgtatgtactcctacaggtacacacgaaagagaacacgtcacgttccatgtagcaataatactcatggagtcatggtcattggatcaattgatcagttaattaatgcttagcaaatcataaagaggaagcaaccggcctttgtcttcgacgtggatccttaattagactggcaagaatttacttgaatcacttgtgctcactagaggaaggtctttttttctgatcgtcagaaccttcaagacaagcagaaatgatacaaatgtgacacaaggataaaagcttctaggaaactagcatttcaattgagatcgtttacaagtttgtactcttaaaagaaaatcacatatccttatctaaaaataagtaattttacaacccttgagaagatatcataaggtaaattttttttttatcatccttgagaaggtactagaggtactatatttttctactgtaaaactagaaaggtggcccgcgtgcatgtgcgggcacttatattattcaaaggtaaaaaattttattgtttgttcaaaaattttgtatcatagattaagggaaaactaaagttcggatactattattttgtaataatttaaggattctatttttcttaaggtatcttaaaaatccattcacaaacttttgagtagaagatggattaaatacttacgacttttgaatcatatttttttctcgagtaaataataaactattgcttgtagtatggctacaaatgaaaaatgcgagagcaaagatacttaaaattcttgtgattaaatcgtctcatgaaggcacatgatataatgagaaagggagggaattgtatacatggtgaaaaagaagaaagggaaaaatgaaaatgtggagaggaagcgtaggtacccacgtatagtaggtgcgtaccgaaggtggagaggtgggacctcgtagtatttagtttgtcctaagatcaatttaatctaatggcttataatattagacccaccgatttaagtaaaatctataactaatataaatatttggatttttccggtcatcacatcgcagtaatctcggtatttttcgtccgtaacccctttttcttcaccccgcgcggttttttcgtcccgtaaccttttttttttccgtcatagggtgatttttgtccgtcaccaccccatccccaagtcccagtcagaattccatcatcacacaaatagaatccacattgagcacatcttctctccaaatctcaaatcatcacaatccaaatcaaacacaaaaccccactccaaatctaaatcggaatcaccttataggtggtgggcgtggcatgtcacgaactcacggacgtttgttatgtggcggcgaggcgaggaggagaccgccgtttttgatcgtgacagggcggaggcggaacggagcagcaaagcgagcgcgaagagaaaaggtgaaatacccctcctccttcctcggcgggcaggaaaacgacgccacccaaccgaaacgaaacgcttctgctaactgctacgaccacgagttgttactgtaatatatctggctatctgattggtaattcatcaaacgttgtgtattgtgtggagaacaatcacataaaacgaagcactctttagcacataattaattaatattaatttaaaaccttaaaatgaaatactatggatgtatttttaaaaaaacactcataactactatgtaggttgttataaaaaccggcccatttgctagttttaataagaactggtatatatagagatttataagtgcggtttttaacttttgtcttttctaagaatcacatggatagaaaatgctctgtaaatgtcagttttaaatgaatcggcacctatatgggtatccctcattagtgttcctgtataatttaactcgccaataccatcgtatatacatgcaccgtatataataaggaattatacatttcggagtacactcatcaattatcccaatccaatacacacccaactattctatatacgcactaaccaaacatcgccgaccccaccaagggtagggcgccgctcgccacagaaggcgtcgtggactgtgacagagagggagggggagtgagagcagcagcgctgccgatgggggtgtgtgggtggagggaaagccgctgatggggaagagggaaggggtggcgatgaaggagagcaggtgcgtagcggaggagtgataggcgggcagaggagagaaggccgagaaaaacgaggagataagggtgacggaaggatcgaggcacgtgggggtatgccgctctctgttttttttacatgtgcgccacgctctcggttcgacaaaataaaattccataggaccacggtccttcgctcatgcaaaggactcttaggctttgctcttccccatctttcccaactcacctctcttgtgtttcacgcgcacgttttttaaactgctaaacggtgtgtgttttgcaaaaggtttctatatgaaagttgctttaaaaaaaatcatatcagtcctttttaaaaaaattaataaatacctaattaatcataagaaaatgtgtcgttccgttttacgtacacggcacatcccgaacacagccttaggttgtgttttgcttggacgctttacaaattgctaaacagtgtgtttttttcaaaaaaaaaagttttctatatgaaagttgcttttttaaaaaaaaatcatatttatctattttttaaaaaaataataaatacttaattaattataagaaaatatgttgctccgttttgcgtacgcgggagatgagttcccaaactcacctcctctcgaccacagcattagcctcttgcgcaacacgtgttaagttagaatctgaaagcaaacatttctccttttctctcatgtccccaaatcctgttagttgacaccgtgattgggcgtgaagcgcgtgcgccggcgtcggcagcggcagccgcatcagcgcgaagctgcgtgcctccattaatggcgtgaggagcagcagcagcagcaacctagccggcatgaggtgaagctgcaccgcgaccactgcatggctcgatccgatgcatgctttctggcgttcgctactcatggctgagtaccgggcatttacctggcgtggtgcaaaattgttgattgtgagcttggaattacatgattaattgcaagtttttagatggaacatggacatcattcttgctgctctgattcttgttcggatcatcttaacacgcacacatgtcaccactaagagactatgagtaaatatgcaaagtatttttatctgtcctgattattgttagttaattttatgatgaacttacctatttttaatacagatttttttcacaaagttcatatcatacatgtacacgtggaataattttccaaacaaaaaagaaaacttttgtgattattattatcatactagactgtttaaaaaatcgttcagttaaattttatccaacgtgacattacccgtgcaacgcacgtgtattttgctagtcaagtaatagatactttgcttttttttcttagaatttataatattttctctaatttattagagcaccacgtggcagcttgggggcattttaagaaattttaacggacttaccacatgtgattagaatattaaccatgtaatatatatgtatgggatatatgctaatattcgttccagcttagtccatgtttatatacatgtagagagaaattaatatgttgctagtaagctattagaagtctaattaatagcaattaattttgacacctatttacaattgttcatagtagctcttgcagattcatcttatgatcttaattatgcgttgatcaccaatttactaatcaccatgactcacatgaaaaaatgtgtactacttaggtttaggacaattgaaattgatgaattatctgatttatgtgatagctatttgagattataaacgaatgaattaacttcaaaaaattaaaaaagttttttaaaaaaaacaccatttaggaacttggaaagcgtggagcgtgcaaacaaaaatccaaaagatggaattatgaaaaaaaagaccttaaagtcccttataacactcttgtactagtaagagttctattgatatttattaatattgttcttgcaaccgtataaacaaataatataaaatccaaatacgacataacacaatacgatataattattatgtaatcaactctgggtttcagtttaaatagagctaaatgttggaaaaactcaacccacggtgcttaattcttctctctctacatcacacctttaattttcttttcatgttattaacaaaattaatcatctccatatatgatttgatatgtggcaaagcggtagcgctgcagtggtcgtgatcaccttagatgcctcagacatgacactttgtcacacgtgcgaaaggcaaagatgcaaatgtgcattatgcagcgggccaaaaaagagaacttcggacactttatttgttaacaatagatccgatgatttaaataatgggtccaccggttatagtgtaaatgtaaattagttaatatagattttaaattgttaatttaatgggtacacaatataataagtgtagagtttattttaaaaccgtgcattatttgataataatagtccaaagtaataaaaaatagatccgatgatttaaataatgggtccatatgtttaagtgcacgtataaatttgataggtacacaatataattgtgtaaactgtattttaaaatagtgcattatttgaaaataatagtacaataatgagtacactggtttaattgaaaattatcttacattattgatttaatgggtaaacgtataatggtgtaaattttattttcaaagattgtagagctaatttagttacctgtgtttataaagagttatatagagttatatgattgtatattctttctttgtaaaattttaaaaatatatatcaattgtataaatggaaaatataagaaaaaagaggaaaaaaaaacatgaaaggagccgtacgtactacatacccatgtgaaagaggagaggtgggacccatagtattttgtttgttttatgatcaatttcatctaataatgtataataatggactcaccaatttaagtgaaaattaaggggtagatgttttgtttttttcttagaatttctagggatttctctaatttattagagcaccacatggcaacttgagagtgtttgtaggaagtttaatagacttttagtatataatagaagatttgatacctctaggtacagtccttaaaaaagtacctaaggtacctaaattttatactaaaatttttgataccttgaaatacttagtacctagagatatcaaattttacagtagaaaaatatagtacctctagtacgtaccttcccaaggatggtaaaaattactcttataggatatattataggatatatgatcacctatatagggcttgaatttggtgtggtttctactctaatattggacaatattgaacttatctacaagctttattgaataaatacaaaattcagcatattcttgtaatccttaaacagaatagttactgctgaacagtttggtatactcagaaattgattgtttggattcatttatctaaatagttctcagtcacttgctaacattgattctctctcagattaagtatatggatcttgaaactttaagaaccaggttgaatgctatcgtcaattctgcatcatttcggggcagtatgtttcattggatttcttcagcagcttcatccaaactaaactcacaacagctgcctgtgatggagatgcccatctaccatgatagagttactcctggacctaataatctgccctcctgtgcatataatgtagtatcctccactcagggtgagttgagatgatgagttacctattttaacctcacaatgcaccttatttttttaaaattctttattggcttgattttggcaggatataaacaatatgagcactgtaatattggtgctgctaactttgctcattcattggctgataaacccaagcagatgcctaaaagattagcaaacaccatttttacctcatgtgcatcaactctaccgaaatgtagccctagtattgatgtactgcatactggccatataaaagaacatttctcaggtgagtttacatcccctttcttatgtctgaaactgagttgagctgaagttatttggcatcataaacactatggtcaaatttgccaggtgatgctgatgatactagaattttgaatgtcaagaagaatgaatgttgacgaattttgaatgaagtatataagagtaaaatacactgctggtccttcaatttaaccgtggtatcgtgcacatataatcttgtaaatttctcatctaggtatatatgtaattttggtgttatgaatcacttgagatccatagcccctttggcaagtctcgccccatgactttgttgtcatggtggcaaacattttgcatttagccctcctctaaaactaacaatggtaacaaatttgtatttagtcctaaatgagtaatttaccctagtctaatttaagaaccggtcatatatttcaatgaataggatgttgtcaccctatacttatttctacagaagttgacagcccatttttaagtcgcgccctaataaggctcttctgtgtttcgtcaatgaatctccgttttattgggggcaaggatcgatgcttgttgacattgtcgcattccatgcaggggtcctttccaagcaagcagattctctttaagcacacggcacgttgaattataagccttaaggcctctcacagtgcaagacactcaatgaggggcttagcccaaaaaagtgacccaaagacactcaagcccacagtgcagttattttttttgagtgacctaatgagatgaagctactattgaagtatacaaagtctacagtggacgtaccctaccacatgtggcactggcaggcaaaggaaattaattcctcacctacccttcctttctcgcgacccttctctttctcttagccgcaccgccccttcttcttctccctcccacgcgccgcgcctccttctcctcgaccgcgccgcctcctccccgttgacctcgccgcctcctccccgtcgaccacgccgcctcactcgcgcctcgccgcgcctcctccaccacggcgaccgcgagcagcggcggccgaggcctcctcccacgtctgtctccgtccaccgccgccgcagcttatccgtggcggtgttggcggcagagctcggcatctctccggccaagacggcggatctggtggcctcggcggttgtccgcgtgaggccctggagcggcgagcgattcgaggcggcggtgaagggccgcggccgagaaggaggtggagatggagaaggtggcggcggtccggagcagggcagactccgtcggcggtggctagcctcgtctagttcgacgacaacggcaacggccagatctcgtggctcgagagcctcggccacacagccaccggcggcgacggcttcatcagcctcgacgagttcgccgtcctcaacgccaccgccagcggtgacgctgccaccgtcaagacggtgggagccgacgcgccgatgcagcgcgaatcctgtgatgattttgctttctttttctttttcattttgttgaatccgatctgttcttctcttccaatcttcaagattttattgcttctctatcaatccgatttgtggcgggaggggattttggaagggcgaatcaggaattttgctgccgcgtgagggtattttgggcgctaggccatgcgagcacgaggctgcaccgcccacagcgcgcgtgacccgccttttctcctcgctgcgtgccctcgttttggcgaggctttgcgtcgctcaggtaggggacgacaaacctaactaaggcgcgggcgcttgctccacgtcggtgaaaatctgagctggcgcaactaggtaactcactagctcagtgcactgtgagaggcctaagtattgcatcaccctcttcttaacctcaaaccctttcatttccagtaggctcaaattatggtgcttgaaatctgaagttttccgtgtgacgttggtcttctcagcaccatactcgcattcgcatgcttcacacgtatgccggcataactgcattcaacaaatgttagacgttagaaatatatttacttcacatatatacgcatcaatcattttagatgaaatatagtgactccatttaacagaaatttcaaaaaaaaaactccctcattccctaaatgttcgatgccgttgactttttttaatatgtttgaccgttcgtcttattcaaaaacttttgtgaaatatgtaaaactatatgtatatataaaagtatatttaacaatgaattaaatggtaggaaaagaattaataattgcttaaattttttgaataagacgaacggtcaaacatgttttaaaaagtcaacggcgtcaaacattttgggatggagggagtatatataaaggtactacctccatttcatattataagtcgtttgtcttttttttaatcaaatttttgttaagtttaatcaagtttatagaaaaatttaccaacatctaaaacatcaaattagttttatcaaatctatcattgaatatattttgacaatatatatgtttgttttgtgttgaaaatactattatatttttctataaaattagttaaaattaaaaaaatagattaagaaaaaagttaaatgacttatactccctccgtttcacaatataagtcattctagcattttccacattcatatcgatcgatcgatatgaatgtcactagaacggataccctcatctcaatcgggcggtaagccccatctcaatcgggcatggcgtccgtcacaggctagaagtcactgatgtgaagagctatttcaatcgggcaaacggctgtcacggatgattctatctcaatcgggccctaagtaaagcccgtcaccgatagctttgacccagacgaccagtcaaactatagcccgtcacagatgacctatctcaatcgggctacaactagtgcttgtcacagatgacccttatctgtgacgggcattaactatagtccgtcacagatgagtaatctgtgacgggcattaattatagcccatcacagatgagtcatctgtgacgggcattaacttatgctagagttaatgcccgtcacagatgagtatattccaaaaataaataaattttattttttggctagccctcactcgtgtgcacacttaacgtcaaagttctttagagattggcttccggaaaaataattgtgacatgttggtatgagtattctattaatcctattatgccttaggccaggatgttaaattggggttattaaatgatttcaaatggaaaagtcaacaaaaccaaagttgtagaactcatcgaggtgcaaaatttttattttggtcatttctccatctgactctatttaaacaatttgaaatttgaaattcaaagtttgaaaagttcaaatagaattttagatcagtgaacgacttcaactgaaaaagtcatcaacaacaaagttgtataactcatcaaaatctataacttttattttggtcatttttctatataacattttttgaaccgtttgaatttg

SEQ ID NO: 44632 - DNA, 12533 bp, Oryza sativa
ctttaggcccgtttgagatatggaatgttatctcaatcaagcctaaagttgtggcccgtcactgatatgtgtcatccgtgacgggcttaagttttatacccatctaacatgtctgtgcgaccatatcttaatcgggcacttttcggcccgattgagatgacttccttgtgacggcccgctatttctaagcatattagagcccgtcacagatagaaggatctgtactagtgtgtggaaaatgctagaatgatttacattgtgaaacggagaaagtaatactaaaccgagagaatatatatcaatctacataccgaaatatacatgctgttcaaggagggcgcagcgtcaagtaaaaaaagagtccagttcaggtcgcatccgttaaagatgttgcggagatgcacgtctctcaggcagggttcactttctcgccggtaaccgcgcggtaaccgcggttaccgggcttaccgtgggggtcggtaacgaaaaccggcggtagggtttgggcaaattttgctcaaattcaaaaatttaaaaaataatcgaaaaaaatcaaaaaaaaatcatggatgtaaagcttgttttgtatgttgttatggtgaaaaaatttcatcaaaaagatgcaggtaaattcaaatttgagcacaaaacctattgtgaattataaaaaagaaaaaagattaaatggaatgggccaagtatgcactgttcatgaggcccaataaggcccacaatgggaggaaaatatctttggaagcctctgcttcgtttctctggcgaatcctaccgtttttcccctctttcgcgtagctgcgctcaggaccgaaggggcgacggcgtgcgcccgcgccagatccgccgcctccgcgccggcgaggccggttcccgcgcggtaagcggtggtaaccgcgcggtacgcgacggtaaccgcctgggtcgacgggcaagaggtaatccctccgttttgaaggttttcgcacggttaggagcggtaaccgtgcggttttgtacggttaccgtcggcttcgtaatctatgagacgatatacgtatgtgcagtaatcgtgtgaaaaccgtggtaaccgtccaccctaccgtggttaccgtggcttgaaccgtggtatggtattttttactgtgatatgcatggacatatttggggatttaggtcaatagaacatatttttaccaatatgcatgagaaatacattgggaatatgagtttatttcggcatttggttgcccgtgcttggctaaaaccatgcatgtgaagtatatttgattgctttggtctatgtacatataggttaaattaaatacgtcatagtatggaagaatttggatgcatgcttaccagtgtacatataattacgtcgtattattgcataatgggaggtatgtttataattagcagtgataatttctcatgcatttgatacagggtggagatgtcagatagtagggaccctgtgtgggagcacggggagaatatcccacctggatggcgctgtaagtattgccatacaaagaggggcggtggtggggcaacaagactaaagcaacacttggctgcaagagggaagggggttacatattgcaattcagtgcctccggatgtccgtgagttcttctgccgtgagttggacaggataaaagatgcaggtgaccagcgtaagagtgatagcggaagaagggttgaagcagcaagggtcaactattatgacctaacaggtgatgccgacgaggaggaacaaatggaagcagccattgcagcctcacgacaagacgaaaactttaggagggatgttgaggagcgtggtggcacttatgagcatggcggtgggagtggatccgcttagccggaggcacggaaaggtagaagtaacccaattaccaatatgctacgaagggctacgtctcatagggagtcacctgctgtgagagattacaacctagcatctgccaaggcccctgtgcagccacgcattgacacaggattcttcacaaagaaggggaagcaagctaggcaagccattggtgagtcatgggcaaggttcttctttaccgccggcattcctggtagaaacgccgataatccatactttgtgagcgccgttcgggagacacaaaagtggggtacgtatgcatctattaaggaacttctttttttctaactcattgcgcactacttatttcatacgtcaattgtaggtgaaagtgtaccttctccaactggtaacgagatagatggaaaatatcttgattctacagagaaggatgtgaagaagcaatttgataggttcaagaaggattgggatgagtacggtgttactataatgtgtgattcttggacaggtccgacgagtatgtcggtcatcaattttctgatatactgcaatggaataatgtttttccacaagtccattgatgcgaccgggcaaagccaggatgctaactttgtgctgaaggtatgtatggttcatgcaacaaattacttcatcacctgttatcgtcagtgttaggggcatggactaatttttattatgttatctaccaatgcaggagataaggaaggtggtacgcgaaataggctcggagcatgttgttcaaattatcactgacaatggctctaactacaagaaggcgtgcagactactacggcaagaatacaagacaattgtgtggcaaccttgtgtggcacacacagttaacttgatgcttaaggaggttgggaaaatgccagaccacgaaatagtgattgagagtgctaggaaaatttgcagatggctatacaatcataacaagttgcatgctatgatggtcttagctataggtggtgaactggttaagtggaatgctacaaggttcggaacaaactaagtggaatgctacaaggttcggaacaaactacatgtttctccagagtttccttaggaagcgagatcttttcatgcaatggatggcttcctctgtcttcatgcaaagcaaatttagtgggactttggaaggtagatatgcacatgcatgtctatctagtctgtcttggtgggagaacttagaggcagtagtgaattctgtccaacctatgtactcattccttcggtttgctgacgaggacaagaaccctaatttgagtgaggtacttttgagatatcagttgctcaaaatggagtacgacagtctttttgcgaatcaaagggacaagtttgaagcatacatggagatcgtgaacagaaggatgcacgacctaaccaatgagactctcatcaatgccggtaaatattggtcataacataatccacatggcatattatgtaactcttacttaacctgtgccatgttttgtagctgccgcattgaaccctaggacgcactacgcgtattctccaagtgctactgtcttccaagacctccgacatgcattcgagtggatgacggatatcgatacggctgccgccgctttgctggaggttgagatgtaccgacgtaagacgggtgaatttgggagggcactagcaagaaggatggccatagatgggaaaacttcacctggtatgtttctaatcatggaactatgatatatctaattgatcttgatgtattcagaattatgaaatgacatgttacttggcttttgcagcacaatggtggtctatgttcgcctcagacacgccgaatttgaagaagcttccgttgcgtttggttggtcaatgttgctcctccagtggatgtgaaaggaattggagcacattcgcattcgtacatacgaaggtccgtaatatacttacccacaagaagctcaacaagctagtgtacgtgaactacaaccttcgccttcgaattcagcaagcaaatgcccaaattagggtggaggacgatgatccccttcaaagattagcggacctctcattctatgaaactaacaatcatatcagtgcctggatggacaatgctcgctctaatgcttgccccgaactagatgaagattcagctgagagtgacgctcccctgcctagtcaacttgtgtctgacctagtcaacttggatgacctgggaaggaccacgggagcttctagtattgctgagtgggctgatacgaatgtaggtgacactcatattgggaaaaggaagactcgaaagccgccaaaagcacgtccatctaaaaaggtaaagggcaagggtccacgatcgactagtgttgatagcgatgaagagacccaaggaagcccagagtaccaagagtccaatgatagtagctcaagaactgaaacagatgacggcgacgacgatggtcaaggaggccaaggcactactaatgtgcctcctaggggtcacacccaacaatcagatcaccacagccccgttcaattcactggtgtgatataattcagttgcaatttcaaccttcatcttccaattcagtactggataattttcttgcaattttttgatttgcaggtgagggcgacttcactcatgctactcaggaccaggatcatggtgctccaagctctcaacgaactaccattgcaccgggagtccgacaacagcaacaattcagtgacatacaacaggatagctctagctcattcagtgtctctagctttgaaagtggctatccaacgtatgtgtacaaccgtccccaagcttctgattatcctgctactacatgggtgtatgaatggcaagagcctcagtggtatgctcaattgtacgctcagtggcaaacaacatcatcatggacaggtcaaagttgggaggaatacaaggcggggttgctacattcacatggcttgatgctcatgtccacagaggagtacaatatggcatataatcagtggaatgcgtagctatgcatgtccttgtttatttcctttcattcgaactagaattgtaatcgtggacattatactgtggactctacaatatagagtaggtcatgccgaatttttctgttgtataaccacatcttaattaactaaaatactcacattttagtttttttctattatttttttcatttttcttatttcagttccaacataaactaaaatactcacattttagtttttttctattatttttttcatttttcttatttcagttccaacatatcgcggttaccgtcctcttaccgcggttaccgtaccaaaccgtgcggttaccgtgtccataccgtggatttttaattcaaaaatttggaaacgaaatttgtgcggtttttcgcggtaaccgcacggttatcgcggtaaccaccataccgcggggggtcggtaaccccccaaaacggtaaggtgaaccctgctctcaggttaccgaatataggagatagcaatttcgggtcttccggtttaacccaaatctgcaataatgaaaaaaaaaaggcaaattaaatacagcgcacgtcaacagactactgaattcagaacatatttaatattcaacaaatgaaaacccagcctgtgacgtactttctgaccacggaagttcaggtacaaaatcgacaagcttctagcgccagaaagccactggcttagaacgaacggctcatgccaaaacaggcactcggatccgaacgcgatgttatcaaggcaaggaacgtagccgaaccgcacctacacgcgccgaagcttgggcacccggatcagatccaccctccggaagttgcagtggtgcagcttcaggcacacgagctgcgagcgcggcgcgtcgatctcgaggacggcgtcgtcgaccacgtcgctgtgcctcagctcgaggaaacgcagcctcccgcaggtgttgacgagggtcgggatgtcgtccggtccgctcaaacagtcgtccacggtgagcctcgtgagccacctgaaaacaacgggacacgcttggaagaaggaccagaagcgtcgtcccagcgagaccttgtgctcgtcggtcaggtcggcgacggcgatgtcggcctccacggtgaggtccagttcctccgtgccgccgccaccgtcgatggcgtgtccgacggctcggccgatggagtgcaggtaagggtctctcaagaagaatgccaggtcgatgctcttcttggtcacccgctgcggcgttgtgatcgtcggctccaggagccacctcgccgtggcggtgtacgccgccattgtctgatcaacggtgtagccggcggcgttgttgtgtcttccgccggagccgatgtccggctgcgtgaagtcacgggcatggagtctgatatcaggaagcatgtgcgggaggtgtctccatcttctcgagagggcgctggccctgacaacggaacgcaggtcgtcggcgagacgttggagtatttcgagcaaaatatcatcaaggagtgcgcttagcctgtcctcgctagttactccctccgtattttaatgtataacgccgttgactttttaatcaatatttgaccattcgttttatttaaaatttttgtgtaaatataaaaatatttatatcatgcttaaagaatatttgatgataaatcaagtcacgataaaataaatgataataacataaatttttagaataagacgaatggtcaaatattgattaaaaaatcaacggcgtcatacattaaaatacggagggagtacatggcaagaacgcgaagaggaatccacctccatcaggccggattttctggaggacaggattgtgcaatactgtaaattaaagtaagcgaccgatcaatactggacgtacgcacacaatggtcttgcaccctggaatcaatatatatttctaacgcgatggctaattcttaggaaaaacggatcggatttccgtttccccccgcacagtgttaaaccgccctccctaagggcggtaaggggaccgcctgcaaaatggcaggccccctatagccgaccgttaggcataagccaacggtcgtctgccacgtcacgaaaaggcggcaggcgactagttttgtaaatttttgaaacacaaattagttttgtaaatattttaataaaaaattaaaaataaaaaaaaaattgtccaacgtgacttgcagcataggcgggccggctgtgccgtattcggcaccaatccagcccatccacaggccagcggtccggtgcctaaagacttgatgaaggccggctgccggtcaggggtgggtagatcggtgggggaaatgtacatatgaggtccctcatcttatcaccgaattacaaaatcgtacctcaaccgggaatatcttagatccctcgacttacaaaaccggatcaccctgagttcttaggtggtattgatcccgattttgtccgacgtaacggatgagttagcgtgggactcacgtgtaccccacatattagggtgaccacgtcataaccctctctcttctccttgtttgggtaggctacctaacggatgggaaggaggtcagcgggacgagacgggagaggaggaggtccggcggcttgcgacgatgcaaaaggggagttccgctggagccccacgagagccgacacgatgcggagatggagatggccgtcgtggcagttggcgcggaggtggtggctttggtgacctctaggccagcgggggctttgcggatggtgcccgaggtccaagacggctggtggtggtactcccagggcggagggtcgggcctcgctgagcgtggtaaagctctagcgtttgccacgaggcgcggtggccgacgagagagggcaactgccatggcctaccgtggagtggaggcggaggtaaccaacaatgtgcgatgccccggcggggggacttggcggaattgatgcgatagagctggaggtgaacagcaggggtgaggtggaggaggacgccgccgccgcagtggaagagttgcgtatggctggttcggcgtgggcgccgatggtgacggggtgaggacggattggttcgccacgtaccagggccacgctgtgctggcgctcgtgaggctctagcggaactccgtcgatttctccgccatcaagacggcgggatcctccaagcatgcggcctctgcaaccaccgcctcgactgctcgtcgtcgccgtgtcacccgtcgccagccgccggacctcctcaccgacttcctccccacccgccggccgacctgcccatatgaggagaagagtgagagagaggaggaagggagagcagaggggaaagagagagagggggggtgatgacgtggtcaccctgacatgtggagcccatgtggatcccatgctaactcagccaccccgtcagataaaaccggggtcaataccacctaaggacctagtgtagcccggctttgtaaattgaaggttcccatatctggttttttggttgagggatgattttgtaattcggggactacttttcctacatgtggtccgtatgtcatgagggcactaacccatgttggcccatgtgggttgacccatatagtgtttgccccatagttcatgcgctgggtcagtgggtagctgggtcgacctagcccatctgcattcctaggtgataccgccatgccaacgagttgtctaccacgcccagagagcaaagcagtggtacaagaaagagaccgaagaaagataatagattttggaatgatcgattttgttgcatcatatcaagccaacagttgagcaccgttgagtgcattattaatcagagatcaactaagcttgactcctattcagtccagcaacagacatttcaagcatgcattacagggaacctctagcatccatgttcagttgcagcagtaagtggctaattgaatagtgaactgctaaaaagagtagagcgatttcttggcatttcgctgacaagttcacatccatcgactgtttctagtgcgacgagtgaattgaagatgagtaatctagaggagtgggagcctagacgagtgaattgaagacgagtttatgctatatatcggaatcccgttaaaaaacgggacgattctggtaccaatatggcatcgctcttagcaactgtcgtccgccacctgcgtgcattgcagcaaaacatgaacgacgaccagcactcgccaaacgccggcttccctgcatctcagcgaaacctcctcggaagcgcgcgcctccacgcgcgattcctcgcttcctcccgctggcgcgcgcaccgtccgtcggcttctccgcatcatggcaaatcctcctagaaagcgcgtgattcctcgcttccttccaccggcgcgagcatcatccgccagctcctctacatcccagtgaaacctcctcggaattgcggcgcgcgattcctcgcttctttccagcggaaccctcgccgtccgccggctcttctgcttcccaatgaaacatcctcggaatcgtgttttgcaaggatatgatcttgcaatcaaaacaatacaaggtttagctgagaaagcttgcatcaatgaacttgacaccaaagcttgcatcaatgaacttgacaccaatgggaggacaacatgttgagaaggcccagtctaaaaatcgaggtgatatgcaggaaaaatttgtgaatgagagtaacaccatcaagacagtgagtatcttggctgctatcatggtgactacgggtttcatggatgatacattagtagaatcatgtgatacctgggaggtatcacgatccttctcgatatcatgaaacctgaaggtttcacacatgatccctcgctaggtatatataatcttgtgtgatacctaaaagtttcatacatgatactgcaaagtatcattatgtgtgatacctgtgaagtatcacatgatcctacttaggtatcatgtatgctatcatggtttctgtgggtttcacatatgatacttgaggatgatcatgtgatacctgggaggtatcatgatcctcctcagtatcatggatggtattatcaggtttcactgatgataccttaggaagatcatgtgatacgtgggaggtatcatgattctgctcaggtatcatgtctggtatcatcaggtttcatagatgataccttagaaggatcatgtgatatgtaggaggtatcatgattctgctcaggtatcatgtctggtatcatcatgtttcatagatgataccttagatcatgtgatacgagggaggtatcatgattcttctcaggtatcattaggtttcatagatgataccttagaaggatcatgagatacgagagaggtatcatgattcttcttagtatcatgactggtatcatggttcctgtgagtttcatagattatacctaagtatgatcatgtgatacttgggaggtgtcatgatcctcctcagtatcatggctggtatttactccacaaaaagtctaccccatgtaatacacttcatttgttcatatatggggaaacgatttttgcttccgtcaacttccagatcaaatatatgtacagggagtggacatgaataagttcatatcagattcgatcgatgtatcgtctatgtgctcgtaccaattcatgtcaccgattttcttgacactgcttaaagcaagaaaatgaagaacctcctgttgatggagaccgtcaaccgaagaaaacacggtgggcgctggcgtcggcgccaccaccacgctcacgccgctctcccacactgacctcgtgcacttcagcggcgacactgaagaggtggagctgccgccgccggcggacgcgagcaggtgccgccgccggctcctccaccgccgccgtcgacgccagcgagatctcacgcgccatgcccacggtgagagaattgtgagtgggactcggataagcacaagaaacgttctgtctctcttgggagtgggactcggataagctcgtgatgatttctgatgattggtaaaaaatttgtcccgtcccgaccgagcccaaacgggataccggtgtttagcatttccgttcctttcttcattctgaacatcgtcaggcagttgctcgaatagatcttcctccgccttgggaactacatagaacagattaagtgcaagtagtcacgagccttgttgttgatttacaaaaataagaaaagaactaaaatggaacaagtgcacacctcgatgatatttcagctgaattggttcactttgacttagtacttgaatcatgccaactgcacaagtcaaaagttgtcatgcatcagaacgtagcacacaaggttaataaagcaaaactaaacaggtcagcagcttaatacatgcagaacattgtttgtagaaatgtagtacgtagccatgtacatgaaccagaattactaatgagcacatgtgagaggtaaatggcaatttggcatatgtgttgaactgattgagatgtgcagtcatgttacttattcttgccttgttgtaatagttgtgaatcattttgatcgatccaaaaattgctgacatgcaagtcacatactcacatgacagtagcaggagcaattaagatgcacaacaacataaaacacggataaggaattaaggatgcatgaaactgtgatactagatgaatcagcagactaatacagtaccatacatagtttaattaacaaggttgttgaaagctacagaaacacacattaattaggcaaactaattttaatctacacacatgcaagcacagaataatgcagtgctagcatgacagtagcatcatcaattcagattcacagcagcaaatgacacattaaaggattcatggaaacgccataccagatgaatttgcagatgtgtcatgttgttctgtattcagaggctggttcagcggccatgaatgaaagaagtaggaggggttgcagtgtgtggcatgaagatctgtgcacctaatcatccttcttgctttcacatccactgtgaataggttcttgccgtggcccgtggacgaagaagagcatccctgtatgcacaggatgcgctgccgcaaccatgaggctcttcttccttgtgatcctgcttacccatctcctgctccagatctccgagaagggcaaatggcactcacaatcccaggtcgcgtgctccggatctgccagcacccatacgctgatgatcggtacgccaagtctgctgtgaatctgaatgtaacgaagcttcccaccgctgctagtaacgcagcgatgcttgatgaggtcgttctccgtgccggctacaggaggcacgcacccatctggaagcggcacgaacagaaggtcctggtgctccgtgaatggatcgcacgcgaggaggccgcaggagagatcaacccaccagagcttctgggcatgggagatgacggcatcgtttgcccagctatctggatggccaagcccggcgtacttgacctccttgctgagccagagaccggtggcgctccagtagaggcggagggtggcgtggtcggtgccgagcatgggcacgagctcagcgatggcgtacgaactccttctcctcctcctcctccaccgccgccgccacccgccgcgcaaggtcttgagattagacccaccctatggaagtcgctcagtggaccaccgacgggaggatcggggacgcgggaggccacgccagtgtgcgcgtcgcagaggaagtacgccgggacgcgggcg

SEQ ID NO: 44633 - DNA, 3645 bp, Oryza sativa
gggggcgatgcgggcggcgacggtaacgtgggagacatgcgggggcttcttcagcgccaggacgaagtcggtgcccggcgggaacatcctcgatgaccggcggacgtcggggacggcggccagcataatccactcctgccgcggctgcgcgtctcctacctcctcctccaccaccaccgccgccgccatgtcacgctcacgcgaggtcggcgagctcgccatggctgtgtctgtgtctctgtgagcaggcccgtccctgagggcgtgcgacacgagcgctcgcacagggcccccattttcaaggggcccccaggctcatatacttgcccttccgtggttcagtcccattgatccaattgataacaacagaaaggcatggaggctgctggagcgtgagtgtgagctcaattaacgagggaatgacgccgcacgcgcacgaatgcacgacagttccttttttcagatcgatctcaccacctatccgccggcctgctgcccaatcacctagctccctcgctttgttttcttttctttttttttttatgttaagatctcaccgcctatccgtgggccgtcgcccgtgacggtagagctcactactcttgccgttgcctggcacaacgtcacctatgcccggccaccgactcggtctctgcgctagtgagctcgtccgcacgccattcccctgcttccgatgccggagcactactgcatctgcagtatgcacgatgaaaccatcacaccggaaaaattcacggttataggcgtcgtcttgtgcttttcaagtgaagattatgtgaaggtattagtttttttctattattttgttggtacgaaatatatcataagtataaattgttatcatcttttttattatcacttatgtttaggctgtgtttaaaattttgaacaggcccctaaattttacgggacggcactgctgtgagtggtcgggtcggtgcctggaggagaagttgggtgcgagtctgggatggtcgaggcccgcatagagcagggggtttggggcaaattgaccaatggggtgcgtaccaatgcgtattgggctttaggatgggttcttccagaagtttcccagcttgcaagagaaggaattttttttatttttaattttttttattaaaagttttacaaaaataattttccattttgaaaattggcggaagtagtcgcctaccgctctttgggagggcgatttttaaaaatcgccatcccagagggcggcgaaaatgacgtggcagacggccgttcgctctcgggcgacggccgtcaacgaaatttgcaggcggcccccttgccgccctccgctagggcgattttgtactgtgcggggggccgcctgcaaatgggcggcgagggggcatggaattttgcaggcggcccccttgccgccctgggggagggcgatttttgcctccccctataaagcccagtcccccctctctgaaatttcattatattcactaaatatccaaaaaaaacgaaagagagagaggggagggcagcagaaggggagcggcgaagccctgctggttcgctcacttcatcacaggtttgctcccatacatcttttgcatttgtactaatatgttatgtttgagtatatatgttgcgttttagttttagttccatatattttagcatatctgtagcacacagcacatatgtgtagatccagagcatagaatataatagtatgaattgagacatagacagtagtgttaattgtaagatgtagtttagtttgatttggagaatgtaacctacttttagaattttggagaacaatattgcagagaatgtaacttagggcgtagtacagaaatgcgaggttaacgcagttattgttttcatcaggcacaatgtcaaataaggtcacatttcagatagttcacggtgaaggaaatattagatttggtccagatggtgttgatctgtcagattttgtaatgacatctaagggcatcgataggcctgcggagagaatatttcagtcaatttatagttggttgttgagaggatttagaatagaccaagaagtctacacaatgtcagtatcagttgtagtgagtcgtgcaacagaaggttatttttgggaactaatgccgatggacagcactgctgcttggagacggtatgtggaaatagcttttgaacggtcatggcccctcgttatatttgtgtcggtacaagagaaagatataaatgtttcaatgcaaaccgaagatgtagagggtcctatcaatgcaggggatgttgttggaccatcgatgcaaaatgaggaaaatcaaccaagggaggagcaggccatgggcatggcggatgagggggccgcgttcgccagctcttcctctcacggagcgtcgatccctcgcccacacggtactttactttttattaatactattaaatacctgtatggtccttgtccagcaggatttgtagccgggatcttcggtactggggcctcttcgtctcacgccggtaggactggtcctactagccagttctacaacgacgacttgcacggtgcacaccaccacgacgtactaggctcctctcagcttggaggagctccagaggcgcacactcaggagcagccagaggtcacacctgtacaggcaggacgggttggccgtgccgtacccccggaccgactcacatactcccaggggcacattagggcgcagggtaggagggacaggggtaagaggcctcgtcagtagtgttctacctcttcagtccttatgtgaccgtttcttttggcttacaaacttgtaaagcagtactactgttgctattactactgtagtactacttgtgtttgtctcgtctacatagtccttttcattcatatggtgctagaacaacttatgctcacgacaacacactttcggcgcttcacggtagtgtcagatccagtagcgcgcacagtccacaacagcacacatgaaaagcggcagctcgagttgtcactatcaactttcggcgctgcctgttgacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactagcacacaacacacgaaaatggaagcgccattccttgagcgtctcaactggtaaagcgatccttttgctggttggtttccaccatggtgtgaccgtcctttgtgcgattgtggggatggatgcatactcaagtcttccctcatgatacaaactcggggcaggagattcttccaatgcgcgaactttgatcaggtatgcttcatctattcgaagttcaaatggataaaaaaactaacttcttcgtacacaattgtaacatcttacgcagacatatcgtccaatgtgcaacttcatcgagtgggtagacatggagaacccacaaaacaacggaacccgtgcttacccacgtaatgaaacaagatcggactacctaaggcggaaggatgagcatgaacgtcgaattgctgctgaggctttagaatggcacgtaaatcccctaggactccccacgtggcgtgagcgtccggagtgtcgttgtggtg

SEQ ID NO: 44634 - DNA, 8078 bp, Oryza sativa
  unsure (1)..(8078): unsure at all n locations
ggccatacagttcattcatgcttggatggagtacgaacgtcgggtggaaattgcaagcttagactggaggaacaatccattagggttacctaaatggtccgagcgtccaaagtgtgggtgcagagatcgctggcaggtggctacatcctttgctgaacaaacatttcgaaggagatattttgtctgccccaatgtagacaacgatttcgttgtatgtctaaccatttacaaaatccgctatgatttgcacaaaattactacccaaactgaataacattactatttttacagggcaatccaaggatgggtggatttactcgatggatcgacaatgtcactccatcatatcatggccagaagataacagagtcagaaacacaagtagagtatcaacgattgaaggaccacgagaatgcaatgcattctgaccgacctagaaggggccgataggttaccgcatgcttgattcgtcgggatcgacaaatttgtaccgtgtatcgatggcacttcttatctatcttatcattacaatgtttaattatggtggtgattttttgtatgcgtaagactaagggcctatttggattgctaccaaaaacataccctaccaatattttggtaatttgaatagtacttgtgtttgatttcgattgaagcctattcattggtaatacgtaatctagatttgagattatgtataacattcttcactacaattttacattttggcagcaaaccaaatatgatcaaatgcaattttaccttaccaaatatttggtagtgccaaaacttgcttatattttggcactaacaaaatatttgtacggtaacattccaaataggccctaaaaataataaaattgtattttaccagtcttggagattttaatcttgtatagttttcaatataaaaagatttgataactattgatatttatacaaaaatataaagcacagtataaaatcgccctcccccagggcggcaagggggccgcctgcaaaattccatgccccctcgccgcccatttgcaggcggccccccgcacagtacaaaatcgccctagcggagggcggcaagggggccgcctgcaaatttcgttgacggccgtcgccgagagcgaacggccgtctgccacgtcactttcgccgccctctgggatggcaatttttaaaaatcgccctcccagagggcggtagacgaccacttctgtcaattttcaacatgaaaaattatttttgtaaaacatttaataaaaaaaattaaaaatacaaaaacctccaagagaagtcacctactgcttcaggtttggaggaaacgcctaagctaatccggtgaggtcgaggcagagtagtgtattgacacgtcgtccaccggtaactcttgtaacaaattccttgtaactgcttgcctcaatggccactggcataattttgtgtactgacccatatgtaaattttgagtgtataaactttagataaataaaatttagataaactttaagtaaatctctacttatctctatctctagtatgataaaaattgaaaatgtttttgctggtattttggtacgtcatccatgtttgaatcagtttttaagttcgttcgtttctagaaatacagtttgtgtttgagttggattttaaactcgtttgcttttggaaatacaagaggaatcttataagaaatctctttaaaaaaaactcatgctaacttgagatggaatatggactcctaattacagctcatgattttctaaacgagaatgctaggggacgggatactgtcccccaacgggatagctcctctccacaacgcgattcgcatcccccgccgctgccgcacccgtcccccgtcgcctccgccgccaccgcgcccgtcctccaccgccgtcgtcgctgtcccccgccgccaccgtcgccaccgcggcgtccgtcccccgtcgacgctgccgccgccgccgcgcccatcccccacctgccgctgcgcccgtcctctgccgccgccgccgccgtcctcgtctacaagggatggctgcagggggcgaccgcgcgtgtcggggtgctcctctcccaacgggatgcccagctatatctagcaggaatcacctgatatctggtaagtatcatctgatacctcgcaagtatcacgtgatacatggtagaaatcgtctgatacctcgcgagtatgacgtgatacgtggtagaaatcgtctgatacatgacaggtatcgcatgatacctcgtgagtatcacgcaatacgtggttgaaatcatctgatacctgacaggtttcacatgatacctcgcgagtatcacgcaatacgtggtagaaaatcgtatgatacctgataagtatcacatgatactttgcaggtatcacctgtaacgtgtgtagaatcgtttgatacctgataggtatcacacctgatacctactcgggattatcctgttctgtagaatcgtctaatacctgataggtatcacacctgatacctactcgggatcatcccgttcgaaaacgggattccgttatatagcagcccccttttctaaatgaaatattcaagcaaattccatggtgaattttatcctaactaaaccgtataataataataaaattaaaatagcatttatccgttgcaacgcacaagcattttttttttaataaaaattgaagatgtttttgccggtactttggtaggtcatccgtgtatgagtcgatttttaagttcgtttgcttttggaaatacatatccgtatttgagtctgagtctttttaagttcattcgtttttggaaatacataatggatagctttaaaaatattgcatgctaattttagacgatcagactcttaactgcagctcatgattttctaaaaaacatatatctaagcgaattcctacagtattgatgtactgcatacaggccatataaaagaacatttctcaggtgatcgcgactaaaagatcatgactatatagatggcatgcacaaatattcgctttgcggtggtcgctggtggcgccgttgtgatcagcgacgtttcattcgtgggcctctcctacgccaccgtcttcttcgcgtgcgctccctacgtgcctcttgtacttccggaacacgtacgtacgcttatcctacggaccacatgccaaagctgttcaagtggtgctacgtctcggtgcctatggccgttctgctgttgtcccgcctcgtgttggcggcacggcaggcaaccacgctggacatcaggctcgtcgccttcaccgccgtcatgttgacagtagacgttaccgcaattgggtttctcgaatggcgcagcaggagggagatgccgaagcctcgtggtacacgtgcgagcgcgtcggagatcgtcacgtcgtttttgtgatggtttgcttacggtatggctgtatccactggtggagaaaccatctttcgtcggtcgaccgaattccacaatagtcctggatgcaataaaaaccggggctaaagatcagctaaagatgatctttagtcccggttaaaaagagtaatgggcatatttgatctttaggttcaaatgctgttagggcctgtcaggcccctccgggataataccaactgggactaaagatcgtacctttagtaataccaaccgggactaaagatcccgggaatctttagccccggttggtaacaccaaccgcgactaaagtcccacccttatatatatatgttttcttcctcctccagctgcccgagcaagcttcaaaatttctttaaaaatgatgggaggtcatgccaaaatttttagtgaatttattttggtgattacatacaaatcggagatgcctaaaaggtttgcaacttcatcctccaatgttttttttgtcatattacatttggagctatgttttgcacacttttttatctccaaaattcagttataagttgatgagagagaaaatttgtgtggggaagaaagaatatatagaaaattagttgatttgctaaagaaggttttataaaatagttgagaaggaaaatatagtgaaagttaatcttaaataatagaaaacaaactaaaatgaaaattaaaagaagtaaaacacattaatataagtttaaaactttagaaatagtaaataagaattatttggtgtaatattttatgatttttatatgaataaagatatgtcattattgtctgactgttcaaagagtttgtaattattttataattattgtatgactgtcattattgtaagaataattatttgtgtacgattttttttcatgtcatgtagatggatcggcaatggatgtacgctgaccggcggtccaaagagtttattgacggcgtgcattattttttgagagtggccgaagctaacaggcaaaagggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaaaatgaagtggaagacgacaatattccggactttgctcagtacgttggatttgaaggaaatcaaacgggcgaggaggaaagagatgctgatggtaacgacgttgcggatgatcttggtcagatattgcaggacgtcaaggaggactgcgaaagtgaaaagggggcccataaattggacaagatgttagaggaccacagaacgtcgttgtacccaggttgcgagcaggggcacaaaaagttggataccactttggagttcttgcaatggaacgcaaaaaatggtgttagtgacaaggcatttggcgatttattgaaactcgtcaagaacattcttccggagggaaacaaattgcccgagacaatatacgaggctaagtatatatgattattnnnnnnnnnnnnnnnnnnnnnnacatatgttaattagagtttttaataattaatttactatcattcatatgctaattatatatgactattcaaatttttaaaagttttaaatcatgcatgtggcatttacatatgttaattagagtttttaacaattaatttaatatcattcatatgctaattatatatgattattagaatttttattaattttaaatcatgcatgtcgtatgtatttacatatgttaattagagtttttaacaattattttaatatcattcatatgctaattatataagattattagaatttttattaattttaaatcatgcatggcgtatgtatatacatatgctaattatagtttttaacaatttaatattatttatatgctaagtatatatgattattagaaattttattaattttaaatcatatatttgcttactacgttttatccacttaaattactacaaacaacaataatttttcgaagtaattgtcattattttttcgactttaaataattttaatgcattattttctattttagaaacacatatgtaatggaaattaatattcagtgcgcttatcagtagtcccggttcttaaccctaaccgggtttaaaaagaatttggaaatagcgggaaaatgtctttactcccggttgttctcatcaaccgggactaaagatctaggggtatatatattcccaatgcgcgccctcgtcttctccatcaacacttagaagtttttgccccgatcgatctctctcggcttctccttcgccgccactgcctagggcatccccgcgccgacgccgccgtcgtatctcgccgtcgtctcgcgcgcgtcgtcatcgccgcctccgcctcctccgccaccgccgcatctctggggtgagagccgccgccgcctccctctctagctctctctccgatctcgatctctctctctctctcggttgccgccggccgcctcgttgccgacgccgacgccgacgtcgtcgcggctgaacatgactccgccgcgccacgacgccgcggcggcacgacacgccgggacgccacgacgccgccgcgtcacggcaccgccgcgccgccacgcctccgccgcacaacgccaccgccgcgcaacgctgccgccgcgccgcgcgctgcgctgccgccgcgctgcacgccacaccgatgccgcgcgcgccgccacgccgccgccgcgccgccccgccgccactccgctgccgccacaccggcgctccgctgccgccacgtgaacgaacgaattaacgtgaacgagcgaatgaacgtgaacgagaacgtgaacgaacgaaacgtacgtgaacgagaattgaacgtgaacgaacgagcgtgaacgaacgtcaacgaatgtgaacgtgaacgaacgtgaacgtgaacgaacgtgaacgtgaacgaacgttaacgaacgtgaacatgaacgaacgtgaacttaacgttgtatttgaacgtacgtaaacgaacgagcaaagcaaaagcagggaactaacttgtgcggctactacgtgtgcgagtattgccactgccttgcaaaccaaatcatcaccacaagagagctcgatgtacgtacaaataaattcaaaatttcattacgtatcgatttgttgtttaattactaattaatttcatacattcatatagtttattcgcatgagggataactttatcacacacaaggaatttatcgcggcggttcaaaaacaactcatgggatttatcaacgaacaaatccttgatcccaagggtgaattctactacgacggaaatacagttcataggtccttagtttctgagatagcgactactactacgtcgaaatcgtagctagctaggacataatggattgtaattaatacatgtctatttttctatatacatgtgcacattttgtataatgtaaatatatattttggtcatatatatatatatatatatatatatatatatatatatatatatatgtatgtatgtatgtatgtatgtatgtatgtatgtatgtatgtatataaatatgtatataaaccatgcagcaacagggccatgcaaaaaaaaaggttagctcgatctttagtcccagttggtgttacgaaccatctttagtcccggttgagatcgatctttagtcccggttatttcacccgggactaaagatagcgatctttagtcccggattggtagtcccggtttaaaaaccgggactaaaggggggttacgaatcaggactacaaacgctttctccaccagtgatctacacgttttctacgtcattggcaatggttcgcaaagatggttcagttaatcggagtccaaaactatcagtaacaaattatgtaataatgcccgatctattgcttttgttttagagacattaccattagtcatttttagagaaggaactgttaatcagcatagtcagtcgagcaaccgaattttattcaaattgaagtgatatcagaatcagcattgcggcacgtagaatgtactgcctactggtacacgaatgagaatacgtcatgttccatgtgcggcatgtagaatgtactgcctactggtacacgaaagagaacacgtcatgttccatgtagcaacaatactcatggtcattggatcaattgatcaatgctcagcaaatcataaggaggaagcaaccggcctttgtcttcgtcgtggatccttagactggcgagactttacttgaatcacttgtactcgccagaggaacgccttttttctgatcgtcagaaccttcaacacaagcaaaaatgatggaaatgtcacgcaaggataaaagcttctaggaaactagcatttcaattgagatcgtttacaagtttgtacttaaaaaaagagcaattttacgatccttgaagaggtaccatgaggtaccgttttttctattgtaaatttggtacctcatagtaccatgtaccaagagataccaaattttacactaatttttttggtacctcatggtacctcaaggactgtagaattgctataaaaaagtttgaactcctaaaaaaagtcacatatccttatctaaaaaaagttcccatatcgttaattatctttaaaacaaaagttcacatgtagtaagaaagaaattaatacttccaga

SEQ ID NO: 44635 - DNA, 21232 bp, Oryza sativa
tagaatataatgagtatcatatgcattcatgctcatgccaaaactgactctgtacagtactctgtgctaaaatggtttggcagaataccctgtgactaagcaacaaatcaaactaccaaaaagctaatttacattgatatgttaatgcacacgacgatagattctggtgcagctactgaccattaaagcagtcatgacgagcaatatgagcagaccagtaaaacagggcaagactgggttggaatctagcgttcaccgaagtactaattttagattatcagtaagattatttccgtacaaaacttactaagatcatttcatatgatcaaaacatttataatgagttgcgcgtgatagagatagagtgctgaatagtgcgatttagtcaacttactgactctaaacgttccaaaaatgaagaataatggacaaagtaatgaattctagccgtgcatgaacatgaagctgtaatttcgagtgcttatttcacagagtgcatgcatgatcaggcctagcaaacaggagacatcttatccaggtgaatccttaagtacttcatttccatgcttaattcagagtaaagacatgcatgctacatcaaattaggcgactaattaattactcaagaagacaccaaacagaaaagcagtagaagagactaatcaagtaatcaacacaaaaaaatcaggaaagaagattatacagttacttaccagaatttgggcaagcccaagcacgaacgaatcgggacgagtggtaacgcatcggcgggttcagcatcgcgaagaactgccactccaggaccttgcgcgtgtacaggttgacgccgaacagccgcgagcgcatgaagaagtaggccacgttgccggggagctccgggtgtatgaacgccaccgtggggatctcccgcggcagcttggtcgccttgtagccctcgtcgttccagatatccttgacgagcggctgacagtcgagacgccaagtcccggcatcctgatcgaccagcgtccacatgctgaccaccggtttgccgtcgtactcgcgctcgtggatccccatgtaccggagatcgtcgcctctaaacccaacgcaccggcgcttatcgaggtcaggcgtgcccggcggcagctcgcaatccggagggagcgggacgaagcgcagattctgacgtctcgcgctgatgtcgcaggagaggagaccgtaggagagatccacccaccagactatcgtcttgtgcacgacgacgccgttgccgccccagggacggtcgcgcggcgggtagtcgaccacatgcgtcgcccagatttcgggaaccgagaagtagatgagcagggcggccttgtctgagccgactatggggtggagatcggcgacgtggaagatggttttcgtgatggcgacgagaccagcgttcccggggtgaaggatggggaagccgtggtcggggaggcgggtggacttgtgtttgagcgtgtcgcagatgaagtacgccttggggaagccgtggtgctcgccgagtggcccacggtagaagccgtcgaggacgggcggctccggttcgggcccctggctggcgtagaggaggaggcggccatggcagtcggcgccggcgacgaaggggtggtcgtcgatggtcttgcggcgcggcgcgatgctccggtgcacgacgaggcgggtggcgcgcggagctaatgcggccttgatcacgttgtccatgccagcctcgaagtagtcgccgcggacgacgtgcggcacgcaagccaggagcacccatttccgcccgtccttcttctgccagcgcttgtccttcaccgccgtatccaccttctccattggcggcgcttcggacatggctggagagagagagagagagagagagagagagagagagaggggagagagaggagggagagagagatttgggttggtgtttggggatttttttttttcgcagcagagtggattcgctatttggtctcggggagaggccggccgtggtctggtcacgttctgtgccgccgttgtgtcgtggtttatatcgccgactcggcgtggagttcccgtggatggcacgagccggtacatttcgtgctcgagaagagaacgcaaatggttcatcagcgctagcgtgcgcgtgcgcggcattgccatgcaacggttagaacgagcgcgaggttcagggtagcgaagacatagcctggggggcgcggtggcaagcgtgagctagcacaggggagaaggggagaagcggacggcgagcatgcacgagtgcgatgtaccgcgtgcgcgcgcgcgcgcgccgatggtgacgcctgacgcgcgggcgcacgggagtaccgagtacgcgacggcgccagccgcatggacatggacaggcgcgcaggcgagggatcgatcgaagcgagagcgccgcgccgaaagctcgtgcgattgccatgggcggggaacacgacgcgagacgacggggcgcacgctgggagagcgaggcggttgtggtctggatcgtacggcgcgcacaccggcacacgggggtctggcctgcgtcgacgcaggcacccagccagtcaggcatcgtgggtacttggttttccagtttttgcttactttgacacgtgatctgcaatgcagcggtcacttggaggacaccgtgtccggtgctcctggccgcgttctccgactgcgccacgcacggcacatcaaccaaaacagtgcaatgttatggtttcagtttcggtctctgtatcaggctatcagcacattaatttttttttgagagaatccctaatatgtcacttcaaattaactggttctcttatatgccatttcaaattagcttattccttctatgccactggttcaagtttgtgtcctcccttttataccattgccgtcgctccaccgccccccttttatgccattgccgtcgcttcaccgccagttgaccgttaactttatagttaacaaacgaatttgtccttgagagttggtatacaaccaataataagtattttagtactaatatagctactggatacaatatatgaaaattgatttttttttcatcacatgcaattttagccatcaccatcaaaaaaaaattcaatataatcatgaaatatgtagttttccaacaatattttttttagtacaaagagcatttttcactggctctaacaaaatttggttcactcaaaaaggatttaagttataattttttgaagtttacatattttttagttgagagggcatattggtcatttatgaaaaactaacatttaaataacagtcaactaacactgtagtgctgagagtggcataaaagggtggaaaaacttaaaccaatggcatataagagagaagccaattttaaatggcatataagggaactggccaatttcgtagcatataagagattctctcttttttcccctttttgagtaggaaaggcatgagctctgccttgagagcaagtttaacggtatagtcaactataggttccaaatcatgtaaagttaatttaatagtcaatatatataatagttatcaataaacatatactctccccgtccaaaaaaaaaccaaatcctgggtatgtctagattcaaatccagggttagtcagagaaaaagaaaaaaaaaagaagagtccaagtagaaatacaatctaaaaatagctgaaattcgaaattaaaaataagcaatattgaaagaagtttccatataataacccaatacaagattaatcaaaattcgaaataaaaataaaataaaatccaaaattagaaaaagaaaggagagtccaaatagaagtacaatataaaaatagctgaaattcggaattaaaaataagcaatattgaaagaagtttctatataagaacccaatacaaaattaatcaaaatttgaaataaaaataaaataaaatccagaattagaaaagggaaggagagtccaagtagaagtataatataaaaatagctgaaattcagaattaaaaataagcaatattgaaagaagtttctatataagaacccaatacgagattaatcaaaatttgaaataaaaataaaataagattcgaaattagaaaaggaaaggagagtccaagtagaaatacaatttaaaaatagctgaaattcggaattaaaaataagcaatatcgaaagaagtttctatataagaactcaatacgagattaatcaaaattcgaaataaaaataaaataagattcaaaattagaaaaggaaaagagagtccaagtagaaatacaatttaaaaatagctaaaattcggaattaaaaataaggaatattaaaagaagagtccatattagaacccaatatgagattaattaaaatttggaataaaaataaataaatccgaaattagcaaaagaaaataaaagaagagttcaagtaggaatataatttaaaattagttgaaattcggaattaaaaataagcaatgttgaaagaagagtccatataagaatccaatacgagattaattaaaatttagaattaaaaataaaataatgtccaaaattaaaaaaattaaaagagagttcaagtaggaatacagttttgaaacaactgaaattgaaaataaaaaaaaagcattaaaagaacataatacggtattgactacttcctccgtttcacaatgtaagattttctagcattgcccatatacatatagatgttaatgaatctacacacatacatatgtctagattcattaacatctaaataaatgtggataatgctagaaagtcttacgttgtgaaacggaggaagtaattttttttaaaaaaaactgaaattagaaaaagaaaaataagatttcagctaggaatataatttataaataactaaaatttgtgataaaaataaagattattgaaagaaaagattgtccaaaacacatgatgagataaattaagtaacaggcctataaaggagtagagtgatggcggttgatacaacatataaaaattgttaataaaacaccaaatagaatcctaatgacgattaaaaggagggacatcaggcaggctgtgaagcaaacgagtaagacggttgccaggatttttagaaagtaaaaaaaatgaaccccattgataatcatattcgatttttaaaatctcaataacaataaaaaggagaaactgcgggcggggtgtataagagtatagttgcagagccaccgatggttgacgggacttctagaaactaaaaaatgaattccaacgatagttatgttcgatttttagaatcacaatgacaataaagagtaggcggcggacgggctgtagaggggcatagtggcatcgtttgatgggacttctaaaaattatagaaaataaaaataaaagtccaatttttaaaggttcggaacttctaaaaagtaaaagaaaaaacaatgttaatcatattcgattttaaaatctcaatggcaataaagaagggaggcagcggacgagctgtagaggagtacaatgacaaagccgctgacagtttggcgggacttttagaaagtaaaaatgaacccaaacgataattatgttcgatttttaaaatctcaatgacaataaagagaagagacagtggacggaccgtagaggagtataatggcaatgtttgatgggacatctagaaattataaaaatgaaacccaacgtgacaataaactctaaaaactataaaatccagtttttaaaggttccaagaagaatgaatagaaatagtggtagatcgagcaagcaaataaagaaggagatgacataagcggtagcaactggtgtggcttttaaaaactatataattagaaacacggggacttctaaatgcccaacaggacaataaactctaaaaatataattttttagattgaatttttaaaggttccgaggagaatgaatagaaaaagtggtagatcgagcaagctaataaagaataatatgacagtagtaaggggtagcagctggtgtgacttttaaaaactataaaattaaaaacacgaggatgataaggtttggtctttcaaaatcttaagacaacaagataactatttaataaattttaaataaaattatattaaaaaatatataactttatatgtgtgctagccgcgtaattgcgtgggccacccagctagtttcatcatatgctaacgaatctgatgattgatgttggtgcagctacgaagtatttaaataggatcatgacaagcttaattatgaacgctagctaaaacagggtaaacaggtggaaataaagagtaatcagtattcaaatacatgtgtcaaaaaatatattcattgcagtcactcacatataacgatccagaaatgaagaaacaacaggtggagtaatcccatgatgcatgaagtagtatacttgtaccacagattacaattagtagtgctgcactactactaatgaacaaggattttggtatgcatgctatcttgtcaggttaaaacatggcaactcattatcagtacaaaatcaacattgctcactgactgccacactgttagcatccacaccaacatcaggcaaggttatgcagttactaaaagtctaaatgcataccaaaatctcactggaacaaagttggcaggttccaggcacggacgaactgggacgaatggtagcgcatcggcgggtggagcatctcgaagaaccgccactcgaggagcctgcgcgcgcgcacgtccacggcgaagatccgggagcgcaggaagaagtagaccacgtcgccggggcccgtggggtggatgagcgccaccgcggggacctgccgcggcagcttggtcgccttgtaggcctcgtcgtcccagatcgccacgaagctcgccgcgcagtcgaagccccactccccggcatcttcatcgagcagcgtccacatcctgacgatcgggtcgccgtcgggctcgtcgtcgatctgcacgtaccgcagacggccggcgctcaccccgacgcagcggcgcttctcgaggtccggcgtgccggcgggcagctcgctgtcctgcgggagcggtacgtagtgcaggtccggggggtcgtcgccgtagacgacgtcgcaggtgaggaggccataggagaggtccacccaccagagcctgtcctggtgtgagaccatgccgttgccgccccacggccggtcgtgcggcgggtagctgagctcctcgtcgacccaggcgtcggaatcggagcggtacaggaggagggtggcggtgccggacgcgggagcgggctggagctcggcgacgtagaagctgatggagtagcagaggaggccgacgttgcctggatagaggatggcgaacgggtggtcggggtcagggaggcggctggcctcgcgggtggtcgtgtcgcagatgaagtaggccttggcgaagccgtggtgcacgccgagcggcctgaggtagaacgcgtcgagggcggggcgcggctccgggtcgggtccctgggtggcgtagaggaggaggcggccgtggcgttcgtcggcggcggcgaggtaggggtagttgtcgatggccttgcggtccggggcgatgcggcggggcacggtgatgcgggaggcgaacggaggggcgccgaagtttaaccggagctcggtgcccggaggaaagtggaactcgtcgtgggcaacgtgcgggacggagacgaggatcacccaccaccccttcgccgcctccctcatctgcatctcctccgccgccctctcctcctgcagcctcgccatttgcagttcggcaatggccggaggcggagagatggttgcggtggtggtagctaggcgagtatagctgctatgacggtatcgatttgggggtttggtgtttgaaaattttgggcagcgaaatggagtttggctatttaaattgggaaacaggagatcgacggcaagtttggttgccacgtttgcgaagaagttttggttgtcacatttgtgaagccgtcactggtcgagcggagtcagccctgtattgagtgccaggccctgtataaatgaattttcgcccaggaggcagtgaggcacaggatattttcctgatccataccgaaatttaaaattatttactgtaaaatcctgcacctatagcggtaggcctgcttaaatggttttttggcacaggatatttacctgtttcataccgaaatttaaagttatttactgtaaaatccttcactactaatggttttggacgaagagcgcatttattatcagtactgctatatacatgtacagtgtaaaatacggagttcagaatgacaaccaatctggggacataggacgaacaagtaagtcatccagcgaccaattggtccactaaaaacatgtattttaacaactcgtttcaaagattaccaggtcatctctatcacaattcacagcccacaagtcacaaatgttacaagatttattccaagcaccataaaatttcagtccgtaaaaaatgtcttgtcttgcatgcactggccaacagaagcatatactctctccgtcccaaaaaaaaaagacaaacctggtttccgtgcccaatgtttgaccgtccgtcttatttgaaaaaaatataaaaaaaaattaaaaagacaagtcacgcataaaatattaatcatgtattatcatctaacaacaatgaaaatacgaattataaaaaaatttcatataagacggacaatcaaagttggacacggaaactcagggtttgcctttttttttttgagacggagggagtagatccgaatcatagcagtgactggtctctgacctgtatcatttttttaatggaagacctagatcaaattaaggaaagttagttatgtacttatgaaatcttctcaattaagatcacatgccgtttgaagttgaatgaaaaggtcgtctggtcatataagtggatcaatcaccttagtgagaagaggcgtagtcagatggagcagaatagcagatccttaggcctttcaccgtaagtccatgatcttcattttagttctcaaacatagacaatcttcctcatcaacatcagatgatacttgatacttcacagacaaatattcattgatcaataacgcagaaaaatcagtgctaattaataattttgtagatagggacaactcatttgaaacaataaagtccattttgagttcaagacagagagagaactctgaacagaaaggacaagaaatataatgattcatcataaatcctgatgctacatatataagagtttcaaatctgaaagcatgaattcattttttagcaaacatgtgaagcttatttagaaagcaatgcttaataaaaagggccaagaaagctttgatactgttgaccttaacactaataccccccccccccccccccaaaacaacaaaagcagttatgcagcacatctttgtgcatattcagaatgagcgcgttcttaaacactcaagcaacagctagcattcttatgttattgggttcaaaacgatatgggattgacacttggaaataaaagcggatactgaacagccaaacacacagcttatactcagagcaaatttacctagatcagtcatatgattttaaatgtattatggacaaatgtttgcctaaagacatgcattcatatgcatcctattaggagatgatctatcaagccaactcagttgaggagattgtctggtaacagcacagataacaaaaagaaaagatctgcttacacaaaacccatggggccacgacattctgtatatgttcaggcagaaattgacattgtgaatttgtgaccagctgtactgatttacctttcctcatgaaacatcactacaaaactacagctacagcattccagagcagccaatcacagtacgcaagaagtaatgaagggacagaggaacagtatagagactacattttatctagcatcctgtttgtagatgcatgagatatgcttagtactatgaaaaatgaatatatatgtgcccatttcaatgattttgctagtgttcaacgaaattctgaaagcacatgttaaaaccctctctaaacacataatctgaactttgatccataagactgttctacgacatccatgggcctcagttgggtggagtaattatttaagcacgaaacatgtgtaactaacaaccaccacaccttgagagcaatgtaaagcatcctttagcactcgaactgatgatagtccatataatgtctagacctggactgatggcaaaatgcggtacaacagtaactgacaaggtagctataattatgtatatctgaaagtttctgaaagcatccactactaggacaaaggtaaccacagaaataagcaaccccaggtgaattattagctaaaaactcttgcctaagcagaggtcttgcataaaactctaccattcggcaatttagcattcttctacagaaaaaaaaacagcactgcagcagtaagcaagaagaaatgcaccatgctgaactggaggaacagtccgtggaagcgacggtggaacctcccaaacgcggacgaagaagggaagagtaccaacacttggcgtcttggtcagtggatcatcccgaagagctcgtactccagaacctccctccgcgccgcccaacatcagttggccctggaagaagtagatcacgtcggggtcgttggggtgcaagagcgccagctagcgcggggaccttgcgctccatttcgctcctcttgtacctcttgccgtcccaggtctcgacaaagggcacctcgtactcgcgccgccaccgtgcgtgcactcgatcgtgcagggtccaaatggtcaccacctgttcgtccggaggaccatggatctgcacgtaccgcatcttgttgcccgcgctcgccttgatgcagcggggcgcttggcgatgtcgccctcccctccggtggccagctgcacgcagaggaagtagctaggccgggaagaagtcggggcggagtccgagggccgtggagtcggaaggctccgccgcggccgggccatggatcactcagaggaggcggcgaacgcaggggtccgcgccgcggcggcgatgtaggggtagttcacgaggctggtgggcgtcaggggtgatgcggcgggtcgtcaagcgggaggcaagcgtcggttcccggcgggaggtgctcctctgagtaggccattagcggcacgcaggccagtaccacccacgggccacggctgcaccggcggtggcgcgctccccggcgtccccgcgcggcacgacatgcccagagccccagagcatgctatgaagaattgggagcggaagcggggagaattgtcagggcaggggaaatggtaattttgggattaatttgtttcttttttacaaaaaaaaggccgtgataaatcgctgcgaaacgtgtcatcgtcacgtatgagtttcactggcatgtcactttgcaaataggattcgttaaaatatcacatttaattctacacgttagaatactatctataaccaaattaccctccgtttcttttcttcctctctccaacgccagtagtggttgccagcagccccagtgcgtcgttcccagctaagtggacgacctccctcgctcccaccactgcttgagcgcaagctccagcattccaatcccgatcgcaccgtctatccaacgcccgtccattatcaatgcgttaccttccccgagctcgattaccgcttacgtggttgttgtccctgtaattgctccatccccaagctcagctttccagagctcgaccaccactgtcaccgagctcagggtggagtggatgacgacgacagcgatgagagggcgagctgctgcgttgtggtctcatgtgtcggagccttattcaccatggcctcgtcagagctagtattcatatgttgttatgcttgtgctgctgcatgtgttgccgtggaggctgcaccaaccgatgacgaccgacggaggttgaatcggcggctcaggcacgatggcttcatctcaaagtggcgacgctcgagctcgaggacagcatgagcaacgactgtggcgtccgctggtcgagcttaaggacagtgcaattgacaacaatgatgggcatgcttggaggtgagctaggcggcgacgacgacagacagacatgctcgggaaaggggcgtcctcacgtgggtgggcacacggcaagggacaaaccggagttggaaaagaggatgggtatgtaattaagaagccaacggtaattaatttgctcatgtatggtattgtagcaagtagctattggtcaatagtgacattttatcgagtccacttttgtgaactggtatttcaaaacctacttaggaaaatggcacaatgtcaaatttgttgatgcctatgagacaatcctaattccttcatccaaaaaatacaaatagaggaggtttgtttatttcaaattttttgttgtcttcttcaatttttatctttttttcttttgtaaaaaaagtaagggcccctttgatatggaggaaaaatatagaaattttggaggatttcaatcatataggaaaattttctatgaagcctttgaaacaaaggattgaatcctatacaatgctttgaaattcctatggaatggacaatcctgtaaagattttggaggaaatttagcaagagcttcaacctctcagtaatttttctttgagtttatctttctcatccaatttatgtgtttttcctgcggttcaatcaaacggccattcctgtgtttttcctgcattttacaatcctatgttttacacttacactcctatcaaaatcctacgttttctcaatcttgcgattctaaggggcccttagatctttcgtcgcaatcctggtctctctctccaatcaacttcgagttccgacttccaagtaaaaaccctaattcttccccaattcctccgaattgagccgccgtcatagcgatggccgagcttaataacagcgcaattaacaacaatgacgggcatgcttggaggtgagctaggcggcgacgacgacggacatgctcgggaaagggcgcgtcctcacggtgggcacacggcaagggataaaccggagttggaaaagaggatgggaatgtaagaagccaacggtaatttgctcatggatggtattgcagcatgtagctatgggtcaagagtgatattttatcgagtccacttttgtaaagtggtatttcaagacctacttataaaaatggcacaatgtcagatttgttgatgcctatgagataatcctacttccttcatccaaaaaaatacaaatacgggaggtttgtttatttcaagttttttttgtcttcttcaatttttatcttttttcttttgtaaaaaaaaagtaagggaccctttgatatggaggaaaacataggaattttggaggatttcaatcctataggtaatttttctttgagtctatctctctaatccaatttttacgtttttcctacaattcaattaaacagtcgtggttcaatcaaacggttattcatatgtttttcatacgttttacaatcatctaatttacacttatacttctatcaaaatcctaagttttctgaatcttactattctaagggcctttagatctttcctcgcaatcctggtctctctctccaatcaacttcaaattcctacttcccagtaaaaaccctaaatcttccccaccagttcctccgaattgagccgccgtcgtagcgatggcgaaccccgtcgtcccgtgcccttccgccgccgcctacggccccggcggctgcgatggcgtaggctgctcctccagccacaacgtctgggctcaccgtgtccgccacaacggcggcgtctaccgcctctgctcctcctgcgttctcctcggccaccgcgacgccttctgctccgtttgccttgacgtcttcccgggggacgcgcccttccaagatgatttctataaccccatcgtctcatgctcctgctgcggcgtcgagcccgtcgccgccgcccacctcgcctgcctcacggacccttcctacttcgtgtgcccagcgtgcgccgccgccgccgagggcaggaccttcacttacgccccctcgagcggtgccccgcacgcgctggcggagcgcgtgctcctcgtcgcggcgcggctcgcgcacgagtccgtcgcccgtgccgcggcggcggcgcgcgagcaggcggagcgcctgatccgggaggcggccgccgccaggaagcgcgcgcgcgacatggtagacgtggcctgccgcgtcctggaggcggaagccagggacgccaaagagcaggccgcggcgcccccctcacccgtgctgaccaagaagacgaccccgaagaacagcgcagcaaacaggagcagcgacaagcctctcaagatcaattcaatacagaagccggcgctggcgttcgccgcagcggcagccgcggccgccgccgcggccagctcaacgccattgtcgacgccgtcgcccgcgggggaaaggaagccaatgaaacagggaagaggtgagtcaacaagtagttattggctgccgatgatgaacagcaattgtgatttgagacaactattttttctctgtacagtactaattgccgtgtaattctctcagcttcagcaaacagaggagcaaaagatgatcaaaggacactgtttggtgcctttcaaccgtgatgactccatgtgttttttgatctttgaagctaagtgacattgaatggtctgggctattggccgtgcagtgtaaaaagaatcccaagtttagatctaataacagctagcaattggtgtatctatctacttggtgttcatattattaaaatttatttctaatgattttactgctgcgcaaatgaaatgcaattgaatatcccaattcaaaagtttatataactgatggcttcatttttcttaggaggatcaatggtggcagaatttgtgcttaaactttgaactagttggttttctaactcgtacatttcaaccaagcataagatccttaggtccctacgtgtacaatgtacattgttgttccatggtattacgttgcgaatgtacaattaattttgcaatatcaagaaaataggatcaatgttgtgttttactattatgttaaggtacaattgttcttttctatgtctcaaaaatttgctagaattgttctttggctgctctaaaccgtggttcggacgttctgtaattggtaactgagataactaattgatcctaattgttctgtactatactaatcgtcattgtatggttctagcaggttcagcaaaaggaggagcagagcaaactaaaactgaagagttagcctgaacatttattcactgatacacagtattaaaactctgtacgcacgtatagcagtgatagtaaagataagaattcacagatccaaaatttaaattctcaaccacgtgctagttcggaaatgtaaacaatcatccatcgaatatacgagaattagaactcagtgtaccatcacgaacaatgtcatcagccatccaccaattaacaaacactggttgtgtaagatagcagagagttaagccagatatctaattaaagacactgtccaacatcagtcagggtgtttggtttctcaactgcctagtaccgtggatatgtcaaacagaggaagcagggagaagaaacaagatttccaaacaaaactttcatctgaaactcaacactgaactattcatacaatactttcagctgaaactcgaggaactatgtttgaaccgtccatggagacatgtgacacgaagtttcgcatcagacacaatgcctcatatgcgtcagtagccttgacaatgacaaatgacaagtacctgatgaatgaaaaagaagataacacacacatgaggttcagtgaagaaaattctctcttgtatgcgagtgcatgtgaattgaagtggtcggcgatccaaagaggatggaaagaggctcacttaggaaaagcagtggcattcctcagttcctggaaccttggattgatgaagagccttccagtggttgacagcagttcgtcagctttgtcactcgaaaagttcaagtcaagctcatccgtcagattctgcaaattaacacaagcaattctagttagtcaaaaaatggtaaacctgtgttcaataacttgataggaacttagcttatgtatttttttccagaagctaaagatgcaacagtacatgcaccagtaaatatatgtctatattatactcagtgattttcagactcagggtcattaatacaaacaaacgaagttgctgttatggaatatattctataagtattccgtagtgttaaatgacatacagatacatggccaacatacagcattactacaacattgtaactactaaaatgtagaaggtactaaacatgcaaattcacatatagtccttgatcgattcccattaatttacaatgtcaaaagaactatacagtgcaaatctgtatctgctagattagatgcaccctctggtgtgcaggattaatcatgaaccggccaaatgagatgtgcagaccatgcccagcatcaaaataactcaaacatgaatagcacaaatggacaaagcacatcagcatgcagcgatgagacagagcaaagaagtgaagaacagcgcagcgtacgtaccatctgtctcatcatcctctccgcggcagatcgaatgtggcagctcccaagcgcggacgtggcgagaggagtggtacatcgtcggcagctggggcatcttgtacttcttgcactcgagcacgattctggtgaccaggtcgacggcgaacatccacgagttccgcgaggtgatctggaagaagaacaccacgccgagctccttggggtggaggagcgcgagcaccggaacgcgccgcggcatcatggtcttccggtatgtcacgtggtcccagatctcgtcgacgcgcacccggtggcggagcgaccaaaccgactcctcccccgcatcagactgctgcagcgtccacatgctgatcatgatcgtcgatggcgcgccgcggccggcggcggtgtcgtagtcgtggatctgcacgaacgccagctcgccgtcgctcacgttcacgcaccggtgcttggcgtggtccgcgtcgctggagtacggtagcttgcatccctcagggagcggcacgaagcgcatgtctggcttcgcggcgaacgcgtcgcaggtgaggaggccgaaggagaggtccacccaccagagcatcccggcgtggacgatgacgccgtcgccgcaccacgaccggcggcctggcgggtagttgaccttcgttgaagcccaccctccgagtccgagctcatgggagtagcgtagtagggtggcacggtggatgccattgccggactctatctggagctcggccaacaagcggatcgggtggtcgcgatccgccgttctgcggatcatgccgacgttcccggcgcagaggagccggtactcgtcggagcagggcgggtagaggtaggccatgcggagcgtagcgtggcagaggatgtagccgccgtcgttggtgcagctcggtgcagggtcgaatccgagcgcgacgccggggccgaaatcgtgggcgctcctcctggcgccgcggagcaggagtccgccggcggagtcgacggcgacgacgtaggggtggtcgtcgcggtcggggcagaaatcccgaggcgcgggggagacagggacagagtcgctctggcgcaaggtgaggagggagacgcccggcgggtcgcgccagtcgaaggcaaggtggtcgccggcctcgaagtcgctgtcggaagaggacacgctcgggacgcaggccaggatcacccacgtggcctcccgcggcggcgccgccatcctctcgtcccgccggaacttgggcgccgcgccgtcgaacaggtgcgggctatgctccatgcgtctcttgctgctccgaacttccgaagcggcggcggcggcggcggcgttggagtggtcggtggcggcgatgggcggggtgggatgaactggaaatgggctgctcccctcgattggtttgccgctttaacggagccagaacccggaggggcgagaaggttctaaattctaatcgcatcccggtgtttggcaattggcactttggcttgctgaccaagccggttagttacggttatcaccatctaaccacctacagtgcggtgattttttttcactaatccatgtggttataagctctgacggtaatttttcgttaatctcatgttttttttagacaaaaaggttattaaaaactagagcattgcaaagctgtggatcgaggaggattcaccaaaccaaaccgcaccgatgtatcgtggtagtccattgtacgcttgtttgggaccatggattagtttcagtctttcagagaagaaaaaagaatgttacgcttgttgccttgtttcctatgctcgacttgtcgcggccggagattgcacggtgcgccaggccgccagttggcagatgccgtttgtgacggacgatgtggtgcggtccgtgtatggcaaaaaatggagtgaagctaagccaccgcgcgtgcacttcccaccgatcgcgattcacagccgcacgggcacacggcacactagtaccagtactactcccacgcgaacgaatcatcggaagtggccgtgcgcgcgttccggccgctacatcgcgccgcggcagcgcgcaagccgtggaagaggccaagcgtcttgtgcggctgctacatttgcctccgctccaaatagagacgttggtactgtactaccgtgtttttcaggctcaccatcagcagtagtactctgtaacaataggcttggacggctgccccaagttatcggtttatcactaatcaggttctctaacctcgaacaaatccccatcttatatgagatttagcacgcatcagccagcacacacagttgaggaatgccgtgaacaagacattaatcgatgaactgtttgtcataaacacgtggtttatgacaatatttcatcaatttgtcatacagaaagttcaaacagtcgatcttatttgatcctgcaagctaacacaagcaatgctagttgataaaaaaagggtgctaatttatagtatttgatagtttgcgaggaactagtcatctgtaaaaatgttaacaaaaacccaaatcaggtaaatgctatatttgtcacgtgaaatcaagcttcaaacccccagcagttgcaagttgcaacagtacattaattctattatacggttgcaccagtacatattacattcgctaattttcagacttcataactatggtagccactaacaccaactaaatgaggatatgctctacatgcagttgatgtttccatgatgaaataaaccagccttggtgctagcatcagtacacaatcatagtactaaaagtccctcgcacttcgtccttttttttagatggatctttgaatacttttgcacttgcattattacttattagacagcgataactgtctagcatgcagttttatgaatcagagtatgaatattcaagatcatatgaaaggagcaagcatgcatgcagcgctgtagcctttcaatctgtacggattactaattaccagcttattgttggaataatcctcacacttgtgtattttcaacacaaaacaaacatattatcaaaattgattcaacgttagaattaataaaactaatttatattttagatgctgataattttttctataagcttatcaaacttaacaaagtttgattaggaaaaaaagttaaacggtttataatatgaaacggtgggccaaaagtttgctagaattattctgcggctgctcaaaaccgtggttcagacgttctgtaattgtaactgagatagtaactaatagtctcctaattgttctgtacaatactaatcgtcatcgtattcgtatggttctagcaggttcagcaaacggaggaacaggagcaaactaaacgagttagcctgaacatacattcactgatacatagtattaaaactctgtacggaagtatggcagtgatatatagtaaaaatatgaattcacatatcataaaatttctcaaccgcataccagttaggaaatctaaacaatcacccatcaaatatgcgagaactagaactcagcgtaccatcacgaacaatgtcgtcagccatccatcagttaacaaacactggttgtccaagatagcagagagttaagccagatatctaattaaagacactacgcagcatcagtcagggcgtttggtttctgaactgcctagtgccccggatatgtcaaacagaggaagcagggagaagaaacaagatttccaaacaaaactttcatctgaaactcaacactgaactattcatacaatactttcacctgaaactctaggaactatgtttgaaccgtccatggagacatgtgacacgaagtctcgcatcagacacgatgcctcatatgcgtcggtagccttgacaatgacaaatgacaagtacctgatgaatgaaaaagaagaaaacacacacatgaggttcagtgaagaaaattctctcttgtatgcgagtgcatgtgaattggagtggtcggcgatctaaagaggatggaaagaggctcacttaggaaaagcagtggcattcctcagttcctggaacctaggattgatgaagagccttccagtggttgacagcagttcatcagctttgtctctcgaaaagttcaagtcgagctcatccgtcagattctgcaaattaacacaagcaattctagttagtcataaaatggtaaacctctgttcaataacttgataggaacttagcttatgtattttttttccagaagctaaattgcaacagtacttgcactagtaaatatatgtctatattatactcagtgattttcagacttcagggtcattaatacaaacaaacgaagttgctgttatggaatatattctatcagtattccgtagtgttaaatgacatacagatacatgatcaaaatacagcattacaacattgtaactactaaaatgtagaaggtactaaacatgcaaattcacatatagtccttgatcgattcccattaatttacaatgtcaaaagaactatacagtgcaaatctgtatctgctagattagatgcaccctctggtgtgcaggatggcaggattaatcatgaaccggccaaatgagatgtgcagaccatgcccagcatcaaaataactcaaacatgaatagcacaaatgga

SEQ ID NO: 44636 - DNA, 23682 bp, Oryza sativa
  unsure (1)..(23682): unsure at all n locations
ggtagaggtaggccatgcggagcgtagcgtggcagaggatgtagccgccgtcgttggcgcagctcggtgcagggtcgaatccgagcgcgacgccggggccgaaatcgtgggcgctcctcctggcgccgcggagcaggagtccgccggcggagtcgacggcgacgacgtaggggtggtcgtcgcggtcggggcagaaatcccgaggcgcgggggagacaaagacagagtcgctctggcgcaaggtaaggagggaaacgcccggcgggtcgcgccagtcgaaggcgaggtggtcgccggcctcgaagtcgccgtcggaagaggacacgctcgggacgcaggccaggatcacccacgtggcctcccgcggcggcgccgccatcctctcgtcccgccggaacttgggcgccgcgccgtcgaacaggtgcgggctatgctccatgcgtctcttgctgctccgaacttccgaagcggcggcggcggcggcggcgttggagtggtcggtggcggcgatgggaggggtgggatgaactggaaatgggctgctcccgtcgattagtttgccgctttaacggagacagagcccagaggggcgagaaagttctaatcgcatcccggtgtttggcacattggcttgctgaacaagccggttagttacggttatcaccatctaacctccctacagtgcggtgatttttttttcactaagggatgtacagtggtgtttaataacaggctcttttcgttgtcatgtaagtaaatttggtgacgtggaagaaagagaaggaaggaatgagaaacatcgttgctacgcatgacaacggctcagagtcgactctttgcatttattaacagaaagtttgttgcatgagggtatagaaaaggaaagaagtataataaaaaaatatttagtgtattaatggtttagaaatcttattatctctattattatagaaggatagtctctagtgatattaattaatatagagaactcatattagtctctacctttgtacatgttctaagccatgtggttataagatctgacggtaattattcgttaatctcatgttttttggggaaaaaatggtttaaaactagagcattactcggcaccgatgtatattgcaaagctgttgatcgaggaggattcaccaaaccgcaccgatgtatcaatttttgcagtaatctaaatgtcatacattagtatactcacttaattactctaatcagtagcagtaactcgaactctcgaaggtggataaaaggtaaaaattattactagcgaatccaaatctacccgtcggggcccacatctggtggctgccgacgaactggataccatatcccatccgcagtcgccggcggactgtaagaattgccgaatcggtggcgattgtgagggggaataagttcactggaggtccctcaacttaacagcgagattttttgagttcccttaaccataaaatcagaaatcttgactcctaaactatacaaaacgaccgttcagtcaaagtccgtaggcagtatatataggacgtggcactagttagcaatttttttaaaaaaagtacatgggacccacatgccagctgcacgtttttttcttctccttctcttcctttttctctcttccctcttcccttattcagtgaggaggccggcggcgggcggagcggcgatggcggcgtgcttccgctgcgcgccgtccgtgacggcagcgtccgtccccgcggggcccagccatcttcctcccgacgggacggcgttgtccttcgccgtgcacgacgccgtgaccgcctcgacggcgaggatctcctcctccgccatgctgcagggcacctggccgacgaacagccgcaccctctcgccgtcgctatcctccgcatctccgaccatcaccgtgatctctctctctctctcccgtctcttttccttttctgatggctatgcaacctcctgtccgtcctctcctcgttcttgcctgcgtcttttgcctttctatatcggacgagcactaaccactgattgattgattgatcagtatcagtgtcttgagtacaagttaattaatcgatgagtagtaccaagtcttgatctcgagtagcagtgaatgtttttttttacggaaagtagcagtgaatgtgatcgaatcatctgattgagcgaaaagcagcagcagcattgatgcctccacctcgccgtccagtgtgacaacaatgtcgtgctcagcgccggactccaggaaccacgccctcgtggaccagcacccacacccgacgaggagacacttggccttccgcgtccgtccctgactcctctggcggcagcgcgggacgaggcggttccgcgccgccggcgaccgccgcgtcgacctggcgtgggacctcacctgcacgcgcttcccaggcttgggttcacccgagccttcccgtggtgccgccccacagacgcagcaattgtgcggctggaacagcggcgccggcctcttctcctcctcttcctcctccggtgagtatagatggacggactacgtcgatgttgtgcgtgcatgcatgctgcaatcttggcgtctcaatttcatgcatggatcttacgaaggtcgggggaggacggcgatgatggcgtgcctcgacgtcgagatgccattcctgcgggggatcgacgtgaactggccggcgccagcgggggagacgacgactgtgcgggggcggggggggaggggggcagctgcagcgaggaggacgaggagcccggcgcgacctcccccaacattacggcacactctccagccggcaacaacgacgaggactccggcggtggcggcggatctcgtgtaccgcagccggggcagggatgggagcagcagcagcagcagcaggagggagaagagaagagagaagagagaaaggagaagaaaagagatgaaaataagatatgcagctgacatgtgggctccacgtgctttatttaatttttttttctgactagaatgccacgtcagcgaaaccacccatatatactacctagggaccttgagtgaacggttttgtatagtttaggggtggagatttctggttttgtggttaagggaccttgaaaaatctcgatgttaagttgagggatctctggtgaacttattccttatgaggggggcgcctgcgaggaagacgatgccatagctggctgggccaggctgcctgggccatatcgcataaaggtgtaaccaataagttcacttagggtccctcaatttattgtcgagtctaatatttatccctagacaaaaacactgaagtatagctcattccccaactcacagtacaatgttaactttggttccttggtagtataatggccggttttagctgacgtggtgggtggaatccacgtgggtctcacatgtcagcggccaactcttctccctcctctctctctccctctctccccttcttccctcccttctccatgagggtgaagagctccgggcaggagggaatcgagggactcctcggcacgtgtgctcttgcagcttggcggtgcgggcgtggaggccggtgtccgagagcgtggagacctcgggttccatggagttgttacgcgccacggtgtcggcatacctcttccacgccgtttttctgtcgccacccccagccccaccgaacatgcatcctagcacgcccccagccctgcgtgcacgacgacgcaatccccacccagccgctgcggccctggaggctctgtcttccacgctgaaggcagcagccgaaggcaccaccgaggtcgggggagaagaagatgatgaagatgaagcgtgagaagtaggggtggaaacttaggtctcgattggtattcggtttttcgattaattcggtcattgaaaagtgaagactgaatttcaacataaaaatatcaggaatggtaaattcggtctcagtttcagtttggtatttatccggttttgggcgggcggggttgctgcttgctgctcgttgcttgacagtttccgacgatctcaatggtttaaccttgttcaattatacaagtggaatttcaatttaatgtttactccctccgtttcaggttataagatgttttgactttacttcgagtttgaccaagttatagaaaaaaaatagtaatattttttacccaagataaatttattataaaaatatattgaattattaatttaattaaactaatttgataatgtaaatattactatatttgtttataaacttagtcaaacttaaagcattttaactttgaccaaagtcaaaatatcttataatctgaaatggaggggtacaagtattcatgataaaatcaaaactctattgctagtacgtatatttctaatcctaatcctagtagaatgcgattagagtcaacacacggtatctcggatgggagagtcgcttatttggttcatcgatctttccgtgtgttctcgacgtgttccccggacaggacgtaccgtattctcatcaatatactatacaggcgaaaatctgcaggtgagagaggttgtcaaatttcttttctgcttttcttttactattctctctctctctttcgcttgatattcccaaactatatatatacacaacataatgacatgcatctaggaccaaattaaactcatcgcatggaggggcaacatgaaaacgagttacaggaaagacaagcaaatcgccccaagcggaggagacggcggctgccgtggtggtactcggttcagatcgacacgaaacggcgaataggcagaagaaccaggctactcctgagagaaaactgcggcctctactcgatatgccagggtaggtacttaaaattcacacgcctgggctcccatcgctctctcgtcattcgagcgaaggaactgcaatcctcctactaccaccgcgtcctcgaggctgggatggagagctgggaggagtacaccgtgcaggacagggaggaggtccgggcgctgatagacgagatcgtcgagctctaccggagatcgattcccaggccgccgcacgacgtggttcgcgaacgtcgacgacgtgggcatcgtcggatcgtcgttgtcgacgacgacgttcgccgccgcagttgcatgccgtcgtcgtcgtcctgcgtgtttgtggggggcgctgtgtttctcattgttcttatggggtggatctttgggcatgtgtttcttcttgtttttttctcgtggatcttaagctttgtttgtttcaactcaaggtttcactaggttattgtaatctaatataaaccagattactataagctggattataataagttatgagttttttctctagattattgggtttgaaaagctaatgtctataataccctaagctattgcggagtgggaggaggatgagagacggcggcggcatggcttgggaaggagccggagtgtagggtgggagcttagggaaggatttgcacgcgactagggagagagaaagcagatgcacgtgcggccgagggagattcgcgcgcgactggagagagaggaagcggatgcgctcaacctgataggttcgatggtagtggtggataatttgcataaaatttttaagggtagtgggtctttagccggacaataatatgaaaaaaaaacgtttagatgagactaccagattatactaatctggtttataaattataataatctatcataataatccacttatttgcttcatattattactaataatccaaatcctatcttattatatagttgatgtccactaactactaaagcttaacatgtaactgttccacgtcatcatccactagcaattattatctagagtattttaaatcacatgcaagtgtaccatatcatcacccattagcaattattatttagagtattttaaatatcatgcaaacatgacatatcaattataattttgttgtatttttagaactcaatatgcaagcaatattaaatcgttatatatctctacaccatttttacattattgaaacatatacatctaccatttcactccataaatcatgggattagctaaaaagctgtcgagtattttttaggaaaaactttcgaatctaactacattatataatttcattagaactatactataataataataacttgtatatatgtattaaaacaatatatgcaactttatatcttatatagagataacaatttagttatagtgtagttacactatacttacaatataagtatataacaatagtataactacaatgtagttagcatgtaactagaatgtaacttagatgtaacttgaacaaatctgccataaacatgtgatgatgagactagcttgtgaaaaagagggtttagatctgatagcaaaatatctcagcacaaatcttagcgcggaatcaacgaccaaaaaattgacagttttcaggattgaaaactatcgacagttagctagcaaaaccgtaaatcatatatacatgcattaatccacatatcccgcaacaaaacgcggggtatcaactaataattataataattctaagctgaaacaaatagagcatcagtctttgtcaactattgtttcggtgatcctaaaacaaaagttgtatgtgttccttaaacgacggtgttcagggtttttttttggcttgatgcgacctatcatggcacaaattaaaatatgaggtggtttattttatatccggagatcataaaatgtttgtcacgctaggtcatttaaggggtgtttgggagagaggggctaaatttgagatcagggacttttggttttgagcaagtttaatagtatagccaactactagctttaattcatttatagtcaatctaatagcttttttttcggggaatctaatagcttattcatacaatagttacatactacactaataatacctggccccacctgtcatacacacactgcgtcttggagtccgtgctatagctggctataaatctgtagcccgctgctcttctctctgctcatttatctgtttaaaatatatttgcagctggcttatagcatgctattgtacctgctcttacggtcgcttggctggcatgttttgagggggaaaaccgttacgaggttgggccgcgcgcggccggcgtaccggcgtctggaagccgctgtgtgcttttaccgtacaacaatcgccgcgcagccacacaagcacgctttttagctagtacaccggcccgtgcgaaccaatagttctgtaaactcgcatacaccaaaacatggacacattttccacgtgcagacaaggtaggctgaaccttttgggctagaaaaaaaaaaaaggagattccggcacaaaccgtgcctttttagaccggtacgacggcggcacgcccaagcgttttcacccgagccggaccaacctggctctggctggtataatacgcggtttcagatcctgatgaggcagcgacgacggcgacgcaggaggtgcacacaggctcctcgactcgtgaggcgaactctccctcggcatcgctacgtgaaggtaattaacacgcgcgctggggctccctcccacgcgcatcgccctcaccgtgcgcgccgatgagctatggctaccgcgacgtacgtcccgtcctcgtggacaaaggccgggatcgaggagtacacaccgagcgggacaggggagtacacaccgagcgggacaggggaggaggtgcagcatcgtacgtggagatcatcgtctgtggtccgactcggagatcgtccatggccaaagccaccgccggacgccgtcgttcgcgaacgtacgtcgtcgacgtgagcagcgtcgggttgccgacgttcgagggagctcctccgtgtggtctcgcgtgtttggggggggtgggtgctcttaattcgacttcaatataatcgtagacggtggtgttgcgagtgaaattcgaatttaaggattgcacgtttgcacccttcgattagcttgcctccatttttacagatttacagggtcatttttatcaggaaaatatccggttctataaaggtcagtgtatagatacagtcagagattggtctcataaactaagacatgtcgatcgacaagggagtaaatatacacattcattgaatttggacttttgccacggcacagaaacactgaacaaaatgtgcctttgttcaatacaatcaagaaaaggaataataaaaaggaatgaaaatcctctatcctattaatctagctataataaggaactatacaggtatttacgggaacatgtcagattgcctacgtaaggtttttgctatgcctccatcgaaagtcgaaataggcgattcaagaaaatacgaggataaagttgatccccaaaccaccaccatctgcatgccttcatgcaaatactggggaaaccagcgaaactatgctgctattgccactactgtgccacttactatggtcaacaccagcttattgcatctctagcaacaaattgtattgtctaacaaaacttctacaagttcacatgaagctcatccagatatactaaggtctgtcatgcttctgtcagcaatatatgcctttatatccctgaaaagatttaaaagggaaaaagataattaacaagccaattggaaaaaataaaattgtgaaaattatttcacaactccggaaggcagatcaatattgcgggtgatgcacactttacctgcatctgggagctgaacagtctgcattgtcacaaagcagtgagtgcgtgaacagcagtttccacatgaatacacacatatggcaacctcctccaccacgggcacgggtatgacatcgtacaccatggaagaacagtttctttaacgtcaaacaaagtttggaagtgcaacttcgatcaaaacatcttgatgcatgcaccaagccttcaaggtagtcctgctttgaaagcatccaattcattagcaagaggcaccgtaaatatcactagcagaaaataatatttgggatgaaaccacataattaccacattagaatctaaaagctcatagaatatttttcatcctgattgaaaatttggatatgcagtcacaaaatactgggacaaaacataacatgaagcaacacataagaatagtgaagcatacacttcacacatatgctcaagattaaaccaaaaggataaaattatggaacaaataataatagtgcaactcacttatattctacagtttatgccaaatataatcatgcgaagagcaaacaaccaaaaaaaaatcagatccccagagttgttcccaaaaaatcagaagatgttaatttcgagtgcataataaacattcatgaaaaacacaaataggagatgaaaaagattcagctaccaatttaaggatacctgtagagtgtacttctgcaatacgtgatggtcttttttctgcctcaacttatgaatatgcaaactttcaccgtcttgtttatagcatgaatcacaaaagttgcagcctaggcaaaccaagcaccgccatgccaagcattgatccatggcacggtgacaagaagaacaagttgaatcatgtagatgataaagaatcatcattgtggaatgttttgccctccggagagtatcaaactggtattgattgtcttgacaatgcttcaggaaatctattctgctgtcaaagtacttgctttccattgttggatctacatcatccgtttctggaagaggttcttcctctatctgtcagaggagattagtaatctggttagtatttccatgcaggcagattgtagctaccttaaatagatgaattcatatacgtactctttcaaatgcatgcttttgttttgttgtagctgggtgcctgtccttcagaggggtattcagctcctcagcataacaactacgaggacaaataagaatggcatcataaataatgggtgccttaacgacaaagagtaattgaataacaacaaaagagtaggaatgtagattcattttgcaatttgacaggcaaacggtcactgtataagctagaatggttgaactatgcaagtgccatgtgcaattatatatttttaccaacagcagacatttcccctagtgctgttccagaaagttcttcagtatgggaaatgcattctatatggtcacaaaagtttacatgactgaatgcttaccgttcacaaagaaagaagtttttgcagctggtgcaaacccaactactaccagatacaataggatggtggcaatgcttgcaaaattgctgcagacaaagcattaaaaaatcttctttcatggttcgcaacctttctccaagctgccaacaatgaaaattaaggggtcaagtgcctaaaatactgaagaaggcccggcgaaaaaaaattctgaagaaagggagcaccatgatttaaacaaccaaccttatgcacaagtaaaatatcctcgaggtttcctttccggtcatcacgtttggcaacccgtagaagccttcctagttgagtttctttcttctgtgaggtgtcatcatctttcttttcaaggagcctctctgcttccccaggccagaaatcattatcacagtatggcaaccatgcagctgagatattggtcttgcattcattggtgggctgaaggaagaagtcatagagtgtattccgttccacaactaccccctccttaacagccttctttaccaaattctggtacctaaatatattgaaaagattatcaaatgaaggcccataaataattttaggattgactgtaaaagatgatgaagaccaaccagctccgaagcttgtcagactttggcatcttctgtattgtaggatgacaatataaaacataatcgtcacgctttgtagatgggcaagtccatatggaacagcttacaaaccctcgtttcttgcagaaatccaagtagccaatctgggggaaaacagattggaagataatcagaccaacatgagatccataaactgaaatcaagatcaagaacactaagtgtttaatgattatgcattctcataccaaaatttcatgatacacaaaggtacggagagcttctccactggccgacttgatttccggtctgaagtacttgacagaatcaatatatgcaagataaacgtgcctttgatttggtgatgggcaggctgaaccatactcttgcacatacatggcgaacaggcatacatctacaccttcattcttttgaaacaagagaatggcctgcacaagcacaaaacacggaaatggtaacccacattatccactaaataatgaaagcataatttaaatggatgttataataatagcattagtaaagtataagtatcacataatcacctttgatttgtacggaaattccccaggatattgttcttttttaaaaaaatccttgaaacgtggttggacttgcagtgttctatcagctgaagataccactctaacagtaagaccttcaactcctggtacctaataattggaccataaaagttcgcccaataagtttctccagtatattacagtgtaataaaaatcctagaggcagaaaaataacattaagatcagcatagatgatcagataagactaagcaaagcatccacaagtttatgttccaagtttgaccatgaattgtaatatgacatcttggtcagctaaatcagatgaatatgcagaaccaacttttatcggaatccaataaaatgcaaggaaaaagaagaaaaaagtagtttcactaaaaaggatactgaaacgcaacaaatatatggtcatcaacatgtgttccaaagatgaattcatgtgtaatcagctgcaatcctgaagccataaatacacattgctagatgcaccaagagaagtattaagaacatgattaagtgaaatgccatcagtacattgtaaaaaataaaaagaaacgtatgacagtaaagatgcattcatgtaatgaattatctaagtcaacttagaagactataatataaggactaacatgttacttgtaaccttcaatccagcacatagagcaagaagcacaaaaatgcaattggaaagacgtatgtaacttttggctgtggttcaataggttaacagtgaggtagcctgttcaacggtagcagaatgcaacaccagcatattctgtacacgggacaaggtataaaagaaaagcataacacaactacctcatcaacactttttccagaagcaattgccctctgttgccgctcctgcacaagccgctcagaaagcctttgctcaatatgatcacttagtctagttcttggtaactcgcgtgctcccagaatagtagatggctcaagtgaatcaacatcttcattatccttttccttcaagaaacattttgcacaagtatattcagcctctggatccacgattttggggttaaaaagtgcgcagatttgatgctgccaagctttgcacttatcgcactggacccactgaaaaggcataattaaacaaaaaatgagtaattcgtatatgattccaaatgactagagagaaataagagaagcatatgttacccattctgcctcagcatctgtctctgcatagctgaatctcttctgatatttggctttggcactactaagatggtggcatctgccacatattgaagatttgtcatttccattttccacttcaacataataggatcctgtagaattaattattttaaaacagagcgcgcaaaatcgtggagggggctcaaagaggagtctttccatcccacataaattgcatgtgttctgatcaggcaagccttcaactgatagcagctcttcagtcggcactttgctctacaaaaaataagttaatcatgttaagagatataaactttgcttaaaacaagcacacactctgtacaatataatcaagaaagcttgagtgacaacaaaacccaaaatcttagtaccaaatgaaaatcaattgaaagtacataatatttagttaattttgcagctgctcagtttgaaaatttctctagactacatcaaccaataataatcaagtgctttacaatactagataaatcatacaagatccaacaggttattcactcacctgagaagtatcatggttcagagtacacaagtgatctttaagctcctcagaagttaatgcataaagtactgaggcccctcttctcttccttgccctcaggctgtcccctgacaatgtttggtccaataaatcaacctttgcatccttcatctcaatgtcactattttcacgacgaaattcttcttcagtttgtacagcactccccgacaatctgaccatatccattccatgtacattatcggtgcaagcaatgttgtcccccaaggaagtacaacatggtgattttgttggtgaattagtgacttcagattgtactgtttcagcagatgcataagtctcattggcagcaggttgttgttcctttgaagcctccatttcattgacatggacaagatggggaacatcaactttcaagcgttttgctggataatgcttgccagaagatccatctgaagcaggtgaagtcggctttgatacagtactatttgatgtctgttcagctctatccactgtcttgcttacagggctacaagcaccataattagtcatgaagccctgctgatgatgcataaagtggttgcttaaatttgagcttttctccctggagaaaccttcatgatcagaagtatgcccaagtttttctttcatttgaatgcatcgatcccgtttgtgctctccattgatgtacggatgaatttgagcatgatacaagtcacggtttccagtggtaatgtttgactgatctgattgctctagtgaccgactccacgtctcttgcttcatctcacattctatgtattgttgcaacaaaggtccctgaccggttgtgggatacaaacttttattgtttgtggaaaggttttgtccgttcactgttgagaaagaatccatcggaagtgttctcattgcactagaacatgttgtttgatcccacactgctgacaaagaactagaactcccagaggttgatggttgtgaactatcattttgatacgcatcacctggcaaaatttgaccatagtgtttatgatgccaaataacttcagctcaactctgtttcagacataagaaaggggatgtaaactcacctgagaaatgttcttttatatggccaatatgcagtacatcaatactagggctacatttcggtagagttgatgcacatgaggtaaaaatggtgtttgctaatctttcaggcatctgcttgggtttatcagccaacgaatgagcaaagttagcagcacccatacagttttcatattggttatatcctgccaaaatcaagccaataaagaattaaaaaaattaaggtgtattgtgaggttaaaataggtaactcatcatctcaactcaccctgagtggaggatacattatatgcacaggagggcagattattaggtccaggagtaactctatcatggtagatgggcacctccatcacaggcagctgttgtgagtttagtttggatgaagctgctgaagcactccaatgaaacatactaccccgaaatgatgcagaattgacgatagcattcaacctggttcttaaagtttcaagatccatatacttaatctgagagagaatcagatgttagcaagtgactgagaactatttagataaatgaatccaaataatcaacttctaagtacaccaaactgttcagcagtaacaattctgtttaaggattacaagaatatgctgaattttgtatttattcaataaagcatgtagataagttcaatattgtccaatattagagtagaaaccacaccaaattaaagcaccataggtgatcatatatcctataatagttctaatgcagcaagagacaacacaaacctttgaatcagctttctcaaaaagatgtcggtcaatacattttccaatttccataagaaaggataggtcaaagttgcagaattccttccgctcatttaggtactctacactggataagaaaaaagaatcaggatatagttgaacaagagataataactgcaataagttatcggtttgctacaacttaagttgcaacaagccaccaaaagcacgtgatgttatcagacagactggtcactagcagtcacagattttagataaaatcgtgccagtagcattgcagtttttgaaatgttcaactaaagttgcagaaaacatatgtacagtgtatactttgttggtacggcatgctagtataaagcaactagtaatctgcgagtcaaagctaatcccaatattggtggtttaagaacttacattttacggtgaataatattgcgaactacggatgtatcttgatccatattatccaactgaagaatttcagctgcagattgtgtccagccacttgtggggtattgctgggtaggaaatccacttgctgcatattgctgttgagtcccttgcagggtctttgccatcatgcttctatctcgcctggaattcgcagaataaacccattacgagcttgatcagtagcttacatgcagccaacacataaccagcaggtagatggcaacagagcagaaataggatagtagcaagtataatacgattctactgtgactcatacaaacaatgtcagttctggaagagaaacacatcgcatctcctaaactacagtcaatatcactaccaatgcgcctaccaagaagcaatatactaggtaaaatggtgataacgagtagatggcgcatattgctactacacaatagcgcgtgaaaaccactatcccgagcacaggatcacccttcgaattctctacacattgcaatactcaatcagcgtccaatgctacacaggggtggacctcatgttggacatgggtgttcaagtgaatccccaatttactattattatatatatttattggaaacaaaccaggggcggatccaacttgggacatgggggttcagttgaaccctcacaaacttcttttggggaacaaacaaactgttattttaaagtttaggccctgaaattaatagaggagcttcttccagatctagaattgaagctagggttaactcccccacaaaaaaaaaaaaagctagggttagcgcaagcaaattcgagacaaaattaggtcggggaggatgtggatgctcaccaggatgcagcaggacgacggcgcccctccctccccggcctctgctcgccagatggagatgggcgccccaaccctaacccttgctgtgctcgcgagatgggggatcggcgaggacgaaaggggcggaggccgagacgagacgagacggggggattttctttgacgcggaaaggacggcggagatactcgagtgctcgaggcacaatgatttttggacgctaaggtttttttcttttctttcctatatgtaaattgatccggttacgtcctggcccagccacgtttgggctcggaacaactaacgggccgtgccgtgccggcccacttgtcgaggggttggccctgctggtcagtggatgggccagaatttggcgccgaatacggctcggccggcctgtctgcctatgatgaatctcacattgggccaatacggcccaatttctaaatttatttcactcgcggagcccattcacccgaaagcgattttgctaacgatcactcgcgtgatttttttctgacatttcacgtttttttcaggctcgtcagccggcgcgtcggacaccagcacatcggccaccgtgtcggagaagcacgatgacacagtggcctctgaccggcgagccagccgccggtagcacggccaatactgatcgacgagagacaccgtctctcttgtcgttgtcgtgaaatataaaattacaatcctatataactaaatttacatttgtaaattcagttgatttgacatgtaagtgcactgtaattttgataaaaaataatgtttaagtaaatatgtacatattattttctttaaaatataaaattacagtcatatataactaaaattacatttgtaaatttagttgatttgatatgtaagtgcactgtaattttgataaaaataatgtgtaagtaaatatgtacttattattttctttaaaatataaaattacagtcttatataactaaaattacatatgtaaatttagttgatataacatgtaagtgcactataattttgataaaaatattgtgtaagtaaatttgcattagttattttatttcaaatataaaattacagtcttatataactaaaattacatatgtaaatttagttgatatgacatgtaagtgcactgtaattttgataaaaatattgtgtaagtaaatttgcattagttattttatttcaaatataaaattacagtcctatataactaaaattacatatgtaaatttagttgatataacatgtaagtgcactgtaattttgataaaaatgttgtgtaagtaaatttgtattaattattttattttgtagtccgttggatgcaaatccaaggaaagaaaaaatctcaaaaatcacccgagtgatgcataggcggccccctcgaaagaggggaaaagaaaaacatcgaaccgacaaggaataagtccattttgcctccctcaattcttcccctttgtcgaattatatccctcaaccacaaaaccgggtatattacctcctccaagtgttaaaaccagtacaaaacaactcccttggtggtttttgacagtggttttgctggcgtggcatcctagtcatcgaaaaaaacttaaaaatatgtgagggcccacatgtaagtggcatttctattcttcctctcctccaccactctcctctctcctcccccttctctctccccaaacagagcacggccaggagaggggccggaggcgcgggaggtgtggggaccgccggaggatgcgggcgcacgccgcaagggagaggatcaccggccgcggcgcccacgcggggagggttcacctgccacggcgtcgatctgctcggccggcaacacatcctcctgctgtctatccgcgccgccaacctccagcaaaatacataagctcatcaggctacctttcgaagagcatgtcatgtgctgactgtggagtgcaaaagattaagctttcacctaaacacttggagggggataaactggcgaccatccatggagcagcaggagtaacaactgaagatgatcatgatccatcccaacaagtcgccggagcaagtggtagcctctttcgagcttcgacacctcacgaggaacaaatcagacataaaaaacctcatgaagaacaacccaacagtaacaaaagcatcccccctccattagctgcatgtccttcctggaattctatttttcttctccaaagagacaacgtgagatgcatggatgaacaattggctatgcgcctactactgcccggactcctcatcggactcgccgtcgtagcgctcatcctccccgtcctcctgctgctgctgatggtgttggtgatggtggtgcgggtgcggcagttgaccggcggcatcggcgctgccgacctggtggtagaactggctgagcgactgtgcggcgagcacgctgatgtggccgtcctgtgagagtcctagctctagccccggcatggtgcgacggatgtcagcgccgacaccggtatggtccccgtccccgtggcggcgacgattgccggctccgcctgctggagcagccactggacggtctcaccgtcggacttgtggccgagctcccacgtcagctggaagatccaggcgacgcacagcaccggcatccggatccgccgtccccgggcgtccaccttggtgtgccgggtccttgttcgagctccgcttcggtcctagctcctgcatcctcctctcccccgctgcaaccgctaccacctgcatctactgctgctgacagcggatcctctccctcgcggcgtgcgcccgccgcatcctccggcagtccccacacctcacgcgcctccggcgcctcccctggccgtgctctgttcggggagagagaagggggaggagagaggagagtggtggaggagaggaagaatagaaatgccacttacatgtgggtcctcaagtattttttaatttttttatgactaggaagccacgtcagtaaaaccactgtcaaaaaccaccaagggagttgtttttgtactggttttaacacttgggggaggtaatatacccggttttgcggttgagggatgtaattcgataaagggcaagaattgagggaggcaaatggacttattccaaccgacaacgaaacgaaacggtccttaattactcctatatatataaggcaacctattattgcctcttcttttgatcttttcacgtagacgtagtaacgatttgatcgaggaggagccataatggatacgaaacagccgagaatcgacgcaatagggctgcggttcaagaccgtggttcacatcacgctggtggcgtcgatggcgtacgcggccttcggcgccgcggtcgcctacccggcctccggcgctccggcggctctggcgctcgcgttcgtcctcggctacggcgcgctcctcttccgtctcccgttctccgtctacgcgctcgagttcctgcggcaggagttcccgatcgcgcggacgccgctgtccgtccaggcgtgcgtcgcggtcacccccgtcgcgctctccgtcgccgtcctggcggtgctcaaccaagcgagggccggcggcggcggcgacgtcgccctcgccacctgcgtcgtctgggccgccgacgtagccgccgtcctgtccctcgcgtggtgcctcacgcacggcggcgccctcgccatggctctcaccaggaggaaacagtacgaggagagcgggaaggcactggagcggatgatgaaagggtacaatcccaaagaccccgccgcggtcctcttcgccctcgacctgggcgagatccgcgatgcgtccgtccgcctcgcggcggctgtgtcggccgcgtgcgcggtcgctggcggcgtggcggtcggcggcggcggcggcggcatgtcatacacaggtctctcctatgccgccgcattcttcgcgctcccaatgctgtgcctctcgtacttccagaagacgtgcgcctacccggtggacatgcccaagcacctcgccgcctacgaccggccccacctgaaggtgatccgctatgcctgcgttcgcttcgtggccgccgtgtcagccgcaagcgcgatagccggcggcttggtcgtcggcggcgtgtcttggataggcctctcctacgccgccgtcttcttcgcgctccccatgtgcctcctctacttcagggagaagtacggtttctccatgtccgatatgcccagcctgctcaagtggtgcaacgtgtcggtgcctatggcggcgctagcgctgctgttccgcctcgtgacggcggcgcggcaggcagccgcaccggacgttaggctcgtcgccattgccggcaccgtgtgggccgtagacgccgctgcgattgggtttctcggctggcgcagcacgagggagatggccaagcccatactacgggcgaacgcgtcggagattttcacgtcgttcgtgatggtttgcctacgatactggctgtatctgcacgttttctatatccttggcaacggttcacagagatggttcaattcattatagccgttctagttgagaattatcaatgttatgctcaaaagtacactttaacattaatataatataatgtatttgtctttttttctaagtatgcaacattgttttgttttagtcactataaaaatgatttttgcggacgcacaccctattttgttacatgcgggctaaaagaacatctacatgtaaaaatattttggatgttgtttggttcagacacgtatagaaaaatcgtttttcgtaaacaggcctctcaaagcaatgcaaaaatattgacgaacccggcataaaaatttatctatagtggactatgattcttaatgtgttagattgcccctatgtcaatggatatctaaccctacttaaaaaattgtaattttctattcgtcatactccgtttcatccatcatccaagtccgactgcctttggcctcatgatcatgatttctccctatgcctctatcgctcctcctcaccttccctaaccttcgccgccgcaacgccatggcctggcgacctccacttcgcaccacttctcctctcccaatcctaacccatatgtcttctttgtctctagcctcaccttctcgcgcgcacggcaccgataagcaggcacgggtgtgtggacagccccctcttcctcccaagtcacaacccagccctagccttctcccttgtgtgccatgtgccttctcatgtgcatgcccgacgacctggtttggagctaggggcaacgcagccagcatctggcctcctccaattgaccatatgaaatcgaattcaaggtgagcatgaagctccaactgctgtatgcgcgggaggaggtgaagagaccgtcgatgcccaccacgctcctttgttttcttgcgtgccatttgtgataagtaacagtaacctagggtcctggagtctcccttcgacaacatattcaattctacggagaatctttctgctttaaatttatattccagatcatgaaatgaaataaataagttccggaacattgatccaacaataaacttagctatacaaagaaaataatttgtaacccaccaagtgaacaattatgaagctcttggattaaaacaaaacaatgttgcatactataaaaaaatagatattaatgtacattttgagcaaagttaccatttacagaagttgatgtgaatattactcaactaaaatggctatagtgacggcgcatggagcggccgctgggcgatgccacgtcggataggaacagtgcgcggagtgaaaatttttcgaaaaaaccctctgatttatgcgtaattagatctaggttccccacaaacagttctcctgaaatgttattttacataggggtccttctaaaaaccagatatgctgtgcgaaggacttaaaaaatcgtgaagccggatatatataaggaagaagattattaaaattaagcaataaataataaaaaatcattataaaaatgaccatcgtcttcaaaattttcacaaccacatgtaacgaagagtttgatcacgcgtctctcgtcatgttgtccacctaaaaaccatacacagccacttgtgctactagccttgtataaggctataagcatatcaccggtcactgacacgtggccccataaaccgccaccctgcccccgcgactactggcgcgcgccttctggactcttcctgacccttttttggcgggcgacgcacggtgcccttgacgtccacgtcgaccgcgaccaccaacctctgaccccgtcgccctccacgtcgccgcctccttctcccccgccgacgtggccgccgcctccgccaccaccaccgctccccacctccccgtgaccttctcgatctccccgcctatttatgctcgtctcgtcacccgcagcagcagtagcagcagaagaactgaagaagagtgatctagctagctcgctcgcctgagttctttgcttcaattcgatcctcgctaagcttcctccagctcgatcgatctctctctgcgttttagttggttaatttttgtgtttgagttatttgcaatggcggccgctaccatggcgctgagcagctccttcgccgtcgccgccgctgctgctggtggcgcgccatggcgtggtgtcgtctccgctggccgcgccgcgcctcgccggcgtgtcgcgctcgtcgtcagggcccagtccgaggtgagctgagcatgccacgcttgattgacttgatcactgtgtgttctggtgattgcttcttaatttgctaacttgggattgatcgttctgcagccggaggtggagccgacgaaggaggagacggccacgtcgtcgtcgtccccgtctccggcgacgaccccgactccgagccccgcggcggcggcgcccaaggcgaagccggcggcgagcacgaagctgtgggacgtgctggcgttcagcgggccggcgccggagcggatcaacgggcggctggcgatggtggggttcgtgtcggcgctggccgtggaggcgtcgcgcggcggcgggctcctggaccaggccggcagctggagcgggctggcgtggttcgccgccaccgccgccgtgctctccgcggcgtcgctggtgccgctgctccgcggcgagaccgcggaggcgaggagcggcggcgtgatgagcgccgacgccgagctctggaacgggcggttcgccatgctcggcctcgtcgcgctcgccttcaccgagttcctcaccggctcgccgctcgtcaacgtctaatttaattaattaattaattaagctgtacgtacaatacgtgcatgtacgtatgcgtgtactgggtagatagctagggatgtgtatgtatgcactgtagccaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 44637 - DNA, 905 bp, Oryza sativa
agtacttcatcaatgagtataaaacaactcataataaaataaattataattacgtaaattttttgaataagacgaatggtcaaacatgtgagaaaaaatcaacggcgtcatctattaaaaaacagaggaacagagggagtactattatacacccgggctgttcgcttgcagtcctgtccaccatcggcgccgtcgcgtactgtcgcctgcgcgtcaccgccgcctgctcaccgttccggcttccctcgcactcttctgtgccccccggccgtccgcttccctttgcccccgctcgacatcatgctccttttctacgcgcttcccgcacgtactgatgcttcacggtgaccgcgcgtggttgcagcccacgccgacgcagcgacgctgcctcgtgctcgccgacccactcacccacacaacgcgtgcggtcgccggagcaagccgacaccgtacgttagcccacccgcccaaacaacgctcgccgccgccacgcgattgccagccgacggatggactcagtgatggcgtcacaggcgcgcacacacacaaaaaaaaaaaaaaacctgcaaccaacactgcggtccacaccaaccaaccgccttcttttttcgttctcgaagcgtgccgcccacggggaacaccacacgccgagtcgacaatatataacccacgacacagccgcgcgcggcgcgcggcggcacaaaacgtgagcaccaaactgatcccctcctcgtctccacgctccgcttctcctccaagccaaattctgaaacaccaacccagatccttctctctctctctctctctctctctccggccatgtccgaggcggtagaatgaacagatatcggcggggaagcaggcgaagcacaagcactggtggacgaggaaccggaaatggatga

SEQ ID NO: 44638 - DNA, 1584 bp, Oryza sativa
atgcaggtcatactcgttatttggtgtttcatattacagaaagctaggacaggaagttcaaaggcaggttcacaattgagttgtttcatagtgggacatagatttccttcactaaaacctaaaagcacaaggttggcattgaactaattggaattcttgggaaataatattagttataacactagtgatgactctcaagcccaaggatagaatcaggtaactttaattatttactagtgctttgaattttgatccgagaaatagggaattggaactgagattcctacacgatcattttttctgacagatgatacagacgcagattaaaatggttgaaggaataatgtaccttctgggcaccatcggtgtttaatggtcttccatctggatttggaccaacaatgccatcaaaaagagcaatgcactttgcatagtttggctcttcgtcgaacttcaagttcacaacatactcaacaaattgacgaaatggtggtggaccaatgccacataaagattctggagaggttgccatctttttcttgcaaacaagaaaacctttattctctccctaagttcattcatgaattacaaaacgaattagtgcatgtagcaacaaaaaagtcataaaatcaatcaaaattaacctggaatccttgccaaggcaggcggccacggagaaggaaaataagtgtgtatgcaagggattcaaggtcatctctcctgcatccagttcttcccaagtgggcatgcacactagcataacgaacagtacccctgtttacagtagcagacaaacaggaagagcgcatcaataaagtaatgtgcaaaatgataggcatcgtaataaactttctattcaaacctaaagatatcaggtctctggtcatattcaacatgctttcctgtaccagcatctttccatttagtagctgcattggaacaaaacaagttcataaggaagcaacataaataattacatgacaacaaattgacacaatataaagataaaagttgattaagaattacctagtccaagatcaacaagaaaaagtttcttcccttcaggggtatctggaggaccaagcaaaaagttctcaggtttcacatcaccatggacgtacctgtcataaacaaaatttattagctaaaacttcagagacgccatgtgaaacactcttacggaacatctgaagagcaggtcgagttaccctttagcatgcatcttctctagtatggagatggcctctatacctatacaagcaaccatctcaacagacatcctgtaaaagaaggccacaaattaaaaaattgaaaaggctgcattgaactgtcaagattaattaggaagagtcaaaagatgcccacgagtgggaattgttattccaaacatcccacaggctcggtcccaacatatccataacctgcatgaaaaatgtgtatggttagaaaaaacgtagttgataattcttaagagaaaaagaaaccaatcaaaccataaaccggaaagcaaaaaaaaaaaaaaatctagttcatgctccattaccatgatgtaaaacccgccctgctttcctttgtagtgtaccc

SEQ ID NO: 44639 - DNA, 8781 bp, Oryza sativa
caaatcctgtataatgactaatcctgctttgatctaatggaaagctaccattatcctaaagaatgcctatacagtagcatctacaatatggctcaacatagtgcgcaataaaattaaggcactttagattctcccgttcctaggcagatcttttatctgcatgatggtagctaatcctaacagaccgatgctcaatcaaatctccgcttggaatttaacacaaacactcagcatgtgaattcaacaaatgttaggaataaaacaggaacagagaatacatgaaacagtaacaacactcagctaaccaattgaatttcgtatacatggcagaaatgaacataattaagcaaccgacaagatctacgttcagtaaaaacacacaccaaacaccagaaatggtatattcatggcacactaattataagtgccatcaaatgctagagattaactagatggagtctagaactcaagatgttagctatctcatcagttttctgcttgaaatgcacaataagcttctggtcaacatcacccgtactgatgctatcctagatttacacaataagcattcttcattcacatttagtcaaaagttctaatttagttccacacaattctctacaaaatcagttctgtgcagctgctatttgtaatcaatacatctgctatcctccccttctcttgtcaccagttggatcagagttaattgaaagtaagctaagaatccagaacaactagtagttattttgccacaagcgtaaaactccaccatcccatcccgcgtgtacagtttgcatagatcaatcagttcatctacaccagcggcagcgtctattcaatcaatagaaccctaaaccaaaaaaacaaaacgccccctaaaaaaaaatcgacagccatatctaggtcacgcagcgggggagccaaggggggatagataatccgcgattaccgtctccgggagcggcgcggggctcccgtcgtcgccggcgccccccttgtcggacccttccatccccttccgctcctcctcccgctgcttcccctccggctgcctcgcgtccgctgggcccgtcggcggcggcggcggctgctgctgcttccgctttccacggcctcggcgcgctggcatgcttcagcggcgcacgcccatcggctcgccgggggatcgaggcgatcggccgcgctggggctagggcttggcctccgcgccggcggcgacgggtggggggtgagccggcggcggtgacgacgacgagacgggaggagggggagattgcgaggtagggcgcgtggtgaaaaaaatcctggtaccacagccgtgttgtgtagtaagtggggattacgccgccgactcgagcttacgtactgtgtagaatacgccttctctcgaacacatgcggatcataccacactggcgtgtagttgtaagtatgatggcttcagaagttcagattcgtcctatcaaaaaaggaaaaaaaataaaaagaagttcagattcgtttcaagaaagatcatatactactcgtcatgtttgggttagcttgtatccatgtggggattttgtttcttacatctcttgccactaaagattatactcatattccttcgagaaagattatattcctacttgagttcttttttcgaaggaccaaaaatcttttgtgactcatcattttaatctctagtatactgcatcattggtttcatattataacccttggccctgttcctttctccaacaaaagtcggataaaattttaaatactcgtgtcacatttttcaaaccgctaaatgatatgtttcatgcgaaatctttatatacgaaatttgctttaaaatatcatattaatctatttttcaagtttgtaataattaaaactcaattaactatacattaatatcaccttattttacgaaaaaaaacttaatcttcatcttcatgagaaaataacaccaccctagtactttgattattttcctattgaagcccttttatgttctaatattttttaaaaaaacaatttaacaacatctacaataccaaattaatttcattatatgtaacattaaatgtattttgataggatgtttgttttgtattgaaaacaatttgatcaaagttataaaagtttaactaacaggaagttaaagcgatttataatataaaccgaaggagtatgtactacagtggcgaattggatcgacttcaataaccaaggtatcatctacatttgggagaaaacaaaatttagtttactcgcatgctcaattgttgtgaaatatcgcgaaaagaaaaaatctttatgaactagagtcccgctccggtgcttttctacttagagtagaaattaatccgaaccgttgatcgtatttaatcatatggttgagatcgagttctactcccaccaaattttatgggagtagaaatgtggagggatatatttgtccaaaggtaataattcgcgtagggtattatcgtaatttgtttttatctaactcttcaccctctctctctatcctatcctaatcgatgccattctcctccatccccgcctccgtcggtgtccatctccttcgccgcctccgtcgccggtccttctccctctccacctccgtcgcctccagcgccatcggcatctccttcccctccagcaccgtcgcctcccccggcctcaccgccttctccgccccctccatcgccgtccgtatcccccgccgtcgccgccttgtccgcctcctctttcaccgtccgtctcctccgcccgcgtcgccttcttcggccccctctgtcgccgtccgcctcccccgccctcgccgcctcctttgacgccattctgggcctcccgttcacctctatcgtcgcctccgtcgcccgtccatctccctcgccgcgttcatcgcctccagcgccctcgcggccctctgccccatccaccttctctacctccagcgacctgtggcggctgcggcgtacgtgctcggcgcctcggcaagggcggcggatccacgatgtgctgcttgtatggcagtccggcggaggagaggctgatgatgcaacgtcgccctcatcttgatgttgccgttgattgttcatcccatctcttcggctgctactggttcgagaacaggtaacgtcctgtcccattttctcccatcacttcctgataaatgatacagtaatgttgtaggatcactattagatcctccaaaagtagcagcctgacgcgagcaaaattcagttttaacaccaagtagtacttcataagcacaacctgctagatttctactgaggttgttgtcccaactatacaaatttgaaatgtgtctgacaaatgttatcaaatcaccacatagataattcttctgtgaccattagcgagagatgatttccgcttgtgcttcattctattttagttgatgagcagccgacaacggtttaaatggttatgattttgcttcagtaaaattctagtactaattctggagttctctatacttcgtaaattacacacagatcgatttttatttgattcgttgcttgtagaaatagttccactccctgtgctacatcacataagtcaaatttcagaagatactactagtttatagtggttacggccagcatggaacagttaaggtccataattttgtaaggctctgcagatcattttattttggaggctttccaatgtgtataattttcttttcattttttcagccatgcagtggagctccaatggtgagtttgcctttcattgtcttgttggagattgcacgttggaattactggcaaaagtcatgcttcttgcattcaagagttgtatcctgttctgcgagtatgatctagcagcatggtatggggctgatattttataaaggacaacgaccaatgtctgaattgatatatatatatatatatatatatatatatatatatatatatatatatatatatatatatatatatatatatatatatatatatatatatatatatattgtactcgccataatttaatgtctatcacagaagcagtaatatactcccttgcgatatatcccacgtggttttctttggtagacagtgttcgtgttttaaaacaaatgaataggcaaagatgatatatatttgcacttgggagttgccgtggatggttactgcaagatgctttaattttgtccatgtcgcgaggggtcaatcccagtaccacaccacttctttttttcaatcatctaacataactgcaactatcttttttatcttcacctaacagaaattaatctgcaatcaccacggttaatatatcctgaaacttggcttgatagagctttattttttgctaattacacccctgacctccacatttacatgcatatcacttaagaagtatataatcatctgaacaaagtctctgatacaacaaaataaaaggctgaagaaacgtcagtggtccatccccaaccttcaattgtgttgatgcttcttacatgctccctctcatagctccggcttgaggattacttcacaagttgcaaacatgttcaggaaagtgaacaattctgtgatacaagtgaatctgacagtcgcggctgctttaaaatctcatctcataatgaaaatattctagcagttaaagaatatatatcatgatgatttatgagaatgcttgtggacatacatggacaaattagtaattaacactataagttagtaactatatggaactgctccctaaaaaaacaactcaggaactgagtttctaattcagaaatgttccctcagataaaaactcaggaactgtgtcaacgatcctaaaattgtgagtattttcttttcaaacaatacttttagatttttagaaatataccataacagaaattaacagtcaaaatagtattttatacatactcaagttcagagattcagttgaattgtattttattcaaataatattataatagctagcacattacatcttcagaattaatatatactccaatatattgcatccagcccgaatcaaaattcagcatccatccatatcaaagtcacatccgataaatcgaattggaacttgtatacaacgctatacatgcaatctagtagcaatagcattagcatgttcctcttcttgtgcggttcgtttcaaaaaagcaggttcctcttcttatcaacaacgaagaaatcaaattcgattgagagcaaacgcacaagtaccatgataatcgaaaataaatactagctgttagcttgttcagtgggaggaggagatcaacgcggatgtgaacgcggtgtcagggccgaagaaatcggcatggccgtggtcgatagggaggagatcggtgcagtgcagatgcgcgtggtcgccagcaacggaggttggcacggccgtggtggctagacagggatcagcgacatcgacggcgggaataccaggggtggaggatggcaggataatcgaggtcaccgacggggagataaaacggcggcggcaggatgaacgccggctgatcgaaatgggcgccaccaccggaatcgagctgtgcaggaacggacggcggatggatgcggcgagacggtcggagcaatacgagacttaaaagaaaaggaaaacacaaatacccaaattacccttaagcacataattagtaagtactaatatacccttccaaacagatggttcagatcatttctactggtagtagaatactacgagtagaaagcaccgtagtcaagctcaatgaactaacgttcaaagttataagactgtccgggtaaccaacaaaaacagtttggggaacctgactgcccatgctcctccccttcgtgcaaataccggctcactctttgaaggatctttggttttacagtacagtacagttttaccataagtaatgcaaatgctactaagatagttagctgtagctacctgtggaactccaaggtagttcaggtgagggctccaataaaaatcatcaaataagtgagaactcatgaaaatcatatttaaaagtcttataaatttatgaaaaaaaatttaaagataaatataccaaatcttaagtccaaactcaactttatttgagaaaaacaaaaaagacaaatttcagatgaatagtgttatattactattcgagtaaaatgcgttgcaggtactacaacttgcaaggtgggtacaatttagtcacccatcttgtaatttgctcaaataaatcactcaacttgtttggaggtgcaaatataataaaaaacgtgtcacgcgtattatttttgccaaggtggacgatacgatggcagacgtgacgatgagttggcgaaagtaatacagttttgtagaaaaacccttctactatattactctttgctaatttaattggtctatttagatatgttatgcccgtgtgctaagccatgatcgtaggtttttttgttggcgtgcgcacgggataggacggcgccagatctagcgagtcgcggtgatagcctgcgtggctgcgtatgaatccatcatcggcgaaattatcaacgctagccacgagcgctcctatttaatccatgaatatgatgtcaaattaccacattgaagagtgcatataaaaattggttttagcacaaggaacaaaccgctttatttcccaatataaagacaaacatatatccttgtacatcaggcaagattcagtactggcagcaaatcacgtattgaagatttggagtatcaaacaaacatatgtactcaaacgaaaaattgaaacaatataagggctaatttgcatctttgttccttgcatacaaggtgaacctgtcatgctgacgtggcgtccaccttggtacaaataatattgcacctctaaacaagttgagtgactttttttttagataatggaagttgagtgacttatttgagcaaattacaagatgggtgactaaattgcacacaccttgcaagttgtggtacctgcaacgcattttactcttactattcactcaaaagttatctcttttttccctctataatagagttgagtctaaacttaaaatttagtgagaatgtatttcatacttgcatctatctacagtattcttctcatgaatttatacactttttaggtctagtctcatgggttttcacttatctaatagtcttcattggatatgtcgccgttctgattagctcacatcaacttctcctttctgcaaagctaaaaaaaaagggacctatcaagtcttgattataactttgtacagcaacctgtggcggtgcgtacgatgatcacatcatcgcgattcactcatctttttccgtatagccatattccttggatgttgtcacgatagcacgagtgacaaaacaaactcggcaaaaaaaaaaaaagttcccattttagttcaccatcgatttcgaccgtggattttcttcgtgggtcatgacacacatcataaaaaaagaaaagaaaaagaaaaagatgaggtcgtatgcgtaatgcgttcactaatcactcgtcgaaatcaatggctagtggtaacaggctaacagatagtgccggccgctatctgaaaagattatagaagaaaagctttagcttaatgctaagcgtgtgactggccggaccggaggaatgacaggtttttgggctggttgggctcaaagtttagaagaaaagggtcgcgtcatgggccaagtcagcagcccggcccacctgcagccgaagcaaaagcaaagccagctgccgagctgcgtcgtaaaggcgaaagcgaggcaccagctaacccctctctgccttttggttttgtgtttttttcaccttttgcatgcgtttttgcctgcctttttccacatgctttggagcttggaaggcgcgcgccttcgcgctagtggcaacgtaaaaactattgcaacggagacgctcccacattggcctcgtgccaggttagccggacggtcgtagaaccaccacatccacaggtctgtcaacgagttttctctttcttaaaaaaaaaatcataatgtctgcatactcactgaaaaaatcaccaccgacgacgttcgacagatatatcacctactacttaaaaaaacaattatctataatgtttcatacataaatctggatgaattggcttgacgataagaaacctagggttaagctacgctcacttcggatgtcaacgatttttctaacgcaaaatagagggagaaaatcaccagaaaataaagtgtcgccggatttgctcgatttcctcgtgctcttgcctctccttcctgcgcccttggcgtgtcaaagcagccggtcactcaggacgatgggcgcacgcgcacggtgtgccaactgccaaagccaaagcagcagcaaaagcattatcaaaagcgcacgagcccgcgccaaataggcgccctgcatgagcaaacgtgcatatggttgatttctacgtgaattgagtgaatattagtggagaacgtttgatttgattaacaagcgaggatgggttttaattgcgatggtgttatgataaagttgtaggtgtatgactctactcagatcaaatattgttctttataaattttggccgtatagtactctgagtgtatccataaataatgagaagaagaacttatattcttttttctccttcagcccgtacgcagagtgccagggctatccatggccatgtgccacctgatcaaccgcacaactttcccctcccaaaaaaaaaaaaagaaaatagaggccccacattcttatatttcaatacaagccactaatttccaatatattatt

SEQ ID NO: 44640 - DNA, 1004 bp, Oryza sativa
agccactaatttccaatatattattatcctattaattttatttgttcaaaagttcctctcacgttgatgtactgatttgcctagaacatatttatattttctgggtccaatagatgttcgataataatcatggcatctaatttatagcaactacatgaacaagcgttctagtactaaatattccatttttcgcttggtaaagaaaatcaaataactacattaaaaagcacttaattttcttacttaaggaaggcgttgctaccatttacgtaatattttttcatggacaatttactatcctttttattgatactttttaaacataaaatcttgttttatgtttcatattagggtctgaaattgctaggtacggtcccgcccttattatcttcttcctcttcctcccctttcctctctttccttctctatatggggatcaacgggcaaagagcttaatctgcccgtgtgtacaagtaccatggcagagatatttgtcacgatatcttccatctgttcacccatgagattgtacggtccacctgtcaatcaatatacgggaataaagctaatccctccattccataaaaaaaccaacccagtactaaataggattttccctttttaataatttgctatcctattgttgacagttttcagaggtgaaaattttcgaattttaaaccatccaatatgctttgagatttgtgttgtggaggaaaatggaaaaaaaaatcagatgctcacggcaaggatcaaacccgaggcctgcagcttgcatgctcgttcaactaaccagttgctccatcgatattttcagaaatcacttatattgtagttacgtagtagtagttagtacaatgtaactacatagttacaattgaaagttttcattttaaaaactatcgaatgttgtatagctactcctattttttaatataaacgaattcggataggctataaaacatcgtatttaatactagattggttttcggtggtactaaaaa

SEQ ID NO: 44641 - DNA, 5361 bp, Oryza sativa
acgcctcccgttgcaagccgcgcgcgcgtgccgtggtggccgaccgcccggtcgccgccgccgtcagtctctgcacgcgcctgtcgccagtgtcgccgctccgctccaaaccgccccgccgtcatcgccgtcgtcatcgcctcagccccgccactcccgcgctagcctccaagggacggaggcagggcctccctcctccctcagccgcgcgcccccgctcacctcctccttttcccgaatcggcaaaggggcaagccccctttctccccctccttttcccctttttcctcctcgccggcgtcatcctccctgtcgccactttggccgcgaccgccgagcgccagctcgcgcccttgaccgcgcaagtcggttcccaaaccgacattgccgcccatttaaaccccagcctcccctttcccttcctcttccattcgcctccgtgccattgccgccgcccccgtgctctgtctcgcctccgccgtccttcgccaggcgccgggagaaccggtgcgttcgaggatgcggaaggggacttcggccgcgccctcttcttcctcttccccggcccgaggccggagagattactcccgcgccgtcggcctctcgtcacagcgccccgtcccgcacggtagtgtctccctccgttcttcctcctcgctccatctcccccccttagttttcggtggtagcacgagtagactccccgtagctagccggcgccgccccaaccgttgccgtcgctcgccgagtgctcgccgccgtcgccgctcgagctccgtagcacccgcacgtcgccagcctcgctcggcgtagctccgtccaatccgacgctagcatcgagttcccgtagccgcatagatgctctcaccgccgggaatcgacccctcgtggcctcgtcgccgtttccctcttccctccccgccggttgtcgccgccgcgattcgccgccgtcaagctccctccggcgaatccgagccgttggctcgtctcccctcgtcctgtgcaaccacccggtgtgctcgctttcgcctgtatcgccgtggttcgctccaccgttcgccgctgtcgtccgccgtccgttccggccggcgtcgtcgtctacctcccgctagcccacgtggcagccacgtaggcgccacgtcggcgccagctcagccgaggacgggacgggccgaccccggtcagcccctcccgtgcgcgcgttccaccgcgagccgtgaggctgcgcgtgggcccgccgcatccgcgttcaccgcgaaccgcgcctgtgcactgcgtccctccccgcccgcgcgcgtgcgccgcgtgctccctccgcacggtgagccgagccgctgacaagcgggtcccacccgggaccacgcgtggtgagcccggttcaccggctccctctctcttccccgcccgcgcgcgttctgggccgtcttttgggccgtccggcccagttaactcggccggaccgctccatttcccttgggccgcgccctagccgcccgaggaaaagtctatcttccctccctcatccttttctttttccaaaagggtttaaataaatcctttttccttcagaccaaaaatccaataatattaaaaattcaatatcttcccaaccgtaaatccgattgactccgttcaacttccaaaattccccaaatctcgagatctatctaatggcacgcttagaggtcattaatagggctttattttcgccgtttgttgagttgtcccgtttcgcgtgtagtttcggagcccgaagacccgcagtgcgaggatttcgaggatcaagctccggatctcgagcaaggcaagccacctttgaacatcttgagcctatatttgaaatttaattatattgcttgcaaaatattatgcattgataggatcgcacttaatcggttgtcccgtctgcaaggcagattggcggacctgcctaatttgttgaatttgatccttcctttgttaattgttataccatgtccccttgtaaccacccagttgcgcctcgatattcgtgcactctgtgcgagtatcgacggtcgccttcaaacttaaaatctgaaaaacaacttgggtaaaacttgggttttacaaaagacttggaaaacccgacgcctgggtcggtgcttgcgaactaaatgaatttctaaaaccgcggaccggggaacgtaccgggtgtacggttttcccgctcccgcacttaaggaccgattccttggaatttcatccgaacataagacaagtacgaccacatgggtggaatgggacacccctggctgagtaactagcttatcaggggagccatgatgccgagagacatgtggattcgccggggtggtgtcggggaggacccctgggcttcctggcacagtatggtctgggacctaacctgttgttggtctgggacccctctcgtcggcatatggtaaacctgtgtcggctttggaaatgccttgtcatgaaagcttggaggtctcccgacgtggttgatccccacgggctgggtgatccgggttagtaatgtcgtgtgggtaaagtgtaccccctctgcagaggttaactaactgttcgaacagccgtgcccacggtcatgggcggatgtgaggtgattcctagcgtagttttgtttgactactgcttgtgaaattgctgttgtgaaaaggggtttgatgtttgaaaaatctgtagctgacgggatcagctaggcccgggtggccgtttgaaaagttgttggcccgggtggccgtttgaaaagttgttggcccgggtggccgttgaaaagctgttggccgggtgccaaccttgttttaagatttaaagactgatacattgcacatactccgaccggacgggacacactgtctcaaccgtgtcgtttgagaagcacccacttagttgtttcagaaaagagttcaaataaaatcaattgcaaaaataccagcctttctttgaagcctgcattaaacacttatttcccctggcttgctgagtactcctgtactcacccttgctctatataaataacccccccagttgctgaagaagatgaagcggatcctgctgatgaggagttcttccaggagcaagccggttacgatgagttttatggtttcggcctagttcccaagtcgcgcctgtgttgtttggtccaagccctggcttccgtttcccttttgtaatgcagttgtgagctcgggatctgtccacagcccaacatgactgtactcctactctataataaagagacctctgttgctgtgatattctatcttcctgtgataccagcactgtttcctgggactggtatcgattaacaggttaatttggagcgtcacgggctaattccagtcgggactagctcggggcgtgacaagttcacaccaaacttcccccaaacttttaactttccatcacatcacatcacatctaaaattttcctacacacataaactctcaactttttttcccaaattaccaactttttccaaacttctctccagtttcaggaactaaacacagcctcagtttgagaattgacacacctaggaatttttttaaaaaagaacgattcgatgctaggctcaatccacatactggataatgtcaactatcaacaagaaggagattagcataagcttggcacaatcactttcaatattgaaattaaccaacacacagagcaagtgtgtgtgcccaaaatgttcaacgctgatgcaacgaaaatgaattaagccgcggtgctagctgcatgcatgtaaatatgtaattgagattgattcgaatcgaagagcagttagtagtgatgaactgatgataataactactgatgcacatgattgacctgaaaaacaaaactctaaatttttttccctgtttctgtctcctttgtggggtttgaaatggaaccatagaaagtgcgagtcgtatgtatgcacgtactacctgcagacacgatagatgattccatatcaaaatcaacataaacgcatatacaccgtacgtatgcttgaggattagtatctaacaaggtagttatacctttgtcctataataattatattttaaaatttaaatttatctcgaaatagttatcacaatagagtatcaattgttccatcaataacttatcatttatttttttaattctacccttaaccaccctctcgctcttgcctatacattatatctagtaagggacaccatagttttctttactcaattcttaatatatgctacatagaattataattattttaggacatataaagtatatatttatctgtaggtatttcaggacgaagttaaaccgatatcattagtgcctttatgtttagtcagttgtaatcttgtatacaaagatgtaattcggagtccccctcatctagatcactcatgctattcatcgtatttagacttttttttataaataaaaggaatgcatttttaaatgaaaaagtacgaaaccgataagttaacaccgagccattttttctaagttaaaattaatttataacgagccttcttccgattagtttgtgtgaataggacaacaacaaaaacctctaaaaaaaaggacaacaacaaaaaaaaacttgaaataattaacacaaactaatttaagcatgcaaaggccaccagtttaattaaagtgcaaaaattatcatttcgtctcatatgcatgatatggcagatacaagttgtgcgggcaatgcaacggcaagcccacttttttttttatctcgtctcctcgtgaactctacatatatagagatttatcacaagcgaggaaattaattaaccgaggaaaaattacacgcagccatgcaggtagaaaaactcgaaacccacatgtcagtgaaacaattttgacgccacatagtcccttatatatatatataagcttctcgtgctttagtattcgcgctcgctcgcccatgccgcggcggcgatggcggcggcggtcggcgggctagccacggtagtccggcgttggcgcggcggacgcctgctgctggaggagctggcggcggaaccactcgatgaagtcggtggccttgtcgtcgacgcggccgtcgacggcgccctccggcggctcgacggggaacggcgagtcggtgacgcggagctgccgcgtcccggcggggctgcggccgaggctgagcgccagcaacggggacggcgtggcgccgggcatcgacgacagcggcgtctccccgccggcgccagcagcagccgcggcgtcggcgttgagcatctcgaagacgcgggccacggcggaggcgtcgagcccgccgtagttgctggcgccgccgccggcgtggcgtgagccgccgcggccgcggaacctgaagggggctgcaggaa

SEQ ID NO: 44642 - DNA, 2113 bp, Oryza sativa
gctgagatagagagcggaatcgaggtgggtggcaatggcggtttctcgctttggattttgcagctttgaagaagggtggtgttggatgggtgggtggtggatggaacgaatgggaagaggaggtgggggcggtatttatagaggaggaggaggaggccggaggtggtggtggggatgaggtgagctggcacgggtggggcccacgtggtagatgggacttaagaactaaggaaaggggaagggaacgttgcgagttgcgggtggtggtggtggtgcaacggtacgcgcgtgtcacggtgcgtggctcgagccgccatcgcgaggattgatcgatcgtgccgcgagcgaacacatttttgcctgttcgatctctcttggtaatcaacctatcaacagtttttcctattgagcatgaaacatcagaagaaattatcatacaattaagtattaaaatcacgagaagcaatcgaatcacacttgaaacgttttactctaatgtatgaaaacattatgtttcaagtactggatcatcaacatatcagcatgcatcaaagacaaaaagtgtgaaacaccatcgaaatccatgccacaacattttgatacattagctgaaacgtcgaaaggtcacaaaaagtaccactctagcttcatcctcctttctagtatcccctcccacatcaccgattcagaccaggttaaccccaatgccaaccggctcctagccatgcacatcgccctgcgttgattcggacttcccctcgttccttcgcggttggtacttaaggatccaaagccctcaagcttggtgtgactggattcaacaattgcttgggggaatgatgagcagggttagaaattccggaatgaaatttccaaaccccccatgcgatattatttcatctgcaattatttttttgaatttggtaagattttgttcaaatttgagtaatatttattcaaaagttcgaaaatttcagtatatcgatgacctccaatagaatcggtcaaaccgaaaatttaaaccctaatgatgagtaataaggaagaacgggagtgtggaggcgagcaagggcgcttgtctcaacagttgctaggatgggggtgagtttgggtgcggattcccgatggtggcaatagttaggcacacacatttaccatcgatagggaggaatgatgcagggcacccgattttttttttatcggtcagatcatcttccaagttgtaaaccacagccgcttttcttctctttgtgtatgtttcttagacgaattcacatcaattatttattccattgcatggggtgctagttaatttaactatagtgcatacatccaccaattatgaaagtgaagctatagtaacaataatatacgagctgaagggaaagctttactcctgatgccaattatttacacgataaaaataaaagtgaaagtcagaagagaggattatgttgctataacactagctctacaaataactaatggtccggtcgccttccaggaagcttccaagcagaacacacagtgccattagcaagttgcaaatcttgaaatatcgcgacatatacaaacgggtgcttgcaacgtccaccttgcactactggatacatacgattttgccatgcatatttggtgtggtgtactgtggtgccaagctaactttggtcccgtcgcttctctcgctaattaagcaagcgaggcgcccctggaattttaggtttcttaagtcccctgttttttcttttgtttgagttcataatcagggttcacaatcccaacaaaaatcagcctgaatttcatgaaaactggaattcccggaacggttcgataagagaaactactcagttttctgatcatgttttaaaagaaaaactaagttttacagtttattcaaagtttatctgaatttcattggtttttacgggtttactaattgttttcagggttgttcagattgatgatatttcaaaccataccaatttttgataaagttactaaagatgtgcatctattttttttcaccaaaatttgttaaatacataagaaatcctggcaaaaattagcagtattgccaaattgataaaattttggtattgtcaaaattttggta

SEQ ID NO: 44643 - DNA, 933 bp, Oryza sativa
taatagtctacgtttaatatttataattaattttcaaacatccgatgtgatagggacttaaaagttttagtcccatctaaacagggccttaagctgcgtttgttgggtgatcggagagaaagcacatcgttttccgtgtgcacgcttcccaaattactaaatagtgtaatttttttaaaaaaaatatagagaagttgctttaaaaaaatcatattaatccatttttcaaaaattaaaatagttaatactcaattaatcatgtggtaatggctcacgaacgttttgcatatcttctcaatcttctctctccccttctccccaaactcaaccttagtcgcatttcgatcggtatatacttaggccatgtttagttcgtgtgccaatttttttttaaaaatatacaggcgcacatttgaaatattaaacgtacactaataacaaaacaaattacagattccgtctgtaaactgcaagatgaatttattaagcctaattaatccatcattagtaaatatttaatgtagcatcacattcttaaatcatggcgcaattagactcaaaagattcgtctcgtaatttacatgcaaactgtgcaattggtttttatttttatcgacatttaatattttatgtatgtgtacagatattcgatgtgatggaatttttggaagtttgaagggaagccttagtcgcgtataaataatgttggcgactttggagcacgttgaagatgggagcaacagggacaacgtgattaaactgcagagtcgtagtttgatcgtcagtgcttacgcagcatgcacgcttaatttcagtatttcacacgcggcatatatatatgtgtatatatatatatatatatgtatatatatatatatatatatatatatatatatatatatatatatatatatatatacatatatatatata

SEQ ID NO: 44644 - DNA, 3196 bp, Oryza sativa
gtatatatatatatatgtgtatatatatatatatatatatatatatatatatatatatatatatatgtatatgtgtatatatatatatgtgtatatatatatatatgtgtatgtgtgtgtgtgtgtgtgtgtatatatatatatatatatatatctatgtgtgtgtgtctatatatatatatatatatagctacactgggatttaataaaataagagtgttttagttttttacatgtattgatacgtgtggaatcgatgaaaaataaacttaattagtgatggtttagttaccaactttttctttaattttttattttttccatcacatcaaaatttttcttcacacataaacttccaacttttttcttcaaacattcaattttgacgtgaaactaaacacacccttagaatagaggaagtagcaatttggaattagaaatcatgcagtagctagctagcaaacatgcacatgccacagggcgacgcaaagccggccggcacccgacacggcaacatgcatatgcaacctcgatcataatttcctcggacgataatgcatcggcctcgatctgtaggttcagttctgcaggaccgtgctagctagctctgcttgccagtgcaacagcgcatacttttaactaaaggtgggtttagttcacgttaaaattgaaagtttaattaaaattagaacaatatgatgaaaaagttagaaatttacgtgtgtagaaaagttttgatgtgataaaaaagttaaaagtttaaagaaaaagttggaaactagaccaggccaaactagctggtggtctctttgtggccttgtatatgcacgatcagttgagcatctcagtacagcggaaaacaacaaattatcgtaagattgatacgcggcgtgcatgctttgagtgcgtcctgcagcgtacattacccctttaaaaatgacgtgtgtgtccgtgtgttcgccctccttaatttgaacacgcctgggatagattagtgaagtttcattataagagcaaccacaatgttacaagaagtaaccttaaaaagcaaagcagtatttttgctttgtttttgtcttgagagataagtaaataaaagaatattgctatggccaatcttatacttaaggctagaccagaaaaaaaaaacattttatccctatgcaatatacatgttgttctctgaatcctaattgagtagggtctttttttttctcttagtgagtctcggcttatacattgtagtatgtgttatagaccaaaggatataagagtgcgaatttcatcttatatctctattgaacttaaacacgttaaggatatcctaagtgtattttgtgggctgtaaacatgtattctccctctaagtcttaaacataagctttgatatatacattggtcgatcaattgattgatccatggaatcagacaacttgtcgacgacatcgctggccaaccacagcattgtacgtacgtcaagccttgcatcacccggggtccgggcctaggactaggctttgttcttcttccaactttgccaatctctttctctttttttcgaatatgtttcacaagctactaaatagtaagtttttttaaatttttctattgaaaagttgcttttaaaaaaatattaatcaaatttctaaaaaaataaactaatacctaattaataattaattatatactaattctttgttgggttttccgtgtcgaaaccttgactcccgaactcagcccggaggtcgacaagaccagccgggcatacagtctttctccccttggtgtgtacggcgacgccggaggacgaacaaccctaccgtcccagccggcggtggtagctactccctccgtccctaaaaaaacaacctaataccgatatgacacatcttagtactacgaatctggacatatatatatatatatatatatatatttgtattattagaaaatatcatatccaactctagattcgtttttttgggacggagggagagagtaggtgacaagcttgctagtgccaacacgccatgacgcgcggcaggcaaccgtatcgtggtggtggccggccggtcggtgaggtcgatctcggtggcagcggcagcgcaggttggccggccggccgggctctccgccgatgttggggccggccgtgccggccaggccggggttcagcttgcttggcgtcttgcccgtcaaaggctcaaagctttagctagctttgaataggtccatgtactatgtagtagtacgatgcagcagagatgactttgttgtcctttgctagtgaccgagatgctcgagctcgaccggccattggtgcaggaccaaccaacggtgtggcagcatcgcagctagccaagctcagccgcgggaaaggagcagagcagtgcaagataaagtaagttgctgttcgttttttaaaataaagataaagttaggggaaaaaacaaaaaagttattagcgcgtgattactgaggtttaattattttaaacttagaaaaaatctatttatctaatactatattaaaaataacttgtatataaaaaatttatttcagacgtgctaacgaaaatcatgataaaatttgtactccctccattaagtgtagttgtgtatttctatgtccaacgttgaccgaccgttttatttgaaatatttttatgattagtatttttattattatgagataataaaacatgaataatattttatgtgtgacttattttttatattgttttaaatataacgaaaatcaaacgttatacacgaaaaataccgtctctgcttataataagacggatggaggataagagaagagccaaagcatccatccatccgtagctgattgactgcctctcattcggcagccacatatactagtagtgtactgcttgacgataccaagggggaattcaatgcgctttggccgtgacccacacagccggggacgacaggatcagggatgagatcgccatccaaattcaattcagttcggtcgcgacgtcaacctgaccgaccgccgatcgctcgctcgctcgatcgatcgctgggatggcccaatcacgcgactcgtcccccacagccagccgcgagcacgactccatttatttccgctcgcgacgtctgcgtaccatccagccaaccgcgacacttggctgtgttcgtttggacgttttccagcgcgctacagt

SEQ ID NO: 44645 - DNA, 8395 bp, Oryza sativa
aaacgtccaaacgaacacagaggcagtcaatcagctacggatggatggatgctttggctcttctcttatgctccatccgtcttattataagcagagacggtattttccgtgtataacgtttgattttcgttatatttaaaacaatataaacaataagtcacacataaaatattattcatgttttattatctcataataataaaaatattaatcataaaaatatttcaaataaaatggtcggtcaacgttggacatagaaatacacgattttatcatgattttcgttagcacgtctgaaataatttttttatatacaagttatttttaatatagtattagataaatagattttttctaagtttaaaataattaaacctcagtaatcacgtgctaataacttttttgttttttcccctaactttatctttattttaaaaaacgaacagcaacttactttggttcaccgatttttccgttggtaaccaagtggtaaaattactattaaggggcggagtatttttttcttgggaaaattggaacagataaaattacccttttttcttttaccaaacggtttttcaagcctccttacatgtttttgttttacactcgacttcttttagtaacagataaaatttagcttctgcttcaacatgagctactattatttattaaaaagtttttggcttaaaaccaattgtaaaaacatctatcgaagaatgaagaaaagaaatgttgaataaccaccaagtcaccaacaatgagaacactgtacaactctttcgtacagcaaatcattttagttctgctaaaaatttatcgacatttttttttaagaaatcactcgattttccaccgtccaattggtattaagattttgtgctagcgtgaacgttccataaaaaatatctactactcctgggcagcgggattagatccattgatcggattattaccaactgcaaggctctaccaactgagcaaggatgatgtgttgtcaagttagccaaaacaacagctacaaattagttacactaaagttaaactgtgaagattggagtagagaaggcttccttctggactttttgtgtgagtttcagggctggcttttcaattgcaattaatgtaattagactgtaggtgtaagtatagaataattagagtgtacatttttttaaagaaaaaaaatagtataagtgttgacaaggagatagttctaggccttgcagcgtcatgtagtttcgagtttttaagttgcccatgtatacttatttattttaacctggacaatacgctgcttataatctaggcagtatgttgcttgttagatggttaaaaaaaatccgagcatttagaatcatcatctatattctctatatagctaatatctactaatttctacatttcaacatacaagggtgccacatcatcacccactaggaattatcattatctagagtatttaaaatcacatgcaagcatgctacatcatcacccactaatagttattattatttagactatttcaaatctcatgcaaacatgatatagcatttatgattctgttatatttttagaagtcaatatataggaaatgtcaaactatcatctccacatcattttcatattatttaaacatatacatattttctacaatacaacatacatccgttcacatatcccgcaacagagcaagtaagtgttattccctctgtcccataatacaagagattttgagtttttgcttgcaacatttgcccactcgtcttattcaaatttttttgaaattattatttattttatttgtgacttactttattatctataatactttaagtacaacttttcgttttttatatttataaaaaaatttgaataagacgagtggtcaaacgttataaacaaaaactcaaaatcccttatattgtgggacggagggagcatcatttaatccccgtccaaaattgtagggcagatatttttttttcacggccgacaaaggtggggcagagtctaattacctgctacgttacagcctgcacaaaaaaactggacccagagcgtacatgcatacccctgtcacggtggggcgccccacccgctcatctcatgcaacccaacaaaagacctgagcgctgcgccaatccaaatatccaatcccggcgctgcaccgtccacgcataaatccatcatacaaattcaagtacggtgttcgattaaaatacatattttattttgattttctttaccttgttttttaaactgtacattttgtatttaattttttaatatagaaattatttttaaatagtagataaaaataattttaaacttaaaataattaggtgctatttttttttattttacgtgtttatacttaatatttatcttcatcatattgaaataggaaatgtcgaacccatagtttggaggcgaggatcctctatcataagctttactttgtttagttaccaatttttttttccaaaaaggtcgtatcgaatctttgtatacatgcatgaagcattaagtataaataaatgaaaaaaaattaattgcacagtttgcatggaaatcgcgagacgaattttttgagcctaattagtctatgattagccataagtgctacattaacccatatgtggtaatgatggattaattaggctcaaaagattcgtctcgcggtttacatgcgagttatgaaattagtttttttattcatttccaaaaactccttccgacatccagtcaaacgtccgatttaacattaaattaaggccatgatattactaccgttatagtcaccgatatgtaattctcactctcctattgtctcacacgacggtatgtataatgatagtgctactacgatagaggatagaggatgtgagccccatggtccggacaccccgctggcaccgctcgtgcacctataaatttgctttgccatcgcgtcgtcgggatcgtgtactcgtcgtagccaccacaccgcccacacacccacaccgccggtagcgaggcagctcacatggcggcgacggcgacggcgacggcggcgccggaggaggaggaggggaagagggtgatgacgagggcgctggagtgggaagggtgcgtggtgtcgccggtgccgacggcgacggccgacgaggcgtgggctctgctgtcggacttcctcgccttccaccgctggcacccgcgcgtcgccaagtgccgccccgcctcgccgtcggccgcggcgagcacggccgccgccccgccgggctccgtcgtgcggtactgcgagggcacgccgcgcggcgacggggcgccgccggactgggcgcacgagacgctgctcgagcacgacgccgcgcgccgcttcttccgctacgagatgaacgacaacaacatgggcttcggcgtcttcgtcgccacgttccgcgtcgtccccgacgctggcggcggcgacgcggacgcgccggggtgcgagctccggtgggagttcgagggcgaccccgtgcgcggcacgcccaaggaggccctcgtcgcgcgcctgcaggccggcctcgacggcatggcggcgcgcgtgcaggagcacctcatgtccgcccgcgccgccgacgccgccgtcatcgccgccggcggcgtcgaggccgccgacgagctcaaccgggacaaatactctatcgcggtctgagtgttcgtccggtccgtcgatcgatcggtacagtacaccagtatatgcgcggttgctggtcaactttatacgtgaactaatttggctgcaaaaacgtatattgttcgatgaaaatacacgaactctgtcgccgtcttccgtatatatgtacgtacctacgtatacctacctacgtatacggtatactgtgtttgtacgtgcttggggtatgggaataaacgttactaagtactgaaaaaaaaaccagtctctagcttgtctctcctcgtgtactgttcgatcgtggcattatttggttttgtaatttaatttgtaaattttattatatggaagtcaatgcaaggattaattttaatgttgactaattcacatgtactttcctgcatgtgcttgccatgtgctgtgcttactattggccgctgccattttgcctcccctgagccccctccgtggaatcaagttaatatgcagctgagtgctgacgtatgcaattgagaactgtattttttttttggtctattttgtaaggagtgttatgtattcacgatgtaaagattatttatctatgagtttcattgactttatgaaacatttttttttacaatatcgtttcccttttgtttactaggcctagagttgtgtgtgactttgcacaagccagcgcaacatgattccgcaaaattgtatagggtgtaaattagctactgctcgaagctaccccttcgtttatttttttccagtcaaatttaaaaaaactttgaccaagtttatatacgtgaatcaaacatattataaaagagaaattcaatgttgtatttaatgaaactaatttggtgttataaatgttgctattttttataaacatagttaaatataaagaagttttattaaaaaatcaaaacgacttataatatgaaacgaaaagaaggatttgcttttgagatgacatccacggtgaaaatcaacttgcatgtcctcctttgctggttagcttatatcagtcgtggtgaaactaaaatttaaaattttgatataagaatttattttgaagttttttccgtcgtactttattcttcagtattattttaaaaccacaaataacacaatataaaacttttacttataagttatttttaagttacttaatttatcttattagccgtagctcaaacaatttgagagcttaattgcgactagagttataagcattacatgtaagagcaagtttaatagtatagccaactactagcttcaaatcatctatagccaatgtaatagccaattcatataatagttgcttactataatattaatatctggtcctacctgtcatacacacattacgtcttagagtccgtgttgcagctagctagatctgtaacccactgcttttctctcccttctttatctctttaaaatatgtttatagctggcttatagcctgctattgtacatgcttttactgtgctcgtaacgataagcattacctgttttattagcaagattggttccatgatatcgagagatctcgatttcagaaatatccatatattttatctcatgttaatttttaaagaagttgtggagtcgacgaaccccagaaggtaccatagaagttgtggaccgatctgggcataagggggaaaaaggtactacaatgatggtatttttctttatcgctaagtaggaattgcgagattgtagtgtactagagtaggagtattatgaaaaaaaaatgctaaaagaaatgcacatgttgtccctgttatttttttattctggatttttcaagatactaaatggtaacgttttataaaaaaaatatataatatttttcttaaatacttatctaaaataaaattttaactgtgtactaatttattattcattcgtttatgccttcaaataacaatcacacaaattaaattattcattaactttagctaccttaaacaagggggttaattgcattatactccatccatcccactgtagacatttgtgcactcattgatgtttgtatatccggtcgattttcataccctcgtcagctaggaaatgtgggcgcctgttgaccccaagagtttccatgctgtaatcaaagaggatttgcacatccatcgccatctgccgttgttgatgtatagtaaccccagcccaagaaattgtccttatctcctcgtggcaattggcacgccccatatatgtcatgtgtgtagaagagtcaaaaaccggtaagccgttacatattaatttagtgacatttcggccatgtgtttgcatattttaaattttcctagctaccactagtttttactactattagacacgtgtattaattaatttagacgaataaatatgtcatactcctccctccagctctataattcttgacgttgaagcgttctgcgttgtggccaggagttcctattgtttgagctcgaaagtggtgtttttggactgttttgcccaatggtgatgtttcaaacaagataaagccgctcatcatttgctatttggttgataagccgtagaacaatgaacgaagaaataagaatattttacaataaaacttttatatatttgtttttagtgatttacgattaaaaaactcaaaatccactataaaattaagcttcaaaaattcaatttttggctagggttgataagcaaacatatttacggcattccttgcacgcttgaattagtggacatgactagaatgagagtaaagagcaccgatgtccactccggcaagtggaacgaagagcgaagattagattgccgggctcaccaacgacgttgagatgtccacagagcagagtgaagatagggttgctaggctcaccaatggcgacgaattgaatctagttctacatgacaaagatctatgttcttaaccagctgagtgtacctacacttttaccaacaattgaatagtactttgatcctttttttttctcgctactggcctcttgcctgtgtttagtgttggacggagttttgaactcataagcaacccgactcattgacggcgccactccggtatatttaataaagtgcaaggcagggaatagataaggtacataagttaatcactcatttaagaccatataccttttgatagagatagaaaatgtaaactatttctattactaaaaagatagtcactcctggataagtgaggattacctccgaagcaacgagtattatagcactggagggagtatcatatattactccctccgtattttaatatatgacaccgttgactttttaatcaacgtttgaccactcgtcttattcaaaatttttatgcaaatataaaaatatttatgtcatgcttaaagaacatttaatgataaatcaaatcacaatagaaaaaatataattacataaattttttaaataagacgaaaggtcaaacatttatcaaaaagtcaaagacatcatacattaaaatatggagggagtattcaattgattgatgaatagtcaactcccgtttgcttttcctctcgtccgaaaattaaagagacggccagtacccagtgttctttgagataataaccgagtaattaattaaccagcggagtacacagtagtacagcaccgtctgctcgccggaaacgatgggccatagctaaatttaggcgatcaagagcaggtttaactgtaaagggactcatatcttataatagagagttattatatattacagatgagttataaggttatttttattttttctcctctctctatcctttacttatatatttaatatatttatcttaagatatgtgtttacttatatatttaatatatttattttgaaatatgtgaatagctagttcttttttattttttaagttttctcttctccttgtaattataccatcctattaaacttactctgaacgtggttttgggttatagttaggatgtgtacgtgtgcgtgcgtgtgacggcgacgtggttgaaagagagagagggatggacggaacggcacggaggacgtgatttattggcgatggcggcgtgagaggctggaggacgcccgtgcagcgaccgcggcgacgacggcgacggcgacggcccacggatccaccgaagccggcgccgcagcgaacatacggccgcacctgcccgcgcgcacgtcttatctggtttgctacggcccaaattatcagctgctgccgccgccgcactgcgcgcatccatcatcatccatgcgcctcgccatgcatgctacacggtgacgcaaaagaagacggcacccgacacggcaagcaacatgcatgtagagcctccatcttgtgattctccctttttcgcttacggcagcagcattctttttccttttaaatgtgcaaggtatgtatatgtatactgtcggtcttaaaaaagaggaaaaattacgaattaccctctcccccgaagtatcgcggtcgtccaaattacacccctgaaccacaaaaccagacattcttcacccccaactatgcaaaccggacgaattacccacctggacccaatccacggtggttttggtttacgtggcactccagtcagcattttatttattaaaaataggtgggccccacctgtcagtctctctctcatctatctcttctctccttcttcagacggcgcggcgaggcgagtctctctctttctcctctttcaaacggcgcggcggcggctgcggcggaggag

SEQ ID NO: 44646 - DNA, 13492 bp, Oryza sativa
gacgtcgtccccccgccagccgctttgccgccgcctcgcctcgcctggtcgctacctccgccgctgcctcctctgccgcgccgttgtcgccgtttgaaggaggagagagagagatagaagagagagactgacatgtggggtccacctattttttaataaataaattgttgatggactgccacgtagaccaaaaccaccgcggattgggttcaggggggtaattcgtctggtttgcatagttggggatgaagaatgtccgattttgttgttcaggggtgtaattcggacaaccgcgatacttcggggggggggggtaattcgtactttttccttaaaaaaatcaacataggcctcttctcctaaagtgatttgaagggagtattatttggataccctctctagtctttttctttttctaaaaaaataaacgaactggcacacaattgtgataatttctttaaatatattaggagaggaaaacaaaatcacatcaccaccacatgctagcagctccaaacatatctatgaagaaaagagctagcaccaagccgggcgccgctatgcgtgattgatcggtgatagtctacgagggttgcgaacgcactgctgaaccgcagttcctaaacagtagtttctcgatcatcctcgcagagcagggttggaaaagggagagggcaagagagaagacgatccactcaaccctcagccaacccagtggcgacaaccgacaaaacgttgaaaaccacattgagataataccgtgacggcaggaaaacaagatctcaaagatgatgcacccaagatggttatgacgttgaagacgccaccatcatccgtgaaatgactaggctttcacccggagaatcttgttaggagggagagagcatgagctcgacaacacccaaaagggaggaaacaacgcgacacgttatcattgctggcccgaagaactccgatcaaggcttttgcctatggttcccttcccctaacctgttgttagcaaccttgtgtatccaccacccaaaaagcctatgtcaacatgcagtcctgccacgccggccttgtcagccgaacactttcacgttgccggttgtgcctgttggccctggcgaccacgtcctctcagcatcggcttcatgtgctgcgggccttcagctcgtgccgccaacgaccgcctcgctcttctagcctcccggccggtcacattaaccgttctacatgccgctaacctcctcctcgtgtgccacctgtcacggcctcgtgcgcaaccaacctcccttcgcgcttgccgcgccagccacccacatgtgtcattgcctaggacggcgtcctcgcatgtggacctccgtcgatgcttacacgctgccccgtcgccccgggcgttacgtgaccccaacttctccactccttgctgggccaccgtgcatcctccccatcaccaccgcttggtttcactcgctgagccaccagatctgaccatgtgagaactggatccaacgctaacatgcatatctgatcaccgacgaccaccactcaaaacccttcctccgatatttggtagcactcggaccgctgccaccagaaaaggaggtacggtagagagctctgggacccccgcccttcgcccgccgggctttcggtcgggtggcagtgaggcgaaaaggaggagggaagagggtggcagcccgtgccgccctagggccgaacaacacgagggctctccctagcctcaaaggaatggaacaaccaaaccctcatggcgcacatttgcacgcgcttcaccagctgaccctttagcccatatgcttgtagagtagagcgtcataaattctcacctagctagacttggtcctcccactcccactagcgtgctgactacatatatatgatcggtcaatcggtggatgaaatcaaacatgcaacatgtcttcaccgatgctcggcgatcctatatatcgatcctatagacagacatcgatccaaccggtctcgctagccatcctcagcactgtaccatggaatcgtccggtaatactccctccttctaacttttttaaatatgtttgaccgttcgttttattaaaaacttttatgaatattatttaaaaatttgagtagtagtagtatatttaacaatgaatcaaatgatagaaaaataattaattattacttaaattttttaataagacgaacatgtcgatatttgatgtcgcaattccggtatttgcatagtatggggattgttggtactaggatatatgcgagactgaggtaaaagagatggagacagggatttttatacaggttcgggcccctgaattgtcaggtaataaccctacatcctgttggccgaagccggtcgttgctcttattcatcataatcacaccagtacaatatttggggatagtctatctaactgttgtcgacatgacggtctgaagttctgactcgtagtcgacaacagggtagtcttcctcctcgaatccgtgcccgtcgagatcagagatagcgctttcgtctctcctgacagtatctggagacaccgtaggggactagccgtgcttatccctgaagtcgatatccggcgtcttgtcttggcgtatgttggcttctatattgatcttctgtcttgatctattgttccgtgtcttctatggtgggtgtgtcccctctcctcctagagggtcttgtatttatacccataggtgtccccttgtccaagtagaactagggaaaccaatatggatacaatccgagtagtacttgtcgttttcatgtagaactctggttgtctttccttatccggaactctttctatatccgtaggttgtttctgtataggatatgatatatggtgagtcctgtcgagatttagtcgactactattaggtatgtgatagaacagtcaaacatgtttaaaaaaaagttaatggcgtcaaatatttagatatttagagagagggaatacaacatgaggtccggtaggagtcctgtggctggttgccgctgggacgtgctactcatctcggacaaactagctatatttatagcgctaagatatatcccgtcacgtattaaatttatttatttcagaacagagggacggaatagatgacaaactagctcgaccatctagagaacggacctgtttcaccaaccggcttgaccggtatgtaaatatgcatgggctaataggccggaaaaaactccgattcgccgatctcatcggcccttgccaagcagaagcctaaggccgttttctggatgggccgtgatctcgctttcaaaaaggctcgtctgctctgcgacaccatttgacacttccaccggtggccggcggccgccgtccgccgcctcccgcgattcgtgtgtccgacacctgtgccacaaccgcgacgtacgaaagccaagccaccgcccacaagtttttcgtcagagagtgtgtggatgagtacgtgatttccacttgtgtgccactatattttgagcccagtagtgggactctgcggttttaagtactattgctgcgctccagcccatccattgcgtggtcggcgtgggggcaaatttcgtttatatggttatcatgatttttttgtgaacgatgacgttggttatcgagtgatttgttaacgatatgatgatgcactccaccaccaaagactggtcatataaaatcgctgatatcaaagtgtcatactacacttctttgttgcttgatatcaaagtggtgccccgatgactatttattcttgcttcgtccctgctcgattgtaaaagtgaacaagctctaggtgtaactcatttggctatattccttacgatgaaacctgtatattcgacttcaagtcttttactaagcacgaatacttatgtttatgactaatttttttaattatggatggtgcctctgtgattactttgtcatatatgtttgctcaatctactagagacgctcgaaatggaactgcactaatttttttttaagtatagaagtcctataaaaatcatcgcaaacaaattaccaaatcaacctatcatcaccattataatggtaaactacctatgtttcatattatatatcgttctgacttttccatagtcaaacttttctaagtttgacttaaatttatagaaaattatagcaatattatcaacacaaaacaaacatattatcaaaatatattcaatagtaatttaatgaaaccaaattggtgttgtagttatggctgtttttttataaatgatcgaaaaaaagtcaaaaacaacttataatatgaaatagatggagtattaaaatacgtgggcatggttaggatgtgtctacgtatatatggatgagtgcgacacacgtacgtgtgtataagcatacgtgtatactatatcgttttgcgtaataaacttaatgttgatctagatcttgatctttatttttagagaaaagaacaccaactatcaactatgtacgtgtcgagaaaatgaagaaaaaaaatgtgagtacttgtgaccaaagtgacacacacgctcactcagctcgtcagcttcttccacgcacgcgttgacacgtcggcacgggaaccatcctctatatatcgtcaccaacctgctgcacccgagcgtcgcaggtcaacacacgactgtaggcacgtgcaacaagctagatggaggagcagcagcggccggtgcagcccgccggcggcggcggcggcggtggcgcgccgccagaagagcagtggcgcggcgccgtggaggcggcgctcccgggaacgccggcgtccgccgcgtggccgcacgtcgccagcttctacgccgcgcaccgctacctccctggcatcgacgtgtgcgagcgcgtcggcgacggcggcgaggatggtggcctcctcctcgtccccgggtgcgtccggcacgtggcgtcgagcgcggcggggctgtgggcgcgggaggagctcctagaggcgccggaccacgcggcgcggcgcctccggtacgccgtcgtcgacagcaacatggggttcggccgctacgtcgccacgctccgcgtcctcgacggcggcagcgggtgccgcatcgcgtgggcgttcgagtgcgacgccgtgtgcggcgaggggtggagcgaggcggcgctggtggcgcggctcgccgccagcgtggacggcatggccgagagggtgcagcaagccgtggcggcggaggccgaggcgcgcgccggagaagaagaagaagacggagtcgctgggtgacgtcaacgtcgccatggcgggggcggcgtctggttcggcgtgtctttgtcgtgtcaggacgtcgcgcgtgcgttgcgtgcaaggtggctgattgatagagagattttctgtcgcttttttttttttactgtagtgctaccatggatcgatcagcggcggtgatgatctctacatgaaatttatctcgtgccactattaggtcgttttcatttttgcgatagcttttcatggaaaaatattataagaaaaaaattgtgtataaagttttatataactcgcaccgcttaggtagtgtttgggatgggagagatttagttagtgtttgggatgagagagatttattttattccctctcaaaaaaaaacataagtaacatactcgtgacaatctaacataaaagaaacatgcaatgatttatagaaaagtttctctttttttttacgttcttaaataaatattgcaaagtattgttgctcctgggtaagtttatgttgctcctaccttttacttaggctgtgtttggatcaagcggtgaaaatttttgtcgtatcatatcggatatacggacacatattttaagtattaaacgcctgtaaactgccaggcgaatttattgagcctaattaatccatcattagtaaatgtttactgtagcaccacattgtcaaatcatggagcaattaggcttaaaagattcgtctcacaatttacacgcaatctgtataattagttattttttcgtttattttttcacgaacgcgcaaaaggattgcacgtcaatatattagaataaaaagagttttagttacacaccacagttagaagaaaaggattgcacgttattttttcatttatatttaatactccatgcatgtgctcaaatatttgatgtgacatggtgaaaaattttgccaggggatctagacaggcccttatttaatattgtcatcaacatttaccgttcatgataagatatcatcaaacttttgtaaatgttaaataccaataactaactcacatgattatatttttttaaaaaaaatcaacggttggtttgtctccgaagagtattgggaggtgaacccatctcccatgcacggaaaacggagcagtttattagcgcgtaattaattaagtattagccttttttttcaaaaatagatcaatatgatttttttaaaacaacttttgtatagaaactttttataaaaaaaagtaccgtttagcagtttgaaaagcgtgcgcgcggaaaacgagagaatagtgttgggaacttgctcttgcaaacacacccctcacgatattacaaacttgttctaatataaaatcaattactaaaactttaaaagttaatcaagcctggtttcgaacgtcaaatagtacttcttcacggtggaagtatgtacttgcttggtttggcaggaacaaaaggacgtgacaattgcacaaaaccaacaccaaaacccacaaatccacagcgcatcataggtacgaaaatctaatctgatggatccatccgaatatctgacgcacaggcgaggctgaccgaccagcttgtttgatgaggaaatgaaacggtcgcccgactagtgaccgagctttctttcctaggtcaccgcactgcaatgcacatggtgtggagcagtgattttattgttccgaccaaccgttcgtccgttcgccattgctggtccaatccaagaaggcaaaatttgctacaagacattcaaaaaatgtgtaattagctgaagtacactataaaaacgtgtatttactgtagggcatcgtaaaaaagtggtaattggctgctggacacccatagcattattttattatttttggaggaaaaggagagagaaacaacgattaaagacaagtttgcccttggctcaaatgaccccaacgtgggccccacatggaagtcccctctccctctccctctccttcttcccagacaagccaggtggcagagcggcaatccgcggcggcggtggcggcggtgccgaccacgttcgccatcgggaggggggctacgtgcagccacgccgccgtggcctcggccgcgtcgccgcgcgctgccggctgccggcgctcatctacgtgctcgactcggcgatgagcggtgccgtcgcgctcatggcggagcgccgcgacatgagtgggaccgcccggccgggatgttggttgtgttggagtggacgctcaagtgcggcggcggcggcggcccggcgctcatctccctcccggcggcgtcgttcttcgccggcaacctcgctgggagcttcctgctcacgacgctcgccgacactcatctgggacgaaggaagatgctcgtcatgtcgctggcgaacatgtccgtcgccgtcgtgatcacggccttctcaccgaacgtgtgggtgaacgccgccctgaggttcgtgtgcaggttcggcaggtccatggcgggcacatccgcgatggtcctatccacggagctcgtcgggaagtggtggcgcaacacggtgagctttgccgggttcgtcttcttctccgtcgggttcatgtcactcccggcgctcgcgtacatgttccgcgaggcgtcgtggcggaccatgtacatgtgaacgtcgctcccgtccctctgctacaccgtcctgctctacttcctcgtctaggagtcgccgcggtggctgctggtgcacggccggaagcaagaggccatcgaggcgttgcggcagatcgcgtcgctcaacgacggcgaaggcattacaatgtcgagcttcaccatgctggatatgtgcgccgtggaggtgggggacggagtggccggtggcgagggcatgttagccatgctgcggtcgatatgtgagtggtggtgggcactccagaggctggcgacgatcacgacggccagcttcagcatcggcgtggtctactacgggatgccgctcagcgtgggcagcctgagcttcgacctctacagcgtagcgtacaacgcagcggccgagctcccgtcgtctttcctctcgtggctcctcatgggcaggttcaaccagcgcagctcggtggtcgagctcaccgcggtgtccgggctgtgcagcctcgcgtgcgtcgtcatcccggcggacccggaggccggcaccggtggcttgcgcctcgccgccgagctgtcctccttcttcgcgtcgtgcgcgaccacgcgctcgtctaggacaacggcaagccgccgtggcctcggccgcgccgccagcacttgcgctgctgcgcccggtcgtcgccccgcaccgccccgcgccagccgcctcccgctcaggtgtacgctcgcgtggtgaggaaggggatagagagagaagcaagaagaaagaaccgagagaagagagagaatgagaaagaaaagaataaagaaaaagaaaaaaaatcaaagggtaaaaccgtatttacactgttgtttctctcttcttttcctccaaaaataataaaataatgctgcaggtgtccagcagccaattaccagttttttacgatgccctacagcaaatacacgtttttacggtgtcctctaactaattacacgttttttggatgtcctgtagcaaattttgccgtccaagaaactgcacaactccccccacctactccaggagtagtccgcacatgatggtcaggtcactaggtcggcagctgggatgtgccatggttgtacttgtcgttgccggctgctaacatacgattagtcttggactcttggtggttgcattgcactcttgcagaaaggtagactagctgctgcctatcatgaataggaaaatagttcaaattactcccgtgaattattgtgacggtacgaattacctctatatcagatttcggagtggttttggtcccacatggcgcatatgtagtagtctagtcagtatagaaaatattaaaaatgataggggccacttatcagtttgtctcttctctcggtcaccatatgtgggtcctactttttatactgactgattgccacgtgtgtatccggtaggaccaaaactgcttcggagtttatcagagggcaattcgtccggtataacaagataagggtgaagaatatctgttttttttaattgaggtggtaatttggattttttccttacgaatacgacttactacgtttgttccaaagtataaatatttttagatcattaatttgttatcatatgctgatattattttttagttgtattaatggttaaattttaaattttgaattcactgtattcctctcgcaagcacgtgattagctgaaaatgtatggatgtctgtgcattagaatcagtgcatcagaaatgactatattatcgtacaaattttgaattagtattttcaaaccgagggagcagtactttgttttgggtgtgtttagttcacgttaaaattggaagtttggttgaaattggaacgatgtgatggaaaagttggaaatttgtgtgtgtaggaaagttttgatggatagaaaagttggaagtttgaagaaaaactttggatctaaactcggcctttgtatacttcatcctattttaagcgcaaccataagttttcgtatccaactttaattgtccgtcttatttcaattttttttatgattactatttttattgtcattaaatgataaaacatgaatagtaatttatgcgtgagatatgtttttgacctttttaaaacaaaataagacgaacgattaaattagatatggaaactcatgtctgcgcttaaaagatgaaaggactagtatccttgaccgaggtattatgctgttgataagaataggaggtccactcttgttgtctatgcttgactgagaagaatcctcttgccatgggaggaacaatcaaccacacaaattgaatatccttatatccatcctacacacgctaaaagaaagatcgacaaatttgatgggccagtagcagtactaggcaaactgcagcacaccaataccagtattagattttatacaaaactgattgaaaatgtccaattcagcggcaggggtttccttaaaaatcttaattctattattgcgggtgtatatatataattacagatcacaaaccctttttcagttttcgacccagtcctacatgaaacaatcaaccaaaatcaccacttgaagcttgtagatcactttcagataattccatcaagaatgagatcaatgacatacacggccattttcctaacttatcatacaatttttcttttctcctttttcaggcaaactgctctccttcacacggtttgcagagctagcattcgctccatccagtcgatgatgtctgtggcgatctcatcacgctcaggctcaaagagcagatcgtgcaagaacccatcgtacagcctcagatccttgtgcctcgatgaggcctcgttgtagaggtcctgtgaagccagggggtcggtcacccggtctgcggttccatggaggaccatgaatgggacggtgaccttcttcaagttgtgcagcaggtaggaggagatgcgtaggatttcatggccggtccgaactctgatcggcccggtgtaaaccagcggatcggagtacttcgctagcagggcagccgggtcgcgggacaccgggatgcctctcttgttagctcccttgaactgaaactttggtgctaacagagagaatattggcgccacagcctgcaagattcagatagttggtatgcacttatcagaatgtcgaaaaaaaaaccaagatggtccaattttttaagatttgcacatcaaggacgagattaaatgtagttctcgtaagcattaattttgtacagattgtttttctgccgggcatagtttgtgcagattggaaaattctaaatatataatgcaatcattttaataagcgcatacaggtcatagtatatctgtttttctaacgttgaatagaatacaactgccacagtttctcgcagaaggtttgataagatggcaaatgataagttgcttaaaccaattttgcaagctgttttaattaattgaaatatacctagttcttcaaaggtattcatgatcttcttttagcaagttatgcagatgaatctacttttgctgacctagaggatgcttattccatcaaaacaaacacagtttagaaataaacagggtatcagaaaaagcagcattacccctacaatgggatgagcaggttttacacgcagagctggtgaagttaggatgatgccttccagttttgctctgatacgagggaacaatgatgcctggaaaataccagctattgataagcacaagggaaagaagaacatgaagcatgtaaaatgaacatatctgcagccaaaccatttcaagttttcaaccaggctattttgttaatgctttgcaccattgctctgcccgtcacgatatccattattcacaggcccagaggagtagggtcagtttctaaacctggcctaaatagagctgagaaaaactacttattgttacaaggcataccttcaaaacaacagctcaccagtggagtgaccaagaagaaaacaggggacccctggattctcaagcacaattttaccaagaagtacatcctgtttgaagataataaaatatttcataagtaacagaatgaaggaataattgcaagacagacttgctattttcagacttactatatcttctacaacataatctagtgaaggcacataaccatgtagaccatcgcttccaccatggcctgacattgtatatggagatgttagagttagcctgttaatgttcacaataaaagtagaaacaaacagatgttgttgatacaaaaagcgatgcaaactgcatggataaaatcaatgaaattgcctactgtgtttggttagtaagtgtgcattgcagggtcaatttgtgctgtgagtgaacagagtgtggtaacattagaatcatgagctagaagttgattctgaataaaatttcatgcttttgtccataacaaacggtaatactctgttatcaataagactacttcactttcaatatcaaatgaaatatttagctggttctaaatttctaattagtcatactccttctaatagacaatccccatattttccaatgactttttggctcacacaaaaactcagttagttatattaggtccgacaaaatgggtacttaaacaaccccaaaaactaatttcatgtgcattctgacccaaaccactgtaacttacctaaatgtaggactaaaactagccatccaaagagtgaaagaggcaataatgcatgtccaagaaaccaaactagttctcacctatccagtccattgcatatactccaaagccacatgatgtgagcagctccgcaaagtgcaaataccttccactggaaatacgggatcaaaaagtatttaattattcttttgacaacaaagaggaaagaacatgtatattgtatattaaggtgtgtggtgggtgggggacttaagaggatatatagccttacctgtgctcattaagcccatgtatgatgaccaaaatacccctaaagtaaagagaggaaatgatcagtataaattgaaagtggaagcaattgtacaacagtgtcactgcaaagtaaaaataaactgttcttaacattagcattgaaacacatgctaccctcgtaaatagatggttcaggctaatgaagaattccactttgctgcaaaagaggcttcaacagaacaatactcttcaaaaggtttcagctgtagggttgtcaaatttgccagcagcgtcaagggtagctgatcagctacactttgaagtattaaacaaaggtggttggttcctatttcaatctttgttcaatgcagcgtttgactacagtatcatttaaaatgtgaacagctgaacagagctaaaccagcaggtcatgggaataagaataatccacagtttggttatacaacattggggcaaaggaataaaaaaaagcttcctccttttcttgatagctaagctattcagggtcactttagtttaagccatcacattcagacgttttcaacgataacaaagatatagcaatggagcaaaggttgtgagataaggaatcgctttgattctgctaatctacccgattgtgcttaaattggtctcctaaactaaagcctaaaggtacacgaataaagcttctataatctcttcttatccattagtactagtaagttaccagcactaaacatttcataccatcagagagaaaaatactctgcatcagaagctgtcgtaaac

SEQ ID NO: 44647 - DNA, 9048 bp, Oryza sativa
cagtgctacagctgccggctcattcatgtggtccccaccatccaccgtccactgtatcatggagaacgggacagccatgctccattctttagggggctcgtctcgcccgttggatctagtgtgctgtttgggaagtttacggaggttgtttcagattaattacattttaaactatattatttttaaaaaaatatcaaatatatacatacatttagttttttttcactaaactctattaaatccataagaaatccagccaaaatttagaaatattgttaaattgccaaaattttggctaaagtttatttcgactataatctgaacaggccctaagatttcgagaatatgctagttggtagctaacttctgataatttagagaagttgtaaaccagcttctgaattctaagggcccctttgattgataggattggcaaagaattttcatatgattcaaatttctatggatttttttctacatatccctttgattcattggaaagaaaggcaattttccataggattgtattcctatgcttcacattttataggaaaaatagcaagaggtgtgatttctttgtgaactttcctttgtttatcccatagcattatcgaaggactcgtatttgtctttcttgtgtttgttaattcctgtaggatttgagcaacgtactacttcaattcctgcgttttttctattcatgtgttttttctatcctgctaatcaaagggcccctaattcattttctggattctataactacatattctcagaatttatgtgacaatctgaactgtttaggaagctgaagattctgtgaaaagttacagctactaaaagctccctaaacaggcactaggttgtgtttgattaccggttacattttatcacaactatactttgttagctaagttatagtagataaaaatatggtagatagattactagctataatatgtggtaaagttaataaaaatataactatgataatgaaccgaactcaactatggtagcttaaaaaatggtgtagtaaaacgtgataatgaatcaaacacctctttaatccgtccagatcaccggcagtcggtgagattgcactcgatcatcgagactgtaggacatggccattttgttgactatcagcgaggaccctggaccctaaccaataaccatctagatgatggacaattacattgattaatcaactacagaaaaaaaatagatggaaaattctactttcttttctgacacaagcgtggctaagacactgtcgagaggacatacatcgtccgcattaatactgttgatgtaataacaatcacttgggtgatctactccagttttatacaaggggcggatccaacgtggatgcaggggggattcgattccccccctacacccacaagacccatggatacctccggagcaatcctttcaattttctcgccataaatgataaactaatggtccctaaatagctgtaggttaaagaaactatataattaagtccatcattttttttttattcctggatccgccctgtttatacacatacaatcaaccaaacgcatcgctggctgcacgagggatacgagccaccccaatgcagccaatcaaacatacccatactacatcagcagtaatgcattgaagctgtttgctagtgaaaggtcattgtcaggtagctactgattgttattgctgcatggcacggtcgatgcagagagagagagagaatgcgacccatacatgtgtgcagatgtgctcatcgatcgtcgtctccttgcaagcgacctgtcggttgcggcaaaaccaaccacatccacatgaacacacagtcagtaacattaacagtaaaattaattttctctgtacctttgatatataatgcttcctccgtcctacgataacttcacttttcactcatcacacatatcaataaaagggaaaaaagctagaatatcttctaatttaacatatcccaaaacaatcgcccccaccactttaataagtctcattatatttgcgatctactttcacaaactctaataaagtgataatctaaaagtatttgaggacagattagatggtgaaaaataaaattattttagaaatgtacgacctgatcgtgcctgaggagtaaacaaatatactacggctgtacggcatatatggctcgttgcgtccctatcgaaccaatgctattttccaagcaaagaactatgaggcatctagcaaatccacagcatcgacgtgaacgaatatgcggccatggaattacagtactaattgccctaattttttttcctgtagaaaggagtataaatgtataattaataagatgatataaacgagctgtggaagttgcgacaaagagaacaagggagccaagagccaaggatttatttatttatttctcctttttaacttgggagtcttttgctattttcgtcttaattaagccgtcgatatatatcttcctgatacttctgatgatactccttgaaatctttgtgataccttcgatatactcgttaatatacggtgatacttgctggcaagtacactatgatagttgttgatattcgtatgtactatcttaaaataaaccatatgagaaaaaaaagggggatacatagtaggattatatcctgccataatgggtcttaaaaaacataatgagtgacaaaaagataagcgtggtcccctgtttttgctagccgagcacatttttgtgggcctaaagttcacaggccttgttattaacaacaaagttatccaggcttggaataagttcactttgggcccctctatttgtcgcttagtccgattttcgtcccttggtcgcaaaaccgggtacgacaagtcccccaactttcgaaaccgtttaaatgttgtccctcggcagtattgcatctggtttttgctgaggtggcgcctacgtggctaggtctttgtccaatgtgtcaatgtggcggttacgtggcaattagatccgaaaaaataatagtacacgtgggacccacatgttagtcgcacacaacttaaaaaaatggtgggcccatgaggacccagacgtcatcctctctatcctctctctccctgttctatcgctctccagccggcggaacgggatgggcggcggccggagcgggcgacggcggggcggagcggcggcggaggcagagcggggcggagccgaagggcgaagcggggcgggcggctgccgaagcggggtggagcgggggcgagcggatgtcgtcgagccgtcgccatcctcgccgcggcgacaccgtgaacgacgacgtgctcgcgcgcgggtggtcttcaactcgggggtgtccaacccggggaagggaggggggggggagctcctggcgccgtggttggaggacgccgaccgcgcccaacgacgacgagcgcgcggagaaggatgaggcggcggaggctgtggtgttcatcaacggggaggacgatgaggcgacgatctgtccgggttcaggggcctggttcttgatctctcttataggtgacctcaacgacctcaacttgatctgacgatatcatccaaagttgcaaactattttgtttatgatagaccaaattttgcagtgatcgtgttagaaagagataaaaacaatttgaaggaattttgcatttttacctcgaaatataaccaggcctgtgaacgttgtctgctggaagcgcgcaatttgtttggaattcatggcgaaggttagcttctctgcttccaaaatcatttttaacttcaccatcagttattcaaagttcattatttgatccaaaaacatgcaacagcagcgctcagaggggcagagcacacggcggcgatggcaggagcttggcgcttcgacggcgtcggttcttgaccccgtagccgacgacggcgaggagcgcgacggcggtgaggaagacgtagacgtcgtcgtcagcagtagcctccgccgccgcccacggccgtgctgccccgcgtccccctcgaggaggggaccgacctcgccgctgccgtcgcgcacgagggctccggctgctacgtcctcaccgtcctccgccgcgccctccgtcctcgccggaagcaggaagggtgccgcccgggtcgtcacgcgcgccgcccattctccccgtcggccgctgctcgtcggtcgtcctccccattggtcgccgcccgtcctggtgccccttctccccgccggtcaccgcccatcccggcgccccttctccccgccagtcgccgcccgtcgcgccattctcctcgccgacagtcacccatctcttcgttgcctgtcacgccgtccaccccgccggccgctgctcgtctcggcgccctagctgcatctcctcctcctccggcggccaccgccggacactgccccttctccccgccggccaccgcccgtcggccgtcgcgcccgagagaggagaggagggagagagacgaagagaggggagatggggagtgaggaggaagaagaggggagtgagattgacatgtgggcccatgtgggctccatcttttttaattattgttttgtgtaactgacatgtgggtctcacgtgtattattttttttccaaatcaaattgccacgtaagtgccatgtcaatgccacgtgggacggagacctagtcaaaccagtcacgtaggcgccacgtcagccaaaaccactacccaaaccgctttaggaccttatgtgtccggttttcgtaagttgggggccggttcgtacccggttttgtggttcaagacgaaaatcggactcggcgacaaatagagggacctcaagtgaacttattcctccaggcttgtctatacatactgggctgatacagtaaggtgtacagggagtagcctaatgacacgataaggaaagggagaaaaacccagcccatatgaagaggaggccgcggcccacggcctcttgactcggataacgggctcaccttgccataatggaccaactttatggcctaacgggcctgtgtagtaatgaacgaaggagaaggcaagatgaaccgtgctcgtccatacaaaacgttcagaatcgctttcaacaaaggaagttcagaatcgttttgtttcttggttttttatgtgacctagttttgatgctccggttagcatccatgctaatagttcagttagtgtgaagtgaattgtttcggtgaaccccgcaaaaaaaaaaagaattgtttcggtgaagatggtagattcagtcatgaattgtttcggtgaaccccgcaaaaaaaaagaattgtttcggtgaagatggtagattcagtcatccagacagtggtcctgtttggatccaaaggatattttttaggcctccctcaaatagtccaaatagctcaaaaagatccaaaagggtgagctatttgagggctatttggaaatagcccacccaaaaaaactatcccacccaaagagtgctaattggggctatttcaggtggggttcattgaaaaagtgtcttttatctctatctctctccatgagaaggtacattaaaagccaaatagctcttaaaatagcccttgaatccaaacaacttagggctattttattggaggactattttttttgctaaaaaatagctctcaaaataactctagactagttctccaaatagggccagtgtttgtttacaagtgttttgcactactgcaatgagatacagtacaacatgagctggttttagatgggtctactgaagtgcctgaaagataagacatttttattcttgagtaaagtgtactggcgttgtgtgggtgtgtcaactagttccctgaactctcaaaatgaatttttaggtccctcaacttgtcttgggtgtcacgtaggtccaaatgtgtttcaacctgctccgtgtgctgacgtggcatgccatggtggcgcctacgtgtaagtagaacccatatatcagccacatatagaaaaaaaataagaacatatttttttctcctctcttttttcatttatttttcaaaattaacacatcattttctcctctctttttaaattttattttttttctacatgattgacatgtggatcgcactgacatgtaagcgtcgctgtggcatgccacgtcatctcacggagcgggttggagcccgtttggacctatatgacacacatgacaagtttggggaccaaaaaatatattttgagagtttaaggatctagataacacatttgtacaagtttaagaaccgtccgtacacttcactctttattcttgcttactgtttggttttcttccctatggatgtaatgacacgctgacaggaatgaagacagtatatgatacctagcctctgtgttttcaacttctgcttgtggcagctgctaaattttcattcatctgactgtgtgaaggtaacagcttaaataaactccatttcacctgatatacagaaaaaacgtagcaaccagcaaaacagatgggcgggtaaaatgggagtagttaagtaaatcaatacatttgtcaatacacatgcacatttctagatatcaaagaagccaagacttcaaaggagacaaactttaagtaattactctaataattaacgatgaattacaatctttaagtaactacaagagctcgcatggaattcatgaaaattctacaccaatagtttcatttcagtacaatcaattttttgaaaaggctttcagtagtatcaatagtactaatcacttttgttgcaacaagtttcttgattatcactcgcaatcagacactaattaatcaacctagaggcttaattaatttttaaattttggcgggctttgcacccgaagaaggtgaaggatttcatttgttgggggcagctgatcagtccttggtaatggcggggatgcagctggagctcctggtgaggccgccatggccgtggtccctcgggctgttggacctcgacctcttgcggaggatctccctcatggcctccgtctgcatcagcaccgggttggcgcgccccacgcggttgaaccgcccgcacaccgccatgtgcgccgccagcgcctcctccgccgtcgccgtcgtccacccggtgccgccgtggcggcatctcctgtcggcctcggcgctcgccgcggcggcgcacaggccgcacacccaccgcccgcagtagcgctcccggacgcggcgcgcgtactccggcgtgcactcctcctgcatgccgcagcactcgcaccgcgcctcctccaccaccacctgctgctgctccgtgatctccggcagcttctcgccgccgccgccgccgccggctgccgcgtccgccacctgctgcttcttggtgagctccagggccaggtcggacatggcgcgctggagcccctccatcgagatcctccgcggcttctccgcccgcttccccctcgccaccgccggcgccggcgccggcgccgccgcagccgccgccactgcgccttccccgtttggcgccatcatccactaccactagtatgatttctagctgcaaaacgaatgctcaatttgctactcgatcagatgctgatgagctgactgattactaccgacgagtgagtatgaaccgaattcaatgtggagaagaaggtgatatcgatgagctatatatacactggccgtgcacgggaaagcgagcgagcgcggatcagattgcgtacgtcggcgtggatgatgagcccgtgacatgatcgacgaggaacggagcgagctggaaaaagaagggaggggaaagagggagaggtcgcttgaatgccctagattactctcactctcaggctctcagcatccattggctaattaagatcatatcgaacaatgggcaatgactaactcaattggccatgcagtgtcaccgagattgctgcgtgtttggacgcctagctcgtgctcgtgagctagatgctaaagtagatgctcgagttttcttggccacgagtaatcagaagaactcctgtgtccatcgatctgtgtggttacaaccttgattaattaattaattgcgtaaattaatggagtacaaaattaatcggtcactgcaaaattttagttgtgtgtcatactctcatcttctttcttcccacggtatatatatatagatctatctggccgattgtgttgtataaaaaaaaactctttttcttctaatatattggcgtgcaatatttttgcgcgttaaaaaaaatgtgccacactatcgtctctatgatcattcatggatagatgaatatatagatggcgcacgcgtgaaccacgttgtgtgtcaatctcgatctctaaacagcgagcgagcatgcaggtgccgtgtccatccatatgccgcgcgcgacgccgtccacaactccacaagcttccgctactacgatacccatcaagtccatcaccacctcgcgcgctgcgcgcatgtgtccgtcgtccgtccactcccaactcccaaccagctagcggccgccgcgcccgcgcgcgccggacgtccgcttcgccgcgtgattgcgtcaatgattattgcgccgcgcgcgcgcgcgctttccctggctgcacgagcgccgcgcgccgggcggggcggtcacgagatgtctgggcgagggcgagggcgagacgcgctggcttttcgattgtacctgccgccgatggcctcgatcgcacgcggaggtgcgatgcctttggctgggccgtgttcaatgagccgttctcttggcccagcaaaggaataagttcactttgtgacccttaaaaatgatcgaaatctaaaccgtgaccctaaaccataaaaccagatatctcaacccccaactcttaaaaccggtgcaatttgactccctcggtggttttggagggcggtttcgctgacgtggcgcatacgtggcattattgactcggtcttctttgcacgtagcgttgaagtggcgcttaggtggcattagaaataaaaaaatgtgtgggacccatttgtcatccactaaaagtatgggtgggacccactgacatgtggggcccacataaaccatgttctcctcatcctccctctctttctt

SEQ ID NO: 44648 - DNA, 2457 bp, Oryza sativa
ctcagccacgacgactgtggcggtgaccgcgagcccgttggcatggaggacaccgtccacgccgcgtccctcatcgtaccggggcgcccactcgcgtccgtgacaagttacctggcggcgcggtcgaggcaggaggtgcgggagatggtggccgcgctggagagccacggcgccgagcagctgaagcagctgtaggttcccgggctggccaccgccatggagcaggcgcagcggctgttggagatgttcgccgccgacgaggaggaggtgaccaggaagaagctgaagcgcgcgagcgactcgccgccgggaggcgcggatgaacagcacacgaagcagagcaaggtggtcggggttgatggcgtcgtcaaggcttcttgacgcattgtcccctgcttctgatctctattctcactgatcaatgtgttattactagttgtcatcaactgtaaacctctgattttgtcatcaattgtaaatctcttttgtaaacctctgatcaatgtgttgtcaaatttgtaaaccaccgacagcgtcatcgtggccatgtcgaacttgacgatgctggtgttgttgtcgcagaggaagtagagcgcgttctccacgaggacgcttggccttcttgcctggatgaagtcgtcggggtggtgatcaatggaggccgggctgctccatgcctcggtctccgacgagtaaagggcggcgtgcgtggttcccgcggcgtcgatgtccaccagcgccacgcggaaggggttgccgccgtggcagtcgagatggttgcagccgtccacggcgcagagcaccgtcgcgctccacggcgtgaacatccagtgctgcggcgcgctcgagttgatgttcctccagcactccgccgccgccgctggcccccgtctctcagtcgccgctcgccgaagagaaaaaagagagggaggatgaggagaacatggtttatgtgggcctcacatgttactgggtcccatccatactaaaatgacaaatgggtcccacacattttttttatttctaatgccacctaagcgccacatcaacgccacgtgcaaaaaaaaaaaacctagtcaatactgccacgtaggcgccacgtcagcgaaaccgcactctaaaatcactgaggaagttaaattgcaccggttttaagagttgggggattgagatatccggttttgtggtttagagtcacgggttagatttcaatcacatttaaaggtcacagagtgaacttattccccagcaaataatcgctctcggccttcgtagttcgtagttggccttgtgacttttcctcacttctcgatcacacggcccatctgtaaatgcttttgagtttggtaggaagaataataatagcagcagcagcatcaacaatcatactcgtaaatcgtactaataagcataaacagcaataagttgatatgacacgttatatattgattcatactccctccgtttcagtcactcggtttgaggttacaaggcgtttgacattggacaaagttaaattgctttaagtttataatactatattaatttcgtcaaatcaataattacatatatttttatcataaatttattttgggttaaaaatattattacttttctttataaacttagtcaaactttaaacagttagtcaagacgtcctatgacctggaacggaggaagcagttaagatacgtaacttttcacgttaagatttgggacataaggagtactctttttttttttatgttgcaagcttacaatcgaccagccgcaatttgctgtagtttttaaacttcatgtaaactttgcgcaagcatgtatggatcgttcattcgttttatgtgtccgaggcattattggctgtggcatagtttagttcctaattttttcttcgaactttcaatttttccatcacatcaaaacttttctacgcacaaacttacaacttttccgttacatcgttccaatttcaattaaactttcaattttggcgttaactaaacacaccctgtgtttctatgagtgagttggaaacatagtgattaattagcacataattaattaagtattagctattttttaaaaaataaattaatatgatttttcagaaaatacatggtttaataatttaagaaaggtgaatgtggaaaatgagtgaagttgaaaagattgagtaaagaagacagcctgtgtgtacaggtacaatactatccagcaaataaaaaaatatatttttaaaaaggagaaaatctccaaagaaaaaagcagagatgcctttagcacagcgctagagtagacagacgcgtcgctttcctccgccgccgccgcctcctcctccgctccgcgcggccgtctcccacctctcgcgcctcacctcctcctcctcctaaaccctcgctaaaccctagcctcccacccccccaccccaccggggagcatgcactccaggctcctcag

SEQ ID NO: 44649 - DNA, 4926 bp, Oryza sativa
ttaaatttaaaaaaacaaaacaagaaactaatgtttggtcgcgggctaaacgtgggcattgctggatggatagatcatagatggatctttccgtggtacgttcgtcgttggctggctgcgcggcggctggaaaacggaaaggaggagcaaaggtaggaggagagacgcctgaaaaagatcaaaaaaaaggaggaaaaagaaaaagaaaaaagctcgagctaagctaggcgacgcccatggcgagttggcgaacagcttgcagcgagctttgctttgctttgctttaatccaataatgccggtggtttcagatctcgcagccgcccctccccagagctcagagctctcacgtgtgtacgcgatgatcgtacgcgcgtactcatcacgtacgtgttcacctccatctccatggaaacgcagagagagaggagaagaagagagagaagattcagaaaagaaagtggaaaaggctatggtctggtctggttaggcatgcagtctcctcctttcttcttcctcgtcgatctctccgtcttttctttgtgtttgtggagaaagagagtgccatccatggcggctcgtgtccttctccttccttggtagtagtacacagtgcagtgcagaggtgtgggatattcggtgtagaggaatattctcgtgctagaatgtgattttcctataaatcatagtattaattccatattcccattaatcaccctgcaactgcaagtatgcaatcataagaaaacgggagatgggtaagaattctcaaaggtgtttctgcttgaccagcactgcaaaacggacacttcgtataagcccaatgatcacgcaatgtaccttttagaaaaagtccaccttgactcccttaaatatcggccgaatctaatctacaaccctgaaccgcaaaaccggataggacaactcccaaactattaaaaccggtgcaatttgactccctcgacggatttggagggcggtttcgctgacgtgccacatacgtgacgatattgacctggtcttcttccacgtggcgttgacgtggcggttaggtggcactcgaatttaaaaaatacgtgtgggacccatttgtcattgacaaaaaaaaatgtggggcccacgtgtcaccctctctcttccctccttcctcatccctctcccttctctctctttctctcctcacgccggcgacatggagccccgactccacctcgccaccgtcgatgccccggcgtcatctaccaccgaagccgccgtcttcatccgcccaagccgtcgtcatcaccacacccgagcccagctcgagctcgtcgccgaaccgccgccgccacgcacaaccaagtcggctgcgcgggcgccgcctccgcgcacgaccgagccggccgcacgagcacgacccgcagcggccaccttcccgtgtcgcctcttcccctcccgtcgtgcaccatccggccgggccacccgacaccgcctgggccgcctccagggcgccttcgcgttgcatcaaccgccgcctagcctcagcgccgcgctgcgccgtcgccggcgaactaggcggatgaggggcggagggccgtcctctctcccccttttctatctctctttctcctccctttctcttcttctgcggggagggccgggggatggggtggtggaaagggaggcgccggcggggggagggaggtgacgctgaggctgggcgatggttggccctgcgcgacggcccgggcggcgtcgggtggaggcggtccgccgctgcgctttgcgtacgcctctcaacctcaaccgccggcgccaacatctctcagcaagggcgcggcagcaagggcccgacggcgagggcgttggctctcgggccgcctcctccgttgccgtcctcctcgtcgaccaccccgccgccggcgccaacatctctgccccaccacacgccgtcctccttgtcgtccatggccgccgggagagaggggggagaggagacaggccttcacgccgcctccggatctccgtgccctacctccgcaccgccgccgggagagagagtggggaagttgccgccggatgaggagaatgggagaagggaagagtagttggagagagggggatgacatgtgggtcccaaaataatatttttgtgtgttaataacatatggtcccactgatttttttaattcctatgccacataagcgccacgtgggactaagaccaggtcaacaccgccacgtcagtaaaaccaccctccaaaatcactggaggagtcaaattgcactggtttcaatagttcaggagtcattctatccgatttttttttgttgaggggtacaaattagatttcgccgatatttaagggagtcaaggtggactttctccgtaccttttcccctgctcaagttggactccattcttgtgaggttctttgggccttaaccatcaaagcccattcctggaaaactgggcctctccctttaaggcccacttgaacggtacacacttccgttctccaattcgttctcaaatctcctttatatgtgtacttcctgagtttaaaatagaagatgacaaatgcaattgcattcgatctagaacagtggacgccgaagaaatgcaagattttcgccaaatagggtgtggatgtctaataacaaactagcaatctgtggctggccaaataatacctaatgcttgctttgccgtcatatccaaagacgtcctatcacctcctattaaaatgcagatacacgagaaaaatatgggacatgatctcaacatggacctcacttgagcaaatcaaaacgacgatacggtgtacaactacgatggtcatggtgcacgactttggccacctttaagggacaaaaaaaaaaaaagttcgcaccatcgtcctattaacgacgtgataaatttaaaaggagagaaaccatatactccctccatctacttttgatagtcatatttccaaatctaaaaattttatttttgataggcatatttcaatccaacaacttatcatcttaatgactttcttggatttaatgcatgactcttcattcttctacacgtgattggctacatgggcattgagacatgtaaatattaatgaatcgcttgtttacgaggaatgactagtagcatatttaaatggatgataagtagaattacttatccttgttctgtgtgccaagataaaaatataactatcaaaagtagatggagagagtattattctaacacagaactcccgaagatccttagaggtgaaaatcaaggagaccaaaacttgggtattaggagcaaaagacgcataccttatcttttttttttcttattatttgtacaacaacttgtactcctactatttccaatgaaattgacaccctctaattaaataccggttcattaaaaatagttgcttcgaattggtacaatttaagcacgaagagatcgactaaaaggagcatgtagcaactaagattcaacgatcagagggagaaaaaattggtaaaatgtaagagagagagagagagagagaggatgaaatggcagagatgatcaacgtcaaggcaacagggagacctcacctcaccaaatatgtaacgctcctgatcgcacaagattcaacagtttgctcgtttgatttggacgccggcgaaggcgaaatgctttcgaccaagcgtaccatgcatctttcaatcaactcacatatatgtgtcttcgattgctttgattgatatgatgatcaacccggcaattcgacctctaatcctctatattctctttcgttctatttgatcaatttcacttgagaactaattaattttccctcaaaaaaaaattaatttgttaatcaacatgtatatacttcctccatcagataaaaaaaaccaaaagggcattaatgagcaaggacattatcatacgtattgccgaccttgccgttgatgcgtcatttgcatcaagatcctatcgtccttgctgtatagatttagaacaattctatgactcttttccctaattgaagataaacaggcaagttgatcattaacgattaattcgataagacttatcgaaaccaaccagaagtaccaccacaactgcctcttgttttcgatatataatatatctatatagagggagatagggatatcgcaacgtgcgtgacaactgtgttctttaaactcgtaccaagtcatatatatatatgtacttatgttgtacatcagctcaagagaaaaagaagctagcaagcgatcctgtgcatctaagtcaacaaaatatgttgagattgacttatgggaatcactacatcaacttttactcccctatcaacaaatataagcattttttatgttttattagaaattaaattcacttgtaatctattatattattaagagaaccttgaaaagaatcattacttcattgtggagactagaaattcccacgttaaaagaaaaggatcttgtagattgcggtgggttccgataataacgatatagatggattaatatagttatatacaaaatacaattatatctatagagattcaatcctattgaaataaaatctaaaagttgtatataaaatccaaatcttatatatatgaaaatagaatctcggagttgtatatgaattgaactatatttctgcatataatggtttctatagaaataaaatttcagttgtatattaaatctaactctatgtgaattatatagctccgtgcaaaactgcacggggcaatcccctagttactttgatatttcaaaaactttatttgattagaggaattaaatcaagcctggcgatgcagtgttttgattggattggggaatgcattatattttagaaatgcttatatttataaataaattttaagaactataatcaatatatatgtacacttactctgttcatttcaaaataagttca

SEQ ID NO: 44650 - DNA, 701 bp, Oryza sativa
cggaactgaaattaaccgtcatttcacagctagatcaccggaaatttcagcgaaaacaatctggaaatttgaccgaaactgccaccagctacaagcctacaaccaaccaaaagaaaacgcttggagaagagacaaaagaagcctcttccaattccccaactcgaggagaacaaaacgccaccccaattccgaaacctgggatctctctccaccaagaaacaaaaatcccctaaaattcagaacgaaatgacgaataataatacagtaaaaatattcacaggaatcagacgagaataaaaaggtagtcctcttgcgtaaaagcagagccacaaaacgcccttcccccaccaatccaccaatgggagaagatcgattttaaaaaaattgaatcgatgtgtccaacaagaaaacgaaatcgccataagccaacaaaaaaaacaagccactgatcccctccacaacaatccaaaccactataccgaaggaaaaattgatcgccgaaccctccgtgctcacctcatctcggcggcggcggcggcgggcgcccagacgcggcagaagagcgcgttcctcctcgccccggggacgacgaacgtctcccaccgcctcgccccctccccgtccgcgtcctccaccatggccacctcctccgcgagcgccctcctccgccgcacgtcctccttctccgccgccctcctccg

SEQ ID NO: 44651 - DNA, 5063 bp, Oryza sativa
gacagatgaagtacatttcttgttttcttcttctctattctcttctttcattttattctctttcccgccgtccttgtaaactaaaaaaggcacattaatcaatgcagatccaatcatgaaacagtgacaaattaggaaccatgaaacataatggggacacttggtaacaatacaagagtttacaactcagaaaatggcactagtttctcagcaacaaattgacctgttggcaacctcatactggttactggatattgctttctaatttgcatataattacagtactattactagtaatccatttttttccgacaattctaaaaaaagcatgtgtgtcatccccatgccagttaacatgacccaaatcaccctaagttcatgtcttcaaaaaatctgttaccattgtttgtatgaagacattagagaactttgaccctaatggcatatcataaattgcagtaaccatctctacattatgtgtattcatcagcctaccactcgtattaaatccaaatagatccagcattgcaacaaaaggtaacttacggaaaaatcgatagcagcgcaaacccaaaacaataccctcttcagcaaccttatggtagtgttccaaataggtagacaaatcagtctcagtgtctgaagatatctccataaattttactacaaggacgttatcatcaccaagaactttctgaagatgagtcctcctattctcaatatatggtccctgcacccagccaatgttaaaaatataacgatggcaccttaagttccttacaaaataaattatcacagagtgcagcatttgttgattttggcgccttgacctttattgcaattagtctttatattagaacttccagaaaaatcttaggcagcttaagaaggatgcatgggtgatatacacctttatgtgaggggtagattcgcaaacagtcaacagcaatgaacatgaacattacacaatcatgactggtagataggagaacatcaaatagtaggccatctaaaaatatcatggttaaacaatgagcacgtataaaagtatcaaaagcaccacacaccttgaaaattttgacaactgtaccccctcttatctcaacattacaatggtagacttttgacatacctggaccagaatcaaggttctgcaagcattacatggagaataatttcatcaggctcaagttataacttataatagaggaaaaggaacaaatagtggaaaacagaaaaataaaatgttagcataatattctcataaggaaattgtgaatgaaaaacatgcacaattgtattgctagaaagatgtaaaagatataatggttgtggataacatgtcagccagcccagacttatcgtaggaaatgaattgtgacgtcccagcattctgaagaactggccactcaaaacctgggtacaaaaggtagtttttgttccatccatcatggtatgcagtgtcatatgattgtaatcaagtacccatttcaatttttttttgtagttattaagtaaaccaagtcgacatttaagttaggaggtacaagtcagaagtacatctagcaaacctggacactagaatcataatgaagaaagggtgatatctggaaggcatcagaagctgagagccaatgtgcactagagtaagcatgtattatgttatctacgcacatacaaaattcaaggacaatgacttgcgtaggtggttccatttacaatgatcatgatccaatatgaaaagggatcatcatgtttgatcatttttagagacctttagtgaaaattattaagagtactggtgttgcaataacctttgctctatctgaagatgatatattatcgtgaccaaatgtgctccagattcgtgactcaaattgagccatggacattgacttcaaggatctgatactgtccacggagaggacatcttctatcttactactttttggtgtagataatggaggctttactcctttcttattcctgtaacaaaaagagaaaatggtgtattagcaacagcataacacagataaaagccatattagccttagaaaatagtccatgttctgctataaaaacatctttgttctttattatgtaaaaagcataaaccgaagagaatctaaccaggaaagataagcaaaaatcataaatatcttcctgaactccaactctcccagcgctagcatctgagggctcactacctccctcaacacattggtcgtgtcaggacagattgctggaggaatttgcggcatcacccaaatgggacatggaggacttcctgaggggccagccatattctcgacacatcttgatagatcccgcacagggctcggggtggaaactctttctggagtagaaacgatcggctggatggggctgtcaatctccatatgtctctgcagcccagatggcatgcggtggccagggctaccaacctgcatcataacatcattaggcaaagcatgagccattggttgggtaggaaagttaatctgcacagccacctggttggacgcaggagaaaccattccacgggaaggcgtataaccttcaacgcagttctggttctgcagcagcacagaagatattccgaccatatgggctcccaactgctgggttagcaaggtccggaaccacacgagcaatatgtccgacagaaccgccattgtcatgcaaacggagcggcatctgttggttgggactcccaacctccaccatgtcgttgggtgtttgagcatccatttgaacctcattgtagtacagtggagtggatatagattcctctgtgtaaccacaagacttattagtaagaagtacttcacaatttaggatatgtataacagctacaaagaccttagaaagaaacaacatgcaaaccaaatcaaccataccaaatgggcgaaatgcaaaggtaaaaagaaaaaaaaatagaaaaatgccatcatactaagctgaaccaacgaggctaaaatcaaccggttaccaaaaccacgacttaagggtggcaaaattaaggagaaaaaaaatacgatcgacaagcattgaattcgaaaactgagcgtcaccattacagaatgttgctccctatcacaacttggcaagattctccaaatcgagagcaggaatcgatagcccaactaaaaacaaaaacaaaaaaaggaagatactcccttccgcctacgaaaagtgcattagcattaaacaggggcgtaggcgcaacaaaaaaaaaagagctgaaaaaatctcccaaacagtgcgggttttgcagccaaaaaaacacgctaaaacgcactgccataggaagcacaaacgcagctaatcctcctctgcgaccatccattaagattaaaattcaaaaagggttttcctcacaaaaaaaaaacgaaatgggcggtgaacaaaatattggcctcgcatgagaaaaaaagagtcggtgaacaaaaaatgccaagcagcaaaccccctcaccttcgcggcaggggccggagatgcatgcggcgctgtgggcggtggggatgccccgcgcgttgcgcttcatcctctcctggttcgccatgtgcctgatgaagccggagagcgtacggacctggcgcgcctccccaatcgcccggagcacccgcgccgccgccggctcgccgagctccgcgagctgccgccgcgcctccgcgcaggcgagctggcccagcctcgcctccagccgctccagctccgcgccgaccgccgccgggagcgccggctcgcgcatttggttcccaccgccgtggggattcatggttgagagggtttagggtttaaggcggccacacacacccacccacgccgcgccgcgcctctccgcggcggtggagatcgaacgaggaatcgatcggtttggaggtttggagcgaggaaatttggaaaaggaggagaaggcgcgagcggggtcacgctggggggccaggaggaggaggaggtggtggggggggcccacatggcagtgggtgtgggaggtggattgattgtggggggtgactgggaggcgaggtactcaactgtgactactccctggcacggccacgtgtcgcgcttcggagggcggtgccgaatgtgggacccaggtaccagagagtggaggattgattccttttggttgcttggactggagtatggagtacacttccggcctccctgtgctagtgcgcttctgcggcagaatcggcagatgcagtgacgcgtcaaaagttactagctagccatctcatccgaagttccaaactatagcatccaaagcccttgtgtaggccatgtttttcaaactttttcaaacttagaacttttcatcacattacatcatatccaaaactttcctacacacataaactctaaccttttttttccaaactaccaacttttccaaacttctccctaatttcagaaactaaacacagccttagttccaaactttttttttcaaactttcaacttttacatcacatcaaaactttcatacacataaattttcaacttttttatcatattattccaatttcgaccaaacttctaattttagtttgaacttatctctgtagtggtagtaggaggggtagtactcctagtagtaatgaaaaaaaaaagtaaatttcaaaaaaactacaaccgtaacaaaagtaacattagtaatatatatttcaatttattgtaacgttaatatatgaaaaattatcacaaaactgtaatttttacgtggtatgcaacaataaaatatgtaggtgacaacagtatgcttgtgacatgtaaaaattacaattttatgataaattttcacgctattgttgtaacaaaccgataattttctcactatagttgtcattttctgaaaattactctaatgaaaacaaccaaggatacccgtttgaccgggagttttgtttttgcaatttaaatggcatataaaacaagatatgctatatcgtatgattaataaaatattaattattacaattaaaaatatgtatttgaatttttaaaaactatacaaatttctttaagaaaatgtacattttagcactttaaaa

SEQ ID NO: 44652 - DNA, 1643 bp, Oryza sativa
  unsure (1)..(1643): unsure at all n locations
nnnnnnnnnnnnnnnnnnnnnnnnnnnnnnnnnnnnnnnnnnnnnnnnnnnnnnnnnnctgagtcatttaccgtctaagcacaaggttttctcatttgtgtgtaccattaaatcactgatgacttaaaactagaaggtcacgagcttggtagttgaagcgtggcacagccaaactaaattaaactaacaaccataagaaaattatgtttgtgagtaaagcaataagctctcacatcgacccatcagagaggggtggttgcaaaagtactttccttgtctttttcttatttaaaaaagtgtcaagtttgatattatattatataggtagtctatgtatatgaaatactccatagtgttacctttgtccattgcagaacatgatatcaaaaacaaacacacaaatgtctacctgcaaagtagtcaaaatatagtcagataaaaaagacacagttacaaaaaaaaaagatggattagtaagcatattatgcattcctaataggtactgccactaactatttgtctatccacacactttctttcaactttcatcacaggcatttcagtgcaaatgaacatcctctatgctaggaaaactgattcatgctatgaactatgaaccacaaaaaaaatatacgtatttgtggaactgtaggaatatctaccacagaagttgaaattttgtcaactacatatctgattattttagtgataagtaataagcactgaaaaaacccggtaactgcaaagggacttgttcattcaattaaagttgttggtgacaaacataaacaattgagtacaaatttctttgattatgtttccttgtgaaattctataattataggaattcatcatgcaaaaatattgcccgaaaataatgttcaagattccaaagtaacaagcacaatactttgtaaataaaagaataatggcatcacctttatgttctgaattgcaattgaggagtgcttgctccctctctctcttgaagacagctcttggaatgacatcagtttgtttcctttcttcctatcgattcccacaaccttgttttgaatgcacaagcacaagaaacacaagcctaaggtgaaggagtgttatattatgaagaaacaaacaaatgtgagttcctcacgaacaaaacttacctcggcgtcaagtataaagctggatacttcgatgctgcacagctctttgatcatgccaaccagatcaggaaatcgagaggttgactctttcatttgccttgaaaatatttgcacagatccatcatttgatctgtgaatctgggctcgctgaccatcatacctggaagcaacattaataaatagagtgcaattatttggcaggaaagatatgcttgctaagtcaaaattcctacaaactggagatatttaagaagttgataaggggtcatgcaagaaaaggtttgaacttcttatgttaatcatagatatagatttcagattttactaagaagagtagacgacttcttatgaaattcaagctcaacaactagcatgagaatagggaagctactcatccattctttcttccttcatgatccacggttgtcataattcctcaaatataatccattagtttgcttaagaaagagtagagtcagaatagggctgcaggaa

SEQ ID NO: 44653 - DNA, 2880 bp, Oryza sativa
aactccagatgttgatagcgtatgtaagttagtcaggaataccttagtttgcgaagtgtggaaaacacatcgcgaattgagaggggacgaggaggagcaagtaacatttgattctggcggcattcttgggcaacatcacctacaaattacactacatccactgttaacactacacaggatcatttcagcataattaaccagtacatgaagctaaacaaggcagttggacctggccgtaagcctgccaaatgttgcatgcatgcatcaaactcctattttgcaaagacacagcctacaccatacagtaattttttccccacaccatggacatcaacaatgctggtacttctaacctccaaacttaccaagatcgccgaacgttttgtacatctcatgtattttagatctgctggatcctaatgcctcctccagagcagatacaaccaaactcccaccaatgtttagttcctagcttcattaacaaatatgggttattgtattgattgtgccacacgacaaggcataacagaagggtaaaccaaaatatttataataggacatgacacagttactcattagaaaataatgaaagaaagaaagccttccaaaggaaagggccagctaattaagaaaatttcaacttaagaaaaagaatcaacttatcctaattgaaatgctgctagaaaatttcagcctgttggaacatagtatcctcacagggattttgtaggacacctacatccatgttcctccaggaagtcccatatttcaaataaagctttagaaagaagcaaagagcagtaaatagggggaagggaaaagtgaatgaaataaaacacttacaatattttcatggtcaggagaaattttattagtacataaataaacagcaggtagcacatcatcaggtgataaggcaagcaaactgcacttgagaatataagatgttaagtatattccccaatcataaacatatagatgataatcaaaaactgcacgcaatgtaacttagagggttataggaaaaaccttcggaacatgttgcaaagcatggcagtagttttgatctttcccttttctctttcaaccagatcaaaagtgcgagccaaatgtaagtatggtgcaggctgtcctgctgtccagcaagctgtagaagatcacatacatggtattactcactgtcaagcaagatgctaagaaccataaggagggtaggcactaaccatgctcgatcggtagatacttttcaattggcaatgatatacagactgaatctgcttgtgccacataagattgtacacataagttcggcatctttggagtggcctcagaagagttgcgaagcaagcccgtactactagatttgtctgtcatttcattttctgtgttttgtgtgacaatattcatatcattttcaagtacattactgttgtcggttttactgtaaaatatatcaactgctacattcacatccccttttgccttctcaagcaatgaaattgcagactctctggacattccaccatcgacaatctgaagaagctggcttacactctgcttctctgactctacaacttcagtaaactggtcgtcattcctcacattgttttgatttgcgtctacagttactttatcggatgtatcgcttttagaagcagctagcatggttctagcaaaatagttcgtaattgtggactgtttgcgcccactggattctgtcaagggtttaaaggcagttgaccgccctttcttttttggtttgtccgcagaattagagcccctcttcctttcccttttagaaagatttgacttcattctcatagcgttcaaattcagcaacttactagaatgatccatgggcttctgtgaaaataaaggaacttcttgctgactacttgcatcagcagaagatccatgatcagaagagagatctatctctgacttaggcgtttcactattataaacatttgcttcctcaaagaaatctctttctttctcaaaaaaatcagttgctgcttgaacaacatcaccgcctgacttaattagcaagtccaggatcaggtcctggctgacccatgagggtaggaaatctgataattctttcttcatttccactgtaatcttctcttgaaaactatctgatcgttcaaaagccaaacttgcaggtaacaaagtagcctcctccagttcttgcacctccccttcttgctggctcaatccagtaactgcatcctcagggccaagagtagcatttcttgagcttcggtggaatgccatcaggaactcctgtttgtttgctgtctcatccaccaaaccagcaaaatgcttctgcagagcaaatgcctctttactatcgagctttccaccatcaagccccacggttggaattacccgttttgggtgcaagaacttcacgtagtcccgcaactcattatagctcgagtgctcgctataaggcacaagatggatctcaagtgaatcctttgttctaactgcaaagccttccttcttggtctcgtacatccaaccggtcggtacaaatccaacagccttgttatatcctctctccaccatgatctccttcatcttcacaaaatttggccgaaaatagggccatgtttcacctaaaatattccacccagtgacatgcacatctgttgctgcagcatcctcagtaaaaactccatcctccccaccaatccccaatagagtcaggatttccatcttcctactgtccacatggatcttacagccacagcgtcgtgcaacttccagcaaaatcctctccttgcccaccacgtaggtcgcgatcaaacacagcacgcgctctccagatgctctgctctcctccttcacccgcttgattgagttcacgacata

SEQ ID NO: 44654 - DNA, 2146 bp, Oryza sativa
ccaccccaccccaccctcccccttcttccttattccccagcccgacccgatctccaaacccctaccaccattccccgcagcgcggagccgccgccactcccccccaccctcaccccgcagaccattcggaaaacctagatccgagccttcccccttcccctcccccggcggcggcggccatggcgacccgccgggccctcacctccgtcctccgctccgcctcccgcctccgcgccgcctccccttccccgtgcccgcgccgcgcgccgctccacccccaccgccgcccgtcccccgcgggcttcctcctgaaccgcgccgccgccgcctacgcgtcgtccgccgcggcgcaggcggcccccgcgcctccccccgcgtcgggcaaggccaccgggggcggcaagatcaccgatgagttcacgggcgctggcgccgtcgggcaggtgtgccaggtgattggcgccgtcgtggacgtgcggttcgacgagggcctgcccccgatcctgaccgcgctggaggtgctcgaccacaacatccgcctcgtgctcgaggtggcgcagcatctcggggagaacatggtgcgcaccatcgccatggacgggaccgaggggctcgttcgcggccagcgcgtgctcaacaccggctctcccatcactgtaatgccctcccccctcttgttccttgtccatcactatgtttggaactgtttatttggatctagtctgacgaaatgacggaccagtagtcggtagatttgatctagatgtacggatccgtgtattgattagggcaggctcaccttacagatccgcgactatagtttgttaatgaatccatgcactgatttagtgcggattcacatatcaaatgccaaatggcgaggccacaaatggaatttgactcttacgaacataattatgcaatacattttctatgttcaaatgctgccccgtagattcatttttccagtccagtcatgccatctggagatggagaaaacatttaccgttggataatttggtaaaggtactgaatgcccttatgggccttttccttttcgtctctatggtcccagaatcacacaaatcaaggaggggccttttgtcttttgggtgtaggggctttatgaagggagggttgagagaaaatgcatgtgacccaatgtaggttcccaatctcaaaatgtgctatgggataacgggaagtccaaaaatgtttcttttaaaataaagttaaagttatcatgtgaagttgaaagttatatttgttttcctgagaaacttaggaagcttaagattaggtgatgggggttgaccctttttttttttgttttgcttacagatattgtggtttgctgattataagttctgtcactctgtgcggcttataatgtgtgtcaaactaaagatcatttgttatttacctgtgacaaaaggctatatatattgtccttgaactttgatgttgtaatgtcagtataaccatctttgatctaaaccatgttctttatatttctttgttttgtctgttttaggttcctgttggtagggccacacttgggcgtattatgaatgtcatcggtgagcctattgatgagaagggagatatcagtaagtctaaatgatatccatttgtatattgtaggtgtatgcatacatactatattttcttccttatgatctttagttattgattacctttctttgccacagcaacaaaccacttcctccctatccatcgtgaagcccctgcttttgttgagcaagctacagagcaacagattcttgttactggaattaaggtacactaatttctgtctcttctgaaatgattttcttaaaccctgtgtctttttaaatttcctagttggttaggtttcttaattgtcaagaggcgttcctttttgtaccattttgtcttacacaaggattgcacatttatcaggtcgtggatctccttgcaccctatcaaagaggtggtaaaattggtctcttcggtggtgctggggtgggcaaaactgtacttattatggagttgatcaacaatgttgcgaaggctcatggtttgctttctacagagcttgatggtcatatccaaagtcttgtgctgtgcattgccttatctggttgacctgtttattttaggt

SEQ ID NO: 44655 - DNA, 11979 bp, Oryza sativa
ttttgactgttgttatttattcccctttggaacaacatttccacagtagagtttttggctgcaagttacaatgtttaggctatcgtgattatttagatacaagaagagagcagggttttagtatttaagttggaacttggagatcatgtgacaagaactgtggttcatgagatgaactcatctgttatggtcatagaacataaattaaaacctgatgtggcataaaaatcaatttacctgctatttagctatgctaacttgacaatatttgtcaagccctgtatcatcttccttttcctaagtcaatggttacgtggctacaatatagtactccgcaaggcagcagcatattgttgcagtgtaacaagtaatagaaagtagaagtgctaacattactcttgtgaactcgtgtcaaacattaccagtacatctggccattttcttattagtgaagagatatagtttttatgacagccaaaaatgcgtctaaaaagcaatatgttttgttatccttgtttctcatggtgcattatctttgtcctcgggggtcttacaaaatcatcactccaatgtctactctttttttccaccagtcatatgatcatgactcttatcttgtgctgtctgcatttctaccgagtaatgaattttctcaacatgtcacagggtgtattggacgggaagtatgatgaccttcctgagcagtcattctacatggttggaggaatcgatgaggtcattgccaaggcagagaagattgccaaggagtccgcttcataagcgatgcaatttttaacatttggaggtcaacatgttgtgccttttatgtttgttagccaggacatgtacttacatgcaggaggcccggccctgctgatcgatgtttttcccctccacttttttccaaataaggatttgcagtgacctatttgtttggcttactgcccttcaaggaagaattgagttctctttttgtgtgatgtgcggccagtccggcagtccgtgaacttgttacttgctgaaaacactgaaatattggtctcccatacagcacctctgtgaaaactcctcatttatacttccaacatgttttgagagccgatataagccgtgtttcgattcaaaattttttcttcaaaccttctatttttccgtcacatcaaatgtttggacacatgtatggagcattaaatgttgacgaaaaaaataattgcacagtttgcatgtaaatcgcgagacaaattttttaagtctaattacatcatgatttgatgatggattaattatgcttaataaatttgtctcgcagtttacatgcggaatctataatttattttgttatttgtctacatttaatactttaaatgtgttaaaaaaaattttggcacacgaactaaacacagccatagagcatatcattgaggtttctagctgttccgaatcctcttcgagtttcgttttcagcgtaatttgtatggttctattaacctgcaatttcgaaatttcgatgttcattttttatcgcctcgccttgcatattttccatgtcgcctatatagttaacatcttcggtgaaatattgctctttttttaagaagccttcctgaaatattgcacttgtaatacgtagcgataattttcgcataaccagcttatattttgtagcttaacgtgagacagaggttaacgggcctacaaatttcgcgtttaacacctggctagcaaacaatgggccccacctgtcagtacaccgtgtcccgtctcccacgtgtcccattcgcatccgatttggcaatctcctgcgcccagaaggccggaacagctcaatcgcgaccgcccaattcaaaacgtaggcccggagatgcgatcgctgcggggagccggcccaataaaggctccctcgctaacgtctctctgccgctgtccccttctccggatcccttcgaattctgaaatccccaaattcttctccgcctctcctcccctccccctacagtatttcaaaatatttcaaatcacactacactctccgtcgtctcctctcctctcctctcctccccctctcctccgcctctctcgcatctgaggctccgatcgccggcgaccccagccagaatccgccgccccgtctcgccctccccgctcgacgagaccgcgccgagcggcgaagaggtaagcccccaactcgcctgcggttttctcgggcccgaaaccctaggcttagtcgcgatcccggcgggttactgacgcgcgctgcggcggcggcggtagcggcgcggcgggtgtctcgctgaggaggttggatttgatatctgtgactgctctgcaggcctagtgttcttcgcacctcgcgatgagtagcgcggtgaaggaccagcttcaccagatgtcgacgacatgcgattcgcttctactggagctcaatgtatgtcaccgcttgccgattcaaccatttcccggctactcgtgttggttctggcatggcagtggaggatttacggggtttttttcttctctcgttctgtttcaggtgatttgggatgaggtcggtgagcccgacacgacgagggacaggatgctgctggagctcgagcaggagtgcctggaggtctacaggcggaaggtcgaccaggcgaaccggagccgcgcccagctgcggaaggccatcgccgagggcgaggcagagctcgccggcatctgctcagccatgggcgagccgcccgtgcacgttagacaggttagtttctggctccaccaatggctgtaaaagaggtatcgcatggttggatcaaaagatggaagtcgaattcctgtggaactgtgctaattggcgatggaagaaaaggaagatttagtagagaactaaaagctacgatttctgttgtaagatgatagtactactgcttgcattgttgatctgatggaggtaaaccgtgtagaactccatcagcagttaacatttttctaactgattagtagtagcgtatcaatatattaagggaaagtgttggcagagcttacatttctttctcacttctattctcgactttatgcccagttactgctcaatcggttctatactttttactgctgttcccatgcattagcaatttaggatatatgttttgtaaaatttatctgtttccttcagtttgaatatgttcagcatgaataatatatttactgttttaccggcagcatgactaagttactgcctcaagtacgttttatttgttgaatacattctaccttcttgactaatcaattctgcttgactgtagattttagcacttcctcagccattcatgcagtaacatgcatttcatctgaaattttgcagtcaaatcagaagcttcatggcttaagagaggagttgaatgcaattgttccgtatttggaagaaatgaaaaagaaaaaggtcgaacgatggaaccagtttgttcatgtcatagagcagattaagaaaatttcgtctgaaataaggccagccgattttgttccctttaaagttccggttgatcagtctgacctgtcattaagaaagcttgatgagttgacgaaggacctggaatcccttcagaaggagaaggtcatcatcactaataccatctttatccattttcaccagtcatgttgtcatcgtgtctctatctatcaagaatccttttcatttcttgtataaaatctcactatgccatatacatgtttgtttctcacagagcgatcggctaaagcaagtgatagaacatttgaattctttgcattccttatgtgaggtgcttggcatagatttcaagcaaacagtatatgaggtgcaccctagcttggacgaagctgaaggatcaaagaacctgagcaacactacaattgagaggcttgctgctgccgcaaacagactgcgtgaaatgaagatccaaaggatgcaaaaggtcagcattgcctgtaccattgtagaggtatcaatgaacactttcagtctttaacttggttaatctgattctggcagcttcaagattttgcttctagcatgctcgagctatggaatctcatggatactccacttgaagagcagcagatgtttcagaatataacatgcaatattgctgcttcagaacaagagataactgaaccaaacaccctctccacagatttcctgaattatgtaatttatcatcactgagattgcaaaaatttatgttcgtactgtgttatatttttattaagatatgaatgttcatcgactatacttataactgtaggtcgaatctgaggtgttaaggcttgaacaactgaaagcaagtaagatgaaagatcttgttttaaaaaagaaagcagaactagaagagcatagaagacgtgctcatcttgttggcgaggaaggttatgcagaggagtttagcattgaagctattgaagctggtaagatactctcctgccttactgccttttattgtgcctgacaattgtcataccagacagagttcatatacctggtctgtgttctgttcgcaggagctattgatccctcactagtacttgaacaaattgaagctcacattgcaacagtgaaagaggaagcttttagccggaaggatattcttgagaaagttgaaagatggcaaaatgcttgtgaagaggaagcctggctggaagattacaacaaagtatggatgctagctgaagctacgtggtctttgtatatttgtttagcaaataatgtggtactgatatttcctggctttggctttttttaggatgataatcgttacaatgctgggaggggagcacatctaacactaaagagggctgaaaaggctcgtactttggtcaacaagattcctggtaatgttactcaatgatttatgtgtttggaacttccttatcaagtgcatatttaatttacaattttaactcttgccattactacaatctgatatcctgctgatttgtgctgagcaggaatggtagatgttttgagaacaaaaattgctgcatggaaaaatgaacgaggaaaggaggatttcacatatgatggtgtaggttttcttactcttacacattacattgatcgggtctatttttgtttcttgctgaagtgcctttcttgcaattcttacaggttagcctttcgtcaatgcttgatgaatatatgttcgttcgtcaggagaaagagcaagagaagaagagacaaagggtattatgctctcgcctaatattcatgtattgtctaaatcatcttttcaccttctgtgaatacgctctaatacttgaatatacctgcaggatcagaagaagctccaggatcagctcaaagcggagcaggaagctttgtacggatcaaaacccagtccatccaagcccctaagtacaaagaaggcacctaggcactctatgggtggtgcaaaccgaaggctatctcttggtggagccaccatgcaacccccgaagactgatatactgcattcaaagtctgttcgtgctgccaagaaaactgaagaaatcggcactttgtcccctagtaagccctactagctatcatgtgtcgatatatttctttttcctcttattttcacttgaacatatgtctaactcaagcaaacaatatcaggtagtagaggtttggacattgccggattgcctatcaagaagttgtctttcaatgccagtactctacgtgagacggagacacctcgtaaaccttttgctcagatcacaccaggaaacagtgtctcgtcgacgcctgtgcgccctatcaccaataacactgaggatgatgagaacaggactccgaagacatttacagcactgaatcccaagactccgatgactgttacggctccaatgcagatggcaatgactccctctctggccaacaaggtttcagcaactccagtttcccttgtttacgacaagccagaggtaacattgcaggaggacatcgactactcctttgaagaaaggcggctcgccatctatctggccaggcaaatggtttaactgttgatcaatttatgtacgtagttgaaatctgactgcattttcttgtcggtggccattgcgtatgttggtcaacaatagtcggcctttccagtagcactattctgatttactgcaattgttttaatgttttctacaaccagtaaaacagctctatacattagcttgctcactactcagtacagctttctcggcagcacgaaacatttctgttctctttgatgaatacttcttgctgtggatagggatagttactgttacatatactgtatgccctccagaatagaaacctgttagtacgggaggtattataggaaggatcgttttggaattttggtggttagcctgcacagtaagttccatcagtttctggattgtccctcgcaaagaaaaaagttttcttgattctggtaattcgtttgtcccacctgactccttgaaagtcttctggacatgggaagctatcgtatcgtatcgctcgggcgaacatgatgtgtgtgtcactctcgagtgagcaggccaccgaaggctgacttgactgactccagcaaccaacaaacgagccagtcatttttcaccccggatttttgtcccaaaacacttttccaccaccgtcaagcctcaagcaaaaccaaaacgctacgtaacgcccatcaacaccatgaaatcgagcagctagttgtgcctgctactggccccccagtgccctgtaccgcccgttcttttcagccacccgggggacagaagagtttccctctcaattccggctggagccagagccgcacgtacgacacagtacaccacccgccgcgccacgccacgccacaccgcgcgccgagggcgccgtgaacgtcaagacggacgcgagaccgcgcgcgacgacgggtgtgtggccggcgggggcacaaccgcacgacgcacgtacgctcgcccgcacgcataatgccgcccaggcgcgcgcgggcgggcggggcccggcatgtgcgcggccccggtgtcatgcgctagcccccgttgcaacttgcaagcactctcgccctgtctgtctcccccatgcgtgcggcttccgggcggtttcgtcggtgacattatctggtggctgtgtggacttgtgtactagttgtgtgtgaggagctgtattgcattgcatcacttcatcatcatcggtacaggttacggttggatcatgtcacgtttttggtgatgatgagggcctggagggaccggagtgtgggagtcaagtcctgcacccttttccggggtcaagctgcgtgtccccccttaacatcgcacactgatcagctcagctgggcttgtttcgccctggactgtcgctgtcgctgtccgcgtcctaccgtttgggtacaggtcgtacagccttgtactacctggaatttgtaggcgcgacttcgaggtgcagtgaaagcgaaaatggtgacgaatgatgaactgccgtcctggtgatgaactgcgtgctgcttactcaaagttgacgggcgcgggacaagcaagttccgggtcatttatccagcggatcaagtgtgttctataaacgacacatcatccacgtactgaggccacacactgatctattaatgcctatcatatgcgcatcaaatttagacctaaatttccaaaatctcccaaatttcgggttattttggctgctgcactttttaaatttagcaaaaaaagaacttgttcgaaaatagcaaaagttcttcattttttcaatattatttaattgaaatcttgaagtttcagtccaccccgaaatgattgtgcataccaaaaagtaaaccctgctcacgagtcatggaaattcctgcgcttcaaacaaacctacatgttgttccggtgtttcgtgccaaataaatatgtcgccctgccatctcatccgccctactacatccgtgcaccatctttccctttcaggtgtttgggattcaccgaacacacgagacggaagaacgaaccagcaggttccaccacgcgccgtgcggccggtcgagccgatcgaatcgatcgactctctcgtcagttgtcacgtcaccggcggccgcacgcatcgcaccaagcaaagcatatcataggctcatagcaccggacccgagccccccgcgcccgcggcgcgccgtggtcggtcggccccacgcccggccctacgcgcaaatccactgcgtttccacacttccaccaccaccaccaccacgacccgcccgcgaatccaccgagccggcagcccggcaccacgtacgccaccgccatctcacgcaactttcccctcagaaacacatctgacacaacacaaaatcaccaacacacccatcgcgccatcgaacgcccagttcgccgcccgctgcgccttttccctctcacgtcgtcgtactcgtacgcgtttccgccaagcaaagtccacgccacccgcaaccaccactccatcaccaccaccccacctatatatctcgcggcctcgcatcccaccgcgacaaaccagacacacactcgcgcacacacacaaacactggcacgctgatcacccagaacaaacgcaacactctcttcagctaccaagcgtagccggcgagctctacctcgttggcatggggaaccacctggcgtcgtgcacgatggcgagggtgccgggggcggcgaggggggcgaaggtggtgctgccggacggcgcggtgagggcggtgaaggtgccggcgaaggcggcggagctgatgctcgaggcgccgggccacttcctcgcggacgcgcgcgcgctgcgggcggggggaaggatcgcggcgctcggcgccgacgaggacctcgagctcgggggcctgtacgccgcgttccccatgaagcgactgggcgcgcccgccgcgccggcggacatggcgcgcctggcggccgcggtgtccagggatcaggccgccgcgcggaggtcgtccgccacggccaaggtggcggccgtcgtggtggcgccgcagcacgacgccgcgatggccgaggaggaggaagacgccgcgcggccgaggctggacgagatggccgtgggcgacgcggcggccgaggcggagatcagcgagctcaagcagcggatcagcggcggccgccggtcgaggcggccgacgttggagaccatacacgaggagagctacgctccagcagcaagatgctagtgatagtttaattcagtagccaacaagtaacacaactgggatggcaaaaggccatttctcgtaatattttttccttcttttgaacgctatgtaaaatatttctttctttggcgccacctcttttttcatgttttttttgagagaggaaaggggaatatatggaagaaaaagctcggtggaaagatgattaatgaaatgaagatatttgaacatttcacctacttatgcactctgattcaggtctgtttgcaatgaagaaaattgctcagatcattttgatcagtaggaactagtgcatattttctagaaaacgaactacagatccatctgttctataggcttaaatctgtacttatgctgatcttttaagaaagaattccaagaatctcttcttttttccttctagaatattagaatggattattggaattgtatatttctagatccaaagtatctaaatctagcgaaaaactgttgattttatagcataaaccattttctgcaaggttgcaaaagtccaaaaacaattctgtatgtcagatatttgtggatattttctgctccaatcctcacaaaccatatggtcaatatctgaatggcaagttctggtttgtttggtcaaatcgtatctcatgggctccttggcaacttgttgagctaaaaacacattaattccgtctctccaacactggccgtgattctattggcacaccaacacaagtggctactgcttcagttagagaactgaacaaaagtaggttatggagcagtataaatcattgactatcgtgagggtagaatgactcatgaagtagtagcactcacgcatgccgtgctcaagacatatgaaccgattgtctcgtcagatcaagcaaatcataatgcaaatgatgctagtatatgctaagggcttattttgaaatgtaggatttagaaaacggagaaataggtaaagcatgggattctgatagaaatttaagtgtaaaataaataattctaaaacacaacaatatatagaatcatagaaaactttctatgaggtttggacctcatgttaaaaatcctccaaaactctttatgaatttcgtaggattcaatagttttcaatcatttgttccaaagggctatataagaaaaaatcttttatgattggaattctacaaaacttttattcctatattttcattttaaataaagggggcctaaattcacataattttcttttttttcttgaaaaaccaaaccagctggttgattccagagaccgaagaaattaatggctgatcctttcaggaaaagtggagaacagtgttcttggtcgttctctggtctaccatatactcatttccaaccagttatttgaaaaggcgtcgaaattatagaagtctagtgcaaaaaaagaaagaagaaatgtcttgctccatttatttatgtgacgcccatacgttgcttccaagctttatcaaacagcgacagcaaaggcacgtacgacatctacacagcagctaatgaaattattggctctcagcctctcacactgtgtcactgctccactcattgtatttttgttagtgaatagatcaatcaaccaaccatgtaatcaaagtgggttaattacgctgttgttttcgaaacactgttccttcccccaattcttcagaggaaagcaaagctgcagagtgcagacatacacatgagagaggagagcagaaaaagaaaggttgacagattaattgacgaaatgcagtgtagctactactagcaagcaagattaaagctaatataaagatgctttggaataatgccatgacgcaacccacactatatggtggtgctgtgcttgctaggctagctttgacggtgctgatccggaccagcgaagccacaagtccctccactatcttatgcaactgcaagagagagacagagaggaagagagagaaaccgggatatcaaatcatggcctgcgaatgattaagggggtgtttaggaacttagggactaaatttagtccctctcacaaaattataagtccctatggtagggactaatgtttttgtgagagggactaaagtttagctccactttagtccctccaaccaaacaccacataattgcttggagttcacttgcatgcagaacaagttgcaatggaggatggtgagggattttatttctcaggtcagagccatctgctgattagttagcggagatctcatgcatatcaactacaggctctagctagcagcgcagtgtttacaatttcgttttgcacatttctataggcgagaccaaaatttcgggacgaaaaacgtaaataaattttgagtgactttaaacaaattcacacacacaaaatttgttgggcggaaaatggttttcaaaccctggctagcagtgacgaaggaaattttttcttccagttttaccagtttgcggtggatgtactggcttgtccatcaaccaatctggtaggttaatttgctgcgaaagctgctgtttactggttacacaaatatccagtgactttgtaaagatttcggggtgtggcttagaaatattctatgactaactgttacacacgtactaacacgcgcacacacatacatacagaggccgtagaaatgtacttcctccgtttcacaatataagttattctatcatttcctatatacatattgatgttaatgaatctagatagataatatctagattcattaacatcaatatgaatgtgggaaatgctagaatgacttatattgtgaaacggatatagtagaatacttcctccgtttcacaatataagacttta

SEQ ID NO: 44656 - DNA, 2461 bp, Oryza sativa
acggatcgaggaagatagaggagagtggatctggcgttggcaacctcccttcctaatgaatgccaaatccgaagaggtggcatgctccacacgatgttatcctagcggtgagctcggggacgggactgacaagagggtggcgacgagcactgcgttaagatgccatgatgctcggggcagcaacatgcctcctcccgcactgatctagggatctagggctgagcccgttgaagaggactgcctagcctccactgagctccccttgccatcttcctctcttcattgcccaaagcgtctctggctcccctcaccacaccatcgtcatctggtggagctccgcctctccgagcacaccggtgagttcacctccctcttctctccatccagtcgctggtggcctccctagctacgcactatcgtccccaatgtcatagtggccagtcgcaatcgagcggcggcatcaacttcttgagtgagaaaaaggacgaaagggaggagaaggaagagaatgacaggtaggcccaactttgttatgcatatattttttctaagagccttatgtatgggtctcacctatttttaatttttaattattcttgttttcatattgaaatggtgtgtaagcgccacataggcgctttgtcatgtaaaatacaaagtaaaagtgatatgtagatgccaaataggatttttttaagacaaagaggcaacaacccctggattatttatttgagaactggaagtacaactagtgttgcataacagtcccttaagaagggggaattacatagaggtccagatttaagcatagaaggataaagtaaaatacttcctccctcccataatataagccatggtcaaacttggcacagttttcaaaactaatctttaacttataatttctcatatactataatgtttattgcaacaaaactataaccatcttaaagtaaatttaaatatcattccgatgatattaattttagcaaataaaatttaatttatattacactccctccatctacttttgattcatatttaatcttgacacatgtaccaagaacaagtaattctacttatcatttatactaatataagaaggagttcacccctaacaatcttacaggccaaatcatcacacatgatctcatccgtccatctgccatgacatctaatctcatccggtcttgctgcagatgagttcgacgaccctatccactccaccgcccgtactcctatcgcaatgacactctgccttcgccccccgcatgctgcgatgactccgccctcctcccatccccgcgctatacctcgctccgcactgctcgcttcttcccgtcgccgccgcacaccaccacgccctgccccaccagcgccaggtggatctcctttccgcaggagcccccgccagcgccgggtggttcccctttccgccggagccctgactgggattacccgtcctccgccctcctcgcttcttcccgtcgccgtgcacaccaccgcggcctgcccccgccggcgccggggtggttcccctttccgccggagtcttgcctgggtctacccgacggcgccgaggtggtatgccctttcccaggacccgctgcggcacacgccactttggtttgcgactctcctcccctgacgacattttgatccccttcgcatgcctaagcaacccatgtgaaggacaacgcctccagctgcatcgcctccaagccatcgactgcggccggtataatggaggtgataaggagaggttcgcggtgatttcttccctcctttctttcgcccaggtgaaaaagaaaaatcccctttatatatactccattagttttggtttgcttccattactggcgcactgagacatgatcttttgattctctctagcacctacttttggttcgactggatgaggcaattagccaaacaatagcagtggcaggatgcaagccatgacagccatggaggcaagcctatacctccccatctcttctatatcattatatatgtgtatgttagagtgtacattagattagtcctatacctccccgtctcttttatatcattatatatgtgtccgttagagtgtacgttagattcatctacatctcgcacatagggaggaatcatttgatctccatgttggtaattttgtttttatttgattctattgtcaagatggattagggcatggtaggattattgtatataaaatatgtagtaatccatggtcaactctaggtctgcaacttatttttatgcatgacaaacacaggagtttctctgccttttctgatccgatatttgcatctgtttatctttacataaagatattcgaatatctttacataaatttatcgtactttacataaatttacataaattcatcgtactttacataaattcatcgtactttatctttacataaattaatttgccttttatgtaaagtacgata

SEQ ID NO: 44657 - DNA, 10784 bp, Oryza sativa
  unsure (1)..(10784): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtttcgatataggggtttgttgaaacgatagaggatggcggatcacttcgcgctgatggctggtcggctgctcacggagtcgacgctgcagtcagccgtgcaggaggctctcgctgtcgcctccgtgaagatagttcatgatcagcctgatcttcccgttcatgaagatgttcaggatggaaaggcgaagagcggtgtcatggtggaatgcagaatctgccaggaggaaggtgacgagtcctacatggagaccccttgctgctgcaagggcagcctcaaggcaaggttttctctgttcccattctgaattctctgcatcattacatgattaggtgttgccattttgataacctttatgtatggaagagcttgctgaattgattagtgatcgggatataaattatttcaatctctagcccttttttttttttggaaaacgtattttctagccctgtttaacccccaggacaaccacaagttcagagtttctgggcacaaattcagaatcattttattcccattactgagtttccaatcacacgacagttcttaccaggtcttctactgctgtaaccaacattcagttttccatattgcaattaataggacatttggggtttcatcccttatggtgaatgctgataacttgagttttccaatagatggtacttgaagttgaagattacttctacctcgaattcaccctaattcagacttttcttgaaacagaaaactcccggtttccattagatagattcttacaatttaaaatgttatcattcatttcagtgttatttctgcctgccattcttacccaacagatttccctgctgtccgaatatttacttgaattagtttgtcactgtctgcagtacgcacaccacgcatgcatccaaaggtgtgcaatgagaagggagacacagtatgcgagatatgcttacaggtgaacctttctgaaaccgtccaacaattcatcatccaaatcccaacaaattctcttcaaaaaaaaatcccaacaaattcaggaaagaagcagatgcaatgcaatctgtccttttcttctctcggaagcaattatgttattatactgaagaattttacagtccaattttaatattcgatttgttacttctgctcttttaccgcagcaattcacgccaaactacactgcccctttaaagttgtttcggcatggaaggaacctaattagtttcaggtaccagctgatgctcctactgatattataagaaggggccatccagtatctactggtatcttaaatccttttctcattgtaggagatctggagaaagatcagataatattgatactgatcgcagtcaagaacactttgcgcaaacctcagatcaagctgccggtacatccagttttgactctcagaattccagcccaaaaggtgtcttctattgccgtgtagtcgcaatatctgtaagtgttgcagagcatgaaattccatttggacattagtactctcaatcatgccatcaaatgtttctgaaaaaaataataaaaaaatgcaatcttcagctgatggccttgttggtgctccgtgatgcgatctcacttatcctcggcgatcctgaggtctactcgatagcactgttcactgtaagatactgatttctgaaactcgattagcatctttcgtgcttggataacctgattacaaatgactgacacaaatcacttgaatgagacagcttttgatgattagaacagctggaattgtcataccaatatacatcatcttggtatcagttaccacattgcttcatcgatacaggcaacatcaggtctgttaccacattgcttcatcgatacaggcaacatctgtcaaaacctcaaataattctgttttctccctttaaaaaatcagttgcatccataatttgggtttgtatgagatttcaggcagtgcacgaggcaacggattcagaacctggaggaggagagggcttgcggccgatgccacctccacagcatgttatcagcatccagtagaaatctgcaaggagataagtaatcaggctctgtaaataactgatatatgacccatcagctcagtaggagtcgttgaatgaaaagtccatagtaggatatgaaaaaaaaatcagtggttgtacagcgatttgatagtattcttgtacatacgaattttagacatagccactcaacttcaccgaccatgaagatgcgaagtgaagattaagtgggcttgatgtgtatattacatgacaagttggaaattggagtggaatgcacatgttttcctacattcatgtcaaagaataagcttttttttcagttgaagcaccgcaaaagcaaaagcaacacgatgcaattaaaagaaagttcatttacctggcattttcccatttttaaactgaacaagaatccaaataaagattttacaagggacttaaaaaagatagtgtgacatcatacaaccaaacttcataataatggaccaaccaatcagtgcctcgcgttcacaagtgaaatgcatatatcatatttgaaggaacgttagaacgtacaatatcatattcttccccccaaaacaatttgatttaaattgaaaccagggaaatctttactacagtagactacatttagggccagaattaaaggggaaaaagaaagaggaagaaaagcttgacaagattacactcgctgcctcttgctctgagtggcgccaagctgatcagcacatctcttcttcttctcatctttcagttcgccattcacctgaaccccaggcgtcttcgcgtgcttctgcgtgcgccttatccggagcatgtctgtgaaggtgcgctcgtcgccgtgccggacttcgaagccgctccacttcgcccagaactcctcgtcggcgtcgggatcgccgtagcccgacgcgtgcacgaacacggcgcgagcgcgggcggcctctcccagcgcttcctcgagcgcggcgaggcggaggcacagcgccagggcgtcgcggcgagggaggccgccggactcgatcgcctgctcgtagacccgcctcaccttcggcacgccgcggagctcggccgcccgccccgcgtaggcctcgtagacgctcgccctgtcgctcgccggcacggaccgcgccgcctcgtcgtacgacggccatggcgcgcggcggagccgaactcctcctcgtaccgggcgtggcgcaggaagaggcgcgccctgtcgtggggaggagcgcggcgggtggcctcagcgaagagttcccgcgcgcgctcggccttgctccggccgtgcctcgccacgaacctctcgaggtaggtgtcccagatgggcttgctgtgcgggtggccgaacagattggcgcccgtctcgtacgccgcgaacgagtcctcgaagtagccgcgctcctcgaggaacgaggcgtattgatcaccatctgcggcgtcgcggcgcgcgcggccatggcgccctcgtaggcggcgcgcgtcgacgccagcgcgcccaggctctcctccaggtcgacgtagaagctccacagctttgcggacttgtgaagcttcagctgggcaggctcgtcgtcgccggcggcggcggcggcggctcgcagcttcacctcggccgagggctccgcggtggcttgtcgcatcagggcgatggccttgtcaaagcgcttgtgccggagctgcatctccgcccactcgcaccacacggtggccaggtcgtcggccgatctgtggctcgcctgcgtggccttcgcgaacacctcgtcggcgctgtccaggttgccgtgcgcctcgtacatcttcacagcgtgcttggtttgcccgtcgccttcgccgggtcgacggtcctgacggcctcgacgtaggtcgccgcctgccgcgcggggtcattgtcgaagagcttcacccgccggtgccactgtgcgacgtcgtgcgggttctgacgcaggaggacgccgttgagaagctcctgccggcggtcgagcagccgctccagcctcgccaggccatgtcgccgtcgtcgccgtcggccaaccagcaaccggtcacgagcttgtcgccttcctcgtccgccgtcttctccatcttcgccgcgaccaagctctgctcgagctgcgcgtacgcttcgaacaccagcgcgaactcagctgcggtggccgccgtggtcaccccttcctcgaagacgtctctggctttgtcgtaaagccctcttcgtgcgtagcactcggcgagcagcgcgcgcagccttccggcctcgtccggaaactcgcgcatggcgccgcggagcacggcctccaccttgagcccggcgacctcgtcggcgtgcttggcgagaaggtcgcacagcttgagcaggagagcacggttgttgtcactgacgtcgcttccgccgttgaggaccgagacaatgtgatcggctgcctcctgccaccgcccagcggagacgaggagctcgacgagctcgtcggcgcgggagggttcgaactggaggaaccggcggtagatgcggatggaggtctcggcggggcaggaagggagggcggcgaggcggaggtagagcggccagacgcggtggtgctgcgtgacggggagcgcgcgcagcgcgcggtcgaaggcgcggcgtgcgcgcgtgacgaggcgctgctcgaggagcgcggcgaggtacatctcccatatccgcggcatgcggtgcagcgtggcgagcgcgcgctcgaaggcgcggttcagggcctcgttcgccgggtgctccccgcaatgcggcttggcgcgcgcggcggcggcggtgcgctcgaggaggtaggcgtgccagagcttgtagctgcccgggagggcgcgcacggcgcgctcgtagatgacggcgcgctcctggaggggcgcggcggcgcgggcagcgaggtagcggcgccacgggcggatgctgtgcgggtcccgcaggacgtcctcctcgtacggcaggtcggcctccgacggcagggccagcgccaccggcatcgcgacgacggcggcggccattacctgcgctgcgcgcgcgcgcccgcgtttcccgctgtctacggcgaggtctcaaactccctcgatccgtgagaagttgagagaaattatggggcatggttatgcttttatagcggcgggtgatgatacaaaggagatccgactccgactcgtcagcggcgtcagtgatactggcgattccgattgcgtatggccacggcagtccgacacggaattctgaaaattcatttggagtgcacacacactggaaagggtagtgaaccgaaagtccgaaactaaagctctgaaaaatataatttcaaacaaaaatacggtgccatgcttatgctgaattaataatagtacatgtatggccatgctcatgctcatgccaaaaaatttgtttataaattgtcctaataccctctatacggataactgaaacgggacaggtaaatgaaaaggaacagtcctatgctctgtagtagtctagtcctatacattgaaaactcaattcataaattaaggggatatcctcatttttgcatgttacttaaaaaaatcatcaaaaaaattgaaaaaaaaatattacgatagatcaatatgtgatatgtcatttcacaaacatgcaaatttaaatttgacttatacaagtataaacaaaaataataaatttgactataaatagaacgtgtaattcactgtcaatgtaccagaagatctggggcacattacctgcaccttcctatcaaaaccgcccaagttccaaaaagaaaaaaaaagatcaaactggattcgaatttcagcatagtttccatatttcaaacggttttcacaaggtttgctgcaaaccctgcgctcaacaccgatacaaattgcaaattgcaaggcaataacccagcaaggatgatcaaagagagataaaccctaaatatgtgagacatttcagcatgaagaacacgacacgttattagagtgctagattattatgtagctacaattattgtcaaataaaaaactccaacgacatatggtcctaggtgacaaaaactttggcagagtcgtggtttgatttgagagcaaattttgtcctgctacacagcccctaataacgaccatctggattggcatactcccaatccaattaaaacaaccaacatactaagcaattgcataataagattgcgaaaggaaagaacacccacatacttttagtccaagcattgaagattttcattcttcaggtttgtgctgtgcttgctgtcaaaactgaatggcagacaacgctgaatcaggagtacaaatgatattcactccagttcgcatcaacaaaccattaagcaaaaccatccaagtttcaaaaagagaaaaaaaaacgaacataattcagatattcagaaaagtttccgaatttcaaatggtattgtaaataccaaagcagctgctcaggagcgaatttcgatcagctgcaaacaatatcaaacaacttggcaaatcgcagcacaattatccaacaaggacaatcaaagagagatgttactctaaatattgtggccaaatccatttcagcatttcagcctgaaccacagcgctagatagataataatataacaagtagctagattagttcgtcgcacggatacagaatcaataaggaagcacataatcagtttcgcaagtgcatcaatagggtcctaggctatatagagtgacgataaattacgagttgggaagtgccttcgacccaaaacacgatacctagaaagtaataagcaaccttgcatatagaatcccaactccgcactgccttgatgaacattccctgcctccagttaactcaagcaatcctgccagacaaaaacatcatagaacttagatggtaaccctgctagatatttttcagtgatataaacaagacgaggcgtgccgtgtgtgatccacaagaaaaagcaaagtacaaattttacaattcaaatgatgtagcagtccttacagtagaattactttgtagctagtggggactcatcaaggtgttggaatgcattggtagggaaggcagccggccggaggatattggagcggacggagtactgcgacaactggattttcttggtgcacatgtcgagcccgcaaatgtgatacatttgggggtcactaggtccggtcatcggtttcggcaccaggaagtagagtgtgccatgtgcgtgcggccttaggaagggccacacgggtaccatcctgggcaacccagactgcttgtagtcccgttgcgaccatatgttccccagcctgaactccacatcctttttccagcacaggccaccttggtccagtgtccacacggccactgttgtgttggctaatgcagtggcgtcatgacagggcctgcccggcggtttgcctgccgcggcatcagtagccggagtgttgatagagacgaacttgatggagcccccggagacgcccatggtccggtacatctccatcgggccaagctcctgggatttgataatgtcatgaagcaggtactggtgggggaagctgaggtgtctgaaatccacggtgtcgccagagaagaggacattggtgtcgcagcacatgaaaccctgtgagagatcgacccagaaagtgttgcccttgaacgagaagatcatgtccgggcagaagaagcccaggggccccgttgggaggcgcatacccttcttcttctccatccactgatcggagcagcaggaactctccttctccttggtaaacagaaggagaacgtccccgtcttctctgctcttcctgctgaggtacctcgctatgagggccaggtcatagcccccagtggcgcggcgccttaggacaggccgcgggtggaaggccacgaagcggtgcggtgacaggctcgggatcatggtgagtgactcgtcgatgccgtcgtagacgaggtagtagatgtggtgggcgtggtcgaaggacgcggagaggacgacgaggttctcctccgcggcgtgcaactcgcagacgaaggtgacgcgggcattcatacttgcctgacagcggaagagcgggcggatgaggctcttctggatcttcgttggcgccgcgaccttccgcagcatctcgtcggtggcacggacggcgagggcggagaagagatcgtcgctggggccatcgttgcggcgcacgtacagcgtcaggccatccaccagctcctgaccgaactccccgcagccgtaggcctccttgcgtgcgcacttgacggccgcccacctgggatctcgctgcgtgtcgacgagatcggcatccctcacgtacctgtccagcacgacccacggattcaaatccggaaccgacgccatgagatggatcaaaaggtggtggtgaacgtacggcgtgagagggggagaggggatctgcgtggatagagacggcgcttcggcctccggagtcgagacggacgaggagaggaggggcgtggcgacccgtgaccgtgagaggaaaggagaacggcgcaaaactcaaaagaaacacacgatatgcggatatatggccttgaagaaaaaaacgacgagaagggagcgtggattcggtgcaccgtagaccaccgtcatgcaatacgtttcctttccgtcgattgcacccggatttcttttggagagggtccattctaattgggaattgctaaaagaaactatataagtttctcgattaaaaaaaatcaaatttaactataataaagaataaattgtactggcggtccttaatcttatgaggagatttcatccaggtccataaacaaacaaacccggggtcaagggcataatcttattttattgtatcaatccggntccatagaacgctttgacccgtttcgtgcatacgtggacaacaacgtgtcgcgacacgtgtgatgccacaccgcaccgccccgcaccgtgccctttttcatctaagcccctctgttcgctcgaattctccaaaccctaaccctctcttctatctgttcttctcctctggacgacgaagcagaggcgatcgccatagaaattgagggctgcgatcgctggtgagatagggattcagaggttgcggggagggtgcggagtcttgacgctggcctcccgaaggtgttgaagccggtgaggaggcatgttgtttcgactagtaggggagccgccgccggtgtacggtatgtagaatggacccaaaatttgagttttttttgggttgattgcagatgggtggtagttgtgctagttgtggtctatttctttgatgactcttagccggaagccctcccccgccgtcgactctcagccaaaagccctccctcgccactcctcttcagttgccctcccacgccctcactcgtcgtctagaggagaagaacagatagaagagagggctagggtttaaagaattcgagtgaacagaggggcttagatgaaaaagggcacggtgtgggatggtgcggtgtggcatcacacatgtcgtgacacgttgctgtccacgtatgcacgaaatgagtcaaagcgttctctggaccggattgatacaataaaacaagattagtgcccttaccctggatttgttagttcatggacctggatgaaacctcctcacaagtttaagaaccaccagtgcaatttactctataataaaattagttctaattaactacatggtacctttatataacaacttttgtataaagttgtacatatttttaaacacatatacttcatccgtttcatattataaaaccttttagcattgcctatatttatatatgtgtctagattcattaacatatatatatatataaatatggcgaatgctagaaaatcttataatatgaaacggagaaatataactattatatggtaggtatagttattagggtagaattatggccatgcctttattatagtggggacttggtaccatggagatcggaatcgtcatcagcatcggcgatgctactggcgattccgattgcgtaagagagtgcaatactagaaaagtacggcttgtaaggcctttagttggagaaaatttttaggtttagttgtcacatcggatatacaaacacacatttaaagtattaaacatattctaataacaaaacaaattacatattctgccaggaaactgcgagacgaatttattaaacctaattaatccgtcattagcaaatgtttactgtaggaccacattgttaaatcacagtgcaattaggcttaaaagattcatttcgcaatttacacgcaatatgtgtaattggtttttttagcctacatttaatactccatacatgtgtcaaaacatcatatatgacagcgtgaaaatttttgttttggaaactaaagagggcctaaatatagcttcaaacaaaaatgcggtgtaaaagctcatggtgaattaatagtacaggtaaggatgcctgattgcaaaaattgcttcggagatgtcctaatactctctttctgggtaactgaaatggaacagtcccgtgctctagtctggtatagtaacagttataaccaaggatacattgagctacaccgtacagaagggctaaactacgatgagcagagatgataataatctcagaggtgaagtacgtaacttccttctctctag

SEQ ID NO: 44658 - DNA, 15417 bp, Oryza sativa
cactagaaaattttagccaggataaaataagatatggtataagcacatgaacaaagacaaaaggttcaataagtccctagttagttctaagaaagtcaggaagaaaacttatgtgttgttatctgatagtttgattcaaatatattctattatccgccaaaaacttattttattgactttttaataattaatgaggcacaactatcattgttaaaacttttgaaattgtatgaaaagcatcccagtccaataaacaaaagaaaacatggaggtgtcaatcattcagaagacaaatccgaaacaaaattcggtgcaatgcacataaaagggaggataattaagccatatttaagaaaacattaggttgtacccctgcttggcaagtgcttgcaaaagaagcccattcccagttccaacatcgagcacagggtagttggatagttgcttctcatcaacttcacaattgatgctttcattaccagatggagtcccaccattaataatgtctatacacaatttttttgtccaaacagccatggtgtccattacatctgcaccaaacctacaaacagagaaaagctctgttcacaacccaaaagacaatcctgaatcaaccaaatttttagagaaatgccaatgaatcatcgagtaatttcctataaataaaaaccaccccatgagagtcaagttaagtaaataacaaggcaaggtgatattttgatatccaaattctgagtttgaggatcaaactctggccacaggtttgcgaagcttgtgattgatgcatataccaatacatctgtaccattaaaaaaaattgaaaagacctaaacagtcacatacataatcaaagcaggtactaaattggattttcagcagatagtgaaaaaaaacaacaaaagaatgatagtacacctccaacaactttaagttcacactaccaggttcctttacattccttgggaggtatctactttaaaaaaagaaaaagaaactctacacaaccatacttgcatttttctgagtttaagcaatgtcaattatcaacagataaaaattataactaattagtgtcaacttattgggcttttttgcatcaactgatatatcaacacttcagttttctatttacttaatctgaatgaccaaatttttcggtataaaaaatcatggtatgtagtcaccatatttctccagcatgcccatgttcctgaaaatttgcaagatcttctgaataagaagcatcccaataactttggagccccagcattgagccttcaacctcgctaggatcttgatcatctttgtcagaactgtgtcaacacagcaatattttagaatattaaaacaaaaactgctgataataacagaccaattataaaactaatcacaagaaaattcaaaggaaagaaataagtaggcaacagacacgtttcccctcttgccatttatgctgatatgcaacatgccataaacgatctagtatattgatccatccttaaatagcaaaatgtaccaattgtctacaaatataatgtatgtattctgattatacactctggagcatgatatatgctcattgcatcgatccatgtcatatctattaaagagtgcgtagataggccaccttcaaacaatgaggtggagtgatacagtattacaatctcaacctcttggtctcgtccttcaacgtgacatcagaatggactttgtcttttagaatggagtatatttcccctggaggaacttacatggttctagtggctttctagtcctatagtggacaggcagtcaggaagctatgattatacctaaaatgtattttctgccactggttagtggacacctacccataacccaacctatctagcagcaatagataaaataaagtctactttatattggattaggcaatcaaacgcgtgtaggtgatgggtccatatgatcatcaagtatcactaactaaacagaaagggtcttctaaaaaaccgtcatgtgtaatttgtcacatttttcagtgctaagggatgatttgcactgcctcgaggcttaaactccagcacaaaaacaaagtgggtgaatttgctttgcttttcaacaataaactcgcttggatgtctgaccacagtcaatttggatgcgcatctgacttccgatgccaacttgcccaataaccacgaagctggcaaagacatctctagcacttcctctttccacatatttgattacaatcctaaatgcaatcatcaagctagtcgcaaccagaaagtgcacaaagtaaaaggtacggacggcaactccacaagagcatgagactacataaccctgtagggtatctagaaaggcaaggcgtccatgagatcaagcattattatttccaacaaaattcaccagatccacattccagagccgctagcgtcacagttcgcaatcccagacagacaattcaacgcgagttaagtagggccaggagccaaaataccagcaatcggaggcaccggaggggaagttggcggaggccgcggccgccgcgagcacctcggcggcgtcggcgtaccgctggtcgtcgtcgagcgtgctcccgtactcgctccgcacggaccacgagtccgccgccaccgaccgctcgtcgtccgacgccatctcgaggccgccgccgccgccgctgccactgccagccaggacggcgcccgcgccggcgaaggcgggcggcagctgggggcggggcggggtgccctgcggcagctcgggctcctccggcgtcagccttattccagccatggtggggatcgggaggaggaggggaagggagatcgcggcgagggctgcacggacacggcggcgattgcgaagggaggaggcacaagagagagagagagagcgaggaggggcaggggcttttggaccgcggacgcgaggacgcgtttcgaatttgggtcaagtttgcggtggtgaatgggtaaaataattccgcgtttgtaggagatgggggttccctcactcgcggggttctgcacacactggagcggtgatgtgtttgcttccatccggaaaagggttcgtgccactctcgtggccgccgcaccggtgcatgagaaaaagtttggacctgccgtccgtggcacgtgtaactttgcttggatttaggtttcatcaaagtggtccacgtttttaagttaagagataataaaacacgcgaagccacttatcaccttgtcaagaagtattgaaatacagacgatgaacggaacctagcttagaccagcttggcctctcattgacggtggaagaagaatatagaaaaacatatatatgatactatatatgttcctaacaatcgggtgagtgattcaattttcaaactttacatgggtttgtcgtcacgccgtgtactttacaccagtttataaagtatgttaagttgccaacatggtactccagttacaacctactcccttcatccaaaaaaaggcaaaccctggtttccgtgtccaacgtttgaccgtccgtcttatttaaaaaattatgaaaaaaattaaaaagacaagtcacgcataaaatattaatcatgttttatcatctaacaacaatgaaaatatgaattataaaaaaatttcatataagatggacagtcaaagttagacacggaaacccagggtttgcctttttttgggacggagggagtaactcgaacacatctctaagaactgcctagcactcatataatgtaatgtagggcttatttggtctagtaccctaccaaaatattggtagtgccaaaatctatgcaagttttggtactattaatattttgatagggtagaattgtaaatggatgtgtttggatttatgtcaattgagagccaaatttcaaattgtggtaagaatattttagaattgtgccaaattaagtataagcattaccaaatatctggctttaaaccaaatcattacatttactattcaaactacctaaaaattggtatggcacattttggtatcaaaccaaaacgccatgtaatgtttatgtgctttaaaaagtgaaatgatcatgaaaaggataaatacggcactccttagcccttaggccatctccaaaatatcacaaaatcggaaaaaaaatggagaaataagcttgatccgatcatacactacaggtattgaagctaaggaaaaaaattgtggttcgtaccattgaaggccatgtagccgcacatggcccccaattctttgggcccccatcacaaagtaggcttgcagcctagcctaagttcagcggcccacgaacgaggaggcaaggagtcaagagtgcttaggcagaaggcaaatttcgcttcggcttcgttattagcttgcggaggagcgacttgcggcgtgtagtgcagcaagtggtagcgacaatgtcttgacaacaagtagcacaatgttgacgtcgccaaacgccaagatcgtgaacaccaacgttgctgagtggagcagtgaggtgccaaggccgcaaggtccaacacccagcccatggccagtggcgaacgacaagaaggcaagcagcgcaccgacccaagcggcggcgatcgaggttccgaggctgcgaggtccaaccgtagcgcctagcaagcagcggcgaacggcaaacagctccgagtggtgttctcaacttctcaattctcatctgagtcatctattcgtcctcgggaattgaaaagttggaattggtaatttactaatttgaaacaaacctaatgaaattacattatagtattttgaatgatccatagattgattattgaattaaaagtaatgtgaatgtcttctcttttgtttataaaacatgaagacattcatttactcaaatcctcagcatttcatttagaaacatgaagtatgattcggatgctcaaaaacataagaagaaccaaagattagatgaagcagctcaatcataaaagtgctgttgataaatttgttgtgagagaaactacggatttaactaggcgaatgatgtttttcagtagaatataaggtattacctttatactctcttagcattaatacttgaaaatgtatttataaatattatacagaataatacatattaaagttatatagttgaatgaaagtaatattggtttattaaattttaggacccaatttgtattttgttccggggcctcaaaatcctggagacgattaaaaaaaattgtatgtgtcagctaaatccattaaaatttgacaaaatgatcgctgttgtgcaaccacagagccaatctgttttttttaattgttgtatggtctcacatttcgtgctatataaaccgctgtatacactatagatgactttaggtgcgaacattatacactacatttactaatgagtttttttcgtttcagtgcgttgaaaatatccctacaactggagagaacgaacggggccgtgcagtcacatatataacagttacaaatagagaggttgggcaaacacaaagcacaaaacagatcattgctgcaaaacacaggtaataagcacatgcactcagcagtcagatggccacgaacctctggtttcctgttcctgcaaggctggaaaatcaggggtagaagatgaccgtgcaagtagcaacaggccgacagcatccactgcacatgcaatgtctgttaaactatatctagttttgctaaactttattcgggaggtcaagtgacccattgaacatgcaaacagatcctcacatgcctatccaggaaggaattcaagcttcaaggtgacccatgcaaactactacgcgccaaaccgccaacgcgacgtgatccgatcgggcaagtcacggctccgcgcctccggacgttatccggtcaacgaacgcctggacgccgcggtccgacgagccgccgccgcccacggcggcgcgcgcattctcccccaggatcgccgcgcgcgccgccatcgcctccgcctccggcccggccgtgacctcctcgacggacaggcggagcgcttccctcgtcagcggcgtcgccggggctcggacgcccacacggtagacgtcgacgacgaaccgcgtgttgatgcgctggtcggaccacctcggggaggccaccatcggtacgcccgcggcgagcgcctcggcggtggagttccacccgcagtgcgtcacgaagcagcccacggcggcgtgcgcgagcacgcgccgctgctcgcaccacggcaccacctttccccggtcgccgccgcaggcgtcgatgagggcgtccttggggaggagcgcgcggttgccgtcgcgcagcacccacaggaacgggcggcccgtgctggcaagcccctccgctatctccaccacctcgtcgtggccgatgtccacgaggctcccgaaagccacgaacaccactgacctccgtggctgcgcgtcgagccacgcggtgcaaccgtggacgtcgtcgtcgtcgacgccgccgtcgtctggctcgacgagtggaccgaccggtataagcggtatatgcttgcgaagccccgccacggcctcgtgctcgagctcgtcgaacgtgttcacgaaaacccatggcgccttctccgtcatgctgccgagatccccgacgagcatctggcgccacatttcctggtcggaagtgtaaatccggagtggccgtagctcgtccatgtccagctccgggagacccgggatggtcacggcgccggaggagtcagcctcgtcgccggacgggaaggccgcgagcgagtagacatagtggtagtacacggacaggacggcgcacgactggatccacagtatggcgcacgggagaccgacgtcgccggcgacgcggaccgcccaggagacaaaggcgttggccacgacgcacgccaccggccgcccggcctcggcctcccggcggatgagctcctcgagcgccgccggcccggcggcctcgacgtggcgcgccatgtccccagggatgcggagccgtgggtcgtcgggctcccacatccctccaccgcggaggcgctcgacgcggacgccgccgccgccgccgtcgccgtcgtcgaagacgcggatgccgtcgcggagagccgtagtgaaggtgacgctgaggcccttgccggcgaggcggcggccgaggcgcaggagggggttgacgtggctctggaaagggctggagacgagtagcacgtgcggctgagccttcgccggcgccggcgccatgcccgtggccgcggcggctgctgattcttggctcatttcgctggctgcgcgcggctgcatgcacggcagtagtgcagctaccaacgaagtccaaatctccgatgtatcggataatggaggggagccgcttttctccgagatgagacaagaaaaaccaacaaactctactccagctcggcgtcgctgtgtctgctcctggaactatcggtatcacggcgtgggcaccacagtatctcctcagaaacgcacgccggttctgggctttgccgagcatgggagcgcgatggccaaccgaaccggtctggttattgaataaccaccgaaattaaacaagagctgttacgagatttcgagtggagagtaaaagccatgggaagctatcaacatactactccctctctccgtttcaggttataaaactttctaggattactaatattcatatagatgttaattaatctaggcacacatatatgtctagattcattaacatatatatgaatgtgagcaatattagaaagtcttataatatgaaatggagaaagtagtattttaagtcaggaaccacgtggctggcccgactgctacaatggcgcaactactcgtgctagcacgttagcacgtaaccgtctcccacacacaaatggacacaatagttctctctttcgagggaagcgagcataggggcacagactgttatgaaaatagatgcacaacggagacatgaattttacgtggaaaatccttgcgggaaaaaccatgggcgccgaccggcaatgatcactatagaggaattggatacaaacgcaagtgatacattgggctgtcgcaccctcccggtgtggcttacaagggatatatatagcagaaatctaggagccctaataggaaactaatcctataaagtagagtcctattagataactaatctgaatatattgtgggcccgaaattcggatcacatatttaacaatctccaccttgagacgaatttcccttgtagcataaaaatcttcaatctccaaagaacctcgtgatgataaaatcaatgtgcgccaaatagtcacttggactataatccataacacccttaatccagaagaggtagaccatacttcaaactcgccattggaaacaaatcctgaatctgttggtatgacattgtggaacccagcagagacgtgaaactgatgcacaaacttcaaactcgccatgggaataaaatcctgaatctgctggcattaatttctggaatccaaacagaaacgcgaaaaattcttgtgcacaaaaacgaagtacttagatcccctgataacctcctggtatgttggatacaatggtagcaaaattcaccggacaatttgatcatcttgtgatctagacaggagcgaggctccctctcgacgacttgaatgtacttttttttaatctcaggtgcatgacttatcctccttgaaacatgcgccaacttgcatcttcacttgccataacgagattgcatctcaatccaggagtggtagatcaaacttctaactcgccttgggaataaaatcctgaatctgctggtacaatttatcaaaccctaacagaaactcgaaacactctgggtgcataaaacgaagttgatttccatgcagaacctcctggtagactggcttgtgaatatagcaatttagaacgtgaatttgtgttcccctgaacagaaccaaaacaatgcaaggcttaaatccctggtgcgaagggcgtgtgcacgtaacaattccaacgtgaaatttaattcacatgaacagaaccgagaaagctactgaaggcttggacttttctccttcctcgggatgcgtgcggaatagatcaatggcttcaaccctgctgctgctgcttctgattttctcctgcgttgcttgatggacgtgattcatatcgatgtgttggagcacctgcttaaatcgatctggtcgacaccgcttcgggtttgcttcaccggtgattcaatctcaccgaattgatttctgcgatgatgacgacgcgttgctgctgcggccgattctctgcgacgtgcgctgctgctccttccccggcggcgtcgacgacgaggccaatcagatcgatatatactccgatccgaaaaatcacaccggtggctgtgtgattagtagatcgatctccaatgctctgataccacttgttataaaaatagatgcacaacggagacacgaattttacgtgaaaaatcattgcgtgaaaaaaatatgggcgccgaccggcaatgatcactatagaggaattggatacaaacgcaggtgatacattgggctgtcgcaccctcccggtgcggcttataagggatatatatagcagaagtctaggagccataataggaaactaatcctataaaatagagtcctattagataactaatccaaatatattgtgagcccgaaattcagatcacatatttaacatagactttgccggaacggtgaatcggtgatgtaggcagagagtagtgattaggagtacattacactagtgttctagtaatctagttgagtgttgagacttgaaacgaacggagactactcgtgccgtcggtgcgcgcgaatgcactgaaattgagcacccgggcggttcacgtacactcaccactcagttcccattccaaggctctcacgtgcactcaattctcattcaaattacgtgcatgcaatctgtagggctaaataagtgtcgagctgcaccacttggtgcttggtgagggatgctctagctctaaaacatttgcccagtgagttatggggatgcttagggttgataaaaggttttttttttatgggacagggagtacttccttaacgtatagtgtggaaatgctggtgttactagaaatgtatccgtcaattgattactttattcatacttggagtacacacatgtacgaactctgccggagtccacaaatatttgccttaatttatgcaccatgcaaacgcgaaaatatgggaggattaggaagtgatatacagccacatgtacgcaaccaatcccaacttgttacgtacaaacacagcttattttgacacgcagtgatgcacagttgtacgatgtgccgctagagcgctgacaagtcagcacccatgttctacggacaaggacagcagagcatcggcgaagtcccggattcccatgtccgacgacccgccgttagccaccgccgcgctcgccttgtcgctccactcccgcgccctcagccgcatcgcctccgcctccggcccgctcatgacctcgtcgacgcaccgggagccggacaccgacgccgtacacgtccgccagtaacttggcgttggtgatctggtcggaccacgccgggtaggcgacgaccggcacgcccgccgccagcgcctccgtggtcgagttccacccgcagtgcgtcacgaagcaaccgacggcggggtgcgcgagcactcgccgctgctcgcaccacgccaccaccttgcccttgtcgccgccgccgccgctctcgccgtgcgggtgtagctcgcggctgtcgtcgcgcacgacccacaggaacggatgccccgtgctcgcgaggccctccgcgacctctgccgtttcgtcacggccgatgacgacgacgctcccgaacgccacgaacaccaccgatcgcggcggctgcgcgtccagccacgccacgcagtcgtcgtcttcgcccgcaccgctgccggtgtcgaagagggggccgactggcaccaccggcaaatgagcgcggagcgcctcgatggccacgcgctcgagctcgtcgaaggtgttgacgagaacccagggcagtgtgtcgtggaggctgacaaggtccgcgacgagcgcttggcgccagacgttcggctcgggcgcgtacaccaatgctgggagctcgccgacggtcagcgccgggaggccagggacagggaccgggagacccgtctccgctccggccggggggaatgccacgagcgagtataagtggtggtagtacagcgacaagacggcgcaggactgcgtccacagcatggcgcgcgggacgcccatgtccctggcgacgccggccgcccacggcgcgaaggcgttcgccacgatgaacgacaccgggcgcccggcgttggcctggcggcggatgagcccctcgagcgcagctggaccggcgtcctggatgtggcgctgcatgtcaccgggggcgcggtaccggggatcggcgggtgcccacaggcggccgccgcgcaggggctcgaagcgcagcctgccgcttcccacgtccatggcggcgccgtcatcgtttggctgaagcttcagcttgagtccatcgtggggtacggtggtgaaggtgacgaggaggcccctggaagagaggcgcccgcccaggcagaggagcgggttgacgtggccctgtaacggtgcggagacgaggaggaggtgcggcagcgaacgccgcgccggcgtctcttggctcattatactgaattctgagctgaaggctgatcagtacggacggagctcgatttttcaagggccaaagtgtgggtcagtgtgtgggacaggatgccaggccagggttcttttcaggtcgttgaggtctcacttggataggcccatccgcccatgcataattatggcccaagatgttgtcatggaataagtagttttgcctccttcaactcatgcccccggttgaatagcatctctcaaccgtaaaatcgggtataacctatccctcaactcccaaaaccactctatggctgtgttcgttcacatgagaaagggaagattgtaactcgttttccgcgcgcacgcttttcaaactactaaacggtgcgtttttttgcaaaaattttctatagaaaagttgctgtaaaaaaatcatattagtccatttttaaagtttaaaatagttaatacttaattaatcatgcactaatggctcacctcgttttacgtatcatcccgcaagtcttttctgcacactttatcgtcactcgtgcgcacccgggaagaatttcacaagaatttctcggtcggtcactcatcccgaaattgctcaagaccaacacaacaacacaagaatttcccgggaaattgttctaggccaagcacgcttaactttagagttcctttgagatcgacttccgaaaaagaagttgcaacttgttggtacgattattctattaatcctattaagccgtgagccgggatgtcacagtttccctttcagatcagataattctcggatagtttggatatagatacggatatggatatggtatcggggtttccgttggatacggataataattcagatatctggtgaacagtgctattcggatatccgcagaagccatgagatataccctatttctttttaactctataaccttcaatatacctttatagattttaatagtagtttatctcttaacgctagtccatactattaatattatttaaaatttaaaaaaacatttataaattatacttcactttatataaaatgagctaattatatatgttgatatgtgtttctgttagaagttgagttggttttcgtattccgagaaaaaaatgtttcagtattcgtgtctgatcatattcgattcttatttgtattcgagataatccgtatttttttccgtattggagctatccgtattcgttttcatatccggtaaaaaaaatgaaaacgaatatggtattagcattatccgtccgtatccgctccgttttcatccgtagccgccacaggcatcgccccgagccgtagcgtgggcagagtcttcaacccgacgccatcgctggcatccatggtggtgaaaaccaagccatgaggcaagttggaaccttcctccccttaccagtcccgagtctccattgtcgccagtgcccttgaaccacctcgtggtaggagtgcggacgaaggtcggcgagggcaagggggaggccgtcagcagcggcagcaaagtgatgagcgctgcggtggcagaaccaacaagagggggactggaaggtgagacagtgagagagagagagagagaggaggaggaggaggaggaggaagagggatctaggaagagaggtgaggaagaggatgggatgagatggaggccgctgataagtgggtcccacctgatgactcaaccagttaacgggtcaaagatgccacgtgggataaaaccgtctagggagtcgatttgctacggtttttggaattgggggataagttatacccggctttacggttaagggatacgattcaaccataggcatgagttgagcgaggcaaatagacttattactaaaagaaattgttagtacacaagtggatggaaattttagcctatactattcctaactactactccctccattccacacaaaaccaaccgtgataccgattcgtttcgtaaaattttgtttatagaaaaatgcccttgcgttgcaacgggtgaagattattattgtgcagtttagctaaggtgaaattcactgtaggaattcgcttggatattctttttataaaatcatgagccgcaattaggggtccgatcatctcaagttagcatgcaagttttttaaagagattttttatatgactccttctgtatttctaaaaacaaacaaaattaaaaaccgactcaaacacggatatatacttccaaaagcgaatgaacttaaaaaccgattcaaacacggatgacgtaccaaaagtatcggcaaaaacatcttcaatttttatatttttgtttatttactatttgcaggttaagttcttttgtatggttatcgctttgtcgtttgtaaagaaacaaaaatttacgagtttgttgttcggagaactgtatcaccggctgatcgtgttgtaaataaactcgtcatagttcgttgttcggagaactgtatatagtttgtgaaactgctctatgagctatgacgaatttcagcgtcctattctcatagacaacttgaaggccattaccgcagtccatcggctggcccctgctcggctgctttggaaaaaagcccaagcacacatatataagactataagagtgtcttgatgaaattgcattaatagtgtttctcttccaagaaaaggtctatttcactccctcaaccataggccggatttaatttatactccgtatttctcaactataaaagcatagttataccgcctccctcaagtgttaaaatcgaatctttcatctcccctaagggtttagggtttaggtggtttcattatatgtggcatcccgtcatcccgaacatcatcaaggctgccagttgtggctagagcttgaagaaggacttgatcacctttttcatactcactctatcccataatataaggtgtgcaaatattctaagattcaactttaaaaacatttggccaacaattattactccatccatcaacttttaataggcatatttccaaaactggaaaatttatttttataggcatatttcaatccaacaatatattctcttaatgactttctcggatttaatgcgtaaatctccattggtccacacaaaattggctatatagacatcgagaaatacaaatattaatgaatcgcttgtttaataactagtaacatgtttaaatagactagtaatcatgcacgtagcggcatgagaaattaaaaaatatatattgcctataatcaaacatattgtttccttatatggcaaatctaacatcaatttgcggaagcaattatacttccaagaggtaaataagtaagatggcgtaggaacttcatatatattacaaactttacctcatgaatcaaacttatatggtttagtaatatgaaatgttagaaatagattcactctaaagaaataagcaattgtcaagcttcgaaatccacacggcaatcggcaaccaccagacatttggtgttaactcaaaagataaagatatggtagcacaatcttgaattatcggtaagatgaaaaaaagaagagaacttctaaagtcaatcttgaatggcagcacaatccattcgcctcactcgcacttgccattccactccaactctcctctacctgcagcgagctgccattcccctccaactcccctctacctgcagcggacacaaacacacaaccataaaagaccaagaacccaaaacaaaccattccgacactaaacctagtgcttgcatataaatggagaccatactaatga

SEQ ID NO: 44659 - DNA, 1260 bp, Oryza sativa
ccaggacccatcaagatcatggcacttgaggcaatgagatttgctacaataacaaaagtttattttttttcatcttccattgaatcaaagcaaagagaggccagaaactaacctggatatattagtagttgaggacatgtgtgcattagccgcgggccacgtagaatagacatcacattgggtattagtttacatcaaccagcgacaagccaccacaaaaacaatcttcgaagttcgtacatcttaattaaaccaacaccattcctaataataaaggtgttgtatatatgctccccacgtccatcatgccgttcaaggctcttggtcatacacacatacatctgcatgatcctggcaaatataaaaacgtaagtacgtggcctcatggaaaggaacagagccacacggaataacataatgaggagcattagcatgtgtccccttatctagagttttatctgaatatacaattctccataagataccaaattcgttcatgtgcatggagaaacacaaacctgaattatcaaacgattgggcaggtgagctgcatgattgaagcttgtaggatgaagaacctgctgcgtggctccctagctccgatcctcattgccacctttaaatatgatgcacttggggcaacaattcacagccagtgcatgcatatgcactgtccagatgctatgccttgcctgcagatgggtaccagtttagtagttctgatctggtgtgttcctccactcttcaacagatacgtacacagctatacaactgaaagtacagtacactgcatcatttcttcttggtcaatgttttgacaatgatgcaattgtcaatgactatattatgtagtatatgtttaactaccatcagaatcagaggccctgtttcataattttcaggcaaatccttccactgagttttataagatgcaacgagattaatgcatgccctttctttattttcaagagtctagtatttcacaagagtagagacatgcatacatcagctgaagttcagaacatagtagtacaaggtacagacaacctatgaaacatgaactacgaaatttctcttttcgaagattaagaaagagtcgaaatatcttgaaataaataataagcataaccttctacatgatataagcataaccttaatgaattaactaacttctttttaaataaaaataaaaatagaaaatctggcctcttagcattctaaggctaaaaatctagtttaaagttaaaaaaaaccgtcttt

SEQ ID NO: 44660 - DNA, 3587 bp, Oryza sativa
ctatggccaagagtggtcaactcctccatcccgcaatcttcggttacatgcgactaacaactcagtacactcaagcataggctacatcatctatggtagcatcatctttctttgatttgctagcaagctaagggactttgtgcaaattaacctttacgacttggtgtgcatataaccgttgctgtgccaactcttttgaacacatattgttttaccactacatatcttcccccaagtaaatgatgcaatacatattttgaatggcgctcatgctggcatttggactcattagagagactcattgatgagattttccgttatcacttagccatgcttacactgttctcagactcttatagtcattctatagctgaaggagttcaactctttcatcttgtagtattccgttactcgtgacccacaactcactatactcaagtgtaggctatgatggaaaaggaggcctcttcactcgaaacagtagcatattttccttttggttgttcgcaaactagtgcataggaggggatctcgccttggacaattagatagatagttaggttagtcattcgagccattgtatcctccaccatcaccacacaaggtggtggtataccttgtttgtcaacatggtgtatatatataaccgttggtatgccaacttatctatacacatattgttttaccactatgtatctttccgtagtaaatgattcaatcacctataaatgaacgacactcttgttggaagttcttgctgggatttgggcacattagagagacgctttgatgagatttttcgttaccacttagccgctccaaccccattatcaacctccttaatcgaacgatgtcctagagctcaactcttccgcagtcttcagttacatgaggctaataactcacttcattgaagtgtaggctacgtcacctaaggtaagcatcatcttcctttaatattctagcaagttggtgacctttgtgcaaattaacttgtacacatagttgtgaaccgtcttccctttcgctgatctcaagcatttgggtttatttcctcggagtgaacatttgatgtcattgtcccttgattgatacctcatatatcttggtgacagtcaatgggaggagggggggggtcccatcttgtaggtttagtcattgaagccattatattgcaatctccaccgtcatatgtggctttgcttgtaatgtagctaaataattacctgaagtaggttgtggtgaagaggagaagctaggacatgagttctgctctatttggttgatggctttcaagtgccccaagagggtccttatataggggttcagtaggtggagaggtcaatgcttctcttaattcggtgttgatgcaatgcaaaataacaaggctccattcatcccctcccccctctctctctcttatgtcattcatttcctagttttgttctctctatatcttgtgattaattctaagattaatagacatatatctgcacataggggtgaaaacggtcacggaaaatcctgatcgaccgatgctccttttcagtttttaccggccgagcaatgtgcagatggtcaccaacgaaaacaaaaataggaatggtaaaaaaacatatggaaatttaaacggaaacatttttgctgcataccgaacgtttctgactttatcgtgttcgtacggtaattacttttttatactatgtaattatcgtagttctaaatacactaatatttatgatatatttctttaattgacccatggtttagagagacccgtcgatttcttaaccagacccttaacttgagtacaaggttaaaaggatataatttggaaccttgaatttatattatcatattatatacttttgcaaagctaaatgtgctattgtacagtttaatattttcgatatttattatcggcttctgattgataccgacatgtttccatccgtattgtccctttccagtttttcgatatttcctgtattgttttcatttatgtctttaccatttttgaaaaaatggttttggaaatggttgagatgttttccgaccgttttcatccttatctgcgcattacaatgatctatataagttggctgtgtcatcctctcatggatgtagatgctgggttttttaatccattaattaacaaaaatgtatcatacgtacattctaaatttgaaacaattaatatagtttttttcagatgaactttgattcatgaacaattctaatacaaatcatgtatgcaaatgatatactacctttctttttcaacttgacatttttgaacattgacacatcaatctctgatacatatatttgattattattttaccgtatcatatttatcaaaagaaaattattaaaaatataactatacttcaagacaaatctagtaatttcacatttcaaactcaataatttcatgcattaatgactacagattttggtgtttaaatgcatatatattgtaggatgtcatctgtcctaaatacaaactgtcatctaaattgtaaagtatgaattttatgctattaagttaagacactttccaatattagtgagccacaaaccagtctcatatgaatatatttgatcattactttatcatatcatatatttctcgaaaggataatattaaatatatagccacacctcacgacaaatctagtaatgtcacttttttactcaataattttgggcattaatgatataagatttcgatgtttgaacgtgtatattgtaggacgccatgtgttctaagtaaaaactgtcctctgaaatgtaaaacatgaatcctgtgatatgaactttaagacactttccagttatattgatgagccccaatccagcctcagatgaatacatttgatcattggtttatcatatcatatatttatcgataggaaattattagaaatataactacacagcaggacgaatctactaacatcactttccctctatttttcgtttatataccaactatatctttctttcaacatcacctatttctctattgatcaaatataggcggatgttttggtgaaagccattgggaggtggtcccaccttgtagtaaattttatagaaatacatattttatggtcaaagttgcaaaaaaccacacacactttgacattggttacttaactacatatattttagattgaagtttcacaaaactacaccatcaatgaacgggcccacctgcaagatgacgtgtctgttccacctaggatgtggacttgggagctttatcctaggtggaacactcataatgccacgccagcatcctaaatatatgtagataagtaaccatgtcacctcatgagtggacccattcgttgattgcgtagttttgtgaaactttaataccagaatatatataggtaagtgtcaagtgtcaaaatgtgtatgttttttttttgcaacttgaaccacgttggtgcagttttatgaaatttactcttcttttttaacttgatatttttttacaatgacacatgagtctctgatacatatatttgcccattattataccatatcatataatatgaaaaggaaattacgggtgc

SEQ ID NO: 44661 - DNA, 13337 bp, Oryza sativa
ggaccgaatttctcggtcttggtcttttcgtttcggtctttttttgcccactcctacctcaaggaaatgctatggttgcaacgagtccgaacacttcatcgccgaaccctttgaaatgtaaaacacgaatcttgttatatgaacttaaggcaatttcctttcatatttgtgagccccaaatcaatctttgataatatacttgaccattactttatcatatcatatatttatcaaaaggaaattattaaaaaaaagctataactagacttcatgacaaatctactaatgttattttttgtgcacgataattttgtgcattgatgaattacgatttcaatgtttgaagcatatattttaggacgccacctattctactagtttattttgtgagagaactccaatcaactccagagtacgcaataactaaaacacgtcccttacaaagtaaaatttatactacgtgttatatgttttcaaacaactaataactttactaataggcttagtaggtgacaaatctactaatgtaattctttatactcaacaacttcgtgcattaatgacttaagatttagaaacttaaatgcatatattgtaagacgtcatatttagttataaatgcaaattaactctcttctcacaagtcaaagtggagatatttctcaaggaaatgctatgattgaaacgagcccgaacacttcatcgtcgattgcccgaaactctaccctctgaaatgtaaaacacgaatctttgttatatgaacttaaggcaattttctttcatatttgtgagccccaaatcaatctctgataagtgtacttgaccattactttatcatatcatatatttatcaaaaggaaattattaaaaaaagatataactaggtttcacgagaaatctactaatgtcattttttgtacacaataattttgtgcattgctgacttaagattttgatgtttgaatgcatatattgtaggacgtcatatgttctacatacaaactctccacattgaatgtaaatcacgaatcttgtaggatgaacttaagatattttcctatcatattgttgagccccaaatcaattcagataaatatatttgatcattactttatcctaccatatatttatcgaaagaaaattattaaaaatataactatgtaggattgaacaacaagaactaagccaaccagagaggggtgaatggttggatatcaccggccctatgcacctggtctgatcggtcccacacaaagaacaccacttctctctatttttccaactatatataccaactatatctttctttctatatcacctatttccatatcgatcaaatataggcggatgttttggtgaaggccattgggagggggtcccaccttgtaggtttagtcattcaaaccattatattgcaatctccaccatcctacacaaggtggtggttttgcttgtaacatcatatatagttgttggtgtgccaactcataaattcttactagtgataatgtttttatcactacataatcttcactcggttaagtctcaatctttcccaagtaaatgattcaatcacctcgaatgaaaggtaattttaccaaatgtagttgttagcatttggatgtgttcaacagatttattgttctgctttcctcttatcactgaactgtgccaacccttcttttagactcttagtcatactatagccaaaggaggtcaactcttccattgtgaatatttcgttacccatgactcacaactcactatattcaagtctaggttattatggcaaggaaggctcttcatttgaaatggtagcatatttgtctttgagttgtcaacaagccagtcaatgtgagggatcttgcgttgtacatttatataggtagttaggttattcatttgagttattgcattctccaccatcatcaccatcagtggcagagcttagtggagactaacatggatgatggtccccctagtatattggatgaaaaacttcatataggtagcacaagttactaacttcctttcatatgttggttactatacttgcctgtttcattccattggttttgggttcaactcctcccgaccccacccccccctcgttttttttctacagattgccctctaatgtgaaaaaaaatatgtctttaacactttcattgtttttctataaattgccatctaatgtgaaaaaatgcctttaacacttttaatattttcctctgtatattgccctcaaatgtgggggaaaatgctttcaacacttccaaaaaaaaaatctacagggtacgtgaaaaaaatgccattaacactttcaatatttttttctctatagattgcactctaatatgaaaaaaagagcttttaacacttcctatttttttaaactaatggtattgtttatgttatcggtactatcaataatacttaactttattctttttaccactgcatatgtttccccagtaaatgattcaatcacctataatgaattacgcccttactagaagttctcgatggaatttggatgcattagagagacatattgatgagattttccgttaccactaagccataccaaccccttttccaccctctgtaatcgtcctatggccaagaatggtcaactcctccatcctgcactctttagttacacgcgactaacaactgaatacattcaagcataggttacatcatatttctttgatttgctagcaagccaaggacctttgtgcaaattgacctttgtcgccttagcgtacatatatataaccgctggtatacctatattaaatggcgctcatgctcgcatttggacgcattagagagattcatttataagatttttcattatcactgagccatgccagccctattctcatactcttatattcatactatacctgaaggagttcaactcttccatcttgtagtattccattacccgtgacccacaattcactacactcaaacataggctatgatggcaaaggaggcccttcactcgaaacagtagcatgttttccttttggttgttcacaaactagtgcataggaggggatcttgccttggacatttagatagctagttaggttagtcattcgagccactgcattctccaccatcatcaccatacaaggtgaggtataccatgctcggttagtcaattccttaatgaacctatatgtttgtcgacttagtgtgcatatataaccattggtatgccaacttatctatacacatattgttttaccactatgtatctttccctagtaaatgattcaatcacctataatgagcgacactcttgttggaaattcttgctgggatatgggcgcattagagaaacgccttgatgagattttttgttaccacttagccgcaccaaccccattaccagcctccttaatcaaacaatgtcctagagaggtcaactcttccgcggtcttcaattacgtgaggctaataactcacttcattgaagtgtaggctacgtcacctaaggtaagcatcatcttcctttaatattctagcaagccgggaacctttgtgcaaattaacttgtacacatagggtcatttgatttatgttcttcttaaggccctacacataaaaaccatcctaggtcctctggtttgatccttgcataaagttccactgcacactacaccctccgtcacaaaaataagttcattggtgggtttttgtgttcaacgtttgaccgtccatcttatttgaaaattttatgaaaaaattaataaaaacaagtcatgcataaagcactattcatattttcacatctaataacaatcaaaatactaatcataaaaaaatttaaataagacggacggtcaaatgttacacataaagaaacccacaaatgaatttattttgggacgaatgattgtattttctggtccacagctgcacaggcttctgatttcttctggcctttgtagccttgatgcttaagctcagatcctgactgtttctgcagctggcatcaacatataattgggtaatgatgcccttgtttatgtctctccaatgcgtgtgtcggctgtgggctctgcagtggtcacccatgactgcacctgccagagatgcccccctccgctgttgccaacaatatctgtgacgtccactcgttctcagccgtcagatttcgatcagaccatcactttcttctcagccattacatgcacacactttcttctcacaaattacacacattacatgcacacacttttttctcacaaaattagaaaattacacacattacgtgcacacactttcttctcagccattaattaagtattaacaccaactgtcttgcaaattaattttctcaagaaaagggttgatcatcataggggcaaaatcaggtttaacaatcccggttttggttataaggggtatcctcggttttcacgccgttgttaaactgataaaatctgaataaatcttataaaaatattataatttagtttgatttcttttgaacttgaaataaaaacgaacgattcgtgttttcgaccctgtccaaaaagtctagattttgataaggttcacaatcccggttttggatataaggggtatcctcggttgtcacgccgttgttaaaccgataaaatccaaataaatcttataaaatattataatttagtttgatttctttcgaactttaaataaaaacgaacgattcgtgttttcgaccctgtccaaaaagtccagatttcatgaattccacggagatcgtaaaccctgcacaatattcactctactgtttttttttatcaaaagatagtgggggagtcccccatggttaaaatgttatataaataaaaaggagacagtttatgtacacactctactgttcttggtgcaagaacaggacaagaacagagtccaccattcacaaacaaatacacaagtactctctcttgactgaatcatcattgctgatatgcaatagagggaaaagtataatggtcactgtttgattagggacaatgatcaacttcttaacctaaagtcttatcttgcacttctttaatggaaaaggggggagggggggggagttacaacttactgctgctacaagaaccattaatccaccaccacataattaattccccccctactaaaacacacactcacacaccaacccataacaataaaaaccccaacataaggtgacacaaccatttttttggttttttatgatgaaaccaaagacattaaaagaggctctactactactataataatgatgaagaaatccggcatcgtccagtggatgatccaacggctgtcactcgtccactcatgcatggatcctgaggtaaccatccgtgtgagcatccactggacggacatggctggcggcaatggcggtctcctcctcgtcggcggcagcggcatcttcattttcttctcacaaaattagaaaattacacacattacatgcacacactttcttctcagccattaattaagtataacaacatctgttgcaaattaagtttctcaagagaaaggttgatcatccgaggtcccagttttggttataagagatatcttcggttttcacgccgttgttaaaccgatgaaattcaaataaaacttataaatatattattatttagtttgatttcttttgaatttaaaataaaaacaaacgattcatgttttcgaccctatccaaaaagtccagatttcgtggaatcgggagatcgggaatctagagatcgtaaaccctgcacaagattcctactgttcttggtgcaagaacaggacaagaacagagtccaccagtcacaaacagatacacaagtactctctcttgactgaatcatcattaatggtcactgtttgattagggacaatgatcaccttcttaatctaaagtcttatcttgcatttcttcaatgaaaaagggggagttacaacttactgctgctacaagaaccattaagccaccaccacgtaattaattcccccctactaaaacacacccacaccaacccataacaataaaacataaggtgacacaaccatttttttggttttttatgacgaaaccaaagacacttaaagaggctactactactataataatgatgaagaaatccggcaccgtccagtggatgatccaacggctgtcactcgtccacgcatgcatggatcctgatgaggtaaccatccgtgtgagcatccactggacggacatggccggcggcaatggtggcctcgtcggcggcggcgtcttcacttgcgctttccgccgcgcttcttgtcggcgtcggcgtcgacgacgacggcgtcctggttctgtagaaggtcgacaagggagggttgcttgcagttgatgcaggtcgggtagtccttcttggcgaccatgcagtacataaggcaacgggtgcaggcgccgatcaccatcggcgacttgtccccggggctaccgccggcggagctgcggccatccgacgacacgcacgacgtcgccgacgacgagtcgctgtcgtcgttgccgtccacctccatacccaccgccgacggcgacaggttcagctgcagctccaacctcgcccccctcgtgctccagacgccgccgccgccgttcccgttgctccggctcatgcttccctgattcacaaatcaagatcatacatgtaaatagaacaccattggtagatatacaaaaacgaaagaaaaaagagatcgattgtttttttgctcgtgaacaagaacagcgcacatcgatcaagatcgatctttgtttggtcatgaaaaagaagtgcatatcaagattgattttgctttttgtttttttgctcatgaacaagaagagtttatgaagaactagaagaacaagtcaatcaagaatcaaataacaaagttgctacctgaaggttgtggagaagagaggagaggagaggagaagagaaagaaatggacactgctctatttggttggtggctttcaagggccccaagagggttttatataggggagttcagcaggagaggtcaatgcttccctcactttggtgttaatgcaatgcgaaaattcatctcccccccttctctgcttccatatctttgtgattaattctatgaatactaaccagatatctgtgcatttacagttatctataatatctataataaattaagtataatatgttttaaacttgaaacaacattttttttcgagcgttgttgcggtacagcggtcggtaccagtaccgcccggtaccaaaatcctggccgttggatctgacccgatccaacggctggtagagtttgtactgggcggtaccaattctgtccctggtgcagtaccaagtggggaactgaggtggaagggcaaaaacgtaactttgtgtgcaatgagaacagactattaccctagaaatcccgatccgccgccgccgtgttcctcttccatgtcgtcgccgtgtttctcttccgctccagcgccgccatgttcctcttccgccccgccgtcgccgtgtctgccactgccgtgttcctccttcggcgccgcgagattggcctctgtattgtccgtgaaagcggaggcggaggcgaatgagccagcggcggagtatgcggttgcagcggctgaggagccgctccggtggtggcgccggagtaggccgtggctgaggcacgacgaaggaggaggcggcgggggagaaggcacacccattttctctcacgatccttcccttccctgattcaacggttggatgatttttggtaccacattctgctggacagtaaaaaatctcttttttttttcaattgaactttgatcataaataattctaatacaaatcagatatactacctttctttttagtaaattttatagaaatacatatttttatggttcaagttgcagaaaaccacacaaactttaacactgggtacttaactacatatattttatattgaagtttcacaaaactacaccatcaatgaacgggtccacctgcaagatgacgtgtctgttccacctaggatgcggacttgggagctttatcctagtggaacactcacgatgccacgccaacatcctaaatatatgtagataaagaaccatgtcatctcgtaagtggacccattcgttgattgtgtagttttgtgaaactttaataccagaatatatgtacttaagtgtcaagtgtaaaaatgtgtatgtttttctgcaacttgaaccccaaatgtgcagttttatgaaatttactctttcttttttaacttgatgtttttttaacaatgacacataagtctctgatacatatatttgcccattattttaccatttcatataatatgaaaaggaaattacaggtgcactaaaacacacccagagtacgcaataactaaacatgtcccttacatagtaaaatttttgctacgcgttatatgttttcaaacacataataactttactaataggtttaataggtgacaaatctactaatgtaattcttcatactcaataacttcatgcattaataacttaagatttagaaacttaaatgcatatattgtaagacgtcatattttgttataaatacaaactctcttctcacaagtcaaagtggagatattcgtcatggtaagggtgggcatttggtttgactgaaaatttcgttatgggtcttcggtctttaggtctttaaaaagtaaagtaaagactgaatttcaacgcaaaaatgtcaggaccaacaaattcggtctcagtcttggtccttgaccgaaattcaacaacattttcatatacgcaaagaaataatggaaattttcaacacaaaaatcacaaaaaaaatgtaagcacatatgagtaaagactcttactaggttgcatgcctagaagaagtagggatgtgaaaattagagtttaatcgtattaaacttagtggattgtaggttgcatttagacttttttttgttaattcggtttatttggttaatcgaggaaaataaccaaattgactgaacaaaattgggtctttcactacctagaaccaaattgatgaccgaatttctcagtctcgttctttttggttcagtctttttctgcccacccctacctcaaggaaatgctatgattgcaaagagctcgaacacttcatcgtcgattgcacgaaactctacctagtggagttgaaactgtttgattgggctccaattctaggagaggtagaaagctggagcgatgtcaaacaacccctcaatctccagtaaatatatttgatcattaatttatcgtatcatatatttatcatataatatgaaaaggaaattacaggtgctctaaaacacacgcagagtacgcaataactaaaacatgtcccttagatagtaaaatttatactacgtgttatatgttttcaaatacctaataaatttactaataggtttaataggtgacgacaaatctactaatgtaattcttcatactcaataacttcgtgcattaatggcttaagatttagaaacttaaatgcatatattgtaagacgtcatatttagttataaatacaaattaactctcttctcacaagtcgaagtggagatattcctcaaggaaatgctgtgattgcaacgagcccgaacacttcatcgccgattgctcgaaactctaccctctgaaatgtaaaacacgaatattgttatatgaacaggcaattttctttcgtatttatgagccccaaatcaatctccgataaatatacttgaccattattttatcatatcatttatttatcaaaggaaattattaaaaaagatataactagacttcacgacaaatctactaatgtcattttttgtacacaataattttgtgcattgatgacttacaatttcgatgtttgaagcatatattgtaggacgtcacctagtagtctactagttcattttgtgagagaactccaaccaactccactcccattttgagtggagttgaaaccatttgattgggctccaattctaggagaggtggaaagctggagctatgtcaaacaacccctcaatctccgataaatatatttgatcattaatttatcgtatcatatatttatcgataggaaattataaaaaatatagctatacctcaccacaaatccattaatgtcatcttttgtaccttgaataatttagggtattaatgacttaagattttgatgtttgaatgcatatattgtaggacgtcatatgttctacatacaaactccccacattgaaatgtaaatcatgaatcttataggatgaacttaagatattttcctatcatattgttgagccccaaatcagtctcagataaatatatttgagcattactttatcctaccatatatttatcgaaagacaactattaaaaatataactatgtaggatcgaacaacaagaactaagccaaccaaagaggggtgaatagttggatctcatcggccctatccacttggtctgatcggtaccacacaaagaacaccacttcgccaattatcatcaaatatcaaaaccaattatctatcatgctaattgttcatcatgaattaataaatcaaaacacactttgatttcacaaactaaaccttacgactaatgccatgttttttactccctctgtcccataatataacctagaaccggatgggacatttcatagtacaagaatctagataacctctcgtctagattcattgtgctatgaattatgaaatgtcttatacggtcttatgttgctatattatgggacggagagagtacttaattagtaagtgtaataatgacttaagatttcgatgtttgaatgcatcatctattctaagtatacaaactccctattgaaatgtaaaacatgaatcctgtgatacgaacttaagacactttcctgtcatattggtgagccccaaatcaacttgtcctgctggtgattgccccctctgcttatccaccatgctattgccaatacctgtgagtatgtttacaccatgcagcagttggcaatagctgtatgacagtgttaacatcttgaatgccctttatgaacagaatttatggccacagctgattctatctagcaaagtaaatgtgcatcaatgtgtcactggttatgtgaataaatagatcttaaataggagatgtgctactttaggtaaatagtgtctttaattgaacggcgaggtcgtacatatgtctttgcagcctctccttcaatgctctttacacttcaatgaagttataggaaactagcagcccattaacttcaatacttcatttgatgtttcacaaggtgcagcttgtgaaatgacatctcaccagcaagcttttagaaccctatcgcatctatgcttgatttcttttactgctttttagttggttatttttataaatgtaccgcttaaatttgctgatgtaattggggctctgctcgtttagtcaaagaggagtttattcttgccagtttgctctgacaacgaagctctatagcattctagggttgactccgagtgtatcttgcaggaaccaggacgagacaagcaacaataccagtactctgaataacttgtgctcacataatatagctccaaaaaatatgtatgtatgaaaaacctagatctcatttttaaagaacaagtaaaattaaaatcatacatattttaagtgaagtgtatctgacctaaaagttgtaaacatgagacatggaaattaaagattagtactttcaactttcaatcaccatcatcaggtaaaaataagaagcatctgcttatctgtagcatatatttaagctgaattaggctcatctcaaaggagggaaaaattacccattcccaagggatttaacagttccatgtgaaattcatgcttggttacttagagggatatcagtatcagactacttatatttctatcaaatgataattgtcctcaaacttagcagactcatccatggtggacatatgaggtgtcaaactcttgttcatgttatatatgcaatcttttcagtaagggaagttatatatgtaatctgacggtgtaagcattagatagaaaagaaggtaatagttatgttgttcacaaaaaagtttaaaaattgtgcacatgaaccttgataaccttatacatgaataaatataacagagaagagaatttttgttgtctaacggattaataatcagatatgcatataggatttgaccttattacatacataaacaggaagttctcaaagagacaaggtagtaattgttttgataatagaggagcactttacatggactgtgcaccaacagtagacgatcaacgaatgcaaccttatatgcattgtttccttttttttcttttgagcaaattctatgtacatatcttaacatcagggcaattgaatgatggtactcagtactcagtacccaggggatttgattactgtacagacaacatgtgcgatttaaacaagtatggactgttattgcacgtgccaacttgaattatatattcgatgaggattaggattttaatttaaaagtatattgtagaccatttattcatagattcagatatttcacaactaagacatgtttcaagatctgttctgctatgtgcaactaaggaaaaaaatgtgacatgccggattctgatgagtttcaaactgcagaatgaagttgcttgcaaactgatatgtaatgctcgaaataaaaaatcgacaagctaaaaataataataatcataccttcaggtctgatgatcaccagaactccagatgacaattatatgaaatctgtgacacaggtgagattactgatgttagctgaaagcctgaataaagctctgagtaagttgtgtaaatacgcacagatcaatgtacaacaaaaatatgtgaggatatatatcaaatatatattatctatttctctgtacttatcaattacttaaagtaaatagaaatttccaagaccataactaatcagatcattcaaaccccatggctgctgttgtcttgtggaaggagagaaataagagaagggtgatcacaagtgaggacaaatcagcatagcaggtggagcaagacaaagctaaatccttaacagaagatagaacaaacgatctacaagtggaagttgtgtatccaacgcgctgattttgttttgctactgacagaagaaaaattgccatttgttggattatgacatttcacactaaacagaatgtacaatatagcatgattggaatggaaccctaactgcacttccagtgtgctggtgcaatacagtctgttgaggtttatttatattaatttccagt

SEQ ID NO: 44662 - DNA, 10351 bp, Oryza sativa
ctcatctgtttgcctttaagtttctgagacgaaactattgcaaaccaattaaagaacgctaggacagtcagagcttgcgttcttatgcaataaaaccagctacagtagcgaaataactgtgtaaatcagaacactttaatgttctatcttggtcacttcaatttcatcagagtacacatttccctaactacaaatatgtactcctacgcaagaactatcacttttttatcgcatgaaagtagaatgtgatataaagctcacatttctcagagtagcaattcacaattgtacttgtattctttcaacaactttgtgcgaaatgctggcaaactttagggtgtgtttagttcatgccaaaattgaaagtttggttaaaattagaacgatgtgacggaaaagttggaagtttatgtgtgtagaaaagttttgatgtgatggaaaagtttaaagtttgaaactaaactcggccttaactgaaaaggtaagaagaagagtcaggctcttccaagattatgatgcaatcatctttttaaccttagacatagattaccactcactggatgaagcatggaaaagttacgagtaagacatctaatgatgcatttgttgtagtatatcttactagcaacttaggctctagctaatcaatagtattatcgtcttgaaaatccagcaatttgtaacttatttctccattaactagtcaggaatctttcctacatttatcgtttctgcgccaagggataccagtattaagttggcatcgttcctcaaaatgggctacaacctttatgagctcagagccttaaaggcaggtgtaaagagggacatgtctaatctttgaccacaaaaaaatgaattaacccaggaaccagtgccatcgtggataaatgaatcccattgacataactctccagcaacaggtagaaataactctaggaaatgagcagggtacttctccctccctctccacaaatataactgttccaagcatttaaaatttgtccacaaatataagaattctagaatactacttattcatcaattatatctcatctgaatttcttcccatcctatccccaacaacaaccatctctccttcaataatggacaccaaagtcttttctcctcaatcttaaatctactaaataacttagaattacttatatatgtggacagcgggagtactctacaaacataatcaatgcattatggaacacaaacttgtaggattgaacacaagtaaccaagcctaccagagagggatgaatggtagggaaaaccaaaaacccaaaaacttttagcggaaataaaagttaccctcaaatcgatggaaatctcgacgtagtcctgtcgccgccggccggaccactcacacgccgccggttagatcatctccctgccgcctgaacccgaagaaacacaaatcgaagaactctcaaagtagatgacaactttattgcttctctctgtgttacaagtgcaccaacagcactctttacaaaaatttcgactaaactcgaaaccctaactaaactagcaactcaattgctctcgaaaacgataccgggaggctacctctccctctctgtttataccgaaaacctcctactcaaagtagcagaacaactcctaatcacactaggactctatcctcaattaccaaccaaattacaatttaccaaattgtaattctctcaaactacagccgcacgcatctcttataccagcttggtctcggtctccatcgcacgggacgacaccaactcggcctctctaccttgccctccagggcgacacggtctgtatccaaccgagccgctgcatcgctacctgtttgcacagaacgcacacacatgcatgctacagtaccgcccgtactgtagcaccatatgccagccaatcacagacacgatcaatcacacatatatgcatgctacagtacctcgccgtagtgtagcatcatatactcttcctcagttgtactctaatccccttcgcgaacaccgacgcttgcatgcatacctcgtgaagcccgttgcgaatatctctcctacacggtatccatccaccgtgtaccatctcgtatccaacttcgtcacccgatatacttaatagtctggacctcaactcctccttgagtttagtcccgatccccaccgttgactgaagttgacctccaagaatcctgactctagtcaccttctcacatggtatcccgaccgcaatagacctctgctcctccctgagcatagtcccggtcctcaccattgactaaggctgacctcaagtcacctgcacacaatcagacaaaacaaccgtttctggacacagatatcacaacctgacccacattagtcacacgcactcacaccaacatccacacatactttcaaaccaaatctttgattaaatcatttgcatagccaattgttcatcacaaatattaatcataaaaatgatttcacaaaactatttaagacaccatgtaatataacataaaaaaaaagaagaggtggtcagaagtacttctttctcataaaattttgtctcgaagatctgatttcctgaacaaagatatgttttcctttgtacaggacagtaggacacgtatagacctaaatgaacaattgaaaagtcaggcaagaaacagaggccgagtttagtttcaaaatttttcatcaaactttcaattttttcatcacataaaaacttttctacacacataaactatcaactttttcagtcacatcgttgcaatttcaaccaaaattccaaatttggcgtgaactaaacacaccagaaatgggccagaaactaatatcagaaaatgagttagacaaaatgtatttcagttttgacacatggaaaggggccatccaagtatccaagtaagatctttgctcgatacagttatacagaggcaacataacctgcaatcagcagcagtaatgcacatgaacaattgaacacagatgctgatttacctttgagttccagaacgagacagatgatgccacctctccagccatgttggcaacaacatccaatagagtaccaggaagcgcagaaaaggtgtcagggaacacacatacagacagaggcagtggtggtggtctggtggatgcctatcttgttgtcgtcccgtcccgtctcgtctcctccaggcagatatggctgagagctccagtccatgccgcgcacacgagctaggcacgcacgcggcacgctcctcgtcgtcaggcgacctggctgcaaatccaagcgggggcgtcctcttcaggtgttgttgcgagtccaatccagccgtcgcctcactctcccccactggtgcccttcggcgcggcatttcgtcaaacacctcgtcgccatgcggtgatgcatgcgcggtgcgcccgtgccgacgagcaacttggcaacaggaaacagtcctcctacgacgagtggcccagcactttcgaggcggcggcggtggacgttttctgcctcggatcagcttgcccgcaccgccgcacgccggcggccgcggcggcggcggacggttttgctcagacaaagacggtgagggtatggcccgtgggccgcctctccaccattctcccattcttgggccgtctaccgatctcctattctcccttggaataagttcaccggaggtccctcaacttaacagcgagaattttcgaggccctcaaccataaaaccagaaatctccacccctaaactatacaataccgttcactcaaggtccctaagcagtatatatgggtggtttcgctgacgtggcatcctagtcagcaaataaaaatttaaaaagtgcgtggggcctacatgtcaactgcacatattctttttcttctctttttcttttccttctcttctcttttctctcctctctccttttcttcagcgagggaggcggcggcaggcggagcagcggagggcgagcgcggcagcagagggcgagcgggcgcgagcgcggccgcgggcagagaagcgggcggcggggcgcgtcacgtcactagacgtgtccatgagcctccttgccggcgagctctcaccggccatcgccaacctcacgtagctcgagctactcatcaacctcacctccaacgccttctccgggagcatccccgatggcctcggctggctccggcggatgtggtatctcagcctatgcgacaacgcgttcgccggcaagatacctgacgtgctccgcaattgcaccgccctcgacgtcgcgtacctcaacaacaacaacctcgattgtcggcggcgttccacggtggctcgacgcgttgccgaatctcatggtgctccggctcagccacaactcgatctccggccacatcccgccatcgctggcgaacctcacgaagatcgtgcagctcgagttcgaccagaaccttctggaaagttccatccccgacggcttgccacgcctcccagcgctccgcatgttagccttgtcgcagaacagcctcaccggagagatcctgccgagtttcttcaacatgacgtcgttgcgaggcctcgcactcgcgaacaacgtgttccgcagtgagctcctagccgattgacgtgggcgtgcgcggaccagcacattcctccaagttctaaacgcagatcaaaccatacaagtgtaaaacttcatcaccgaattcgcatttctatctactccacgattcggacgtcaactagcgatagcactgtagtctgtaccacgagttcacgacccgacacctccaggctctatccctaacccgagtaacaaccaaaagaacccaccaaacctggacatctcgagcgattcccacacagatctgcgagggctagcgaatctatcgacactacataaatcagagtaagtccaaagaagcaccttgcggcggaggtgctccttggggatgccggagaccatgcttatctcgcctggcttgatctcgacgagggcgtcggacgctgccgcggagagcatccgcgcgggcgcgggagacgatgagaggagcgcctgccccagggaggggaagctccgcaggagcggggcgtccatcttgtcagagccgtacgccgaccgatgacggcggcgcctgggagttcttggacaacctgaccaactgcaacgccttggctgagatattcctcgacggcaacatgttcgccggcgtgatgttgagctccatcgtggttccatccgccattggccgattggcgacctcacgcagctactcaagctcgaccctgagtggtaactcgcagctcgttgcgcgccgcctgccgcctgccacgcccgcctcctgccctcctctcccgctttttccccacgccccgccgtgcccgcacccgcatctgcccgcctctccaaagaagagaagagaaaagagaatatgcagctgacatgtgggcccaagtactttttttaaaaaaaattgctgactaggatgccacgtcagtaaaaccgggcaaaaatactgccgagggacctccggtgaatggttttgtatagtttaggggtgaagatttctggttttgtggttaaggggccttagaaaatctcgctattaaattaagggacctccggcgaacttattccttctccctttcttgggccagtggtccattttgaaacgttaaatgtttcatccctcaaaaaagaaaaaaaataaatttcacaaactaagtataattccaccaaactattacaaaacggcaggttgatgtgttggagtatatcataatcacagattgaacattatgtgtactatgtaaaactacatatctactctctctctccctaaatataagggattctagttgtaccaaaatccttatataagagattttggttgaaagtgacaggacggagggagtataagcgtataagttagtacggattaataaagttattatttttacaaagttagaaagctatagttttattatgtttgtagttttgtaaaaataaaattggtaataaatctctagttttgtgatttttttgtttaagcaatccctccgtttgtaaatatttgacaccgtcgactttttagcacatgtttgaccgttcgttttatttaaaaacttttgtgaaatatgtaaaactatatgtatacataaaagtatatttaacaatgaatcaaatgacatgaaaagaattaataattacttaaattttttaaataagacgaacgattaaacatattttaaaaagtcaactgtatttagaaacggaggagtatatattttatttttttaaaaaaaaatacttaaaagaaagaaaggcgtctcttggtggcgtggcgggccgcgcagctgctgcactccaactctccaagagagaaggaatcgcgacttcgccgccgcggccgcaacaccgacttcgccggcggcggcggcgatgggcaacgcgcaggcttccgcctcctccaccagctccccccgcttctccatggcgtccaggtagtaccccctgggcatcgagagagccttccccgttctcgcagcagccacttcaattccccttactcgattctcccctcgcgatctcactcgctctcgctgtctcgtctcgccgcgcagggccttctcgaggcaggagctggacgacctccgcgcgctgttcgtctcgctggcggcgcagtcgcagaccggcggccgtgccatctcccgccccgtcttcctcgtgagcacaccaccacgcgtccgttaccgttgaatcgaggttctggatctgggaattccagtttacggaatctgacacgcgctgttgatcttcgctcgcaggagtatttcgggatacgtggggcgctcggggatcggctgttccagctggtggcgagggagagcggcgggggtgagggggtcaccttcgaggactttgatcgtctccaaagtgagttggtgcctttctttctcctacttctcaattcattcggtccgttttgttgttcaattaggtgttgcaagtgtgagttttagtggattggacaaatttattagggcattcttgcttgatttcttagtgctaggagctctttgcgttcaaagacaaatgtgcttcgtgccatatattgttcgaagtttagctagaatttattagagaaattcgataatttgacacttttctgttacaaatttgctttaatttacatttgtgcggatgacatgtgtgaccatctgggtgaatgaaagtggcccaggatgtcaaataattgaagcccattttaagaagtgccaaattatcaaatctctcaatttagagaattatgaactttcatctctttctttgcagttttttagctttgttgcatgcatgaaattgttagttcgacttgatatcatgtttcattaacagtgtcagtgtactagagccttggattctgtccaaaatggcaaacactacagcaatggaaattgttttgcttaaccatacttcatagggttttatctttgaaaccttctacctctatataaatttagtccatgaggtgatgtagtttatgtaattatttcttgatttatcaacacaaatgtctctacccagtgttctagcgtaaaatggatatatgccatattttttatggataccaagtgctttcaaacattttatttttattttttttcttgttaggtaatgttttctttgtacaatctaccatgtaggcaacatacgagagaggaactcgagatgaagttgatgaattcatttatcaactatgtgatgttacaggagatgaagtcttagaaaggtactgtcgactgttctcgtatagactggtcttctcatggtgtgtactgtctataaatttgttgcactcttctgatccaaattaatttatgtgacaagaatttcttctttgaagtattctatcaaatacttagatttattttgtgttaggttttattattagctcttctgtttttttatgatccgtttactcttcttctttttatgaatggtcattttacatttgcctttgctgtcctggattgccaggtctgatctggaaactatcttggcatctattcgtgaaaccatattttcagaaaataaggaagctggggaaggctcaaacaagaggacatttgaagcatttatcaactctgcagtattttcgaaggatgctgaaggagtcgcaaggaagtctatgtcgctatcagactttaggagctggtgcattctcattccatccttgaggaagttccttggaagtttgttgatgcctcctgattcaggtctgtttttccattctgtgtattccctacagcagcaatttgaaaagaagtgtctttactgcatttttaatagactcgactgcatagtctaattaatttgtatgatcaagtatgataattgtgttaatcggactagcattatgtttatctcatacacatattattcctcatttttagaatttaccctgttccaacttccaaccccactcaaatggtgagtgtagcttttgtgcagactacagatggtgtttaggggataagcctctctttcacaagtcctgcaataggaatttctacgtccctcacatgtaattatgtgtataggcaggacaaaagattagaagaaccccgagaccatagaaatcaaagagtgttaagacatcattttctcttacttctattctgtctatttctcaaacatgcattgtttccggtcatgcttggaatggacatgtactaggcctgttttagggtacatatacatctggaattacataacctgcatacttttattatcggttgagggagattaacaatggacgtgttgccaagaggtcatgcattgagacgtcacagcgcatagctaacttgacagaggcttagggatttcctgtgaacatcccaatctcacaataacaaaggaagctaaaatggatcaacattcaatctaccatccagtttagtaagtaagaaacctgtggttgattcaatattttcatgtgtacaacaaagccaagtcctgcaggtgaaatgaatatgcgagttaacatagatctttttcacttcatttggtaattgggcagtttctagtgggcatgaatgactgaatgagtctgaatggtgtcaactgggcacatggtgttggcatgattgcaccagtctgctggaacaagatggacagttggtgtagactgtaggctgcctgtagagggccttcatcttagaacattccaccgttattcaaagtgaacctttgatcaaaatcaccacaatgcttgttattcctcattgatatgatcctactgtacccttgcttgtaccttttgaaacagtgtctctattggttaatttgcatgcgatctttgattatgctatacctttttttagtgtttaagcagtctaaaacaattcttcatgaaaatatgtgaactctgaaaagaccatatctaacctggatatgtatggtgtatcatgagcatgatttgtgttattctgtaggcagaccaggcttccaagtaccagcgcttcattacctagaaaacatctccccagatttgctacttttaaataaagagtatgcttggcatattggaggtggtttttcacaacaggaggtgcaagaatggaggcttctatatcacagttctcttcatggacaaagcttcaacactttcttaggcaatgtaacgtgagtactcttaaatattggtgattccaactactctgtttgatataatatacccatttcaagactatctaattctaaataaaaactacacctacaaactaaatgtcatgataatcctttcgcttggtctatcatatctgatataccatcatgattttccagtacgtgaataatccctgggaatgtttgtcattttataggaatggagatgcacagactgttatcatcattgaagatactgatggatttgtttttggtggatacgcatcacatccttgggaaaggcacagtgatttttatggtgatatgaaaacattcctgttcaagttatatcctgaagcatccattttccgccctacaggagggaacagaaacctccaatgggtatgctctgttcaatttcatgctctcatatgtatctatgctcggcatgtcaaatttaaaggagtaaaccttatgtatttttttccagtgtgccgtgaacttcagctctgactccattccaaatggcattggctttggagggcagccgcatcacttcggttttttcctatccgcaaattttgatcaagggcactcatttacatgtaccacattcaccagtcctgccctttcaaagacaaataggttcaggccagaggtaattgaatgttggggcatacaaacgaagggggcacttgatgaaaaggcagagcttgtcaaggggac

SEQ ID NO: 44663 - DNA, 7251 bp, Oryza sativa
caagagaaaaaggggacatgacaaactccgaaacaacgaacggcataatgggcatcgatgacagcatagcctgacaatcactgcacttgcgaaagtacatgtacatctatgtatatatatgcctgtaaatagtagataacatttttggcatgtccaggatctaccatatagggctggggctaagtaaattatgtgctgggccaaattattattggaccaggagatattgatttgtccattaatttcttcttcaatgggcacacggattgtaccagtgcagggtaagctatccgactcagaaaatgaaattacgatgtacattcatcatctgcatgtagagccacagccaaaatttaaatttcaaaacttgatttttagagtaaaattcaaagtttatttttcagcgtggacttttaaaccttaaaaaaaaacttttgctcataaattactttttagtagcttagttcacttctccatggccgtaggtccagcaaattttaaaaatccgtttctacacagaatttccacagccaaaatttaaaatttaaaacttgatttttagagtaaaatttgaagtttttttatcgtagtttatttttcagcgtggacttttaaaccttaaaaataaaacttttgctcataaattatttttatagtagcttagttcacttttccattgccgtaggtccacaacaaattttaaaaatccgtttctgtacagaatttttcgaccatataataattgttcacctacagttccgaatactgtagcatatcactaatctcactaaattctcgttaaaatctcatctacgtatgtcaaatatttgtgagcgccagaatttgaaccctaatgggtgaaatcatgcaactatgattccaccacatcattgtgtttcccccgcaatcccttttcgtttgttctttccaccgaaaatatatttcaggagcacatcatgtagatctcagattaaccaataatatgacctagatctggcttgaattactatgtgatgtggggccacataattctacaatgaagatgctcgaggttcaattatgccatattcgggcaaagatcaaattactcctatttcattttgatatgttcaactaacagagcgtgaattatcaaacatatctgaatagatcacaataatttagatatctgaacatagcaaaccataattacatgtatctaaacacatctgtgttccacatgaccagcacatctcatttcgggaatacaacaaagtgtacaaaatgctgccgaatttgaaccatgcaatctcctcatgcaaaccgaaggagatatatcaacttatcatgaatcaaggaccaccaatcaggagggcataatgtgcacaagaaagctctctacagatgacatcctaaccatatttgtgaagaatttgcagtgcatgtgagattcgtgatagaaagatactttgcatattggccactttgaaagggacaacacctaagaagatcactacatgctagacctaaacatatgtacattgaccaccgatattatttgtgccagcatatcgcgtgaagttttgtattgcacaataataactcatcaaagcttagtacactagttcttctctcagaaccaacaaggccacgttatcaataaaaactcatgtagctagagccagggccacggccagcccctgagctgatcactcagtccgatctgatcagacccaactctcttcaatcatcactgaaacatgcatatgccccccattaataacaagatggacccaaacacagaactctcaaggaaaatagaacatgtatacttatgctcctttcacatgtagtctcatctaactactttacagtagacgcgtttccattatctatgtgcctgtatggcagggtccagcttcagtttcacctctcttagagttgaagccaactaaatggtttcaggttcataaaaaaaaaggagtgaagtagactagtgatctaaaaatgaactagaggagtgggttagggttcaggacgctccatagctctactccgaacttcgcttttggagttagattttggagttggagccttaacaaacatatcgtgcaactaaagcatttcatcttgccattaatcttgatataattttatgcatgatttcttcccatatgttaattcttcataatctaaccaatttatgcattattccttctgtcttcaaatacttgttacaatgggtactattcatcttcaaactgtcttatttgaaggaaatgaatagatatttagagtgtgttatatcctaaatataatcatgaactttcatacatcatgatctaaccaggggcggagctagaacgaaaagaagagagatgccactcgcttgctttactctattttagactgatataagtacatgagtttagattgagggggtgcatatatggtgaaaataattaactatagcttaaaaaaatttcttgaccgagttcttgggcaccccctctcctacctagctccgcccctagatctaaccataaaaaaatattaatggtagggagtacaattcaccccatacttgggccctgtttagttcacaccaaacttcccccaaactcccaactttccatcacatcacattacatccaaaactttcctactcacataaactttcaactttttttccaaactaccaactttccccaaacttctccccaatttcaaaaactaaacacagccttgcttcagccagagtcggggcagaatcccaaatgctcagaatgcctacctacacattgcaaaacacatgcagatgatcagatggtgggttgagtggcatgcagagtttggagcaccagcaccttccaccaccttggtccctactaattaagttccctcctctgatatatctcatccctatctccatcaataactgtacgctttattccattttttttcatctactccatgagtgacaagatgatgaggatgatcaaagcatatagatagcatcatggcaatttgcaaaacattataccggtacttccaccacactcaaaatagaacaacttctaacctttaaaatttgtttcaaaatacaacttctccacttatatacattctcttatcaatcaatcataacattttaccattaaaattctctaaatatctctctcttcaacaaatcataattttcaccaatttaatttcatcaacttttttaatagtcttgtttaaccctaaaactacttagaagtatattttaagatggaggtagcagtagtagataccagtgtggcttgcaaggacagaattgggtaaagtgcatgctaggggaccagggcccatggagggcctgcctgacaaggcgatctgcatcggcaaaagcctagctagagtccagagagagagtggaggcccacttggagatggtgacgtcaccaggcatgcacacgaggttcaggtgtcaccggacaaggggacccacctgcaggtgacgagaatcattgatcatcacgctagctagctccccgctgctgctggtccgaggcttcacccaaactacgtcactctagctctagctagatcgatcatcgatcagctcaaggaaagagatgaaagaaggggggtaatgtagcagtggttgatccgtggatcagtctgcattcaggttactgattgggcagcagcagagagagagaagcagcagtacaagaacggtgtgacgcacgtacccgatgcatgcatccagctgacaagatccaacgaggcgtgtatcgtgcatcagcatgcacagtggttagcctggtggtagtactttcttcgtttcaaaataaacaaatttaatatgaaatataacatatgctagcattgtatgttcgtagctttagaatccatcacatctcttactaggttagttcctctccaagaagaaaatccactataaaatggtactacattcgtcccaaaacaagtgcagttgtggatatccgtgtccaacgtttgaccgtccgtcttatttgaaaaatttatgaaaaaattaaaaaaattagtcacacataaagtactattcatgttttatcagtttctaataagagtcaaacgttgaacgcgaatagtgtaaaactgcacttattttaggacggatggagtagagtactactagatcggatcaacatagttagttcacacaataatatattactatatttgttttcagaagtaatatctctatctttaagtgtaacttgtttagattcgtaatagtagaatgtatataatacaatcttatgtttgacggaggaagcagtaaacaaagaagccacaagaggtaagcttatacgtaccgtagtgactgaggtggacaattaatcaccgtttccagcggcattatgcattgcaaagctgtgacgatcattcgcgcgctgtgcaaagtgtgtaccccagcagcatgcgagaaacttgatggcgttttgctccgaggtccacatgtacagtagagatcggggacctcatccatcaccttcacatcacccctgtgtgtggcccgcgcgcgtggaggagagcgctgagctaggctggaccgccggccggctagccggggacccctgcctccggctcgccggcgcggcggcacgtggacaccggcgcccggccccagccagttacagcacgcgcgcctgcaacctgcatgcctcctcctcctcgtcttcgtcgtcgacaacccgcctaacaacggcagcagcaggggaccagagagagatatatgtgagatcaattcatcaatggaggagtctagctaagcaaacataatgcagcttgattaggccccgtttgggtttgctcaagatgataaagtacggggcacgcagaaggagaaaaccactaacacgtgattaattaagtttttattattattattttaaacttgagaaatggatttgtgtgatattttaaaggaaaaagtacgaattaccccctgaacaattgtggtcggccgaattacacccctaaacttgaaaactggacattttacaccctcaattatcgaaaccggacaaataacccccctaaacactgttttgagtggttttgactagaaattacacacgtggcgccaatgtggcaatccagtcagcaaaacaaaataaaaaaactccctgagcccacttgtcggactaattcctcaacccaatcccttccgtccggctctctcttgcgcatgcgctcggacaaggaagccgtcagcggaggcggcaggcagccggcggtggaggcggacctcgcccgtgcagtgggtggtggaggcataccgagcagccggcggcggaggcgggcctcgtccgggcagcggtcggcggagacgaacccggcagcaagcggcggaggtggacctcgcctgggtagccagcggcggaggcgggcctcgcacgggcggatggtggcggaggcgaacctggcagccggcggcggatgcgggcctcgcttgggcgactggtggcggagacgaacccggcagccagcggcggaggcggacctcgcccgggcagctggtggcggaggcgaacctggcagctggcggcggaagcgggcctcgcctgggcggctggtggcggaggcgaacccgacagccgatggcggaggcgactaacgcggagctcgggctgcaggccggtgcgggacgagggtgacggcgatggggccaaggcggcggtcctgatggcaacgacgaatgggctcctcctcttatgctcttctctctctctcctcttcacgcgcgccgcggcgccggcacggcccatgtgggcgctgctccagctctcgaagatggatcattcggggtgttgtcgcagccggcgcgtcgctccacgccgactatccgccatgcatctcctacctcaccttcgccgccagattcgtcgacccccgcccctgccacgacaccgagtccgagatactcggcacggtctccaccgacatccacgccacgagcggtgacggcctcgtccttgtctgcttctgtgactcccgcaaccacgtccccaccgtcgggagccgcggcggcgagctgatgcgcgagtggtccgcgaggaggcagtcacgcgagcgggacagtgccggcgcctggtcggcctctgcctccatcgtcggccgccactgcctcaaccaccggttgccccggcgagcttctcctcagccgcctgccgcccgggcgagctccgcctccgccgtcgaccggctggtccaccttcgcctgcagagccgcctgcctgagcgtgcacgcgggagagagaaagagagcgaccggggaggcggggagagagaggggtatgaccggttgtaggatcgaaatgtcgactagagggggggtgaataggcgatttaaaactaaatgacacataatcaaaactaacctaagttgctaggcttggtgagggtgaactctaactaagcaactaagttatgttttgcaaacctagggtgatagtggctcaattatatctctaggaaagtaaatcacactcctatgtcaatgtttagcaatcctaggataatatgatctcaagtatgtctctagaaatgtaaattgcacaaatgtaaatgcgacaatcaaatgagacaaggagacgagatttttcaccgaggttcggaaactcgccggtttcctactccccgttgaggcgagcccaactctaccgctcaaccacgaagccaccgcacgcccccttcgtcaaagggtggacaaggcgggagccggcccacggagaggactacccaagcctcgatcactagggtagttcttccttcactccgaaggtggtgaactccaaaccactcacaaaccggcgccgggcctcctccacaatcttctcggagaggtcaccgggcaactcctccacaagccgtctaggaggcggcaacctccaagagtaacaagcaatgacccggcgtggagatgatcaatcaagtgccacactaactctacaatggaagcaaatgcacttgactcttggctagatcaaatctctaacacactagatggatgaacacaaagcttaagtgggtgtgagagaggtgtaaggggtgtatgcaattgaattgggtgccaagagagtccccttgctgctggtgggggagtatttatactcccacccaccaaaactagccgttgggggcgaaatcccccaatcattgtgctctgccggtctgaccggaggtatgtggccggtcagactgtgctattctgcaacggatagaaaactagcc

SEQ ID NO: 44664 - DNA, 1499 bp, Oryza sativa
atacagtgcagctgggtacgtacctgtcccgggtgcttttctagctcatccaactggatcgatctttctttcaggtaccccttggaagagaccaccaggataaatataagttaatttggtgttttctgttcacgcaagaagccaacaataatgttacaattaaagagatgtcattggtaaaaaaacggagatcaggcatatggaaattattagcagaagtgttatatttattgagtttaatacaccaactacaactagcagcttagctagaagattaagccaatgcgaaaagtgagccgcagttttaaagaattgacatcttgtctatatgtccatatcatgaataaatgaaggatacaaagaaagctgtggctgatgaactgtagaaacatgaattaattaattaaaaattctatacaggtaaaacctttatatttgtacattttgaaagctaatgatggaaaataaagaacaatgagaaaaccacaaaatcaacttagaattaagtttgacaatttaaatttggattgtagttaataaggagcagttatctaatttgagtaccacaatgctcaaactcaaatttactactagttcggttagggaccccaccccaccttccatgcttcattagttcctcttaatacaaataatgcagttacaaattgaaatgtcaggattatgcccgtacccagtagaggaaagtttagtttttaacttcagcaagcgacaaaaacaagctgaatataccggttaattagtgacaaaaacaaagatattactgtactttctctaatcaaacttatatgatgtagcgaaaactgaggttagtttttccaacgtcaaatgtttttgactaaagaaagtacttaactaacatgatgcaatagagctggactccatcaatgcaattatcatcatgtcactattaaatactccctctatattataaatcgtttgtttttttgtcaaactttttttagaaaattatagtaacatttccaataaaaataaactttgtatcaaaatatattcgatgttgaattttatgagactaatttggtattgtaggtattgctaattttttttataaatttggttaaatctataaaattttgaccaagaaaaaaaatcaaacatcttataatatgaaacgaagagagtagtccgccgtatgaggggaaaatcctcacctgatcacaccattgtaacctgtgtgtgttcatcctttttagggcctagtatcaaactctcactttctctttctcgtggtaatcaggagggccttgcttccactttgtctccccccttcactcctataggagagtgtactctttaaccctgacagagagtagtagtaacatgacagcaatgcaggccggccctgcgactgcgagggtaaaaaggcatctgaaaacataccagtttttctctgccatcatctcctcccctgcccttctctatcacgtcagtcagtctttcttcagtgcgccaaaaca

SEQ ID NO: 44665 - DNA, 3350 bp, Oryza sativa
ctaattgcacagattgcgactaatttgcgagatgaatcttttaagcctaattgctccatgatttgataatgtggtgctacagtaaacatttgctaatgacagattaattaggcttaataaattcgcctcgctatttactgccggattctataattagttttttctattagtgtccgaatatcccatacgacaccctttataatactcgatctgacacaccaaaactttacaccttggatctacacaccccctcaatgtgcatgcatgcacagagaaaacaatagcagaaaacttctagggattagtagtgactacgaggaccaggagttgtacacgcaacagcagggggtgaaggaattggggacaaaaatttgcatcaccccattcatgaggttattggaaattggagaagggggatctctgcgcaggtccaatcttgatcctatttcccatttcaatgttagaatattttgacgtttgggaacttggagcccccggcaacaccaaggcagaacaggtaacgccaaggtcacgtgagataataataatcatgtatttgctccaattttcctggagctagttaggccagggtagaagaaaacataatgtttagatgatactggtatttgacatatgatctggatgggtgatgttgtgcttattgcacataagaagcaaattatataattaatggagccattacctattaggagatccctttaacaccgttatgattggattctggacaaaaaaacgccccatcttgggccctccggtttctccaaaggctgacaaactgaataatacttggccattagtatacatcagtgagcacacaatgtatctgaccatgtgatggaatacttgtctccaaagaagcaagcaaagcgacattgctgattttatcgttaatattttacagaatctgatacagatctgtcgttaaaaaaaatataaagaacagatcatattatgttctgtattccaatcctccagcagcaagaggtgcccccccaaaatgccctaatgaaatgataaagaaccaccactgatcttacttattactattaaggttatcatccacacaagaagaagcagagtaatgaccgatggctttactcccacgcaagcacacacactccttacaagtggaattgtgtgtgtcctgagcagggtaggttgtcctagggcaaaggtttgaatggaaacaatatcttacagccaattcaattcattgtgtgagaatccaaccaaaaccagcttgtaacttgcaagtcttgtcctcttaaggggtggtcagcacacattcaatgagacaggcctcctgacaaaaccccttgattgtgttgaatctgagatcaaagaaatggctggttgctagtagtaggagtactctactccatggctgtgcatgataattagagcacacagcccatacacctcaaatgtcacatctctcacaagaggcctctaccctgaacaagttattgcctactccctctgtccaaaaataaggcaaactatgggttttcgtgtccaactttgactgtccgtcttatataaatttttttataatttgtatttttattgttgttagatgataaaaaatgattaatattttatgcgtgacttgtctttttaatttttttcataattttttcaaataagacggacagtcaaacgttagacacggaaaccaaggtttgtctttttttgggatggagggagtacaccagctatttcaagtggaccacaaatataaactgctgccaatctatcaatccaccccttttagctagtaaatctatactaaaattccatgtctttctccacaggttaaattgcaatgcaacaagaacaagcctcctcattcattcagttccaaatgaacagtgggatagacttgggttccttacccaggacttccaaagccaaatcgaaatttggtgccctgcagcaacacaccaggaagctaaaggaacctggacctctacaagttaaaatggggagttaaggacagtggtcatacatgcatatgcataggcccccaaccacccatgcacatggaaagcaatggtagggtctacccccctggatggctgtgattaggccacaatggccaggcaccaacttttaagtaccaccacctgatcattcctcatcacctacactcagactatatattctaacctcaccacctttgaaccccccttcactttgattcttcctgtctacctaggttaaaaaaactccccatctctctctctctctctctctctctagagatctagcagtaatacatgcatacaccaaaagaacctcatgtactagtagcaaatatcaatacataaagctctacacttctactactagtatagttggaaggctataaatgcctagccatgatatgtgcatggttctctacacaacacaccatcatcatcttcatctcctacctcctctcctctcctctcctcttctccactacccaacttttgctcccaacacatctttgtttcgatcgaccgatcgatcagctctagctcagccgcagcaatggccatgcaccctctcgcccaggggcacccccaggcgtggccatggggtgtagccatgtacaccaacctgcactaccaccaccactacgagagggagcacctgttcgagaagccgctgacgccgagcgacgtcggcaagctcaacaggctggtgatccccaagcagcacgccgagaggtacttcccgctcggcggcggcgactccggtgagaagggcctcctcctctccttcgaggacgagtccggcaagccatggcggttccgctactcctactggaccagcagccagagctacgtgctcaccaagggctggagccgctacgtcaaggagaagcgcctcgacgccggcgacgtcgtccacttcgagcgcgtccgcggcctcggcgccgccgaccgcctcttcatcggctgcaggcgccgcggcgagagcgcgcccgcgccgccgcccgccgttcgcgtcacgccgcagccgcctgccctcaacggcggcgagcagcagccgtggagcccaatgtgttacagcacgtcgggctcgtcctacgaccctaccagccctgccaattcatatgcctaccatcgctccgtagaccaagatcacagcgacatactacacgcaggtaactaactaaacacgcaattgcatatctagtagtagaaactcaagaacaaattaattaagcactttgatactataattaacatgcaactacagcaagtgattaaagatcatatacctttcgcggtggaacaatttgcaggagagtcgcagagagaagcagacgccaagagcag

SEQ ID NO: 44666 - DNA, 2673 bp, Oryza sativa
agatggtgagagcccatgagaaacttacaggagagagagagagagaggaaaaattgacatgttttgcaagtatgtatgtgtcatctgtagtatgtgactgtgagtgggtccatgaacaaactgtgaagttgatgtatccttctcctgctgcctcccctgaacctgaagaaacaaagtaataccccaatggggattttgttctcttccccttttcttctaccactactactgtttctatacatgcatgaatgactcttctactgttctatacttctacatgcatgatgcatgagttgttctttgttttaaaaaaataaatttaacctcgtgcaatcaattcattcaatgctttcacctaataatgagtaatgcaaggaggaggggggcatgtgcagtgcatttctccttctctaagcaacagggtggtggtgatgcactagcagtagtaggagtagtgaaattatggagaaaaaattcatagtagatgccccaaggaccattaaagaagtgatgtgccacaagcaatgccgacacctggggattttcatgtcctgatcttttactagtctattaatggccggtctctacctttctgttccctcgggaaggaaaggcacaacaaaagttagagtgtacaagtgggctcaatttgccctaataggatacaaagaaaaaaaggctagctaagttgatggtctaaggcacacaaaaaggccactaaactccaataatccgccagattccccacacagcatgcaggtatcaaaagattaaaaaaaaatggagatctgtctcctgcttttgttgcctatgttagaaaggtttgtacgaggctaaaccacagatttattgctctgtccggtcaataatccaaagcagcagatgcctggagaaaggaacatggaggcctaactgaactgacgtggtgctatcagcctcttaattaacttcaggcagttacctcgtgtcaactaatgaaacacaaccatagctaattaaaacaaaagtactcctacctgaagaatctagagtgaaagctttgcattacctagctaggccaccaagctaatttggaggcaagagcaccacttggtatgtatgacgactgagcaagctgcaagttgccctaagaaggtaggtacacaatttctacatgcaggacagattaagtataaaactaaggttagtactagaatagagatttgattaggaaaataaagaatgagatgcaggtctcagattcatctgaatggggggcttcctcgcggcaattgtgctagtgatgattaaacttaataggttaactaccgtatcaacagcaagatttcctgtctgcttgcaagaaccgtagccatgtgcagggggagctctccctaatgacaaaagatgaaccttatccgaggcactccagggttgcatgattaacgcctttgaaccccaaataatatatcttagcattagcagaaaagagtcatgtgagtgccataatgataaagtagaccctcacttagtctacttaacgcataccgagaaaaaggatctgtttttttatatataacaaaaaggaggccttgtcaaaggaacaactgccaagtacagactaatcacgtcatctatgttaaaaatatacagctgattgtgcatctctgtctggaactaaacccctgtcctacctgcctaattttagtctctactcaatgtagttactgccagggatagagaatacaggtttaggcaaaaaaaaaattaggtgggttaaaccaaagaattactaaacacgatgcatggtggtgagcaggcaatagaattaactaccacatgattaaaaacggttatacgagatgagattgaggatgcgtcacatgagtgactcagtgacccacacacccttggctactgggactaccagaacctgacccacaaaactggatgcagccatgcaggggcccaactcaaaaaccggacctacaagacgctatgatatacccaccaccaacaccaaggaaggcatcactactgcatcatcagccacaaggccagaaagcccgcaagatcccatttttcgctacaagaagctgctgccttcatgtagatcatgaatgggcatggtccacaaagagatggctaacccagatgaatggtcatctcttgtaggcattatttgcccttttcctgagtactaccttcaagtggttctagacgccagcttttgtacacaaacagtactttccttgaaaaacaggtgtatcatgcgcatggtggaccagtattggactgtaaggaccaaagatatggccggttctaccatgatagagaaaactatagaacagtcagtaagttggtaagggtgagaaatgacaaggacaaacatttcccctatgttatgccgtaagtatagacagtgaaaagatgttttcagtcgttgatgacaaatgccttgacgtagcaacatcataaagtaactgatcatcatgatcaagagaatatgacaaattagttttttaggagtacacttgtcgacatcctagcgtaaccaacagctcaggttttgtctattatgactgatgaacatattagaggcttttaggtaatgaaaatctgaaccaatgcgcttgctgtttttgttccagaatatcaataatttgccatactgaagccaacactagatagata

SEQ ID NO: 44667 - DNA, 16219 bp, Oryza sativa
  unsure (1)..(16219): unsure at all n locations
agctcccagcctctcccctctccccacctatgcttctcccatcttccttttaccggccatcgcgctcgcaagccttcccaccctatcgaccagattgaggtggcgggcctcctttcctccccttttcgtcgggagaccgtgccaaggcggcaggaggacgagctcccaatgacggcgcgaccaacaagctccttgcagcaggcatagatcaggtggcgagctccgggcggatttgcttacagtggcgccctcactctcctctcttgctctggcgtggtcgtcgaggtcaacatcggttgatggtggtggtagctaacgatgacgaggcacactctctctcccactttctctttggatggctgctaactagaccacaattttcctccttttctcctcaaaccactatggctcctgcaggtaactctgacacaaatgtagcccctcccaaacctccaccatggcattcgagccaagttataggctagaaccacaggcttgagactacgcgttgggcatggccttataacaaggctagtttgtttgagcatttagctcatgaagtcatgataggtgttagtttaacgtactagggtcaacaagttcaggttggtggggtcaccaccaacgatatgctgaggaacacatcggtttagtcggacatcgtaatcttacctggtgtcgttggtgtcattaacttcggtgaaacaatagtagatccaccggtggagtacccatagagatattaatacttttgtatagtactagttgagtctgattaggtctgcatgatcctggtggagttggtgtcatattccttatcaattcaggataatatcctcatttgggtaatcctcttattgcgtttagtcccacatcggtgattaatgatgggggagtacgacttaaaggtgagggcagtcctcacccatcaaactagtcttttgggttgtgtagacgtaggacctaaagttgtggctccggttgggcttgtggtagagtagggccaatgtgacctgggtagccatgattggtgggccgggctgcgcagtaacaagtggtattagaacctagactagttcttttgggttgtgtaaaccaaggatctaaagttgaggctccgattgggcatatggtggagcaggcccaatgagacctctcttaaagattgggcatgtgttggagcaggcccaatgtgagactacaatgtaccgttgacacgcagagagatgatggcggagaagccatggactcgtagcggctagaaaatatattgattgggaaggagcgcccataatcaaagccccggagatgtaggcttcgtttgaacttcgttaacaaatattgtgtgttcatgtgccgtcatctggcatgtcttaggtgatcaatgactgaagtgatcgagagagttagctgtcgtttcgctatatcaactaacttttgtaacaccttctagtagaactatatgtattctatatgagtatttggcattttccaccattgtgtgggtatgccatattttatatactgacagtggcccccgagtgctgatcaaacgaggagcaatcacactatatatgtgttgggacctctgctgggaatagttccgaccaggtagagattggtagtggttggctggcttgcctatcatgatttggttggttcagggtgagattgatagtggttggccgggttgcctatcagccgggttggcatctaacccatcgtatccttaaaaagttattttcacgcgtgcgttgtttgtagtttgaataggattggaaaatacgaaccgttcactggacaatttcagtggacacatggtggagaaatcaggtatagtggactctggaaaacaatcatattacttgaaaacaaccaaatccgtacatttttatacaatcaaattaaggaaaccttgaagagtcttagaaacaggggacacaattaaaactagctagctagctaatattgttttaatagcatatgcatgtgtgtataagttcttacatgcgtggaaaaaaccattgtaccattgatgaaaatctgtgttgccctagggtacttaagctaattttgctggtcctgaagtcatacacaccatacatgggaatcccttccttttgctgatacacatagctgttggtaattctggtatggatatcaccccactgcctggtcaaatcacctcccaaaaagaagatgcaatttcctccgaatctcgggtcgccgtgatcaaaagagaggatcgccttggagcaagcttctgaggaagacgacctgaccatccaagcttttcacctctaaccactggccaccctccaaatccgcctcaaacaccttgaacttgatttcataatcgtccacatttgctgaagtgcccaacatgggagaaatagtacacctgaacatcaacagagtgccactgcatgaaataacaaggtacttgcatgaaataacacggtactggtgtactatgtcatcgatgctatattgccattgaagatgcgacaatggaggctctgctgcggcgcccctaatcacaagctcagcacgagacaatgtgttgttatctctgatctcatggacaagaagatccccgttgctagtaagggcgtagagcttgccgcggtacaaggcgatgtcctcgtacattctcttgtgatcaccatcatcatcatcatatggaagaactgaccatgatgtgtcaatgcccggcctgaaagagacgatgttgttatcgataaggcgggaggcggcgacgatgaggtccggcgagcacacgatgatcttgtgcaaggtgaacctctcgggccacgtgctgtaacggttgtcaacgacgaaggcgttgatgggccgatcaaagcggcaggggatgtcgatggtcgcgttggagaaggagttcttgaggaagtgacgattatcgcatgccatgatgcaaggcttgaacacgtccatgtgcatcagccacccgtcgttgtgggaagagatgcaccagagcgcgtcgttagacatggggatccggcacgccacgccgtcgtcggcaaggctatggtgggtgcgcgggtgcgtcagggtgagcagcaatgttttaaatagcgggctaaggcatttagcggttagcttctcaaatagttatagcggcagttatagcgggctaaatagaactatagcggctaaattgtacatgagagcaaatagctagaacccttctcaaacagttatagcgggagatagcggcagtttagcgggagatttaaaaacctggtgagcagacatggcagcgctggcggcagcagctggcgctgctggagcgcgccgaggcgccactggctgcagacggcggcgaagctgaggcggtcgtggtggaacggcagcgaggagacgatctggccggcgaggtccgccgggaggtccgaccagcctggcggtggctccagctgcagcggcggcggcgaactgctgcttccgctgaaacagagccccatggtggcacgagaggaagacgcggctaattaacacaagggaaaggagatgaaaaattgaaacctagctttgggcttaatttatcttgatagctagaaaaggtgatcttaattaaagatgaaagacaaatctgtttcgaactcggttgatgaactcggtcaaaagagaataagaaaaactatggatggacccaacttgtcagccagtataggatggacagtgctgacgcgtcagcgaccgtgtggtgtaccatgtcggattttggaatattaattgtcagtggtgcatttaggagtataaagttgtatctttttaagtttattgacccagatgaaatctatgtactttaaggatggcctatgtaatttactttaaaaaatattattagatgtttgagtctaaaacattttcatttaaaaaaaacaaatgtgcatcaccactacaactagtaagcttagatatatgagattttttactgtccagcaggtttgagcggtaccaaatgctagccgtcagatggaccagatccaacggttgaaattgatcggtaccaccaggtaccgctttagtcacttaggtggtaccgcaccggtggaagggtaaggtggtcttttcgcatagaaaattttgggaagtcgattagagcagcgtctttcctcccccagatggctagatgcgtgctgttgtcgccaccgctgtgtgaccttggtcgccgtcgccgccgtggtgtcatccccatctgcagatgagacagaccaagactagaacacctggggtcgtcgtcaatggagcagcccagcactcactctctgggtgatatgccccaaagcgggaggtggagggccgtgcccatgttggcgatggcgaggtcaagctccgtcgaggtggtttccagcttgcaccgcggaggactcctcggcgacggccgccgtctcgtgccatcttccgaagcacagggattgcgcagagatttgcaaatggcaacataatcttcaggaataccatcttagtactgtacctttgtatatgtatttgtatatctgttaatctactaccattagtaagagactctgaatcaatcctcactgtgcattcatcaaattgtcactgtgtgttctccgtccaggcggggtctggcttgtcccactaccacggccggacgacggagcggaagagcgcccctgcatgtctagaagtagttgttgccatacgcgacacagccggcgtgctgcagcgcgtcgacaccggcgggaagcctgcgttggtacttgtgcaaccacgcaggtggaactgatggctcagcactacgcacgccgtgaacaggccggcgaaacaggtgtgccgcgacagcatcgacgggagggaatgaatcggcggcggccgcccgtggaatattttgcggtgggcaggagaagcgttggggggattgtggcgcctgcgagaggatgggtggcatggagtccaggatgattcccatcgtgcccttggaaattggacggttagattcaatctggtaccaccaggtactagtaccttgaggtacaatttgctggaccagagcaaatctctagatgtatatattggctcctttcacttcaagtcaaccaaatccttacacaatcttgtaaacaatcaaagagcctctcccagcgccagcagagtcttatggaagacaaaccaagccagctaatttttactaatatatagcatgtgagtataaatccttacatgcctggaaaaaaccagcatacctttgaatgcttatattcccttcctaggtaaatcaaactagtcgcgttggtgctcaagtcatacactccatacataggaatgccttcgttttccttatacataccgctagtaatactggcctgttgtatgtgatgtcaccgccaggtgatatcctctcccaaaaagaagatgcaattccctgcgaatctcgggtcgccattacccggcgagcgaggaatggccttggagcaagctttgctgaggaagatgatctggccatccaagctgttcacctccaaccactgaccaccctccaaaaatcagcttcaaacaccttgaatttgattgtagttccacccatggaagaactaccgtcaggcgaatatttagttgtgcacctaatcatcagcagcttgccactgcatgaaataacaaggtagcgactctcatcggagctgaaattttgtatccgttccagaagcgtcaatggatggtgatgcactgccctgatcgcatgctcagcacgagatagtactgcatttgcactgacagtgtcaatgtcgtcgtcgttgatgatcccatggacaagaagctcctccttgctagtgagagcgtagagcttgcctcgatacaacgatatgtcctcgtattttctcctcatccacggataatcatcatcgtcgtcatcatcatcatcaccaccggtcgtcgacataacttcatcaccggaaataaccgaccatgaatgatcaattcccggccggaaagcggcgatgcaggtagagtggacgacggcggcgacgacgaggcccggcgagcacacgatgatcttaggcaacgtgtactcggcggggttaatgctatgactgccgtcgttgtcgcccaagaagtagtcgaggctcctgatgcgctgatcgaagcagcgaggtatgtcaatggcggcgcgggagagaggattcctgatcctgtctcggcggccgaagcattggtactccaggagccagccatcatcgtaggaggagaagtaggggatcgcgcggctcgaattcgcgccggggacggggcggagctcgccgtcggggaggctctggtagacgcaggggctacgcaggatgagcagccacggcggcggcggcggcagcgggtgttgccggagcgcgccgaggcgccactggccggcgaggtccgtcgggaggtccgaccagcatggcggtggcggtggccgaggatgcggcggcgacggaaggatggcgacgtccgtcggaaggtccgacgagcctggcggtggtggctgcggccgaggatgcggcggcgatggcggcggactgctacgtgtgtcgatgccgaaacagagacccatggctccacgactgtgggcggcaaacacaaactaaactgattgcaaatttgcccctaataataaagtgtaaagatgaaaaacaaatctgtatcgaacaatcgatgaatccagtttcaaaatcggatattgttaggatgggatgcatggattgccaggagagaacactatctgtctgtataacgtgttacgatccaactcgagtcttaatacggttctatctttggaattctgctaaactaaaactattaaccatgattttggaaaaattttaaatcaactcgactcttataatatagtattatctatgggtatcagaattttggaaatttcgaacctaaattgtaaaccatgattctcactcatcaatcaacacatgtacagtaggatcatctgatggaattactgcagcaagtaatactggaagcactgacaaattgcctgcagttcaattattaccttgacattctagctagatgatgatctcctccatgattaattagttgtaattaccttggaaagaaccacgtcgcactggatcggcgactgatgtgcggtccacccggtgaaattgtcttgcttctcagatcataaacgccacaggttgaatctgctggccattcgtgccgacgctctgcaccatagtcggcgaagtatattttacctgcttccacataacctccatagctcgacgcacgaactgccatggagcagcttgtactaacgaagatcgcctcatcacccaagctctcgatatgaacatcagtccatttgattgcttcgacatgacgaggtagtgtaatctcttgcatctcacggcggcgtaggtgccatccaataagaagctctcgaacaagccgacctgaatgatctgtgtcgcgagatcggaaaccatgggttgtttggtctttctgtgggtggtgatttcatgggcgaagaggtcgcctctcccggcgacggtgtagaccttgccgtcgtggaaggccatgtcgtggtagcccttgccttcccacgggccggccgaccacgacgcgaggtcccggccggcagcacgccaccacgtcgtcggcgttgtcgtgactgtagctgatcctcgcgacgacgaggccgccgccgccgcagacgatcaccttgcggatgtagaagtaggcggtgggggatcccggcgggtgttggcggcggaggcgggccgggtcgccgcagtggcagtggcccgggaggcgcacgacctcgccggtgagagggttcttgaggtagtggcggcggcgagggccgtgccccggccgcctgaagaggagccagccggcggcggtggagccggcgcagatcgtgtgccggttgaggcggctgaagcggcgtcgctcgccgccggggaagctctggagggtaccgtcgtggaagttgagccacgggagagccgggggcagcggaggcggcgccgtcgtcgccgcgtggcaccattggcggcagacggagccgaagcggacgcggtcggcgtgggagggcagacggaggaggaccacgccggctaggtccgtcgggaggtcgaaccagagcggctgccggcttgccggcggccgttggcgtggctttgcttagtccaacgcccatgacgcactagctacctgcccgtatgtatgtaggacgtcacgtccgcacatatatttgggagtttgagacagggtgcggtacgtgtgaataacggttcaaaatttcggactgacatttcgaatctatgttaagatttcggctgtttttttaattttttttcaagcttttatgaatttggcaaaaaaaagttcaaatttgatcaatttttgttaaaaaatttaaattatttcagaccgaacttgtcgaaattttgaaagtttggatcatatcggtacccgatagaaatagtgtaaatgattatttcgtacgaaaatttctatatatataagttgctttaaaatattaaataatttattttttaatttaaaataattaaaacttaattaatcatgcattagacataaacggttttttccttaacaaaactcccgtcgattcaggtttgaaatttcgggcactgttcacttgcatgaaactatgtagtccaggcaaactatgtagtccaaaatatatatatttatttattaacttgcgaattcagtaaagtttattctaatacggtgtaaatctgctcaattttaatttttaattacgaattttacgaattaaacactaattaacttaataccgagaattttatactcaagttagaacaacagggaacatggtgttgcacttgcacttacttcctgttctaccccttaagagcaagtttagtatagcccactactagctctaatttatatatagccaatctaatagccaattcatacaatagttgtttactatactattaatatatggtcccacctgtcatacacacattgcgtcttggagtctgcgttgcagctggctacagatctgtagcccgctgctcttctctctcatattttatctcaataaaatatatttacagcgggctaatagcctgctactgtatctgctctaatggcaaccacagtgtttatttagcaacttggtattaagtagtaagatggattccggtgtgaaacaataatagttattagcatgtttcacaatgtttaatacctgaagtgataagtaaagtggggtccacatggaatgcttccctccatcacatataaaactcaaccctacctacgaatctaaacatacacatatccaggtttatagctagtatttctctttttttttacagagtagtatgtgagaagattattatacatacacgagtaaataatatattttaataacttattgttagtagtaagcatactatccggttataactactaccacataccacaattgtatatactctctccgtcccataaaaaacaaatctatgatcggatgtgagtatgtacgtatcatagtatagtactatgatgtgtcacatctgttttttatggaacggagggagtagcttattacccgctttttctttgcattgtggttgctctaacgaatttagcaacaagtgtaagggtttaactgcaaaaatgtaaaaccaaccccctccccttcccttcctataaccaccccaccggccccgcctcacctcgccggaatcgcggcctcgttcactctcgcctccacccgcgccgccccccaccctccgatgccggagcgccgccacatcgccgcagatccgccgtcctggtgatccccggagcacacccgcccacccaccatggaccgcctcctgctgtttcgcccccggaaaccgggctcctccttctccgtcgccgaggtggcggacggcgacctactcgagcgcgacgtcctctggcccgcctcctctgccccaggccttctcgccgcgctccccgacgacgaggggagcaagaagaagaagcgcgcgggccccgccgccgtacggtccgcctcccgacctgtcccggagaccgccccgttgaccccgacggcgggcgcggcgaggtcggcgcccgtgaggataccctcggaggccgcggcggcggcggggaggagggggaggtggtcgtcggcgcagtcatccgtcggcggcgaggacggggacgccgccatggtcgtcccgccgcacgaggtcgtcgcgcggcgcgccgcggcgcacagctcggtgctggagggcgccgggaggacgctcaagggccgcgacctccgccgcgtccgcaacgccgtcctgcgccgcaccggattcctcgactgagagggcggaggccagtcgtctcgtcgctctcgggataaaaccaaaaaagttttgaccctttcttcctttgattttgttcccctcagttgtgtgtttccggctatctttgatttcttccccttcgttagaatgggatggaaagaattgaggcgagtttgcgaggtgtacaacccggcgcaataacaaagttattccatcagttatagatggaaattttggtccttacatctgttcaattcagtatttgcttgatttctgttcaattcagtatttgcttgatttatgtttgcttacttttgagtaggtgaaaatttagttatcggtagcttggtgccatggatggaaaatttagttgttggtgagttcagctcacatgctcaaatacttatgtttagctactaataatcacccaaaacggaggctcgtaaggcgcaaattgaagttcttagcaccagagatggcaattgtttggaaaactttggaactgctgaatttggggtaattataagtaggatactgagaatttagttgcctccatgtttgttcataggcattgtgttgttaatcagacgtgccatgttaagtgttacttcctccgtttcatattataagactttctagcattgctcacattcatatatatgttaatgaatctagacatatatgtgtgcctagattcattaacatctatatgaatgtgggcaatgctagaaagtcttataacttgaaatggaggtagtatgttctagctaatggtgtggaatttcatctcgatactgcaatctactatatagttttggctgcattgcagttcggtgtggtggaaccattcagatttgagtgtttgaagtatctatgtgattatctcatatttcctggttctgtccaagagagtataagaatggtaaaagtttttaagaagagatgccaggcgccagctgccatattgtttctggttttcgttttagctgaaactgaggataagttactaattctgaacattgccaatagagaaacctaacagtggtgtttaagatgaacattgtgtttgcttttgttatttttattggcaaatgattgtatcaatgtatagattgtaggcaagttgctcgtaggtcaaacagatctagttgatgtaggaactaggaagaaatgtttatctaggtagttggtaccaagaaaaacacattcatcttaaaagcatagatgttgattccttggaagtcctttacaccattttttggtggtccttcaaattcactacacatctcaatagttatgctttgctgtagatctggaaccactgcacggcgttctagtattttcatggaatcatctgctcttatgtcttgtccaggaccagatataaaggagctgtttgcctattttgaattgcacccactctcatttctttctgtgcagctgattgccttgtcacccctctgttcaggtataaggaccaccaccattccaccgcggtgtagctaatctgctaatgatacctcaagtacacaagttccttggattatccccatcaagaaacagctaatatgtctttgccatcttaacttgtgggataaagttgtttggttcagtcacttcaaaatatgatgccatacaattcagaaagctaatcaaagaaagagtgaataaatatggtccatatagaaactctgaagttaattgaagaaaacagttgatgaatacggccatccacctagctgagaccaaattatatacaaggacattattaatttcaaatttctgaattaatatgataaaaaaatactaaactaagactcccaagatgaataaaacttatatttatcaattcttaatttcagaattatcaaatcatgaacaaactaaaattgaaagtccaagctgagtaaaaattgtacttactaatttgactttctaaaccattaaatcaagcaaattactcagtaactgtcgatatatatttgtaataaagttttatacaagtatttggtatgcaaatgtaatataaatagcccgtgggaatacacatgttaacgatgacctgccagtctgtcactaatgtggcacattatgcatagttttatgtttatggaggcagtagtacaatcatcaaataattgaatcttgaatgcttgatttgtgttgtttcatcactactaagagattgcaagaacatgactagtcgagtagccatttgaacaagagaacatgactgagagattgtgataattgacaccatgaccatcttttgtgaattggcacattttgtctagtgctctagtgatctgtcagattaagagcaatgaagttctcttgttcaaatggctgttctacatatactgtcgtcatggatgcgccccaatgctgcattttctttgtatggtttttcttttgtcttttaatgaagtacaatcaacttcagatttacacatccactctcaagttccgtactacatgaagaattttgttcagaagggcaactgaccattaatatggattttggagctttattttacttcaatgtaggttccatccttaagttgtttatagaattgatactgaccttttttgtgttgtctggatgctaaaagtaacactatctttacattaaatcgtttgatatccctttcaggatcaggtccactttcttgcttttatttgattccttcaaattattgggatgtcaatttatttgtcctgagggctgtacattatgagattcnactgctctgaacatgccatatttctttcattatgtactcctgctgaccataaattatttagtgagcatgtgtgatgtctagctcatacttgattgtacccaactcatgttttcagtataaaataaatagcatatgctgccaaatggtgtattcattgaccatctctagatgaccagctgcttactttatttcattgttttggcttcaacatgtattgatccgattgcaataagtgatatagtctgcaatgggcatgcaatatgttgcttcataaccatactgatgtcctattgtagttctggtaagacaaatatacgacgtgtgtacaaattatactcatggtaacccagtctcagcgaagttttgtttatcatcaatgatgtatgtatgtatatatagccacatgatgttcagaagaactactacttgttaatgtaatcacattgatgatgatcagacaatgataatggtagttatgcagcatggatctaaatatagtctggagtgaaagcatcctgaaagaaaatattctgagcacctatctgagatcactgtgctcttgttggccagataagatatactttctgtggtcatgtgatctatgtgtttgtccatacaactgttctgtttctttgtgacattgctggtgcctggtggcatggctttttgctgtggtccagtctccaggctataatagtatgttctgttatgatccagttcacaactttatgatgatgctgcacccctgcaaggaaaacagttttgttgcagtttgccaatgaatatgctgtggtgattcctcctcaactacttcactgggagatgtaacaataaaccctagtactcctgagatgccaagcatccaatgctcacaaggcaataatgcatgcagtacaagagcaagtgaatttacaccagagctgatgcatttcatgtttgaatgccatccatagatcctataaaattgttgtttgaatggagctgaggtccaaagtatgaggttttcttggcaattgctaggtcttctggaaaccagtcatcttttgctttaatcctgggaatttactgaaatttggcttggctactgttacgagtgccttgaaaaaagaagagagaatcccagatggcttgattagattttcaacgtttgaattcacacttcacaaaccctttcctcctcggaagcctgaaaatatgttgaattctagtacacattccactgctaatagtacttgtatgcacggtgcttatgtgatgcgtggtggctgtatgtgtttactgatctgaaaacgtcctgaattcgctgcgtggactatctcaaactttgaagtcagtccttggttgagcaacccacacgtgtacaacaattggacctgactctgaatttctgaaaactttgaatttcaacagccatttccaaggtactagtagcactaggagtacctttttgtggctgcagcctgcatggatcgtaggtgtagaccagaacagcatcaatcacgtagaaaaagcatcattaactatggttaattcggtagcctaaattgcacaccggttttacatggctacagttggtgccctgcttttcttcctgtctagaaatgagatcagatcagacttgttgttagtcagaaagtgtgatctgtcaaaatggcctaaccatctatcagcatggagtctgctccagctcctttgttgaactatatgtgcattagccatagtggagatggaatcatggaattggagtgaacttgtatggactcatgaatcaaacaaaacttggaccatggttgaatggtcagttagaagctgcttgctagaatacagagccatgccatacaactaaatagaagtttcttgctaggctctcttctgtcagatccccaaattcaacagaatgtagaattccagtctccgaaattcccatccacattccaaaaaccggatgaagaaaaaggtaattaaagaagctggattcattggaccggtatgtttggcatccttcaacaattgtgctgatcaccaaattaactaaccatacgttgaaatggtattcagtcgaaggcgacagagcatagcatcacggcgacgtgtgcttggagcagagacgcgttgcatgaatcatcgcagagcgaagacaatgttacttctgttaaaaaactgtgccacctcgctcgcagctctggactgaaggtgtacgcgttcttgacacagacccagtcgcaagcagtagctacgtagacaggaaagactgttctagatttggactgaattgcttgcacttaattgtagtgatatagggtgtgtttagttcctgaaaaaagttgaaagtttgaaaaagttggaagtttgaaaaaaaagttggaagtttatgtgtgtagaaaagtttttgatgtgatataatgtgatggaaagttgggaatatggggaaactaaacacggccataattgatttaacagatttggacttaattgcttgcacttaattgtagtgataaatgatttaacaaaaagataaatacatcgtcagtccttaaatttggaccgcgacatcacgacaaattggttatctaaattaaatttagtttaatgtatcacccaagatctaaaaaccatttaacaaatctccgacgctggtgtagttatctagagtgacaaatgtttttcatttagccccgttgttttagatttatccttttattttgaacgactcgcactagatagtgcaaagttctattaatagagtaggaaaaagatttgtcctcaacccaacttctctctatactctatcgatcttctcctctttcagaacaaggagagaaagcggcagcaacatgaagtgcggtgagcatagggtggtgcaaaatgcgggaagggagggaggaggcaaagttcggtgagggtagtgtagcgtctttttgtcatcaccaccaaggatattcgctaagcgcctcattaccttcaagtcacatgaggtccatcactcatcctcatagtgaccatagcaactcaccgaacttgcgggatcatcctctccctatcgcatcgtctgtctctgctctgagacctctgcctatcgataattgcccccccccccccccccccgtgaccgccatctcttcgcctttggggaatgac

SEQ ID NO: 44668 - DNA, 9025 bp, Oryza sativa
  unsure (1)..(9025): unsure at all n locations
tatatttgcaaaccaaggaaaacaatgtcctcaaggacgagaggacgtgttgggttgacttgacctagtcattcagccttccactaaaacgatatatatagtcgatctacgttgggatagtctacttatttatacggaatgggttaaatataaatatcatatattagaaacctaataaatattttctccgattcaaaatataatgcatccttattatcgatatacagtggatccatcctgggatgatctactttttcatatggaatgagttaaatatcatatactataaacctaataaatgttttctctatttcaaaatttaaggcatcctttcaaattatcaaaatcaatatttgaaaattttaaataatgactggactaaaagtatgagtatctaaggccatgcatgtagctagaaatcacgtttctctatttaaaaatattttcatataatattaatttcgtaattgttgataatatattatgaaagacactaaagataaagtaaagataaagtataatgtttgagaatgtgtaaaaggctaatacgtcttttagcatgcaggaagtagtacactgtacactgtacagaaacagctggtctcacgtagaaggtctttagagaaatcatatcgttaaaaacgtgatgcaaacaatccacggcaataatccaaacgatcagctccattgaacaggtcattaaagaatctctcattcaattctcttggcagtactcggtgcttggtgcttactgctaatatatataattagcaattgctctggtgcagtgtatgaattgaaaagagtgaaaacttcatcatcttttccattgcatggtcatggcaactgccgagcaattctttgtgacagcatgtagcttatataggtgatctcagctgaaggactgcaaacttacaataatgctanctgaaaaacactcncnnntcccatnagggaannccnatcatatgcctgtaactccttattaactattctgtccgtgtgatactacaagatggggggggnnnnanaagnttataataaaatttagcaacatttatataatatatcaaattagttttcctaaatctaatattgaatatattttagtagtatatttttgtgtaatgaaaaaatgttactctgtcttagatttgattaagtttaaagaagtttgagtagaagaaaagttaaatagtgaaacgaagcgagtgatattgagcttatttgattaatttagataagtgtacacatacccggtcattacagccctagtgtgtgtgtttgaggagaagggaattgaggagattgggaagatacgcaaaacgagatgagccattagctcataattaattgagtattaactattttaaattttaaaaatggattaatatgattttttaaagcaactttcctatagaaattttttacaaaaaacacatcgtttagtagtttgaaaagcgtgcgcgtggaaaacgagactcaaatctcccctagctccccagaacgaacagagccttaaagcaacacggaagtaattaactcctccgatccataggcttgtcatatactcgtgtcagttcagttcagttcataggagtagaccttgacctggacttcgatcaattccttgactacttcagtcaacgcgagtagtttgttgctttatcaattcatcatcgtctttttgcgatcctttttttcagaacttctttttacgatctagtcagcttattaattgactggttaattactttaagcatcgccatcaacgataccttcatcgatatcattatcttactacattcatgtctacagtcaaaagacgtttacacacgtactatgctttagggggtaaaaatagaatgggtatttcctaaccgcctacttgacccgaggcttgcgggagtaatatatgggaggaaaaaaaaagagatcccaatactatccgaatttattaggaaaaaatgggttaggatatgggaagacatgtattcacccgtatgtcccatgttacaaaatatgtacgaaaacttattataaatccacctaaaaatatgataaaagattggctaatcactattttacgtgctcacatgtactattgtgtatttttttttgatgtatctcttttagtactttaattatcttattatatttaatatctatgaattagagagataaattaatatcggttatcaaatctgatttgaatgaaataatatgggataagtgatatttatatggcactatctgtatccggttccgaatttaaaagaaaatacatataaaattatcataatccgaccgtaaccgcccattttcacctctactatagcgccccgcatgtacatacaaattgacggcacaaattaaaccgatcaaattaattaacttgtacaacgacacgaatgtgctagcttttgcaatcgtgttaattctagctttcgtgctaatatagggctattttggtttgatcctaccaaattgttgccgttttaatagtattttggctagttttttatttgtaccaaaacatgctagtaacacatataacactactatagaaatgatcttcacatgtgaccaaaacttgttttcgcagaccaaaacttgttttcgcaggtgaccacccacctggagccaagtgtttgcgaaaattgacatttttctatgcggacgcaacaaccgcatacgaaaatgcatattcacatatggcgtcctaagaaggccgcatgcatgtaaagatccgatttttacatgcgaataagtaaggacgcctcactacaacgattttctaaaaatttaaaaaaaataaatccaaaacccttgatcgggcaccgccttggcagcctgtgagtccatcgccgtcgggtgccgccactaccaaggcccctccgctagctccgtgaaggacagagccatcgtcgtcattgtcgatgcagtccgccgcccaccgtcgtcgagaccctaccgcaaacaaggccgacagcgacagatccatgagggagagggccgccgctgtagaaaccgcatgggggggtaggaagtgagtagtggagagagaaatttgatattttaaggcgtggtgaactggttgcaggtccacttgcgaaaataggtttatttttgcatgtggttatttaagagcccccaacaaaaattgatttttacacatgggcttcttaagtggccttatgcgataatacgcctattattatagatgtgtttcttaaggagccgtatgcgataatgcgttttcacatgcgaccctgaactaccccccccgagcaatttttgcataagcgaccaattacggcctgcaatgcacaagggccctcatctagaaaaatcgttactactaaaattttggtattgcctatatgttagcatggtagcataccaaagtccataactctctagctaattaatctacttcactaactttgactatcaataactttaaaaatatttagtttaaaggaactataacaagatatatatatttgtctttcaaagcactataataaaagtaaacattcatttatttattatatatattataatagaaaaataaggtcaaagatatatttggtaggccatgttattgtctaaaatgtcaattaaaatgaaactggagggagtactagtactgtaaccaccctccctctccctctgtgcgcaagtccacacgtcaaccatggccgtacgtattgtccatgcatatgtaaacttctccgaaaccaattcattcatttcacgcgaactcgagccccacacatatatatacacatcccaagatcacaaatcgagtgtaattaaatttgtgatttgtgaaccttcttcaattctacctagctagcaatctattgagaggtgaattgaagtgcatgcatacaagaatatatagatggtgatgagcggcggcggcngcngcncnaggattgtcagcgatccggcggcgacgccggggttccgattctacccgacggaggaggagctgatcggcttctacctccgccaccgcctcgccggcacgagggccgacgacgtcgcccgcgtcatccccgtcgtcgacgtctacggctaccatccttcccagctcgccgccatggccggggtggcgaccgcgggggacagggagcagtggttcttcttctgcccaaaggcggagcgggagcttcacggtggcaggccggcgcggaccacgccgtcgggctactggaaggccacgggctcggcggccttggtattatgctcctacgccgacgacggcgacagggtcatcggcgtcaagcgcaccatggtcttctaccagggccgcgccccctcaggcaccaagaccaggtggaagatgaacgagtacaaggccgtaaccgcagccgccgccgacgacgaccacaacgccgctggcgtggccgtgcagctgccaccaatggagccgccgccgtcgtcctcagcgtgcgtgcggctgaggaacgagctgagcgtgtgccgggtgtacgtcagcaccggcacgtccgatccttcgaccgccgccccctcgacgcgcccccggtgatcagccaccatcaacctcagctccagcaacaacaacgtcagctgccatcgtcggcagcggcggcggcgacgaacggcaacctcatcgccctcgccggcgggtacgagtgctcacacgacagctccggtggctcgtcggaagatgccgccatcgactggagctcgctgattaccgccgccaccgattccgctaccgccgccgttgatttcagcttcaacgacgacatcgatttcagccctgccgctgttggcccatgggcgccacagctttgattgattgattatttgtgcacactgcataataactgaattactagtaattagtagtagtaagtttgatcagtgcttgctaattgccatagtgttctatgttcaggtcaactcgattgatttattacctcccaaactctcaattctgcttgtctttaatttttcttgaataaattctgaactatggcctgttcttttcttacgaagatttcttacgaagatgaagattctacctcgctttccgttagcacgtttttcaaactgttaaacaatgtatttttgtgtaaaaactttttatatgaaagttatttcaaaatatcaaatatatccattttttaagttcgtaataattaaaactcaattaattatacgctaatagttttcttattttgtgtgcccgtatttaaaccgaatatttatgtgtgttagcaatagcatgatgaatggcaaacagaaggctttattaaaaagtcataaggaaaaaccaggaaagaaaagaaaaatagagtgcaaatataaataataaaagttccaacagaaaaaacacaagcatacaaaaatttaagaaaggttagaaaaaaaatgaaattctaaagtggagaaatataatgcatcggatgagaaaaactcgaaaaggaaaaatcagaaaaactataagagaaggaatctaggatattggtgacaatcgtacgttacaaaagacaggtaataaccaaaaaaaatatggggtaaacatttttatctatattcctagaggtttaattaaaaaaacaaagttatgcaatgagtaaaaggcccagcattaactatgaaattatgcttcaaaatccaaattatttttggttgtaactgatgagctaataagcagtcaacagacgatgaaagacttatggtgaaccacttatttcgtgctgaagtacagtgatagccaccttaaatgtaaactccaaaatagatatcatcacataccacatcataaagaaaggtcatgataactgcttgggatggtagctttgaagttgagccaatttatatgagcatacgtaagtcgccttctattttaatggttacaatctactcaacacttgtattgcgtaactaaaaacatatgtactgcataactaagatgatgcctcttttttctctttatcctcaatttttctctttaggtaaactaggaagaaagcccgcgcagatgcgatgcgtatcttgttaattgttttataaaaaataataaaaaaaattatatatcatcatttctacttaaatgatacttcctctatctacttttgatagtcatatttccaaatctgaaaaaattatttttgataggcatatttcaatccaataacctagtatcatattaatgactttctcggatttaatgcgtgactctccattcttctacacatgattggatacatgggcattgagaaatataaatattaatgagtcgcttgtttacgaggaatgactagtaacatgtttaaatggatgataagtagaatcacttatccttggtctatgtgccaaaatgaaatatgattatcaaaagtagatggagagagtattaaatgataagaatgtttctcatatttaaataaaaacattttgatcgagtgacatataaattattttatcgtcaccatgacttattatgttttaaaagttgagcatctattaataaataaaactgcatatgtaccaattaaataggcctaatacatcattaatacactaaaatatcctctacttaaatttcataactcacttatttctaaatccatatataaatattgtgaaaataccactacttctatctattaatgggatacctaagttaaacatgaatgctactctactgggtagagccgatcatagctgccaagattttctttctccgttgccttcaaatataggtcccacatcgatatagttgtactcctcaagaccagcttggagcacaattttaattcctaattcattaagtattgcatcgataagtacgaagttgagcactattagcgatggtggatcacactggggctagattaacttagccatatgttgcatgctatatatacttaccgcaccgtagcaaactctgttatcgatgcttggtgccctttaggaaaggacaaatggaagatggagttgatcaagatagtttttctattgtttttagtagatttgtggtatagtgtagacacactttttttatgatgttaatcattactacctaaatttttatgatataaatagaatactctgttataaaaatgagcaaagttaatcattcggtgatacttaaagaatgtacatgtttttccaaacatatttacaataactaatccgttggagtacacttatagtcacgtcagtggagtttatgacatatatccatcaattatacctgacatattgaaatttcatacgtataagaaaatataatatgagtagtttattatgcatgttactttattgctcatttgtttaagaaaatatttggcaaagaaaatatatatgaccataaatctcatgatggattatagcaagtccattggctggaaatgttgctgataacttttttttcatatctatataccatgtatactgcccacttctgaaaaactttgagaatgttaatctcaaacaaattacaattaaatctcggatgtacttgaaaaacacaactaaattgtgttgttatgtagatttaaattagtattttatatttgtaaactgatatttacaccctaaaatatgatgtgatttttttgaaaaattgccgtacaactaactattatatgtcggccccatatgtcgtgatatatttaggacaacaatataacttttatagtttatttaaaaaatacagcggaatcataaattggatatataatttttttaaaaaataatagatggtttaataacattgatcggatattttatatttttattatccattttaatttaactacatatttatatttgtgaataatatttttatttttatactgtaaaaaataaaatagatgaccgtcgattttcttgcagcagaaggtaatctttgttttcaatcgtacgtgcgtactcaacttttgttttcagtcactagaaaaaatgcccgtgcgttgcaacggggtaaaaacgttatctttatcctatacattttactcccttggttttggaccgaatgcttccttggttttggatccaacgctcattccttcctttccagcttcagtcctagccctgtccgctacctccctctactcggcctacctctcttcggctcagcccaccagtgaacctgtaggcctagctcgaacaatcccgtgcctgtaccataacggagccgatcctcccattaaatccggtccaatctttctcgatctccaaaatttaatccggtcgagcttgcatagtccagtgtccgtacgatgatggagccgatcctttccatcaaatccggtcgaatctttcttgatctccaaattgttgagggattttgatctactcgatcccaatcttcctttttaatcaaaatccccaaaattgtcaagggaaaatgacaaatccggtcgaatctttcttgatctccaaaattgttgagggattttgatccactcgatctccctcttcctttttaatcaaaatccccaaaattgttaagggaaaatgatgagagagtagtcgggaatcttcttgatctccaaaatttaatccagtcgagctttcttgatctccaaaattgttgagggatttgatccactcgatctccctcttcctttttaatcaaaatccccaaaattgttaaggaaaaatgatgagagagtagtcgggaatcttcttgatctccaaaatttaatccgttcgagctcgcatagtctcgtgtctgtatgatgatggagccgatcctctccatcaaatctggttgaatcttttttatctccaaaatttagagggattttgatcccctcgatcttctttttctatttttttatcgaaatccctaaaattgttgagagaaaaataataagagagtagtggggaatcagtttttgcaatcaattggagaagaaaatacacatgggaaagcaaatcaacgtgaccgcggtgcagggttcggcacacgagaaaaactaccgcggcgcaaggttcggcacacgagaaaaactgcaaaaaaaaaagc

SEQ ID NO: 44669 - DNA, 9900 bp, Oryza sativa
ttatgaattttttaattaggtatatatatagatatagatatgtatgtacatacctacggagaacagcagtcgtgtttacatgagggggaagttattattttttaataataaatctaatctaatggtgtaaaataacgggtccacaaatttaagtgaaaatcaacggtgagattagaatgggtccaccaatttaagtgaaaatcaacggtgagattagatagtcccatgtggtggcttaagagcgtatataggagtgccacatgacgtctttagaatatttgtagaaaggttaatttgtagaaaggttaatggactttattatataataggtagactgtgccctcgctcggaacgatgccaccaatttccttagcaccgtgagacgttcctaccaaagtccaaaacaacaagctaggtacatcaagcgtgcaagtggcaccatcccctcctatcttctttcatccaatagctactaacatcttaggcaatgtttggctaatgggaaatggaaatgatttcccacccaccaaaaaaaacatctttaaatcctaaccattcattctccctctttcatttaatcctaaccctttattcatttcccaatcccaattccactctctatttcccattatccaaatacactcttagttgaagaccgacaatagcatagttggctcactcctagtaatgagaacaaccaactgcgacagtggcggagtcagggatgtcacgaagcccaaacgagtagtggcgttttctggtaatcgactaatattttcgaatatcataagatatctacagtggagacgtcagcgatggagcccgtgcagccacccgacctgcccggaatctagctcggtctttaatcgcaagtactattgtgtaaagatcagagttgcgaggcaccatcatgtttctacttagtattggatagtaagtagaagctattttcacctttgttgtaggcacggttttcataattaactgtgcgtatcaaatccatatttaacagtttctttggaaaggtactttaaaaggggtacgtgtgccgttaagccttcaaccattagatcaaacatgttttggcgtgagttagggtctgggcggcacccaggcgactgggttgcggcagccttctcctcccatgaaaggaggatctggatggaggttctctccgatctgctcagaaagtctgcggaggtcacgtctgcgatctgtaattgggttggtgatcaggttaatcgtgctggttctggttggatctggccgaatgcttttcgacatcgggcaggatggaggcctatcatgggacaatggaatcctaatccgaggaggagggcggatatgaagtttggtagaattacgcctgttgtcaaattctggtacggcaagttctacaggggtcacaccaaagatatcattgatgtggatctgttttggcgatcaaccgtgaaagaaaaggactcggagctgctggggtataaattcaggtacaaggaagggataaaatcaaaaatatctctcgggtcacagatatctagtgcaggtttcaatctagggttcggtcatctagcccttgtgcttaaggtcatggcggctgccgagggtgggggtgatcaagggactatcaatgcgatagttgcccacccgaagccttccggtgcgtcgtcgttgcccccagggagcaggttggaatctgaactccaagctgtactagttctgaatcaaagcgtggatgggatacatgatcaggcaacaggttcaagagtgctgccatcgtctggaaatcatgatggtgggttggcaagtaataacctgagcagtcaaggccctacagttttcactgaaggagaggttgtcgatgaggaggaggatgcagttgaaattgaaatcgaagagaacgaagttcagaaggccggtcaatggacgatcctagcgaggttctactcgctcaagtttcctaatcagtcggctctgtttgaggatatgagaagagcatggcgtttgcgggcggagatgagttacaagtccctaaaggataacctcttcattgtgtcttttaatgcagaaggggattataatttcgtgctgcaaggagatccatggttgcacagaggagatgctttattggtggcggagtttaatggcttgttaaacccttccatggtgaacttggatacagtccctatttgggtcaggatctatgaccttcccctagttatgatgaacagagcaagaggtgaactctatggcagtaagatgggcaaagttcgcgaagtggatgtccaggaggatggatgcaataagcatgatttcttccgtatacgggtggatctcccagtcaatcgccccctaagaagaatgctagctattaagataaaggtgcaaggcaaagaggagactcgcagatttcaccttcgatatgaaagagtcccacacttttgtttcttctgtgggtttatcggacactcagataaagaatgcgaaaagagactgacaaatgagaatgagcctttagtattttctgctgaactccgttgttcgcccttaaaaccctttgagagaaaagtgggtaaagtaaaagcagttcattctcaaggtgttcagagaaaattgtctttcaggggcccaggaagtgtgagttcttcgtcagcgggtattagacaggatgctaagagatatgaagatcaacccacaagggtggatgcttttgatggttttgatattagagaaggaaaaggtgaagactcaatagatagtcaacttgctgaccagacaaatatgctgcacgtctcggaggtgtcaagccttggacagaagaagggcaaggatttggttagtaaggaaaccagctcaataccttcaatggagatgatcccagcaattagagacctgaatgtacagcaagtttcctttggagatggctctactgaagaatttggaagcccaacaaagaggaaagctttgccgacaacaaagagctcaggcattgtccagcaggctgttttggagtatggccagagaggagcagaggaaacggcaagctcaacacgggcaatgaagaggctcaagaagggagtggaggcaaacactggcgtggaagacatggaagcaaccagcctaggggctgctggtaaactggcgggacctatgagagggtctcgccaggagaaatgagttgcctgcctggaactgccgtgggatggggaaccctgcgtcagttcgagatctgtgtgccttatcaaaggaggcgagttcccgactggtttttctatgtgaaactagacaaagtgtggagaagatgagtcgcttaagagggagactgggtcttaggggttttactggtgttagcagtgaaggtatgagtggtggtcttgccttgtattgggatgagtctgtttcagtcgatgtcaaagatattaataaaagatatattgatgcgtatgtgcaattgtccccagaggaaccacagtggcatgttacttttgtgtatggtgaaccccgtgttgagaatagacatcgaatgtggtcgttgctgagaacaatccaccaatcttcgtccttgccctgggccgtcattggtgattttaatgaaactatgtggcagtttgaacacttctcaagaaccccacggggtgaaccccaaatgcaggatttccgtgatgtcctgcaagattgtgaattacatgatctgggatttaaaggtgtaccacacacttatgataataagagggagggatggaggaatgttaaagttaggcttgatcgagtagtggcagatgataaatggagagatatatactctaccgctcaggttgtgcatcttgtctccccatgttctgatcactgcccaattttgctgaacctggtagtgaaagatccccaccaacttcgtcagaaatgcctccattatgagattgtgtgggagagggaaccggaagctacccaggtaattgaggaagcctgggtagttgcgggagaaaaggctgatctcggagacatcaacaaagccctggcaaaggtcatgacagcgctgcgatcttggagcagagccaaagtgaaaaatgtaggaagagaactggagaaggctcggaaaaaattggcggaacttatagaatcaaacgccgacagaacggtaattcgcaatgcgacagaccatatgaacgagctgttgtacagagaggaaatgctgtggctgcagcggtccagagttaattggctaaaggatgaggatcgaaatacgaaattttttcatagccgggcagtatggagagcaaagaagaataaaatctccaaactacgggatgcaaatgaaactgttcacagttcgacaatgaagttggagagcatggcaactgaatattttcaggatgtgtacactgctgatccaaatcttaatcctgaaaccgttactcgtcttatccaggaaaaggttacggatatcatgaatgagaagctttgtgaggattttacggaggatgaaatttctcaggcaattttccaaattgggcccctgaaatcacctggtccagatggctttccagccaggttctatcagcgcaactggggcacaattaaagctgatataatcggtgcagttcgccgtttcttccaaactggactgatgcctgaaggggtcaatgatacggccattgttcttatccctaagaaggaacaaccagtagatttgcgagactttcggccgataagcttatgtaatgttgtctacaaagtggtatccaaatgcctggttaacagattgagaccgatcctagatgatcttgtttctgtggaacaaagtgcctttgtgcagggaagaatgataactgacaacgctctcttagcctttgaatgtttccatgctatgcaaaagaacaagaaggcaaaccacgcagcttgtgcatataaactagatctatcaaaagcctacgacagggtggattggcgtttcttggagatggcaatgaataagttgggttttgctcgccgatgggttaactggattatgaagtgtgttacctcggtgagatacatggtaaaattcaatggaaccctacttcaatcattcgctccaactagaggtttaaggcaaggagatcctctcttgcccttcctatttttgttcgtggcagatggactgtcattgctgctgaaggaaaaggtggcccagaattctttgaccccttttaaagtctgcagagctgcccctggaatttcccacttactctttgctgatgataccctcttattctttaaagcacaccaaagagaggcggaagtggtaaaagaagtgctctcatcctatgccatgggcactggacaattaattaacccagccaaatgttctatcctcatgggaggagcctcgaccccggctgtcagtgaggctatatcagaaattttacaagtggaaagagacaggtttgaagatagatatctgggatttcctaccccggagggacggatgcacaaaggacgttttcagagtctgcaagctaagatttggaaaagagtgatccaatggggtgagaaccatctctccacgggtggaaaagaagtgttgatcaaggctgtgattcaagccatcccagtatatgtgatggggatttttaaattacctgaatctgttattgatgatctaacgaaactaacaaagaacttttggtgggattccatgaacggccagagaaaaacgcattggaaagcctgggattcgttaacgaaaccaaaaagcttgggtggccttggtttcagagactatcggcttttcaaccaggcacttctggcccggcaagcatggaggttgataacatacccagatagcctgtgtgctagagttcttaaagcaaaatatttcccccatggttccctgattgacacttcctttgggagtaactcgtccccagcatggagaagcattgagtatggcctagatttgttaaaaaagggcattatttggagagtgggtaatggaaattcaattcggatctggcgggattcatggctgccaagagatcactcaagaagaccaatcactgggaaagcaaactgcagactaaagtgggtgtctgacctaattacagaagatggatcctgggatgtgccgaaaatccatcagtatttccataatttggatgcagaggttatactgaacatctgcatttcttcaagatcggaggaagacttcattgcctggcaccctgataagaacggtatgttctcagttcgaagcgcttacagattggcagctcagttagtgaatatagaagaaagttctagctctgggacaaataatattaacaaagcatgggagatgatttggaaatgcaaggttcctcaaaaggtcaaaatctttgcttggagggtggcctccaactgcctggcgaccatggtaaataaaaagaagagaaaattggaacaatctgatatgtgccaaatctgcgacagggaaaatgaagatgatgctcatgctctctgcaggtgcattcaagctagccagctttggtcatgtatgcataaatcgggaagtgtttcagtagatataaaggcctctgttttaggaaggttttggctgtttgattgccttgaaaaaattccagaatatgaacaggccatgttcttgatgactctgtggcgcaactggtacgtgaggaatgagctaatacatggcaagtcagccccgccgacggagacgtcacagagatttatacagagctatgtcgatttactgttccagatccgacaagctcctcaggctgacctagtaaaaggaaagcatgtggtgaggactgtacctctgaaaggagggcctaaatatcgagtgcttaacaatcaccaaccatgctgggagagaccaaaagatggctggatgaaattaaatgtggatggatcctttgacgctagctccggtaaggggggtcttggaatgatcctcaggaatagcgctggtgatatcatcttcacttcttgcaaaccccttgaaagatgcaacaacccgctagaatcagagctgcgtgcctgtgttgaagggcttaagctggcgatccattggactttgcttccgattcaggtggaaacagattgtgcctcagtggtccagcttctgcagggtatcggtagagatttttctgttctagccaacatcattcatgaagcgaggcatctgctggtgggtgaaagggtgatttctattaagaaaatatgtcgtagccagaattgcattagccatcatcttgcaaatacggctagagctgattttcttgctggattttggttgggagagagttgtaatcttatctcacatttattaagcgagaactttatgagtgagtaatatatttctttccccccgcaaaaaaaaaaaaggggtacgtgtgatgtgcatgtgtgtgtctggactctctctataacttgtacaaacttgaactatactgtttgcccgttatattattttgtcggccgattgtacaggccggtttttatatggcccaagtccaaagcctgccttttggctgcgtgaccacactcatgtgatgatgtgataagtctgctagcactagcagacgccttcacggaccaacacaaaagttacgacccaaaaacaaactctccgaccgaacgcaacagcgcactgcatgccaaccgaccgaccgaccgagcccgggccgaggggtgggccaggtggccattcttccagacgctttcggcccccatgccacccactgacgcgtgggccccacacccacgtgggggcccgcgaggagggccatcggtcgccgatttgaccggggaggacaccgtcacccactgacgccgtggggcccacacgtcagtagccccgtactagtacgttttttgcatgctttgtccgggatgcgcggcgcgaggcgtggctccacgtgtcctcctcctcctcccccacagcctacgtgtgcctgctccggtgatgtcctgtgtcgcgggtacgtggcggccggcgaccgggcgcgccctcgatatattaggccgcgccccccctcgccgccgcactcgcctgcccccacggcgagcagccagatgccaagatcctccccgcggctactcctcccatgtcggacgaccacagcggcggcggaggcgagcagcggcaatgccggcgagggttcgcggtggacgtggtggagctcggtgcggccctggctctggccgacatggccggcgccgccgtcaaaccggccatgcagctgcagctgcagccgaccgccgctcaggaggaggacgaggagatggcgaccacgaggctgagccttcagctcggcaacaacgtcggcagcatcatccagtcctcctcctgctccagcagcggttccagcgccggcctccccgcgccaccgccgccgccgccgccggccaccgcctacggcaccaagcccctccacatgctcaccgaggtaactgaaactgaagccaatgacatcgctcgcctatcaaactgaaactgaaactgaaactgaagctggtgaaatcgcctagctgcaaatctatcctgctttaattaatttctcctacaaatttgcaggaggagaaggaggcgaagcggctgcggcgagtgctcgccaaccgggaatccgcacgccaaaccatactccgccgtcaggtgatccgatctgctcataaatagttggaaattgcacaaactgtactccaaattgctgcgactgttgggtgtcaatataatcagtgtttctcctggactatcaatttcaggctattagagatgaactggcaagaaaggtcgcagatctgtcaacacagaatgagagcatgaagaaggtgagcgaattagacctgacaagatcaacagttgtatcttttatgtagcttaagctggcaattaacagtaatgatgttgtgtttgggggtgcaggagagggagacagtgatgcaggagtacctctcactgaaggagacaaacaagcagctcaaagaacaggcacagcatcatctttcgctttccttgttctaattaatctcttagtagtataatcttcttctttttttgttctcttttactacaaaattattattactcctaccattctgaggccaaagagagcccaagagaatctactctactctactctaccatgttccaaatccaaacctccagttactttaatccctaatcccttttctcttttacttgtactacaaattaagctaagtaccattctgagttaaggccaaattaaagagaatctactagcatgttcctccatttgccacatgactgcactttactgctgctactggtcctagtagtggtcaaatcaatttggccattgctgtacggctgtagctagctgctggcgaattgggaactgaaaatgtttttattggatgctctggcacttgtgtagtgctgtgtatgtgccacactgacatctgtaatggatataaccattttttcttcctgtgttttgtggtacactgctccactatctggcaccttgtgcatgtccagattcttttagttgtcgatgcgatgatgcaaaaagctcgcttgaaattatttgtttaatcattgtcatgtgggatccaatggtccatccttgttccgcatgggtgttctagccagttcagtttcatttatgcgtggggaaaaaaagaaaataaaaaatgctatgtgtgctgggtaatgaagcatgtatgtggcaagcagcaatagaatacataccaactctactcttatgtgatgtttgtgttagaataggggttgaatatacgagttgggattgaagttggaataggtataatatccctctaaaatagagacggggcaccacaatcacggcaactacaatgagtgttggaataggtataatatatagttagagagttgaatcctgtgataggcttgct

SEQ ID NO: 44670 - DNA, 2104 bp, Oryza sativa
tgattctacgtcgtcatctagtgtgtatgtagtgacactctaatgcttgaagggatcgaggaggttagtcgttgaggaggttagtcgtcgttcttttatatcgacgaacgtttataacattcgtctgtgtaaactattttgaaggtctaagaacgccaattagtcgagatcagccttttgatgataatggttggttaaaacgcaacattcccgagttcttcgcggatttgaattcatccctgcggatgcgttgcaaaatttgggaaattcatgcgttagcagtataaacaaacactgctgtaatgagacaagaaccaaacctgcaaggctgcaacaacgccaacagcaactgtgccttccagctttgtcagccactctccgccggagctgagatcatcgaggtgcagctcaagctgggccaccatgtaggggaaaaagcggtattgaaattttaccgacatagcgatacatgttcacgtaaaattaatataataataataagagaaattttatggggtttgcatttcaaaggtatagattccacggttctcagtcatatgtactatgctaaaggtatttaagtattgatataggtactatgctaaaggagaaccataggtactatgctaaaggtatttaagtattgatataggtacttaaggtatttaagtattgatatagatacttaggtattaagagtaaaacatataattttgctagtagagtgaaaagggtagaatttgtcccccaaattataataggtaccgtgtagataggaccgtacgcattaacataacatggtatcagcgttatgtgtttttatttatgccatttttctcttttgcgtggtttcttgtagatttacgttgtgttcgagttaagtcgtttatcggcactaagatcaatcaaatattgtctcatgttcaaacgctcgaccatgccaaaaccttcttcgaccgtgtctctcgtggctgcacctcttcaaactctagaagaacaatgtaggagatattgtttgtcccttatgaagggaatctgtgaactacataaataactaatcaactgtgtaaataaacaaaggataacttacgaatacgcttgtctagccgtcgatcggccgatcctgtctcctcttcaaccctcaaccatattgacgcttctccctctgtctcccttcggtgaacaggtttaaaccttagaacacgcacgaagcaaaagggaaagaagaaagaagacgcgagtgttacgttctaatcagtcactaaatcaacgaagtaatctaatttacttttttttcctacaatgataccgagatctacgatgatataccgatcaatggtttcgaagtaatctaatttactttttttttctacaatgataccgagatctacgatgatatactgatcaatggttggaggtattcaattcactaaaaaatactcatgttttactagttaattactcaattgtcattagttaattactcaattgtcatcatgttacaataattttattttctaccttatccttctcttgatcaacaatacatattattccacctccaagtacctctaaatacctcacaaacaccgtgaaagatctcaataagaatatatatctttatcgatcgttgctggttgtaaaatttagttttttttctaatttctatcagcgtttttataaaattagtaaaaaggaatttattaaaatttaatttttttaaatttctatgagcgtttttatataaaattaataaaaattgatactgttttcaacttccgaccgtcttcgtctccgtggccagtgagcacggccatggccgccgcggcattggcattagtacgttgctagcacatgaggcaaccgcaagccatcagtattaagttgcatatatcgaccagtttaacttaaaagcaaagcttaaactgatgagaaaaggtggataatccactttatattccaataggtatacactgtccagcgataacgtcgccgtcaattaaattgtgccaccggttacaaacatgaaaagcttctcgtagaccttgttaaatcccaagagaaatattaaaactgtgccaccggttacaaacatgacaaactt

SEQ ID NO: 44671 - DNA, 1712 bp, Oryza sativa
  unsure (1)..(1712): unsure at all n locations
ggtaaagtcggaaacgaaaacgatatcggaaaaccggaaatggaacaatatggacggaaacatgtcggttcagatcggaaaccggttacaaatacgaaaacattaaactataaaaacgtatatttaactttacataagtatgttatatgtataaataaattcaagcttatacaattatactatataaattataagttaactccattttagccatgcactcaagttagggatttaatggaagagtcaatcaatctctaaattgtgggtcaagtagagacatgccctaaaaatatcagcatatttagaaatacggtaattaccatattataagaaactgtaatttctacaagaatacggtaaatacataaacaatcggtataccagcaaaaccatttccgttttcgtttccatatttttcaccattttcattttcgttttggtctattactattttcatatggctcggccggtagaaagtcagaaacgaacgtcaatcggctagaaattaccattaccattttcacccctagtgtgacctccattgtggaaggtgtggcctatatttggtttcagcccatatagcccacatgagaccactacgatcatgtggcctccaacctccatggaccatgctctaagtacttggcacatttccaaaagctttgttatggtgttgtcacccgccatcgtcccagtgcccattgacatatttgattagttaacaaattagctattttagctatgcagtagtttatctatgcaattatactagtaattccgccatgtaggttatactcccttcgtgatcatctcctgtcgtccaggtttgtagccggccagaagttgattcattttgtggcaggggagtaaaaacaactttgccgtgttgcttttgtgggcaaaataattaagtgtgattaaccctatttttatatggctttggaccataaattattgctgaatattatagtttatagtccaaattaaagtggttcaaacatttatgtttcctcactgaaacaatccactcggggctctagctggaaaataaataaatttcaagatatttagcccaaaaaattattgcgattagagccctacagaacaccaggtcagaatagggttcacatcgtctgccgttcaggctgacggcaaacattgccgttgccttcattcatgccacacattcttctatcaacagttgcatgcagtggtcccaccattgtgattaattagggactactaataagaagaatcacttatttctcttccaaaaaaaaatcagcaaatagaatctcggcggtaaagtgcgcgagaacaaaagcagagcagagggaagcttttgctttttggcgccaagaatatggatcgactgacagaacagaagcagagcatagtacaacagagcatattactacagcaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 44672 - DNA, 11574 bp, Oryza sativa
gcagcgcctcgaccccgccgtcgaggacatcctcatcaccgccgcccacgtcacgctctacgacttcaacatcgagctcaaccagtgggtgggtgaagccatgcgccgatctgctcgcctccctccgctggtgtccccgtccatatgatccgatctgacgccgtgtttttttttctctcttccttgtctcccttttgggtctatgtgtgcagagccggaaggacgtcgagggatcgctgttcgtggtgaagaggtgaggtgggggtgctttgggcttcgggaatggtggtttagggtttggatcggggtttttgcgtgtgtgctgattgagatctaacactttctggaacgcgttggatcgcgtgtaggaacaagcagccgaggttccagttcatcgtcatgaacaggcgtaacaccggtatgtagttgatgagtttttttttcctgttgcccgtatttcgtagcacgcttgttgtttagaactttggatattggactgattgagctgatctgtagtaccactatgacctgtgatctctgatctgtagttctgacacatatccagatattagcaggctagttcttcttaggattttaatttactataggcttttggaaagaataatctgaaattctgcacccaaatggcatatatacgtaaatcagctatgatcaaggtatatctacatctatgagtagcagagcattttatgattttgtagaaggtgtttttttttataaccacagtatttaacacagttacgcagatatcagctcaatacatcatagtctagacaatgaactgcaacattcaatattaattaatttgatttgtatgctttttaatgaatttgatttgtatgctggattcctcatgaaaagatctgtttctgttgttgtagcctgtaacagataatccaagatctgggctgtgtatatccccttgcagatatagaggccggatttctatccattttctaaaaaaacagataatctaagatctgtttttcttgtcgtaactcgtaacagataatctcgtggaggatctattgagtgactttgaatttgaacttcagcctccgtatttgttataccgaaatgctgcacaagaagtaaacggtatttggttttataaccaacaagactgtgatgctgttgcaggtgtttttggaaggtaaggccttttctctaatatctcacctgcgtgacatgtttcaatctgactgggtcatttagattgggcaaacaagaaatggacagggacagatgagaaccatctaagaatcgtgctccttgctatctccatttatgccatgaactaatttcgctagttactcttttgtgtaaaagacatttgtttttttacttttgttgtttagtatattcaccaaatcgtaaattagtagttgcaaatgtgatcctttttctgattctaaattatattatgtctaagtacatacactttgactgaaactgtggttgaattgatctgtttgggttcaggatattgaatgcttacgccaaagtgcctccaaagcccaaagtaccttccacaaaaaggttcccatcttttgagttgaactacacttgcattctaagctttacatttagctatatattggaattatactgatttctgttggtgtactgcagtgagtttgaggaattggaagctgttcctacatccgctgctatagatggcccccttgaaccttcttcgtcgtccactgttctagtttctaatgcccctgatgaatcattgactgattatttcagtgtatgttctctcctttaaactccctgctattgcattctaccttttattttttttcatgttcatcaaataatatacaatagcttgcctcagatcctagtaaatctttatttgcatcttgattgctacatttgtactagtatattgcttcttaccagtcacacatgtatatatgtttgtactgtcagtcttgtcacaatattgagttctgttctgaacaaatctgcagggcgctgttaatgttgggaatgtatcaattacaccaatggttggaagaactcatcagcctatcgagtctgttgcatcctcacacgtaccattgatcatcccatctgctgctcctacacatcaaatgggtgttccttcaggggctgcgtcagctccaccactgcccgtcattgacactaacgttcattctagccactcaacaaatcttgtaactccagccttttttgcacctccctcatcgtcttctgcatcattggtggcaccagcttcatcctttatgcccacagcatcaccttttcatccaacttctgccgatgctcaccgtccagcatatggacatggtacaccccttcttcaaccccttccgccgccaacaccacctgcatcacttacccctgtacacaacgatgagcctgttatttcgagggataaagttaaagatgctctcctgaggcttgttcaggtatgtttcacattgacaaacacatggttgaataacctttttctttatatatttttaactcttttatctcatgcccaacagaacgacgaattcatcaatttgctctatcaggagttacagaatgcacatgcgtagactgcttactcagcctttatggagtgtctggccttgacgagagttcacctgttctttcgtagttttgtgtgctttagttctcaaaactttatgtacagctttggcttctttttatatcggatgtccgcgaagagattgtgcagctttgtcttgatgcattattgatgtagagtttttatagcaatggctggtagtatttcttccaaatggttgtacttgtatagtatttttgtttcctgttggaaactcgaaatcggaagctggactatgtgtggcaacgttaaaatactgtccattttgtgtgatatactgcacagttgccatttagatatttgatatcacacatttttttagatcaaacttatttttacacattgatcagttctaaagatcaaatatatgtggccagagcgagtatgagtagctattgcctattggtggatatacgtaccgtggcaaacccgtggcactttgctccctcgtcgatcatcgtcatccatcgattgttccagctgttactcttatgccattgctctacttctattctgcacaagcttgtttcatcagaaagctatttcttctgtttcacaatttaagtcattttaatatttttcatatttatattgatgttaataaatcaaaatagatatatatgtctagatttattaacatcaatataaacataaaaaatgctagaatgacttacattgttaaacggagggagtagctacaagaacgtagtagtatgcacatgctcgtttgttatcccccatcctgttggctgcgaggcaggtcacacccgctcgtagtaaaatttaattgcttcattcgttttatattataagactttttagcatggctcatatttatatatatgttaataaatctagacatatatgtatgtctagatgaatgtgaacaatgttaggaagttttataacttgaaacggaggtggtacatatttaaacatttatgttcttgattttgttttgcaactcaaaacaatttgaattccaatatgtacacactacgttgtcaccgaaacctacgccacgtcagagtgcgccgcgcgccggaggggacgccggccggccgcagcgcacggcacggtcaccggagcgtcagcgtcgagaggaccccgacgaacgccgccgcggcgacgccggagcagaagaagtcgacggcgccgtctcgcctcgccttcttcaccttcctcgccgccctccccctcgcgaacgcctcgtaccgccgccacgccgccgcctccgcaccgcggccgtgcctcgcgccctccatgaccgccgccaccgcggccagcacgcaccgcccgctgacgccgccgccatcgccgtcctccgcgcgcaggctcacctcccgaacgtgcccgtgccggtcgtcgcatgtcacccccgcgtcgagcgcaacgacgccaccgccgagcaccccggtgaaccgcgccacggtctccccggcgagccactcccggtccacggacaccgaacgccggctcgaggcgttgacggcgcggccggtggcggggtcgatgagtatccagcttagcgtcagctcggccggcgtgatcggcgccggcgccgagaagccctcctggacgagcgcgtcgacgcggaacggcgagcccaagaaccactccgacgaggcgtccgtctccacgacgcgcgacatgaggcagacttcgccgtggtgcaggtcgacggcggagacgagccgggccgggaggagggaggccgacgacggcaccaagccgcgggcctccgccgggagcgggaacgcgtcggcgaagagcgcccggtaccctcctccgccggtgacgccgccgcattcgtctaggccgtcgacgtcacgcagcgacggccacgtcgcgaggcagaggccgcgccacgtctccgcgtcggcggcgagctcgcggaaggcggagcacgcgcagccgagcgcggccagggaggcgccgtcgtcgagccggcgtagcacgagggagagcacgtcgcccggaatgtcctcgatggccgtcgtcgtcgtcgcgcccgccacggcgccgtcgagcgacaccgccgccgcggaacaaacgctcgccatggtcatcaggtcaagaagatgcatgccactgtcgtggatgtgcttggttggaagcaaccatgtctcgtctataaatacatggagctcgatcgaggtgggtgaagggagcgcgtgcggggatgagatcgatcgatcactccagatggaaggaaagcgaaggtcaactcgtgtctcgtccatggagaagaagaagaaggagacgacggacacggcgcggcggcggcggcagtaggggttttgcgttggcgggaagcgaaggagagaattattgcatggtaacacaccgttcgtttcaaaataaattcatttttcaccgatccgcacatactccctccaaatttataataattgattttttaaacaaggttgagatcaaacggtcataactttaaccaccaataacttcaaaaaaatttagtttaaacgaactataacaatatataaacatttgtctttaaaagtattataataaaagtaaccatacatttatttattgtatatattataatagaaaaataaggataaagatataatttgtagaccgtgttattgtccaaaacgtcagttaaaataaaactggagggagtagttggttatgtgtcgtgaaaaccagccattctagtttatgttttataatcggcatgtgtgctcatatttggtggtaagtgatgtacttctcaatagcgaaaagtctacgataatttcatcaatctcaaaatatacttgcccatttttcaaatatactcataattatagagtgtgcgtgggtttttatataggtaagtgtatgtgtgttgttagcgtatgtatttgagtctgtttagttggggaaatgaaaatttttgggtgtcacatcggacgtttgaccggatgtcggaaggggttttcggacacgaatgagaaaactaattttataactcgcttggaaaccgcgagacgaatcttttgagcccaattaatccgtcattagcatatgtgggttactgtaacacttatggctaatcatggactaattaggtttaaaagattcgtctcgcgattttttccttaactgtgcaattagtttttatttttatctatatttaatgatccatgtatgtattaaaagattcgatgtgacgttttttaaaaaaaaattatgaactaaacggggtcttatattaaaaaacaaaaaggagcaaatggaaaagatcctcaattgaaaggactcgtgggcgtggcacatcctagatgtttcagtcgtgccgtgtatcattcctgaaaaccgagaatgctttgatttagacaaatcatgtagtagtagatagagatgattagatggtggatgccgatcgatattttcatggtcccggccgtctccattaattaatggcggccagtagtttgggctaagaacttgggtttctgttggcagatgaacgtacgtaggtaccgcgtgcgaacacagttcgccgccgcgcacacggtttgcttctgctggagggcttgtttgatttcgagaaaaccccaaaaaaaaagatatctaagaattaattaattcatatgaggtgttatttgtagtacagaaaatcaattttttctctctttttttaagttgcggagaaaaaacatatggaatttttcattcactcaaatatattgaaaaattgctataaattaaaatgtgcatgtatttccgtttctctaaattttctattcttatggttaaaaattcctttaaatcgaactagaaaggtaatgtgagtgaaattttattatgaatatttatgtgcagggttttttattgaaatatttttattatattctaaactaaaattaaacttattttgtattctttgaacgctggtattttcttataattactctttcaacatataaattataaaataaaattatttgagatcatgtggttttgaattgctaagaacatattgtgtcgaaactatggaggtggccccttatctcgaaaaaaaggaggttgttgctatcagaaaatttagggaattttaacttgctagattgataccttacaacccaaaacaaatcaaataatatatttttttgtttgattgtattttaaaattttatatttttcattctaatagtcctcataaatatatttgaatttttatattaagtatgtgttttaaatccaacaacaaagtatcaaggtcaatttgtataggtaagtagccctcatatgtatgttaagagaaattaattcaattggtagaaagttgttagatgcctaacgtgatataagtaatagatggagatccatttgtgtttttcccatatagataattttaatattaattgtctaggagataaaaaaaacagatagaaaagaatggcgcacgtgtacttacgggcagggagggagggaggtttgggatgttttttctaaatgattaatacaacaacctaaattaatatgtcagatgtttatgtcgaaaccgatggttggatgctttgttttcttatcagaatttttaggattttctttgatttaagagaacaacgtaacatcttaagagcgtttacaagatgtgtaatggacttttaataccacatgctgtaaaggaggagggagagggtttggggtgttcttttttttttaaaaaaaatagatctaatgacctaaaataatgtttcattcgattgaaaataatgtgtccatcgatttatgtctaatcctatggttggatgttgtttcccaaaatttctaagaattttctataatttaagaatttcatataccagcttagagtttttcttattagaaaaactaacaaatcgatagtctaatgctttgttatttttaatattttctagtattttatttaatttaatagcatcgtatagcatcttaaaagtgtttgtagcatgtttagaatgacagatcaggagctgctagacctagtgggtggagatatgtggtattttaatgcaaaaataatattaattttaatttctcatgaagaaagcttgttggtatgtacttgacagggaggttgtggatgtgtgtgttttaaaagaaaaaaacgatctaaccttcgaaaatgaaataatagattcaccaatttaattgaaaatcgatgtgcgaattagagtatcacttgacaatttaggagcgtttgtaaggtgtaacttgccggcttagaaatatttataggctgtttcatggacttttagtatataatagtattttttctaaaatttctaagattttctttaatttaagaatgtcatatagtagcttagaggtgtttataaaatgttgaatggattttaccaccgcacggattttttattaaaaaatatataacaacctaaatgcatcaatttaagtagaaactggtggtcgatgctttgtatttttttctagtactttctccaatttaatagcaccacgtagtgatttagaagtgttcatatgatttttaaagtgacgaagggagagatgctagacctagtagttggtctatttgtgattttctttttgaattgtaaaagtaatttttattttagtcttcttaaaatagaaaataaggaaggaaaagatggatttacatatagtaagtacgttcgtcagtataatctaaaactattacgtacttttgtacgttggtttggatgttggctccggatgtttttttttataaaatagatctaaccatctaaaacaatgggtccactaatttaagtaaaaatagatggttgggtttctcttatttattaggtgtcatttggcgacttttgagtgtttatagggtgccacttgatggtttggaatcgtttataggaagtttgatggacttttagtttaatactccctccgtattgtgggacggaggagtatatataatatataatagatagataatagataatagaaatagatagacagatagataatacagtagatagttttttttcttgctatgaatagtactaccgaagctttatttccttttcaatctcaagtacgtacttatgtttgtatatgtacttatgtttgtatatgtacttatgtttttttaacagttagtatatatacatctaatttaatggtctataatgacgatccaccaatttaaatgaaaatcaatgctgagattatacagtaccacgtagcggcctaacaacatttgttggagcgccacatggtgatttatgagtgtttgtaagatcacaaattaaatatatcatttattttttttaaaagatgaacaattaaagatgattgatttgatatttgatatttatattgtagatctagttttaacaccgcatgtgtatatttatgaagtaatatatttcatctttatactgtagaccgtcgatttttcaatggccctaagtatttatgtttatgttttattttggctttatctttatagtaagtacgtgcatatttttttttcttccggcaaacattatgtacatgagaaagatattatattatataaaacaacatgtccattaatttaaaaatcaataacacataaataaattaatggatccatcaagtgaaaaccgacattaaaattagttcaactgcatgtatatatttgtgggataatatattttatctttatattgtagatatttgcttgttgacagtactatacatgtatgttttattttggttgtcgtatctcgtatgtacgtccatacgttctgttccttcggcaggcaaacagtacggaggagaaagatattatatatacatagatataatctattagcataaaataatgagtatgtatatatctaatctaacggtataaaataatggttccatcaatttaaatgaaaattaacagtgagattagactatgccacatgacgatctaggattgtagaattgccacgttacagtttgggagcgtttgtagaaagtttaatggacttttagtatataatagataagcttgtcagcactgcgcctctgctctgtacatacgcagcagaaatattagcgtgtggtatttccgttcccgtgaataactcacacgtgtggtgtgttttatatctccttaattcaactccaccacgtgctaatcacgtccgtgctgtttaataagtacggctagctagctgcctgcttgctaggccatgccggcaagcaatgacaattttgggttaacgatctataacctaactaatatggtcagttccagaccgttcaaaaaaaaaaggtcagttccaagcttatcaaattcatttccattacttcttaaaaaaatcatttccgttagtattggcctgaatggccagtgctactgctattttaacatctaaaacaatatgcagctagcgatgtgtactgttcgatcttgtccaaataccaatcaattcggatctttccggttaatttcctactgatattttatcgaatctgtataccactcgttcatccattgaatttgtcttactcgattattaagttatgctcagctataaactcatttatctatgttatattttttgcattcttttaatataacaatgacatgtgagattttggtgaaatattgtacagtgatatacattctgtttttaagggcatatttgatagggatccagcttcaactcaatatctccatcccgcttggaattagaacctagccaagcagtacattctgtttttaagggcatatttggtagggatctagcttcaactcaatatctccatcccgcttgaaattagaacctggccaagcagtttcaacttcacctcaaaagagagtggattgggctaaattgatttttgaaaaatgaattagagagttaacggctttgttcttctagagttattttgaaagtttgagctagctctactaaacaatccctaaagctttggatggtacaccgatatcgttcggtaccaaaacattctactacatgtttccagagaccgtcagattggaattgacaagcttgtccgtccgcaagaagagaaacatgctaagccaggttgaaataaatgaaatggcacatgatgcatgacctgatgcttcacttgcttgtagggtttaattgaatattacatggcataaagctaaccaatagcttgaaaaaaaaatccaagcaatactatttctaaatcatatttttagatcaaatatttggaaaaaaaggttttgaagaaatcatattttctaatgtatgtcacgaataatctactcgataatccatataatctggttttagctaattcaaacaggactttgtgatgctttccctgtgtaagatcgatcgagatgtttatcgatctgtgatgctcttcccttcattgatttgttcaacaaaaaaaaaagatttagtggactaattacaggattgcacctttcattcacagataggactacctccatcccaaagaaacctaaaatgagatctaatacattctaatactacaaatttgaaggttgaaacagagaaaataatactaaacaacctaaattcctagaatgccttcttttttttttggacggagtattattcattcaagacgatccgttcctgggccgttgcctcgtacgtggcggcgacgttgggcctgggctgtctgatgaatgcggagtaggcaacggggccggcctatcaccaaggaccgaacttttttcgtttttagattttttttaatatttacagaaataatctatggaccaaaaaaattgcagaaatagcccctgccgccctaatggtgggcggcaagctgacgtggcagacggtgggtcgaccgcgccgtctgccgccgtcggccaaaattgcgattaggcccttgccgcccgtacagagggcggcaaggggctaattgcaattttggccgcccataaagagcttgcggccgtacttttttcatctggg

SEQ ID NO: 44673 - DNA, 22065 bp, Oryza sativa
  unsure (1)..(22065): unsure at all n locations
aggtattattttgtaccttattcgacgtattagtactcggataatttatataggcctatcgcagtctgggtcgtagaaacattatgtggacttaaacaaggagaattatgtaacatgaagaaatagtagtacaatttgaacatgatacaactatttgcattgcggttacatagatgatattagattcgaactaggagggaggtagtgcaatagttgaacacaacgacgatgtagtaatgggacaaggaagcatgacagtagaaatttcaatatgccaagttgtccgataatagctaacccctacgtgaggatccctctcctctctcaaaccgcgctttagtaaccctgtattgctctggtagttcaagctgcacaacacggctaggtggagttagaacccttctggtgtctatccattctcagtattgacatctccttggtggttcctgggaggaaagaatagatgtaaagcaagcaaagttagtaaatgttgtgagaaaataaggattcatgtaatcaaaatattcttaccatgaaatcgtcgttaagaatatttggacaaacaaagaaccttcgacccaatgttgtaggatttatggaacgaagaacctgataacgctcaccacacctgcatcttggacgggcttcccatggagggagtgccgtagttagcacccgccagtcgctctgttgttcacgacattgtcgttcataagccgcttttctctgtaagtattgctcagtactttcggatgcgaaataccagcgaccttcttgtaaacaagtggttaggtcaagaacgggattttctgtatcgacccactcgatgtatgcgcaagccgtagtgcgggtctgccgaatagagtagtgttacgaagaataaagcgattgcccatacggaatgaataagcatgtgcagataataaaatacctcacggtcatagttagggcacctaaaaaagcgccttcctcgaatatcaggattcctcgaagccattagttggcatcgatcaccgcataggcagagaggacgctggcaccaaggtggtagtaggtatacacaaggatcgctacgccagtttggatcctcaacacctcggcgtctagccattgacgaaagccggtcggatttgtaatgaagcaagtggggaagagagtactgaatgtgactgagttctgaaagattgtgaggcctcactcgttaaggcgacttatataggcgcaaaaaatcgagtgatacccctgacatgtgaacgtggtggggtatggtgggtacgcctgattggcgccgaaagatacatgcatgatcggcgccgaaagttacattggtcatatgcgccaaatggcgggcaaatactcgtatcacacgcgaataaaggaggctgcatcggtgcggcagaaagtagtcgtgcatgcgccgaaaggtatcgtgcatgcgccgaaaggtatcgtgcacatataacaacaacgtagtcattacacaagcatacagtactggaaagtgaagcaagtaaacaaagagaagactgctctactggccctgccccgcgccgcgaccacgcttggtcctccgggcctgtgctcgcacgtggtcctgggagtaggtgaaacgatctggtggcacagcacgggtagcacgagtgtcccgcggaggagtggcctgcgcctggtcctgcgtctgcaccggcggtgcgcctcccagctgtgaggggccgatgacgtcctctgtcgagcctgaagcgaagtcgaagtcagtgatgtcgaagaggaaggtggaaggcaacaagtggtccgacgaggacccagcatggtccagtggtggaccctgactcgacgtgccagctgcctgtgacgaagtcccggtgtactgccagaactgcgctgagtgcgaggtcgacacagctgcctgagacgctgaccctgcagcctgggagaagtgggcggcctgcgtcatagcgaactaggcgaaacctacacatcgacaacgggacccttgtaagctaagacataaaatgtatgtaaattgattgtcgaagtaatgttgtttttttaagtacctgtggggggcacaacagaaggcctagccgaggaaggcggggtgctgaacggtgcacgaaaccctgaagcaatcggcaagtgaaacgactcacttatatgtgcgaggcatgtacagaaatagtaataaaaatacttacctccgtgcggagggggagtcggcctaggaacgtgcgcagctggacggggaccagtcggtacgggtggccgctgtacagctgcgtctgcccgagcaacgtcgtctgcacgacaggtgagcactcggagaatcgagcgcatcgaccccaccatccgcgtgtacgtcgtcaggtgctcctctacgggtaccggaatccccgcgcctaaacgttggatcgtcgttgaaccgtcaacgacgacccggttgatgtcgtcgacctgcatggttaatttgttcgtaaatattcgtaaaatttgacgaagagaaagacatgaaaacataaaggaatggtgcgatgcaaggtactcacagcacgagcgaagtcctggttgcggtgcctggcatagaggtctctagtgctcgcaacgtggggctgctgctccaagggagcgaaggtgaccctagtacgggtacgtggctggtaccagcgtaggtaggcctggtacgactcctcagtgtgtggctctccctcgtggtccacgacctcctcggttgcgagcaaccagtcctcaacaaaagtcgccagctgactgctgacccttgcgcgagtacctgcgaattaatgtgtaatattagtgtaaaacgacagatgttacaaattattgtgaacaggcagattttaatgcaacaacggaaagcgtagtgcaagatcttactggtgaacagcagctgggacagtggtcggaaacggtactggaaagggctgacggaagccgaactgccgcatcacgcggaaaggggcatgaggctcaacgcagatgtcgaagaccatcggaaccgtagtcatccagtacgcctggtccctggtgcagagtgtggacagacccaacggcgcacgagcctgggtagctgtggcactgtagggctcccacacgacgtcagtcggcagaaggcggtcgaactccataacaaactcaggatacgaccgcctaacctggacgtgagcccatcggcgctgcaataggagacgatcgatgtgatgtacaatgaacttagcaattaacttaacaatacgataagatcgatgcaacgtacctgacgacggcaccacagagtacccatcgtagggtagtcgacctctggtcgctcctcgtacagtgactcctcgtacgcgtgctggtccacctcagggcggccgatcgcaatcttctcagctgcccagatagaaagaaagagagggcacccaccaaaggtcgcgctgggatccgtcttcgtgcaagactcacaaagtgcacggtacagagccgccaacaacgcggaaccccagctccactgaggcacctcacctaccgcggcgtcggcgatgctcctggcgtagtgcacgagtcccttgtcgaccgcgtgcccgtgaccgccacagaacatcacccagccaaaaagccagagtaagtacgcctccaaacatcggctgtaggagtactcgtcggcctccgcctgtagctgctcaacctgcaagccgtcgataaaatgttaggcaccttaactgcggactaaatatgtaatacgattgtcatttcggtacaaaaacactcacggtgaactgaagcagccacctcttcgtaggtccggtgttgcggtggtgtgccaacggctcgaacgggaggtgcggtgcgcgctgtactagtgtgaaacgtgccgccagatcgtcctgccagtccacagccgtggtcactggcccaacagcgtctcccgcgagcggtagccccaacaagtacgatacgtcctgtagggtaggggctacctcaccgcacggcaagtgaaaagtgtgcgtctctggcctccatcgatcgaccaaagctgctaggagggacctgtccacagtccatcgtctggccgggtccgcgtcgccggccgcagcctccaccagccgacacattggtaggaggccggcctcacgtagcctgcaataacaaattaatatgtcattataaaaaatattacagtgcaactaacttatagtaaaacactgttcgtacctctcgacaaaagagtcgtgaactgggagtagctcaccgcacgtgcgtgcccggaacgtcccaagctgagccccctgcaccgcagtaaggtgagaccggtgtccgtgatctatcgccgggtccaacaactgaggtgtatcctgacgtgccatctctgaaaaatatagtgtttcgtgttagaacaattcaaaaaatagtactgtaaaacaaaagatagcttggcaaaattatgaaatagtaataaatttttgaggttaattatgtacaccaagagtacaggctatttaaataaagcacacgttactaatggtacataccgatgacgtgcaatttaacatatatgtagagttcaataatataacataccattacgtgtcgaagtccgacatacatcagcatacctaaagacgttaggcgccttagtccgacgttacatcccgagacctaaagacatgacatgccgaagtctgacattacatgacgaaacataaacacatcgataagttcgaaccgaattacaagcaaatccacatgccgacatagaacataagatctacaccacgtagccagacgcggcacgactacgcctaggacgtggtcgagtggaggtagtgccttcaccctttagggcgagctccatctgctactgatcctaatagtcttgcctccgccgcacttggtttctccttgtctttaggacaatgcttgtaggtgtgcccatgtcatgcattgctgcaacgcttaaccatgccagcctccgactcgtccatatcgttgcggatgcgatgagtcctcctccttctagccttgcctcggagtttcgatgggtcacgaatattgagtacttcatcgttagtctctgtgaactccccagctatgccgaacccataaatctcgccgctccatgtatgatatattgcttgcttactgaagtactgtgacacatatactgcatctggtatgccacactccgctgcagcagcaatgacatgggtgcatggcctgtggagcagcttcggctttgcacaagagcaatgacatgtgccgtcggctttgagaacacactcctgcttcactctcttgcggtagatacccctgcctgccttatcttgacatagtatctcaaacctgtgctgttgggtaccttgcactagagctcgatgtttcatggcctttttacgcaactcctctagctttttctgcatgaaagctccaaacaaaatgctgttgttcggcatagagggaagaactgcctggaaccgatccctaaaatacctgcatgtcccatgtaaaatgaactctactatgccaactagtggcagtccacggacaccgcgcatcacccagttgtaaatttctgccaaatttgttgtcattattccatatctagcaccacctgtgtcatacgccttggcccatttctcttttggttcatgcagaatccactgagaaagttttcgaatctccaatccagttcttctaaccaatgttggactatccattgggagaggtccaagagcttgaggagggtcagcaacggcggtcgatggagccgctgcacgctgatcactgcatttggctgtcaactcatctaatctcttccaaagctcattgaattttttctcctggttctgattgcacagcctcttgaacatgttcatgagctccttgttcttgaattgcttgaagaaattagctcccatatgacgcatgcaccacctactctgtacatcttcccaaacactggggtatcctcgttccatactcccaaactgcaactctcctatcgctcgcagaatgccagcgtgcctatcatgtatcaggcatacatttggcctcataccaacaacttttgttttaaccaatttcaggaaccagtaccagctgtcggtattctcactctcaacaaaagcaaatgccaagggcaatacctgattgttcccatctacccctattgctgttagtatctggccccgatactttcctgtcaagaatgtcccatcaatgcagagaacaggacgacagttcacgaatgccatcttgcatgcatgtagagctaagaacgccctttgcagcacactcttgccaggatgttcaattgaggggaatttcttcacttcgtaagagctcccagggtttctttcctcgataacaccaagcaggcgtggcaaattgtcatacaaggcttcgtaagttccaaatctcatctctattattttctgtttggccctctaggccttggcatagctaatagtatacttgtatgtctcttcaatgtgtcggattattgaccttggttcatatgtgagattatcgatgacatgcgcatacatctcagatgcaacaaatgcacatgtaatgttcctgtggtatttctgaacagcaggtagaaaacatgtatgcttggtaacaactgacactgtccaataatccttccatttccccttatacgcgtgcactctccagggacaaccatctttttccttaacacaccgaacttcatattgcgaccggttcgacttggcaacccaaaactctctatgaagtgacactgcaaaatgttttaccgcctccttcatatcttctgctctactataaatcgctcgctgaataacctcattttctttgtactcccatctcacactatcctcttcagagacgatcagcccagaaaaatcctcactagcccattctgctggattaatatctgtctcatcatctgacgaatcaccttcctctacacgctcattgtcagaatcctccctctccatttcatccacaatggcaccgacagtctccccctcgtcggccactccacctggttgaatgcccactggagctactacgcccccgtcctctcgtgcgttgacctcctccacagaagtctcgtttacttcagcacttggtccctcgctatcatccatgttcgtgtgcacacctggatccttcgggtgaacaaacggaaccaaagctagaggccacccgcgttgcaatgcattttccaaataccatctccacactcgagagttttgaactggcattagttcccaataaaaaccctcagtgcccgacttactataacattgattgttatgtcacttgtctgtggatcaactctcaagcccctcattaaccatcccgttatagaaggtacactcctctcagccgggctatcaattcccctttctgatacaataaaatctgacagatctaccccaggtggcccgtaacggacgtttactggtccatggtaaacttggaatatttggttgttcgacatatctgtcaacgaaataactagatcatattactctttcatgcaataaacatctacaacgtaatatcttcttgtgtaagccaatgcaacggtaatgtattaattccaaactagcagatctacgtaggtaccgatatctacaatacgcacttttagattagtacaactaaaaccctaaaaatataatgcatttattcaaacaaatttttaaagaatacacactatttaactcaatagtcacatataggatctatgaatattacctgaaatcggcgtctgaatccggcagggcttcgccccttcttctcttctcctcccctctcttctttttttttcactggaattgaggagagaagaatgagggctgggggctgggcagcaggccttttataggcagcgaggcctgccgcccggccagagggcggcaaggggccgcctgcaaaataaccggccccgactggcttttttgcattcgggccccttgccgccccaccagagggcggcaagggttttcttgcaaaaaaatcctccctccgtcaccgcccgttcctcccccgtttgccacgtcagcttgccgccccagaggtgggcggcaggggctatttctacaatttttttggtcgatagattatttctgtaaatattaaaaaaaataaatctaaaaccgaaaaaaattcccaaggaccatcgatgcatgggccgctttgtcaaccgcgcacaagcaggaacatatgggccgttgaattatggaactacactttgcttgcaccggcctaatagtctaataatgttctttctgggatcatctataaaaaaaatgattttgctatatctcactcgaaagatttttttcttatcgctcacttgattttctcactcaaatttacagtttatttttttgtaagttacagtataatttttgaatctttgcataaaaattttgaaatttatattcgatttggtctttttcttgatgatatggtaatttagtgtcgattattgtgtttttagttgctttttactttttactgtgtctattggattttaatataaagattacaaatctgtgtgatatgttcataaaaatattttgaaagatgcataggtactccctaaaaaattgtctcattccgtcaaaaaaaaattgtctcatcacaatgacagtcaatagcaatgcccaatggccatgctggcgtgaactttctccctttttttaacccatcttcggcctctgcactatatatagctggctttagtaacattgtaactatggggcaatttcgatgattgtgatataattggtcacaagtcacaactcacaacatactactgtgtatgtaactttatgtccactatagaccatctacaatgtggtggctcattgatgatttatgtccacccatgataaacaggacacgtataccaagttagtaccaactaggaatattttttgaacatagcacgtatgcatattctacctatatgactacatctgagagaacataccagtatatcttaattaagatagataaactattaaaataataactaaccataaatatatacaagcatccataggctttatttctgagtgagcattccaccaatttttaaagtaatgctcatcgtttaggccggtgagtgacatttttgttcactgcgcattcacctttggggttcttcgcatctaggtagtaccaggacccttgtgcctcggactgcaccgaccgccttatgacccatgctgcgacgagacgtggacattcctcatgctgcggttcccttcggtccattcccgggttgggttaggggaagatccgagcgattgccttcacggacgcggatcgagtatcaaagaaattaataagcaatggaaaataataaaaaaacccagaggtttggaaaatgttgtgtgtcctgtagtgtagagcagcataaatcatttggacaagatcagggaagtactgatcggtcgatcgatggttgcatggtcccttccaaccaggcttggaccccttctttggaggaaaaagacgatttgctgttcaccaatgtgctcatcaagctagctagctttgtgggggttccatagctggctaatggtcggtagagcatcaatttttgtttcaaaaaatggctaaagttagcctagtaacttaactgtcctaaaagtggcagaaagctatatatacaactagtgataatattatattgtaattaagctgatatgatctacacaaaaagtgtggctgatatctttcatcaattatcattggctcccatcctaccttgttgattcgctctgacgttaattagctagcatcatatatatttatcagggatagctagttgctagcttaatatattgcagtaagtaacatgcatgcatgtatggggatagatccctttcctaaaaaaatatataggttaattactaagtaagatgtgtgagaatatttgttcatatgtagcttgtcgatatccttaatttgcatggtaccttgtgatagcgaagaatatatactctgccctttcgaatgatcgcaaatctaaatattagtacgccccccttgcatttggtataatatctcttttttaaaataaagatctaaagaaaggcactagttattgttcatcccttacagctcccatagacataaaagcatcatcaagaccttaattcaactcaagctcaatagctacatcaaacatgttccgaaggattttacaaaaatttcagtaaaagccacacagcagctaaaacgaacattttggattggtgtcgatttatgccctaccaacattttggtagttccaataatgacttattggttttgattttggattaaagccattttttgtccacactaaattattgctcgtagcaaattactataccaaatttgatagtaccaaaacttgcttagttttcggcaagctatgtaacataagcgcttacaacacgtgcgcacacactctataatatgattaagtcatcatagacatctcattgtatagaacttaaatccggatgaatagattccaccacaagaaaatctaagatatactccaacgcttcgacaatatgaattagaagtctatctttggcagcatcttgctggtaggagtataagcataattttcctctgtaatccaacctaaaaagtggtgtgatcactgcaacttgttggcagcataataatacatactctacacattaaatttgggtaagtttgggtttttaatatacagcaaaatcaatcatgctttcatgcatgccaatgtagccgcataaacagtatagaagcatgtgtgcagcaacaaaaactgtgggcgctctcaagtatggactagctagtacctgtcacttttggagagtggtatgcagctcaatccaaagctggtcctaaaataatggtgattaggtgcaagatcggcttctgtagtggaccaatatgctagcctaagaacaagatttggacatttgatttgatgcgagcagtggccattggttcagttaggtttgttgttttttgcatgcacatgttgactactccagctcacaagtaaattaatgaaaagatcaaggtagggcttctaggaattcagtgtgttaagataaacagaggtctactgaggatttaggcacaaagcagcatgtatttatggactaattgcaatgcattctaacgagactatactagtgttcatcgatcgtaggtggcccgaagttgttcgcgttttcctctcgaattaatgtgacactcatatagctcattcaaatatataaatacggaaaaaattattcaggatactctatatttatggtatttgcttaggacactctggttttgacataggacactaattatatggctctttataaagacactttgattcttatcttaatatatccccttctaatatagatcgagataaaactttgcaaatgatagttttactcttgaggcgaaaatttaaaatttgaacgcattttggctaagcgcttgtttagtttggtgctaaaatcaaccttatcaatatttggcattgctaaattggcacattttgatagtgttataggggtttaatttgtagccttaccaaaatttcgtagtgttcttatgagagtaagtttttggaaatatgagaatttggtagtgtgtcaatgacaatagaatgtttggtttattatcttatcaaattttggtaatgcacaaaatctgataaagttgaaactgataacaatctgaacaatcccaaattacataattcaaatacattcatttttttttcaaagaactaataaatttgaaataatgttgtctggattcaaacagctcttagaaaaaaaatattcttttatttccatagtttgtgacaacttttgattttgcagtttatagaattatctcaaatgtatttaaatgtgaattgtacaaggtgatccaagggtaaaatattcctttgtgaagttttgtctcttcattgctgatgaaggatatatgaaaataatggtcaaatatctttattagggatattaattattaccgatattgttgtacataccttgtttagttgtttaggctatcgagactgtgcttttaacccagaaccataaagtgctctatggtaaaatcacaaaactagcatatcttagagcaaacatcacaaatctaaagtgtcgtagagcaattttacctatataaatattatattcgtacgtactatttgctaggaacgatggtacagtgtattataaaaaaataatctgagaaaaactctagtcccctcaaatttcaaaatcttcaaatacataagtttgtggaaaactaattaatttaatctgaggctacgaaattatgcctcaattaatttaattcctgatgaagagcagtagagcaccaatttaccaagtactccacctatccgtaaaggaagtcgtttagaacaatgtttaagtcaaaccttgggaatataaatcatgaataactctcaagttgttgagtttaaaaatataaaaaatatatgaatagatttatcttgaaaaatatttttataaaagtatacatatatcacttttcaataaatatttttatagaaacaagaaattaaagttgtgttttggagaccgtgtcactgtgtaaaacgacttcctttacgagtacggagggagtcactgtgtaaaacgacttcctttatgagtacggagggagtacagtagagagcaccgcgcttataattcataatttgctggtactaattaattttctaaaaaaataaatttgctggtgcctttcgccctgcaggtaggcataacgcaacagtagttaagcatctttgatttattggtacagatcgacagaaagagcgaaaggctaaccaacctatatcgatcaggacaggaacacgacaaatgatacctaacatgagtctttttttctctaaaacatgggagtttacactatatgtacttattgaaatttaaaagtatatgcacacatttatttataatttatggtgtcattggtatgtttaggtaatgtaagtgcacccaaagacagggttgaagccagcagccgaaattatcaagggggttattaactccattgcatggtatggtgaatcttgaatcaaaatagtgtttcgctagaagatttaatttggagtttcgcaggggtcgctgaccccaacaaagactagtttcgatcttatatctacaacttatgtacagagaatatgttcaggtattaattaattacctgcaatgttatatggacatatgtatgtgttttttcactttatattttactgagctactccctccgtttcataatattgtttaaattcattagtatttatatgaatattgacaataataggaagtcttatattaaaaaatagaagaaataattaaggttcacggatttataagtaacacccgtctgcgagagcagatagagtcgtgtgtacatgttcggcgaactaaagacttttgtgcacatgaacttgttgtacgatacgatggagctgagtcacgttaaaatttaatcagtcgtgttaacttaatttttgcgttgatagtactgtagtacatgtgtacgggggttaattagttaatattgagagcgagctgattgatcgatgttgctgaaaatgcaagtcaacccctttggcggaaaattcctctcttttcccctaacttatgtactgatcgatatggtattttgttcttgtacgttcggcttgctaagagtcaacaagcgcatgcaatggccttttaggaaattaatatacttttctttctggcctaattgaggatacatgcatatggatatgctgctactcttgtgttatttgtgaagtacatagtatacataatttttaatatgtttatttaggaaggacacaaataaatgagtaccttacgtataatgtattgtatgttctcctgcctatgtcagatttatgtataaaaaaaatttatttctgttccagagagtatttgtgcacccagcgtatttatggattattattctttcattgatatgtgatacatatccattgatagtgaggtatatgtctgcaataaatttatcagttttgtaagatgtttgcgagtttctccaagatactaacttaggagtatacagctaatgtgtactctcccttcgtcagaaaaaaatcaaattaggagtatatagctaatgtgtactctcccttcttaaaaaaaatcaaccaatttaatctgtatatgaggtttttcggatttattgttgtaggtgttatcaaattttcatctagttttttttttgcgcgtcctccgtatcaaaatataagggattttggatggatgtgatatattctagtacaatgaatctggacaaggagtcattgtactaggatatgtcacatccatcaaaaatcacttaggtagtgtttggtcgcaaggatgggatgggatggggtgaacccacttttagaggtgtttggtttaggggtgagtgggttgggttggtccctgcagagcaatatttctctcaggtttgggaccaaccgatccggtaaaatcaactggacgagcacacggcgtgagccgcgccgcttcacnccgttcactcgcaccgttcgcgctcgctcaccctactagcctgcacggcaagcgacggattcagtaacgccaccctctagtgcgtttgcggtgacgacgacggcgggctcgagcggtggcagggggctcggtgacggcagatccgacgatcgggatggttgtggcagcgaagacaatggcgggcgagggtgagtgctctggtggtggcggcgacgatgacgatggtcgttggcggcgccgtgcggccatcatcacactcctccacccacccggctgtcgtcgaggcagagcctccacttgctaggccgttgtcacacatctccgcccgtcgtcgtccatcttgcaagcccgccctcgctgctcttcctcttgcttgcctgcccgccggcccatctcacttgccgcccggtcgttgacggtggttgcaaacggcatccatcccatctctccctcgtcccttcaaccaaacaaaaaattgggatcgtcatatcctataaaccaagggcctgttcggtaggccgactgcgacggctgcggctacagctgcgcacagtgagtgcggcattattcgtgccgattgcggcacaatcgcagtccaggcagccgaatagaccccaaatatataggtggaatcatcccaactctaaaatcaaagatggtttcatcctatcccatcaagttccaaaaccacacacatgtttatattttgggacagagtgatgagtggtatactccctccgtcccagaatataagaattttttgggttggacacagttattaagaaagtaggtagaagtgagcgatggagggttgtgattggatgagtagtggaggtaggtgggaaaagtgaatggtgaagagttgtgattggttgggaaggtggagaagttgttatattttgagataaattatgatggctaaaagttgttatattttgggacggagcgagtacattaagggcatgtttggtacagctctaactcttaaatttagcttcaggagttaggtctgaaatagagttgtgaagctgcctaaacccagctctaccactccagatcattttgtgagagagcttcactcagcttcgctcctatttttgatggagctgaaactgtttggctgagctccagctctaggaggggtgaaaatgaagctggagctgtgccaaacagaccctaagggcccctttgaatcgcatgaatagaaaaacggaggaatagaaaaaacgtaggattctgataggaatgaaggtgtaaaacagagattggaaaatacaggaaaaacacaggaatgcccgtttgattggaccacaggaaaaacgcaggaatcggataagagagatagactcaaagaaattttttcaagaggttggatctcttgctaacttttctctaaaatctctataggattagccatttcataggaattttaaaggatagtataggattcaatcctttgtttcaaagtcttttatagaaattttttctataagattgaaatcctttaaattttgtacactttttctacgaatcaaaagccctaagagttgagtgtatgatgtgggtgaatgtctatgtctacacgtttgtactgctcagttccggtaggaatggacagaggagcagcagcccacaacggccaacattgcggccggcgaggcgacccgacccatgccaaatgcgtgacgtgacggcggcctactacttttaacgcctcgagaagcgtggcaggttggcctcgtgggccccacatccccaagccctcgaggccatcgtactgggcccacctaccagagtcctggcgtatcagaagatcccgtcgcgtcttgtcttgcaggcatgcatccggcgctgctgcccacgtagcccgccggtgaaattatcgaatagccctccgatcatcctgcctcacgaggggcaatctcacggaagcttggagggcatatcgggaaagaaggaaaatacagtatgtatacggggctggcacactgctcgaggaggtactatacgttctatctactgtataaagagggatggataccttgtgagcagagggatgaaggtccacttgtcacccgttatctgaagctagaatgggtaagcagaaaagggaattaatggcaatggttatccgggcgatggccaatcggatattccgtggtatcgatcgattaatcgatcttcgagaaaaagggaaaaaaaagaaactgaaggagcttgtcggaaaatactgtacacactatgtttgtgttaagagtctcgctccggtgctttctacttggagtagaaattaatccgtactgttaatcgtatttaatcgtagggttgagatctagttctactcccaccaaattttattggagtagaaatgtggagggctatatttgttcagagataataattcgcgtaggggtattatcgtaatctgttattatctaactgttcaccctttccctatcctatcctaatcgacgccattcccctccattcgccgtcgaagacgaaggccagcgtgtttatcgtctgcgtgccagcgacgaactgatcgatttggagacaatcgtcagatatgttcatgagaaaaatgtttactaatctctgaagattaatctgttcttgcttatgatgaccatcgtaccggaacgcctttgtgaatggtgctgatgacggcggtgtcgctggtgaaaacgccgctaccgaaccacatgccggcggcgaggaaggccgtcagcccaacgccgaggacgacggtgagctgcagcatgcgggcggtggtcaccgccaccttgtagtgatccttctttgcaaacacgctggcaagcaaggcctgaggttgattgatcaatttaagcaaagttaattaagcagccatgcatatatcatcggaatgtaggctaagctagctaggtaggtaggtagctagctcacctggccggcgatggcgaggccgtcggcgaggagcgacatggcgagccagacctgggcgcagatttggaacgccgccatggccgtcgcgccgtggcgcgacgccagcgtcacgcaaaacgtcacggccaccactctcgtcaggatactaggagattacttacctgctctttaaaataaacggtccagatgaattctactcggagtaaaatacttaaagtacattgcacaggagcatctctcttgtgttaagaaaccacaggtgatctcatccacccaaggaaataagagcaacggttcctaatctaaccagtagataagaggagatcgctcctctctctccctttggcgtccctctcgacaaccgatgcgatgttcccaaacattgcgtcccctgcggttgacaccgcttcacattgtataatgtattgttgattaatgagaaatcgatccattcgctctagtgtgttcaattctctctctcgctcaatctctctcgctccaatcaattctattcacaatagtttgcctaccatttcagtaacgattaaacgccccaccgtttaagtggaaaaacaatctattttatgtagtatcaaaagttgcagccgttaataaaccgtaggagagggacgttcgatcgtaaacattagatcgtacgtatagtaactctcctgcttatcagcccaacaattcaccgagagttagcatgtcttttttaatccaactggtagtacgtgtactaattttactccctctatccaaaagttttaaacatattttgttttctagttttttaaataagattcgcatatttatagtcggtacgtattaaggttatacaaataatttactctatttaatcctccctcctaaagcataaaaatgtttggtgtttttctaaagattaaggaaatgtgaagtaaaataatacagtcgtgattggttaataagagaaaattgatagaaaaattaaatgagagatggttataattgattgagaacttagaatattttgggacaaagattaaggaaaccatccttttcttttcttaatcgttcctcctatatatatttcgtcccttttcgcctacccctatagttttccttccctcctacaaataatgatttttactttttgttgtgtaatgtacttctactatttgggtttatccaaagacaataaacatgctattttttccctacctaaacgactttcttctatgctgaaaagggtagctagaaagtgggaaagagaatacatgagtagaaaaggaacctttcacatgattgatagtggagacggttatatatgtgcgttagcaataagcttcaacttgtgccttttgcttagccaaaggaatgcactcaacttgttagtccgatcctagccgtttaattcctctttcattcaacctatcaaaaaaatgtaaaaccctttaactttgtttttgttcgacaagagaacaaactttgtcgcttgctaaaatgtttagtgttcctagaaatataattaatgtgccttccacttatatttcagggtttccagtattataaggtgtcaacctatctctttcagtgaggtagaaccaacaatatacaattctataaaaaaaataaaaattgctatacatacgacccaactgtccgaatcacgtatgactgaatttgatcaacgatggtaaatggctacagtgcatatgaacatgctcttctttgattgatctatgattgtatatgagttatatatgagttatacaactaaatcgtatatacagcagtataaaaaaagggttaggagaaatttctaggatgctccatgaaagtttatatgcaaatacttctctctcagtgaggttgaaacaactatatataattttgtcggaaaattaaggagaaatttcctggatgcaacttgaaaatttacatgtaaatgtcaaccatattttgtggaaaaatattatttgtccattttccatgaaatttttattagtaatacaaaggatcttaacttatggtagctaactaactggccagcatcacctgcataagagcatgatttgtgtgcagcagagagaagacatgaatgcagcaactactccctccgtccaaaaaaaaaaggcaaaccgtgggttctcgtaccaacgtttaactgtctatcttatatgaaatttttttataattagtattttcattgttgttagatgataaaacatgattaatactttatgcgtgacttatctttttaatttttttcataattttttcaaataaaacggacggtcaaacgttggacacggaaaccagggtttgtctttttttggacggagggagtaccaaattaggagaagtgtacataagagtaaggttgtcaggatcgggatactaggtagtatcattttgctcaaagtaataccgtatcgtagaatcgtatcgtagtatcgggatactaagagattttcttttttttaagtttaattaatatttatattaattatatatagccattttgtataaaaaaatatagtaatgatatatataatgcaaataaagacaagagaaaccacgttggttttgatatatttaactgatttttatataaatttgagcatatttagttacattattttgaaaccatattatttaaaataatattttgtagtatcgtagggatcgtagaatcgggataccacctaagatttcgtaggatcgtgtagtaatgaatagtaggatcgagatactatgaaaattaagatactaggtgggatcggtatcctttcggcttgataggatcgtagtatcgtaagatactagtatacgaatcgggatactgacaaccttgcgcaagagacaagggaaagagatggagaaaccgtccaaccaccaagcgggacccgcaacggctgctcgcctggcatagcttagctcaggctcttgtcatgaaaccatatggttcatcagttcgctgaactcgataccaaacaagtcaacatcgatgtatctaccagattattttcgtgatgtaaaacaagcataacagctacgtttactgttaattactcccccgttgttgaatataatgattcctagattttaaattttgttttttcatatataagaaattctaggtactgatatattgtccgatcaatcaaccatagtttaattttctttcatcttacttctaactatcttccaatcacttcagaccttctctcatttagtaagtgaggaacattaaatccttttcttttctcttcaatcttaaaaagaaatctagaatgcttatatttgtagacgggaaaataaaataacttgtgtttccttaaacagtactataatttattatcacatttatggtattttaaagaagagaaactatttgttgtacaccaactcatgtcgtcaaactttagtcgccatatttaaagctgccctaattgactacatgaaagtgatattttgagattttgagatttgtcgataaaagtatatatacagcgcattgtgatttttcatactaaattataattcaattagtgagtttaacatagctcagctgattaagttcattgtggtggaattcatccatctgaattcaagttttagaccgggcaaaggtgttgatatttgcgagtaattattctagctttcagtggtatacaactgctcgccgataacgagacgtctgtagtgactttctcaattgcaagatatatgtgggactgtttttgaaagtatttataggggtgtatatgcttttagtgatgagtgtacatacgcgtatatgagcatcaacgtttataccttttttgaaaataataaattagttgctttgacacattagtttttttttggctgcgcactcctagttagtgcagtggtcggatgtttttattggttaataaaatatttaattatatttagaaaaaaaatcatttaaaatgacaaataatggagagagcaattaaataccacacaaacatactaactattttatcaagtgtcgtccgttgcattgtggaaaatcttttgatgtcacgaggagccaacaaaggagatgtatgtcaccttggattgcaaaatcaccaataagtgtagaggaacttggacttggaaatttattaatccaaatggccgggacagattactaagaaaaaccacggcaaattcactttttgtttcaattttatattaaagctatggacattgacaaacaccacaaaagtatcacttttggttgcacgtttgccgcgtaggcacacacgagagatagaggggacatcacaaacttccacttcacatacataggcatcaataaatttcaatccccaattcaagttaaggagatgcccacgacacaccataataatctgtatgttactccctccgtttcgttttatttgacaccgttgactttttagcacatgtttgaccgcttgtcttatttaaaaaatttaaataattattaattcttttcctatcatttgattcatcgttaaatatacttttatgcatacgtataattttacatatttcacaa

SEQ ID NO: 44674 - DNA, 10290 bp, Oryza sativa
tttttccacacaaggatctcacatgtattaatgcatatcggatgcaatcatacatcatagaggtgatatttagcgaagttgtggacagtgtctactactgttttggcccgtttggatgtggatgaattgcttctatcaaattaatggtgtactccactacaaatatgggctatatgggagttggacaactgtacctaggatgagcttttatggaccctttcaattcgagcatgtctgtccagcactccagctggttaattaattggaatttggcaaaattcatttgaaaacatacttcgaatttcatataggaactgatagtttatttgtccaaaacagagatcaagcctcaaagagatgttataaagctcctttagaaagagaattaaacatagctagtaattctttaacataaaaggtgaacttttaggatttggttgtgaaaataaattacctagcaccagaatatgatctctaggtctaccaaatccttcccacccaaatatcttcttcaaaagctttcaaaatctggcccggaaacttccaaaaagaaagatacgggcaaatttaaaagtgagagttccactagaaaccattgctaaaagaaaaatcaattattccacataaaatccctatttaatttctaagttgacttttacaatttcaatcctatatgcaagttttgcatgtctggtcctgtccattcgcgagtccttatgctgaccttgatgacgtacattgtgtcagcatgtgttttcaatttggaattatctctttttacgccccctttgaattagaggatattattgtaggaattttagaggattattatatttaattttctaattattctttgcaatataatcttttttattcgtatgaaaagataaatttccattgaattgtattcatatgaaaaaaaacacgaatattagagaagaacctaatatcaaataattagaaggggtgaggcttggacgtttctcatccatatgactcaattttatggaaaataagtctaaccatttgaaaaactattcggtcctctcatttcctatattttccatgttgtaggattagacaaacatacaactttaattactgtggttttcttattctcatgtcctttcactttggaacatatttttgtcataaaaagtcaaacttcaaaatttcagctcattttaccgtcacatttcaccgttggtaactgtaaaactaaaacggtaaaaattgaagtctcaccttttcacaggctcactcactctataaaaaccgctcccgacctgccgctcggtacgcatccactcctctcctctcttccgttccttctccctcgccgtcggccaccgcatcgccgtcgtccgccgccgacagggacagcgttccagccatggacaagggcgccctgatgccgtcgcccgacgagacgtgctgcgtcggcggaggcgggggctcgtcgttctcgagcctgcgcgcgtacgggcgcgcgctggcgcagacgccgcggcggctggcggcgcgggcgtgcgccgcggcctcgcccggcgaggagatgagccgcgtgcgcgcgcgctcgggggccgacatggcgcgcgccctgcggtggccggacctcgtcgggctcggcctcggcggcatggtgggcgccggggtgttcgtcaccacggggcgcgccacgcgcctctacgcgggcccggccgtcgtcgtgtcgtacgccattgccggcctctgcgcgctcctctccgccttctgctacaccgagttcgccgtcgacatgcccgtcgccggcggcgccttcagctacctccgcgtcaccttcggtgagctcagctgctcaatcacgccaagatcatgacttaaatatttcccttcttttttggcgtcaattcaggatttcttcaaatttcgtttcattttgttgggccgtttgttcatgtaattacgtcattaaagattgggttctatcttttctttcttttcttttttttttctgtactcaaagatttgatggttatctatctctatggcttggcttttcgccatccttcggtttatctatctatctatctacacgctagaaagtgcaaatttcagtttctttttgtgagcatttatatgcatatgaacatggcagtttccttttaagccggctgctgttgtccttttgtttgctcctatggttttttttgataaattttataatacctgtacttttgctgattgatgctgccctgcatattttcgctgtatttattatgggctcaagttgtatgagcaagaaaatgtctttctctgatttcatattaattggctcttccttttcttaaaggttactagatttttcatatgttttttttaaaaaaaaatttgtcagcttgaaaatccgatctaatttctattttcacacttttttattttgacaagtaactacgggtggtttgattattttattatttgttcgagggaaatgagcattccaaaactagtaacgaagcctaatattgtgccaactttatttagttacatgcacgtagatttgtcaataggtttcatatcaacatttttctttttcagaaactcacaccaaatggatcataaaaaaaaggagtttggctagattgtgactcccaacaaattttattacacgggcgcatgtccatgtccaaataatgttgcaaagtccctttctttgtttctttgcatctcccaaaccgcttaccctttttttttccacctgggaccaaaaagatcccattgtgactgatcatcagtttttgcagtcacttcattttatttttcacaaaaaaaatatatcactcttcagctaaccaagcataattgcatagaaattacatacactgttgcatctattaacttgcttgtaatttactatatctgtcctagaatataagtatttctagagttagaaatacttatattttaagatggatgtagtagtaatttagaatttgagactatttttctgctctctaaaagtccaaaatgcgttatgttttttttcagatggatcagatttttgagtttgtttggttgtgcaggggagttagcggcgttcttgacaggggcgaacctgatcatggagtacgtcttctccaacgccgccgtggcgaggagcttcacggcgtacctcggcacagcggtgggcgtcgacgcgccgagcaagtggcggatcgccgtgccaggcctccccaagggcttcaacgaggttgacctcgtcgccgtcggcgtcatcctcctcatcaccgtctgcatctgctacaggtacgcacacatctgtaaaaactaaaaaaaacaacttttttttttgttgggggagtactccttccgtccaaaaaaactcaatctagaagaggatgtgacccctacaatgaatctagactaccatttgtccaaattcgttatccttaactctttctagggccaggtttagttcccaactttttttttcaaactttcaacttttccatcacatcaaaactttgctacacatataaacttttaatttttttcttcaaacttttaagtttagtcaaacttctaattttaatgtggaactaaacacacactagcttaagtttttttttgggaccaagggagtatggctgtgtttagattcaaagtttggatccaaactttagtccttttccatcacatcaacctgtcatacacacacaacttttcagtcacatcatctccaatttcaaccaaaatccaaactttggatccaactaaacacaccctataatagaaattgtgctggttttgcttatgacacaagtgtcagagttcttgtctcttcctacggatgtgtactgcaaggcttttgcagagcaagtgcaagcaacttttgttgcgttgtctgttcccttgtcttctctgcaactgctcctgtagtcctgtgtctttcttcttggcaaattctagctcaaagttcacacaatgtgcatggtgccaatttaattttggtcgaatttctcctgctccatggctgcatggtcctcctctgcagagaaaaaaaaaattcagagattttgttctgaaagaaaggatcttgttgaatggtcggtctctgctattccaaatgcccgttttaccctccctttttctttcacgatcgaatgtgttttctgtggcgaatgtgttggcaagctttgtccaaaggaagaatctgcaaaagaagccgtccggcctgtgtccttgtgttcccatgctctggcatatcgtatcaagtcaaaacagtcaagaaccactcttttttgttcttgtcccctgcacaaatgtgtgctgagattttgggaatacaattcctgaaatgattggtgaatgcagaggagaatcaatcagtacattatgattgaattctgatagctatgtttccatgaccaagattcattttggtcagcatgacaatattcttacaattttttttaagaaaaagaattattttgatgggattttttatggcgcagcacgaaggagagctcgtcggtgaacatggtgctgacggcagtgcacgtgttgttcatcatgttcgtcattgtgatgggattctggcgcggtgacacccggaatctgacgcgccccgccgacccggagcacaaccccggcgggttcttcccgcacggcgctgccggggtgttcaacggcgccgccatggtgtacctgagctacatcgggtacgacgcggtgtccaccatggccgaggaggtggagcggccgtcacgcgacatccccatcggcgtctccggctccgtcgtgctcgtcacactgctctactgcctcatggccgcttccatgtccatgcttcttccctacgacgcggtaagtacacctcccctctctctgagatggctgggcccagtgtcatctctccctccatccaaacatataagcatttttgatagtttggttgagaaacattaaatgtgagataattatcactagttgagatgagaagtatagagagaagttgcaatattctgaataaattttcaatgttaaaatttgttatatatcgggacagaggggatactacctatcaaagctatcaaaggaatctatctatagaaaaaaaacggagattcccaaataggacattgtagtctcactctcctaggctaataattaaaaaccaaggggaaaaaagtttttttctaggctttgatgttagaggataattctggggaatatattagctatagctagaataggaggccggcacacgaatctctttctttttctaatcctttgtttcgctttcaacctttccgggatagatatgtagtagctggatgaatctacagtaaaaaaagatctagtcacagtattactactttttttttccaacaggatgaattaaaatacatcaaagaatctgcaaaattaacctttctgatccatatgctcacattcccccctcgagaaattgggaattaatttggaaaaataacatcaatatttatttttgttgtgcttgtgttttggtgtggtgcagattgacacggaggcgccgttctctggggcgttcaaggggagctctgggtggggatgggtgtccaacgtgatcggcgccggcgctagccttggcatcctaacgtcgctgatggtagcgatgctgggacaagctaggtatctctgcgtcatcggccgatccggtgtcatgccggcctggctcgccagggtgaaccctcgcactgccacccccgtcaatgcctccgccttcctcggtgagccttttattatacatacctgctccttctgagtcgtaaataataaatatttgatatttaacacaagattcggttgaatttctagttccatgaaccaattttgctttatagtgaattataaagtctgatgagtttaaacgatcatattatattttttcatggtgaatatatggatatcgtttgtttttatttctaaaccaaccatctgagaaattatcgatggttagggctgtgtacatcctttttgggtgtagaggccgatttattatattatcttaaaaaataaattatcgatggtcaatttttttaaaaaaaataccaaatattgctgtaagtgttaaagatatatatatttttttaaaaagaaacttttacatggatgttttttttccccataagtcaaagtggcatgtgagtagcagttgacgacgaaacagtgagctagcttagctagtacagtaccagctcttgttcacacagtgtctaaactaataacagcagcatcagtctgccttttcttgttagcctttgcggccagggaagctagctaaccgcgatcgatgaaattaaagcggcggacatgacacgggtgtggtggtggtggtggtggttgttggcttctctctcaactcatctcggcgaggaagaagaagatgacgacgagagcacaaccaacacaaacacagccacacacacgcaattaatgaaaagctgcttagctaactaactaactaactaactaactaatcgtcttcaaactcacggttctagctactactgtttgacatttgacaggataacgacatgctgatcgagtgagtgagtcagggagtgagtgattggctgtgcgatgcaatggttttgattgatgagccgtgagaatttgtaggatggtaatgttcactgtgagaggaaattattagagcccgtgtctttgaattccacttgtaatcccgtgatttgggagtactgctagggggtagtactcttttgtctcatgaatcttccgtgattagtctgaaatccgtgtgagccttttctgacttctcaattcaacttaccttcctcctaattaattccaggtagtcaagacagcgacactgcctcgattccatatatatatatgtcatttaaatagttatattcttttaaaagaaattaataagatacgttactaaatgatatatcatttcagaaatataaaaagttaaattttgacttgtataaattttagaaaaaataaactatagataattaatgtatattcacaattaatttttttctcaacttgtagtagatgttaaatttgattttatatgcttgtgaactgatatatcatatattaatttatcttactaaattttctttattctttttctaattatttaaatgcatgcaaacggggtgtaatctcgagagtgtagaatctactccatctattttatattataaatcgttttgacttttttctagataatttttttctggtttaactaaatttgtagaaaatatctagcaatatctatcacaccaaattagtttcattaaatataacattgaatatattttgtattttgatagtacgtttgttttatgttaaaaatgttactatatttttttttacaaatttaatcaaatttagacatatttgacttaaaaaaagttaaaataacttatgatataaaacggatggtgtatctttctacaactgtttgatcactttgatccatttgttctggggaataaacagtttggtccttggcgacgatgcaggggtgttcacggcggcgctggcgctgttcacggagctcgacatcctcctcaacctcgtctgcatcggcacgctcttcgtcttctacatggtggccaacgccgtcgtctaccgccgctacgtcgccgccgccgaggacgacgaggaggggcggcggcgcggggcggtgccgacgctggcgttcctgctggccttctccctggtggcgctctgcttcacgctggtgtggaagctggcgccgcgcggcggggccaggacggggctgctggtggcgtgcggcgcggcggccgccgccgccgtcgcggcgttccgggcgctggtgccgcaggcgcggcggccggagctgtggggcgtcccggccatgccgtgggtgcccgcggcgtcggtgttcctcaacgtcttcctcctcggctcgctcgaccgcccctcctacgtccgcttcggcttcttcaccgccgccgccgcgctcgtctacgtgctctacagcgtgcacgccagctacgacgccgacgaggccgccgccgcgctcgacggtgccaaggtgctcgacgagggctgcaaggtataactagctttggggggtggctgacatgtagggacagctggtcaagtgtactctgtagtagattttttttttcttcttctttcttgctatatggtgtttcagctttttttcaggctaaagtagttttttagtgttggattaaaaaaaaggctctaagtagtttttggtggtaaaaaaagattcaagatgctaacagggtgaaaagacaaggaaatagacaggagtgtgaatgagtggaaggaaagagagaaatgtaactttatcttgcaaatatgcaattgtacaaaaaaaaaatcccctcaagaaaatggttattacctcggtcgtctcgttctaaatttgtcataagtcaaacatttatatcttcaactatcaattttttttcaaaaaaaaattatattttaacaacacatgaattacatctcgtgaaagtatttctcatggtgaatctaaaaataaaaatcttatggtgctaaacgatataaatttgtagaaattggtggtcaaaggtgcaaatgtttgacttaaaaaaactagaacaataagtaattttaaggacacatttgctatcaatgagttatcatcaacttttactcctttaggagtggatgggagagggagaagagcggacacagtgaggatcatgggtattagacccaattcctatatttattatatttatagaaagtagttctctatttgagcataaacctcttgttgcttaattggttagtaggcgattcacacattcaggccttgtttggttaatccccaagagggagggattggaggggatttattccacacttattgtggtgtggaattattctccatcaatcccctccaatactctttaatcccctttaaaccgaacaagaccttcaatggaagctgggttccatcctcgtgattcctctagatttcgtgctgccataggacaccaccagcccaaataccattgacctcgatggattaagtcctcagggttggggcaagtgtacaagagggttggatggaaatgatagctatagagctagagcaaacctagacacctagacaagctgtttaggtttatagttaaaaataaagtttttcaggataaatgtagcctctagaacaataaattcttgtccattttacctttatattattgttaggattcttgtccattttaccttttatattattgttaggaattaatgagagttgatcaccaataccatgagtccatgactgcgaagttttaacttgcatttttacaaatactccatttggtaaaaatatatttgatctttagataagatttggttaattttcaatttgatcatcaactttatattaaaataagtttatgatattttgatacttctctccaaggtaaatctatacataccgattttttaaaataaattaactaagcatttcagaagtaatttgtggtcaaagtttgttttaaatgaaaatgatccattctcatactaaacgtcaaatatttatcacttgaagtagtataactgaagcaaagtaccctgtccgtcccaaaatatataaaaccgctaactttcttgcataacgtttcaccatttgtcttattaaaaaatataaatattatttactttgttgtgatttgtttcatcatcaaagaaaatataatctcaacttatacttttacatattaatacttaatttttaaataagacgaatggtcagatactataaaaaaagtcaacggcgtcatacatttcggtacggagggaatgtttacatgattgcatcctcctcctctgtgaatatgtgacaatcagcattgttatctgaaactatattttttagcgaaatctgaaactatttatcaacagaaacgcgagaagctttacacagctcggagaagaagggccggatcgagccgtacaagcaaatggattacatccttgttcagattctcaggatagacccaaatccagaatccaccattgctgcactgttcttgctgcacacacatttggcacgagctgattatcccagtagcacaagatagagacgtccattttgcaaggatatatatgcattctttgagctggctctactctacacctctccatatatcctttttcttttttgctactaattgattggttggtcgtgtgccatttttactagattgcagcatcattatctacatctcgatgctaatctttcat

SEQ ID NO: 44675 - DNA, 4125 bp, Oryza sativa
tgttctgaatgttgcaagtgttcgacaggtgaaagtattattgattcttcggtaggcagcacaaaacaactgttactttgtgcctgcatccaaagcttttcagaattcagattgacttgtagctaaggcaaagatttgggcaatggatttagctttcattaaattaagctataggataacttaatcatgcagcatcaagtgtagtttgcgtcaccatctcatgaaaaaacagttatgagttaaccatgttcgtggtacgaagtttcagtggtatgtgtgtcttttccccttcaataaaaaaggttggtgatagtgttgatgttctatgcccatccatcgatatctccaggtgggttgtttataaaagttttgaaggtctctggagatattttgggagtaacttctccagcattgtctttcataaagaaaagtttcaggttgcatttttttaagtacttacctttccacctatcatgaaaatgtctattggaaagatagaattctttgtatagtggtggaaaatcacaccagcctcctcaaatcctagtaaagatttggtgcaatggcttttcgatattttggtgtttggtaccttttaaatttaaacctatgttgcaaaaattaggcaaaaggatgtgacgtaattattatggggaacccgtgtggcccaacgatgttttatatagtacttttctagagaacatatcctatacatataagcttctcgtgcacactccgtgcataccaactagcaaatatcacagaaaattttagaaaaaattggacacatgttccaatagtattacatccacgtgtgaaatattatcatcaaattcattatatttcagccataacaaaaaagacaaaattctgacaaattttcacccttaaaactgtcagatttttcactttttgttacagctaaaatataatgaatttgaatatgagactttgcagatatatgtaatactattaagagtatatgtctatttttttagtttttttgtaacatttgttaattggtgtgcacggagtgtgtacggaaagcttatgtgcatagtagaatttcccgtgacatttttctagtagtacttctacgtacttttgcatgtaagggttgttcggttactaacattgtcataaatcataactcactttagttaagtgtggcttgtcataattttttccctacaaattgtagaactatttttagaaacaacaccatttaaatgagaaattgcaaaagtagagatctgttggctaaaattgtaagtttagcacattgtcgaactttggttgtttgaaaggggttgcagggtaaaaacaacttgaaaactcatggtgcatgtgcatggcctattattgttggccactacatgcatgtgcttttaccttacatgaatgtgtaattagtccagcaacctttattgaacaatggttgttcgataggttatccgacgtgtcatgctcgtagcttcgtattgtggttgtttgatatacaccctactatcaaacaactaaatgattggtgaacaaacgattgagtatatgacaagaggggcaatgtgctaagaaagtgtggcaagtcataattgtagcaatgaaccaaacaaaaggttaaaagatgcagcagcctaaagtttggtatggtaagttgaactgttattagatggtacctaataggttattaggtgttcttataatgctttcaatgccgacatacttatggataatatcttttctagataatatcaataaatttcaaaatccatttcgtcacctaatggctaccatcgtctttttaatctataccgctgtaactgtttggttagatacgggagtaacattacccactgaaaaatccaacttagttcactaagatcaggcaagccatagaagtgaggctcattttctagaatatgaacttaatatggcctcgtcaggtagtgatgaaaataaagattaagtacatgcacgtaaaaatgagaaagccattagcacatggttaattaagttttaattatttcaaacttagaaaatagatttatctaatgctttaaagcagcttttatagagaaagtttagcaatttaaaaaatgtgttaacgaaaaataaggtaaaatatgtatcttactcagaaacgaacgggccttaacgataaatggattcacaatggagcttcaaaaacaaatcatcgtttcctaacccatttgtctataaacactttattttgggcctttccaactaaggcctgtgtggataatttcgcctctctataaatttcggcccacataacgtagttgggcctcaaccccaaatccccccaaaattctgatttcctaatcggatccgctcctcccactcccgcagcctctggtttccgcgcttagtcttcctcctcccccacctccactccgcgcgacgatccgcaggtcatctcccctccacccgcgaggattcccggagatcctgcccgctccccccgcccccctcaacccccctggagcggaggcgcgtggtggctggcgcttcccccctgcggtggttgtgctgctgtgttcgcgcgcggggcgcacgggaggtgttcgacggaatgcccagccgagagaaagagagagagagggagggaggtatgtgggtaagcgtaagcctcttcgtttccctgttttatggtttactacttgtgtttgcatgctagcgtgcggtgtctgcgcgctatttcagatggatggaactggaacatgatcttgcactgctttgaataaaacagtgatgtgatgttgagcattcggaattgagacatagaactaatttttctccgggtttctactactgttgaaatgctatttcgcttcaaagggctagtaaaaatggcaaccccattctgtagtccatcagtgttaaacccagaagctcaccaggcattagaattccctgctccttaatctgttttatatctttgttatcttgcctagtgaaaatctgtaacattttagagttcctttttcatgagaacttgcatccttttcctgatcaaatttcatgcaacaggattgaaaaaaaaaatcgaagtatggcgaatatcacatcgttgttgctgacattctcttcctaccagaggttttatcaaactctcaaattttgaaggtgaactaacaagagaaattatcatttcaggccacaacggatcctgtgctcttaacagcaggcaagcatccaaactttcctattagctgctgctttttgtgtcatcagtgcatcaaaccaagtcaattggtaaaaagttagcttgaagtataattatgaacgtatgagcagttgatttgcatggatgggcatttggtttcactaccatcctctatgccaaaggaccaaggctcttactttagcatgctctggaatttattttgctactcgtgctttctgtgacaagccgaaccacaggattgtccacaaggataaaaatcttgttagggtcgagagggatttgattgacgtgtttacactccatgaacttctgcagttatgtgcaaagaggaggtccctcttagttgggaaaagctgccatggattagccattcattttgggctggtaactgatactgtcacatgcaatattctcatcaacttgtacacaaaatgtggccagaatgattgtgctcgtcgcgtttttgatgcaatgtctgtcagaagcataatctcttggaataccatgattgctggatatactcataatagagaggatgtagaagcactgaagcttttttcaagaatgcaccgagaagggacccagatgaccgaatttaccttatccagcactctctgcgcatgtgctgcgaaatatgctattattgaatgcaaacagttacacactattgccatcaagcttgcacttgattctagcagttttgttgggactgcatttcttgatgtttatgcaaagtgtaatatgataaaggatgcctgtgggttttcgagaatatgcctgagaaaacttcagttacatggagttcattatttgcaggatttgtgcagaatggtctccatgaagaggtattgtgtttatttcagagtacacaaagggaaggaatgcaattgactgaattcactgtttcatctatcctc

SEQ ID NO: 44676 - DNA, 958 bp, Oryza sativa
  unsure (1)..(958): unsure at all n locations
agcacaccggcctcggcactgtggccttcttttggtgacaggaagtataaatcaaatgcaaaatgccatgaaaccgagagacggctaaagttaggtttgtacagcgacattcgcaacacttggctgatctagaatctccagagggccttcagctcacaggtttgacagctctagttttggcagcgacgccattttttggtgagcattgtactctgttagcatctttagggttcgcaatgctgtgacgatgtgatcgactagatgctgcggtggtatttgctgcctctggcgtcggcggtgcatcactgcagctcctcctccttgtaaactttggtgatttagcacgagttggagggaccttcaaagaacaaagacaagtgaatgtcatattgcccaccagtagaatcatcaattatggaaattaaaactgtgcttaagatacatgatgcaagaaataatatagatttgtatatattccttgtaaagaaggaaaagctttctcaaatgtagctttcttgtgttatcactgtacatctaactagttttggcattttgggcaaaatggcaaatatgttgttcagtgaaaataagtaaattaaggactcctctcattccagtgaaccaacaatctcctcctagaagttagcaatatatctccacattgccaagactgacaatcacaagtacatgtttccaaaagaaacacaaaacatcagaaattcagaactaccttcttaagttcagcctttggaggaggtccttcttggtagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 44677 - DNA, 9130 bp, Oryza sativa
  unsure (1)..(9130): unsure at all n locations
ccttaagaattgcaaatgccgctcaacagatggctaatgtaacaaggggaagtagcggatctgtcgcgctatttatcgaaattttgaacaagtaatctcaagacctagtctgatatattctcttgtgcatatgattgctattgttgtaatccacatgcttctattatttccaggtatttgtacttcttcgagaaaggaattccagagatcacgaacactgtaatccaggatttgattgaattgattaggacagagaagcaaagtgagaacactgtagctgatccatcgacagaggccttctttgcaagcactttacgttacattgaattccagaagcagaaaggtgggagcataggtgaaaaatatgagcaaataaaaactacctgattgtgcactaagtcaaaacaagaacagcgtcacgacgtgttgtttttgtctcgagtcatatttgcggaagttcagtgaaatacaagccattggtctcagctgcctctggcctaaaggatctttgcatctgttgttatttgtgcatcttacgctcaaagcggggcctcccctccattttgtgacatgtttgggttagtcaggtggcaataagctntacccttgggaagctcagatctgtacagcgcaacttgtgtaccagagtatcattgtcgtatatcctttttctttcttttctttttttgtcaaagaacaattttagggttctaacttttttaactttggaggtacatatttctatttatctggctggaccttttgcttaattcatagcaatgaaggcgttgaatttgaactatgttccgaaagtatgaactgtttgtctgagaccttgtgagctgacggacctacacagacgattaaggttacagagttttaccttgtccggtagccttttcagagctccaatacacgccagcgatcgattaggctaagctcaacattgttagggaccagatattcgaagatcaagcaacacatttcattaactgttgatagaacaggcagcaatctaataatggaaagttgctgtgtaaatgaaacctatttgtgcaaatcacaatttcataagctagattaggctaaactcaacgttgttagggaccagacctctccagatgttcgaagatcaagcaacatatttcattaactgttgatggaacaagctgctatctaacaatgggaagttgctgtgtaaatgaaacctatttgtacaaatcacaatttcataagctggaaaaacgtactaggtgggatttgggaaatgagttcccttgtatgtttccttgtgcttcagctttgctgatacagctagctagaagctagtcagttctatcgttgccaattcccagggagaaaaaggacaatgtcctctctgactaccatgtcttctcgttgcatgaaatgcaaatttgcacaaaatctctgttcatctataagatgctctttggcttgatcacgatgaggtatacacccttgaatacaaagttctcagtttttttctttcttgctctatatcccctccagataaaatcagcactatttagcatcaacacaaactaatccgcaaggtgccagatataatgaagatatagtacaaaatatgacctgccatgtcaccaatcatgaattgagctgtaccatatcatccaaattcaatacctaattgctgattttcttgaatagtatttggtaataaactgttctcatctttcatctcaattacaatggtctctgagtttatgatcaccctgcatagtccaagatggcctccattaagaaggtcacaattctcatacaaaccatcagctggtggcatgttcaacatgcaagattttggcagcatgatccttttcctttcctgaaggtggttttccttaactgtcagcacaaggcggtgtttcctccctagtaattcagaaacatattccatatcacccatagccaaagcatggcgaacacgactagaagaaacctgccccttgtcgcttgaatttacggaggttgtaactccattataagatctagctgtgtccatgactgaccgtacaataaatgcacttaaaccaaattcttcacatagtttcactagctcagctgcatcgccagatgccctgtagccaaatctgtagttttcacctgtcataataacaaacaaagctatattgtaaaaggttatgacaatacagtaagatagtgcacctacaagagaagacaacatgtttctacctgctacaacaccttgtattttaagatcccttgataacctctcaacgaattgccgcggagttaggtacctgacctttgaaaactcaacttgatattcaataggcactacattcttacagtatggagcccaagaggtgagcactcgcttccgatcacactgagcaactataggaggcctgcatgaaaggaaagcagtcatgaattgccacaagcaaggcactcagttatttggggctaatgattaccaagggaaattatgaatagcctcttttacactcacctatactcccagccaagaacctcagcaattcccacaaaagaaagaagaaagggagttcctgccttagaagcatacattgccaattctcgatggccaatgtgaagggcatcaaactttcccaaggcaactatcccatctgaaacatgcattgaatacccaatgaaaatctggtttaatcctagcctcatgcaagatttgtgcagagttttctaagaaagtatatgtgcagccttagaaaaggacatgagctgcccataatagatttggcatgcaattatcacttactggaggtgcatggtataggttttacatgcaaaataagcacacaagtatgaaacttaaataatctgaagaaaaaaaaacatagtgcataccaatcacacaatcttgatcttccccacaatctattaggagcttatctttcactaaatcttcattgttcagactgatccctgactgtccaaatgagctgaaagttgccaacgagcatctgttttgccctttgttcgtgcctagaagcttgctttgactgcagtatctacaagtgtgtaagagaaattttaaagttttaaatgagaaaccaagttcacattattaagcatttacagcagtaaacataaaagatcgactcttattgatgtgattataaaccatagctttatgcgaggtctgtaagagagaaataaaatcctgaaatcttaggattaccagtgggaaaaatcatatggcaataccgcaatagtgagccttacatggggaacacgtcaaatatacggcctcatcttttcgcttatgcttatcaaccaaaatttgaattttcaaccttaaatttggagttgattttgaggttttttcatcaaagtttatttttcagtctttgcttttagatcgctaagaacacgtaatataaaagttttattcacaaattatttttcgtttgcaaatatccaatgggcacagttgttccacataatctctttaattttaattggcttcacctgccaacaggctagacttgggcaagatatacttcttgcctgacgttagaaagttccgcacaagtttaacgttacacttactaaaccagtaaaatgcaacaagccacccgcaactttgagccatgaaagtacttgacatggagacatgctaatttaacccctttcatcctcgcagctaattcgaaattctagcttttgcccatcatctgctagaagctcaaagtatctagactgaaatatccaaaattagaattaatgtacattgtcaaacccggaaaggtggtaagacaagcacaaagaactgtccgaatgctccaagcctccaaccaaccatagcaaagctactagctgtcaaagttaacatttcactggcacgagattgaacaggctcaacgatccaaagttgccagtcctaatccatactatataaagtgtcctaatcgattaatcccattcctaagatgacggcatcatcacttacccccaaaaagcacaggcgtttcatcgaacagcttgcgagcgcaggagcaatactcccaatcccaaccgagacaaggaggacaaggaaaagggaacaagagacagcagggagctcgctacctgaagcgccggcatggtggcggcaggaataaccgcggtgccccggcgaccaccgcgcgctggccccagccccggccacgcgagcgggagcgggagcggaagccgaggagaggccgccaatggggcgcggccggggacgtcggggaaggggaaggggagcggaaggtgcatgagagcgctcctgcggcggcggcgcccctctccatatcctcactttgatgcgccgttggcttctcgctcgccgctttgcttcgcaggcggcggcggcggcggcgcgtctctcctctcctccgcttgctgctgctgctggcagtcacgcacgcggcacgcgtcacgggcgagctgcctgcccgttagatgagggtgtgtttagtgaccttggttatttcataatccaagggtctggatctgttcagggaacttaaaattacgagaagttgttacttctaataatacagcggagcgattttttagtttatggtttctaatttattttctgaattttacaactacaacttatcagaatccgaacaaaaatctagaccgtttggtgtgtgtgcgcggggttcttgttctggaaaaattttcagctaccaaaagctcccttaaacatgtctcaaggctgttgtgttataaagttacggaaaaaaaataaagttgctgaaaaatgatatgcagaaccaagtttttatttcgaaagtagagatgatggataagatattagaaagttgaagatttaatgaaaaggtattattaagaaatgttgatgaagtttcattttttttttaaatggtgcctagaagtttgataagcatcatgtcagttgaaactactcttaatattgatggctcgattaacactagttttagaagttaggacaatctatacttaattttatagttgactagaaaatgtctatgttttgttatagataaaaaatatattataatatcatagcataatattattttatcaagcatgtaattgtttgcttatttgcatatatggtatttacttgaatcaaatattagaatattctacagtatcagaaaatatcaagcggcaatttataaaaaccgaagaagcacaagtagaataacagatttactcccatcaccatcgtagttttttatatggagtatatagttgtatgtaaatgaaactcgagcactcgaccattagttgagggacgtaaagtggacctttttgcacttaacgcaaacaggcccaaaccaagcatacaccgctaggacatccggtccgacaaaaacaatggcccattctaagctataaaccctagcggcctagcccaacaaaacctctcgcctcgtcgagtacgggagcttgttcacacgcctcctcccctacgacgccggcgatgggtaagcggaagcagcgcggcggcggcggcggtggcgggggagcagccacggaaggcggcgcggccaccggcggcggcgccggaggccacagcccctccaccgtgttcgtctccaacctgccgtacaccttcaagtcctccgatgtaagcgcaagccgagccccaatcccaaagccttatcccctgcgaagctatgcggctagcatttttttgctgtttcggtctgcgaggctgtgatacgcggtgtgtattgctgtttttttttagctcgaggcggtgttcagcgaggtcgggccggtgaggcgatgcttcatggtcgcgccgaaaggtatgagaattcagtgacagtgagttcaatggctgtttagcagggagtaatttggttgtgtttgtttctaatgcagggtcagagacgagcagaggctttgggttcgtgcaattgtaagtttcattgcttgcttttctggttgttttccgatggaaatgtgtttccctttcctgccacaattccagaattcgagaagtgattttgatcgtgagtagtgtaatgctctagtgagcaaattgtttaatgctaagcggaaatacatttattcagtgtctctagtgatggtgtctggttaataccagcctatcaggtccctcacagaagttagccccacaccgatagttcttattacaagtatgttactgcacgaagctttcaccatatgttatgtactgtactaatgcacaaaccaaatcacaagaggttggtttagctcgatctttttgtttctcttacagatgtgtcgtgtgattattcatgtaggaatatctttctgcagaaaatatataggcataaggcataaaactgacgcgtaatctgttatacatttttgacatatttacattgatacagtgcaactgttcaagatgctgagcgatctattcagcaaaaggatggattctctgttgctggtagaaaaattagagttaagctagcaacgcatcgtgctccactgaaggaacgtttacagaagaaggagaatggtaaatttctatttctggtatttggttctgaatttcaattgattgagattttgattgcctggctgtttttgcttgtaagccgtgcaagccaaggatgccgatgcaacaaatgaagccaaggatgctgatgcaacaaatgaagccaaggatgccaatgcaacaaatgaagcatatgctacttctactgcaaaacacaaggagacatctcataaaacagatacaggtttgaaaggaaaattgttcgattccaacactgtttccattcctaaattttatcaatgctttaattttctgattcatggtgtattactgaaccagaaccactacagttgttgaaaaaggaaactacactatcaaaggaagtcagcatttccaatactgctaaggtgaaaagctcagaaaagcaaaggtgtggactcaaatattctataccatcaagccataacattacctaaaaacaatttaagtaattatgctgattttttcccccatcccattctagtttggtttccataacctcacaaaattcttagttttttcatggatatatgctgtaattgtttatttttcatccagcatgacatttgtaattgcttgtgatgaagggttgcaaaaactgtgatattcggtggtcttcgagactttgctatggcgagtgaagtatttcgtctagctggagagattggcacagttgtatctgttagctatccacttccaaaagaggaaatggagctccatggtatgacttattaagttttatctcattttcccagttcctgctgtacacacaattattctcctttaataccactagcatgtggttcttgaaacagtataatttatggaatggctgtcattctcaacagggcttgaacgagatggatgcacaacagatgcagcagctgtactttttgccagtgtcaaatcagcttgggattcggttgttcacttgcatcgtaaggaggtcaagggagcagttgtttgggctcgtcagcttggtgagaggtattcttcttgcattatatttaccttgatgtgctgccattacttcattattttagcttgatagacttgttctattctacaattaaacaaacttcaaatacttccgtttttcttccactttttgtttaccagtgtagtagtgcatgtgcacacatttagtttctcctcaaagctacatataattatccttatgttctaacctaaggtggctatcatgaattagtacggtaatttaaaacggatgggtatgtgctaattaaaaatgggttggaacttcaaattctggagtctcaaactaacaataactttctgctgctgtgtctcctggcaacgtcctgaataccacatatattacagatctcctgactacagtttcaaatatagttagttacagtgtcctgtaagacctgcaataagtaaactagatattttaccagaaccaacatagtgcctgttcattgcaatggatctaaactaaatattataagttctaaactagaaaaaagttagtatccccaaattttaaatattgcatacatagttcacattagatcagatggtgacatgcaatcgttcacaaaaggcactactatattattcatcataagatactaccatcaccaccgctaactccatttttgtatctgtaaaagatgtacaagcctctagagattgattagtcagtgagttaatcaagcttttctcactttcagttagaaagatcctaatattattccgtgaatgacacaatagatatgctaccgctttgtctccacttataatctactactactatcttgcatggctacaattgcagctgtgagaataggtgggtaggagatagaatgagattacttaaaatcctaattttcagttgttgtgtgtcccccttcttcacaagagttgcatggtgtttatctgtactctggaaccactatcatatgtttctcttcagctatttccccagttacctgcagttgtttctaacttgcttgctatacagggctcaaagatcaggaaatggagagtgatagtccggaatctaccatttaaggtgcttgattgaatgcaaaagttcacttgttccaagctttgtttcctagaagagataaaacagaggctatatgtttttgtttcattgttgcagattacagtaaaggagatcatggatatattcagtttagcaggatttatatgggatgtgtccattccacagaagtctgatgacgggtatgtttcgcgttgaatcctttatttcttcagcggtttaagcaaattgcaagatatgataactctgttgcattcattcttctacagggcatcaaaaggctttgcttttgtgtctttcacacgtaaacaagatgcagaaaatgtcagtgccctattcagtaagagcaaaaaaaaaaaaaatctttggaagtcctaatattttatatttttttctctttaacaggctataaaaaatgttaatggaaaagtagttgcaaagagaactgtagctgttgattgggctgttccaaagaaagtatacactgttgctgcaaaatccagcactaaggatgatggtaaatatatagacttttgtatcaattattttaatta

SEQ ID NO: 44678 - DNA, 712 bp, Oryza sativa
ttgtacctatcccagaagtactgaacaacagtcttccttgtcccattatcatcaacaggaaatctaacaacatcaaaccaggcatcagtttggtgaaaaacaagttatgttcatgctataaaacagtgaacaagcatgataacaaaatgcaggtcctaaaaaagatgacaaagcactattctcaggacagtaaaattatgtgcacttcaacctttacacatcaattttgttgaacattgaaggacatttcacagcattgacagtatggatatcaaaggaacatacattgatatctaaggaataaacctttgaaaaggattaaaatgtttctatcacatgtccacaaacaattaatgtacttaccatgcccaagatccataaacaaagacatttcaaatattccatcaacaatctatattgattttctgtatcttaaagaatgtaaacaaaaagagagttatagcagaagcagaggaaagataagtacatcagctggctcataggaatgggggtaatccctgttatcttgtatcttctgatttggtcctcttggtggtttgtttcaatgcgaaccccacgtaatgctttctttatctaaacatcatgaaaaatgagttaggatcagtattgcatgattttatgaattccatcagtaggaatattaccttcacacgatcccggtctgacaaaggtcttgaggtgtcacgtatgt

SEQ ID NO: 44679 - DNA, 6119 bp, Oryza sativa
gggtagagaagaaggatctggacactgtgacataactgcagaaaaagtagttatcaatgcattatttgtaccctagtcagtaaataatcaagcaaaagtcaaaacaaagacaagaaagaatcatacttccaagatggtgactccctaaggacaacatcaagaacttgaatggtttcttggggcatatccctctgtcttccaagcaaaaactgctggaggtggtacaagtctgttctgccagcaatccgaattgtgatcttgtactccctctccgccctgcagaagacaagaaagaaaaaataatatgagactgcaaaacacataattcataagaatttaaatctctagtttgcatcatacaaacctttctttatccttcttttcgggatcaattagcttaaccacaaactcctccgattcaaaagggagtgaaccagcagtatagagactctttcttccatcataggcaggcaatttgccaccaagagatgtcttcccgtgcaacttgatgagctcattgagtacttccctatttgttgctcttgattttgactcaggattgattgaaacctgtaacataatccaaaaagaagatcaacggcctttctattggacatgaggggcagattttttttttataaaaaggaagatcttagagcaacttaacaagaactctacagtaaacatcacgtaacaagtagtttagatcagagcagttaaccatcactaatacaccaaactactcaatgtgtatttcgtctagacctaaatgagtaattcagcaccaagttatgagtagtacacacattatccgagccgattgattagggaaatgaatgcaggccgaacaaaaaaacagaatgccccaaagtaacgaaatctaaatcagctagggaccaacagaaatcaaacaacaaagaaggtggtaaagattgatcctctccattgaggtcacgatagaggtagaactacacttgcaatactacgggtacgacacttacatggggcgggcatccatggcggacgctagagcctggagggaatcgccggcgaagcgttcgaggaatggggagagaagcatggggagagttgaagaatagctgtactacgggtcgaacatgaagaatagctatactacgagttctttaaagcccaccaaagcccataggaacagggccaagaatatcggtacagctcaggaatcagaaaccaaacatcaaagcccaaaaacaaaataagaaatggaactactactaaaagccccaaagcaaaacaaaacatatgaaacgagtttgcaagaattccacctgaaaaaacgttattgttttttgaacgaataaaaaaaaagctaggcgtacaagatcatgaatgagaacgacatcctgaagacaacgataaaattttcatatattttgccaaaaaaaagagcagaaaacacaaaaaccaaaagccacatgtatcatgagtttttaaacgtggatccaccactctacttctgcaagcgacaggcttccggccgctggagagttgctgcaagaagatcagagaaaggacagcggcactagtccgctgctacaagaaaacaagaatcgatctgaccactttggatgcaaaagttcacgcgaaggcttcgcatacagggagaacaagtttaacatgtcccttgcaagaaaatagcaagcgaacgtatccgcttacacaaaaatggcagtctccaaaagacaacaaaagaaacagtcaaaaccagaggtagaaccgaccgggcagggcacagagaggtttcgtcgtcttccaactcacacaaaaaaaagcaaacttgtaaagtagaacaaaacgatgcaaaacctttgcttgcagagggaaaaacccgaccagctcccacgagggagagatcagaactacccttgtacgaaatcagcaaccccaaacacagcaaccgttctgaagaaaacgggatgcgcgcgcatgtacgccagtgcgtttagcagatgagatgcatgtcacgaaaacgaacgcaacgaaacgcttcgaattggtgagctgcgtgtgctgcggccatgagatttctgtcgacatcggccagatctctagcaccaaactagcagcgagcaccgaaggtgtaaatggccaaacaaacggaggggatcaaaaaatcggagaagaaactttatgcaagaaacgaaacgcgacgctccgaccaacacccacgaactggatgataaactttaaacgaaagcagcagagaaacgaacttgcaatcgaaagaacgaaacagaaggatcaagaagcaaaactgaaccgagcaacctacccttgtacgaaacgtaaaacgttcccaactaaacaacgacatgcatgtacgccggtgcgttgagcacgtgagacgcgtactacatatgtacatgcatatcaccaaattaaacaaacagaacgaaaggcttcgaacgggtgagctgcgtgtgctgcggccctctcgacatcggccagatctctagcaccaaactagcagcgagcaccgaagtggagaaggccaaataaacggagaagaaactttatgccagaaaggagacgcgactctccgaccaaacacccacaaactaggatgagatcggaagccctcgctccatgcaaaactgcaaacgaaggcagcagagaaacgaacttgccatcgacacaacaaaaaaaaatcatccagaagcaagcaaaatccatgcatacacacaacatgcaaggtaaatttaacagatctgaccatcacacgtacaggagtacagtagtagacagcatgcatggagtatgcgtagatctaggggtgggaagggaagggaaagagggtcaggggtgagctcacatcgtagtggaagaggttgttgtcggcgacattgacgaggaagtggttcgcgcggatcatcaccttcttcccggccgctccgaaccccggccgcgcagggtgggcgagccccttcttcgacaccggtgccagatccttgtccgactccaccgacgcctcgccagccggcgcggccgcggccgacgccaccgccgcgggtggcgccagcgcggtctccgacacgaacagcttctgctcgaactccttggccagagccgtagcggacggcgccgtggaggacgacgagggagccggcgcggccgccgccggctggtacggagccggagccgacgagtgcgacggcggaggcgcccggatggtgacgggcgtgctgcgcgcgtagccaccgatcaccggaacccccggggagggcgcacggtacacgcccccgggctggtacgcgccctggtggtgcgccgccggcatcggcgcgccgtagacgacggccggcggccccggccgcgggtactgcggctgaggaggccccggccgcggcgtcatccccggcggcggccacacgaagcccgaggcgggacggtacggcggggctccacccccaccaccaccgccaccacggccagggacgtcgccgcggccggagtagggcggccgctgctcgccgccgcggccacctcggcctccgccgcggtaggccatggcagagagagaggtggaggaaggcaacgagatggaggtgagggtttgggaaggggtggggagtgggtgagtgatgttgcggccttgcgggaatggaaggggagggggattttataggcggagggtgatcgacgaggagaaaccctagctagacgcggtgggagggagaagggggtggtgatcttaccgcgcggtgactgtatgcttgtccgtacggaagagtgattaattaggcggccggttaatcaaacttgctacccaagacaaattatgtgtcattatagaaagtgaatttatgtccggtttttttttgtgttttttgaaggaaaattatatgtcattaagttcatcgatcggggtgaactaattaatctgagtttgttttgttattaatttgggtgttaagatattgtatagaaccaagctatgaacgtgaagttatacatatgtatagtcaagtgtacgagtgtagcaattcataatgtttaaagttaaactgcaaatggcaaaaaaggccgtacgtctagtgtagtatcccatttgacaccatccttccgttttgttttctcgtaattaatattgaagttatatatgtttggtgtggtttttgtgatatacattgtccaaaatttgacaaattaaatactatacagatcaataatgcataaaaaaaactagctagaagtgcatgcgtaccagctggaaggatcagactgaaattacttttttgaaaacctaccgattgaaattactgttgcctagtattctcattttcccagcgatcgagtctcgaattgctgccacgtaatgcctctatcttggaccattttgatcgctatgggtagaaaaggtttgatttaaaatcaagtcgtgttctaattaccttcatgaagggatggtcaagacgaagcgtataggcaacattgatttttactgcagttagaaatatttgagaattgagatgtgaatatacatgtgcaaggcaaagcacgtggacgcatgcagtgagtgatgagatgagtccacacctccaagacaagtcacaacccgatcacaccggacggaaagaagaagattctggaggaacgaatgacccatgcatgcatctgtagccagtctctctctcatgcgccttggaattatctctcgtacggcttgggcccacctgtcattctcacactgtattgtacccaaggtgaaaatatcttcactcctaattaatggctaggtagttttaatcatgggtaagataaataatctatatactattaagctagctactctgtactcctgagagaggaactcgatcaatcatgatcgagtagaactttacactggaaaaacgatactatatggtgtgatcgtctatcggcgattcgatcggcatacgtgtcacgtttgaaaaactggatcactgctcgcccctctctctctcgctctgcaaagagatcgtatcagatcgtcttggctgcgagagccacccagcgatcgagccagaggcggtcgatggctgtagcagccgttcttccggtgaaagctgaggctatgggaacatgcagatgcgtccaagcggtcggcccagctcatccatgcatgtatacgttgcggcgcagactgcatgcagtagtcgaaaagcaaaaggaaaaaggtagagcaaaattttttgatcgtctccaaacccgggttaaaagtgtgtgtggactgtgtgattttaactgcagttaacattatctccaagcccgggttaaaattatgttctgtattctgtagtggctgctgacatgcggctcggtttttctgatcactaatataacctgcgagtaggaacattgcatgcagcaaattttactgtctctatcccggtccgttttttatcatagcgcagaacaaaatagaagaagagctgcgcagtgcatgcgtggtggactggtggtaaaaacgacgaggtgtgtacagtacacgatgcgctccttttcccatgccgcttttggcatcctcgcgccctcctcccctgtgcaaatctctgctgccgctgctgccgcaacctcgcaatatcgcattcgactacgaccaaaccgcggaggcgaggagcgtgtaggggaggggttggtggtggactggtggtcaagcgaagcacgcagcggttcgagccgcaaacggcaaagcatctctggcgctgcgatgcgctgcaccgtggggggaggggacagcggctgcaggtatcagagacaggagcagcgtacaccgcggccaaaagcaaaagggtgggtgatcgtgctggcctaagttggcaatactggcaagctgtgaggctgtgaccatgcatacaatgggtaacccaaacccatgcttctctgtttgcgagacgatcagacgagacaccgcgagtgggtgtgtgtgactgcctaccatggaattgcatgagactgaggccttagttctcaaaataaaaacttttcacccatcatattaaggtggtgtttggttggagggactaaagtggggctaaagtttagcccctctctacaaaacgagagggacttatgtttttgagagaggggctagagagagg

SEQ ID NO: 44680 - DNA, 14075 bp, Oryza sativa
cctctctcccaaacacccctaagaccctgtttagatgggactaaaacttttaagtccctataatatcgaatgtttagacactaattataaatattaaacatagattattaataaaacccattcataatcttggactaattcgcgagacaaatctattgagcctaattaatccatgattagcctatgtgatgctacattaaacattctctaattgtggattaattaggcttaaaaaatttatctcgcaaattagctttcatttatataattagttttgtaagtagtctatatttaatactctaaattagtgtctaaatacagggactaaagttaagtccctgtatccaaacaccacctaaatgtttggacacatctatgaggtattaaatgtgaaaaaaaaataattacacatttacgtataaatttcgagacaaatcttttaagcctaatcgcgccatgatttgataatatggtgctatagtaaacattaataaatggtggattaattaggcttaataaattcatctcgtaattttctggcggaatctgtaatttattttattattagactatatttaatacttcaaatatgtgtccttatatccgatgtgacaatcaaacctaaaatttttccccaaccaaaacaaggcctaactatgttaacgttgcttattgtaaatattactagtattgtatatttgtatactctagtactccactacgaggactcatctctgcgtgcagtttgaagcaatttgaactcaggccctctttatttcacaccccaaaattttacatcatgtaacatcgaacgtttaaacacctgcatgaagtattaaacataggttaaaaaataactaattacatggataaagactaatttgcgagatagatcttttaagcctaatatctccataatttgacaatgtggtgtcacagtaaacatttgctaatgatggattaattagacttaaatttgtctcgtgtgttactgacggattatgtaattactttttttattagtgtctaaacactccatgtaacactctatgtaatattcaatgtgacacgctaaaactttacccctctaaatctaaacacccccaagtttgaactggagttggaaaaacaaccgcggtaaaagatgtgcccgtgtgtggtaaattaaacatgcagcactagtggagtggggctactacacgtctacacccttggtggactggcagagtgggcccacgcaccggggcagaatgttggatgagaggagagagatgcttcttgttggcttcgcagccaagaaagaagctcctgtatgcctggctatagctacctggaacatgcacggcgcgctgcgccgcctgcgcacgcagcaggcttcgcggccatgcattcgtccaagcggtcgtcccacctcatgcatgctgcacgtatacgttgcatcgcagactgcatgcactcgaaaagcaaaagaaaaaggtagtagtagagtactagcgaaagcgagtgggcgggtggcatacgtacgtgtgcactccaatacttaaccatgcacgtagacgtagggggtgcggattaaactgcagttattctgtagtagtagctgttctttttttttttctgatcggtaattaacctgcgtgtaacaacagttctattaattagaccatgaacaataatgtacatgcagcaacttttacgctccctattatattacgttccgtttttacacgtatacgggtaaaacgacgaggtccacacgaggcgctcctttcccatgccgcttttggcaccacagttctcctctgtctgtgcaaatatctctgccaccctgcaggctgcagctgctgcctcccactccaatggtccaacctcgcattcgatttggagtacgaccaaaccgcggaggagggaaagcgagaccgaaaacgctaatcagcgcgccattgatcgcgcgccctccccccgtgcggcgcagccacgtggcgcacgccgagagactcgtgagcgcggttttcttttttttttttcggttttttcgcttttctttaggttttcttttggttaattcccggttttatccattttccattcggtttttcagtatatatacttatcgtttggtttttaatctatatatgtatatacaaagtttatatatgtgtgtattcgtacttatagccaaacccttctacaatgtagagcaggaaggagttaaaagaatcagttgggcataagcaccagatacaacataattagaaaaggggcccataaatctctataagtcagacaattatgttccaggttttggacaagttgaacgaaagaggaccataaagctacagccgattccaagcaaaaaaacatggtacaacgcatcaacactaatagcaagcaagccagcatagatgagaaagatatgcatgggagatcacatgtactcctaagtcatagtaagattaaattcctgtttctgaagttactgctgcaatacataagctaggaacaaaataagcagccagattaaattcctatttctgaagcacatccagatctacagacaaccatatatagcagcagcagccatagaaaacgtagaagcagctcgcaaaacaaagcacgacgatgcagatttcgatccctgatactgtaagtataagcagcatgactagatgaggtctgctccagcaccacaagacgtctgcctccaatccttccattccagtgctgtcaaacagaaatattaattatagtatagcttagaaggatggcaacatcaatggcaaaaccaacagtattaatactaccaaataatgtttaactcagggtaatttaaatggcaagccgctaagaagtatagctgtgattaacacaaaccaataagtgcagaatgaaattgcaaacgaagttaattaattaattgcatgcagaagaagtttagcggtttgagttacctgacgaagatgtcaggttcttgacaacctcctcttgattgcagtcgagcactcctccaaatcatcacgatccctcttgggtggaactggattctgaatgtgtttgggaaattctacacccaaaggctgtgttgggcaggaggagagcctggtggaggacatgatgttcttggtgtgcatgttgaggctgaccatgtacaccccttcttcagcagcattgagcatgaaacagatgacaccgttttcctccatgctcaggacggggctagtcggcttgaccttaggcaacccggccttcttgaagccctccagctcccacaggcttgccacacggagttccccatccttgtgccactgcgtggtggccagggtcagagtccaagtcgtcatcatagcttcatcagggggcaccatgtcaatagaagcgaacttgatggagtccttaacgcagttcattgtccggcataaccgcagctgattcttcatggggtcaagatggcactcaggcggcagcgggatgtagcggaacggcacatcgtagccaccggtgagcacgtcgtggcagctgcagtagaggacaccttgcgcgaggttggcccagaaagcctgacctccggacgagaacaccatatgggccttgaagcgattcggcgtctctggagggaagagcgggttcttgaattgccacggcgtggtgacagcggagaaggaggatggcggtggaggtctcgaggatggcggcggcggacacaggcagaggacatcctggaagaagcgcctggtggtttcccggtcggaccgcatgtcccttcccaggagggcaatggtgtagtcgccgccggcgccggcacgaagagggagaggctggaacgtggcagagggatcgcagcggttgggcaggcaagggatcatggagagtgacttgccgatggcgtcgtagactaggtagcggtgggtgcgattgcggaggcaggaggtgaagacgatgaggtcgtcggcgacggactggacggaggtgtgcaggttgagggcccgtttaggcaagtccaagagctgcaagacggaggagccatcgtcgaggatctcctctggtcgggcggcgacttgcacggggggttcgctgaggcggatggacagcttggagagatccggcggctcggcgatctgcactaggagtgacaagccatacaccacctcgtcgccgacgtggtcgttgcgcaggtaggtcttccgatctctacactccatgatcgcccactccgattcttccttgacggcttccttgtccagatgaaccacgcggtccagcacgacataggaaggtgcagaccccatggtagccatcagctgtggatggaggtgtatgaaggcgaaggggatctgcgagtattagggtttctctgggtagaccagtcggacgaggggaaaggttcgatctcaactcgacttacagccacagccgggaagggaacgcgatatggtcaggggcaggcagacatagcgcatatcgaatcgatccgaccgttagatgcatggcgacgcggatcgtggcttcatcgaacggctggtgtctagccccaacaaacacaacgggtgaccaacacctggactaggtgcaccatgccgcactccataattgagtcttctgggcctgcttcaaagcccctaggctcggtggccccggtgccaatataacctggcccgcctttaggataaataagttcacttcagatccctcaggttgtcaacaagtctgaaatctgtagctcaaccaaaataccaaatataatgcatccctcaacttaaaaaaaaaactgcaaataagataaaaacagttttgatgacggtttcatccaacgtggatggtttgatttggttcttatcccatgtgatgttgatgtggcattattagaacgaagattgacaaatttaattaaaaattaaagggacaattacttatttgagcctagtttatagcctaactaccaaattaaccctactcttttaggtttgctcatttaacccaaattgaccgtcttaaatttttttcatgaaaaatattatttttcatgatgttaaccattctattttcaaacttcacaacaagcacttctatgggggattcattaagaccttcacagttcatccagtataaggataacaagcacttctattggtgggggtgggggggggggttcccaacaatcacagtatgaccctattctgtgtaaaaggttggttcaagcacttcagagttcaataagcactactctgaaggttaacaagcttttatgttcaaacttcaaaaaggttaccagctgtgatcctgtgaaggcctcaaaggtaagcattttcattttgtataataggaaaaatagagggagaagtttacagctagaattccctcacaagggtgaattcttctttacaacgaaaaatagttgcatgttcattacatcatttagcattcagtgattttttgagggatcgaaggacaccccacatgacagttgataaaaagaacagaactaaaccagtgataatggcatacttcaaaccaagattcataagcaaatttaccaacagtcctgctaagacaacgcccacgaaatttgctgaaaaacctgaccagaatggcatgccaagaaccgatgaaattattgccccagtccatgctccagttccaggaaatggtacagccacaaacagcatcaaaccaagccattgaaattcctcaacaggtgcagccttctgccgcgcccgctcaaagagaagatccataatccgagttgcagatgcgcttctttgagagagaaatgctgcaagttttttcaggtagaggataatgaatggcacaggcaccatgttcctggataataacataatggcatcagatcctgaattgtttttgtggggatattctgtatatttacgatgaggcattttccaagagatataaccaaattgtttattagtactactgttataacttataactagcagtttctgttctaggtgtgtcagtgtcactgagaaataacttcatgtgtcgtcgactcatcacaaattaacaaccctatcatatcacaatacaaaggaatactcagtcaaatattaaatttagttgctgccatttcactgctttgctctcttatgctgacaatgcttcaaattactgaccttcccatgtaggaggtccaaatttaaacggtaaacaagcgtgcatcatatttttatcccaaatgttcattcatagattgatatttacacataatctgtcacgttgatcgaatcagcactgatcagttactatatgcagtttctttctttatgtatagtaactgatcagttatgcataaagaagaaatggcagaaaggtattgttgctggaattgctgctgtccagaacaaatcagaaccaatcaggaactatgcataaagaaagaaattgcaaaaggttcttgctgctggaattgtgatccagaactgatcagtcactatacatatagtaaaatctaactaaaacatgtgctgttgtttaattgctagagcctagaagtagcatcagtgactaaaatcagcatggaattgcaggtttgcagttatcatttccaggttatcctacattgtgagtttattccatcattagtttcagtatacatattccattacccaggacctaggtaaatcaggctagcatatttattcataccatattattattttacagtagacccttactttgtttattcatcaaactgtgattttgatttgtggactgtgtgaacaaagcccaaaatttagatggttctgcaaattagcaccagaacattttgtaccactgtatattagcactacattttctaagagacataaccaaattgtttattactactattgtcattattagcagtttctgttccaggttagtctttgtcataactagcagtttccaaaatgtttattagtattattgtcaacccatcacaagttcacaatcctatcaattatcacaatgcaaggactactcagtcagatattaactttagttgctgccattcaactgcttttctcatgtaggagtgcaaagttgtactgtaaacaagtgagcatcatctctattctcaacaattcattcatagattaataatcacacataatccgtcacaatgattaaatcagtactaatcagttactatacatatagtaaagaaagaaattacaacatggttcttgtcgctggaatggttatccagaacaaatcagaactgatcagttaaaacctgactaaaacttgtgctgttggctaattgctagaagtagtactctgaattaaacacttaagtaaaatcggcatggaatcgcaaactcgcagtcatcattttcaggtatcctacattgtgagctcattacatcactagtttgttgacctgtaaaaatgtgataatgatttgccggacgtgtgaacagaagcccaaattttagatggttccaatacaaattagctccataacattttgtagcaatgaatattatcactatgttcaatcccagtgtcacaggcaattcagcgaacacctcatgggcaaagctcgccaaaaggaaaaaggtaagcaagagagacaaacccgagaacggataggacggtgaggcggatggggtcgaggcgcatccagtacccaaccggaatggccccgcgcagctcgatcaccggtagcgtagcgagcgtgaacacgacggcctcgtccgcccacccgagcctccgcagcgacgccgccacacgcagcccgaagccggacgccttgatcgagtcctccgccgccaccgccgcaccgccgcagcagagcacggcgcaccccagcgcgcccagagccagccgcctcgcgagcgcgccccagtctggcgccgtcgcagccgtcgcatcccgctccgtctcgtccccacccatcggcgccaccagacaccgccccgtccccgcgatggcgcgagattcgccggtaaccggaggagacgccgcagcgctcaggcggagagcgagcctgggatttgtcgctccgcgagctgcacctgcaactgccagaaaaggcggcggcggcggaggcctccatctccacgacgcgagcgcgaacggaggaggggaggaggaggacgaggcggcgagaaccgacgccgccgccatggccatctggatcgaggaggaggaggaggaggcctctcgcggatcggattgagcctgccactttggactcgatttgattttgacggttgttacgaggcaacgattcgtggtgatgcgggaggaggagaccccgaggctacctgcggctgctcgctcgcgccatgggagggaagaggaaacgggtggcgatttgttacactgagaggtggggccggaaaggtgtgggcccaccgcatccggatgtaatagctttttttttttttttttgctggttttggtggtgtgttgatccagtcgttatcaggttgagcgaatcaaaatcaacagaaggaatgcagcaggtaaaccgtcaaaattaacgactaaatgaaagaattttcgatggtgatggccactgctcgctacagacaatcagagattcaattatcagttcttgaacgggcaaaaaaaaaaacaaatattgcttctattgcggaaatatcaataaagaattgaatatgatcagatgatgactcaagagcaacaggcaattacatttccattcccaagtatcacaagtttattgtcttaaacgcgtttactcccacttcacatcgaattttgcagcatttttaagaggacaaccacagggtctctcactcctagcaccgagagaaaccagagcctggtactaaatgaggaatgcaggcataagtttgggatttaggatgaggaggatgaaatgaacatgttgactttcctctccagttcatccttcttagcaccaaccacgcgactaacctccttcccgcccttgattaacacaaaggtcggcatggcctccactttccattgcctcgccacttcctgcaaaattcaggttcaccaccattaacaaaacatcatgttcttgttatacaagaataaaagaagacgaaacactagcggtgtgtgctcgaattgccagacaggcttgcaaatggaattcttaagaaccttttgctacaaaccaaacaaagtacaataattggtctgcagttacatactttataactttataaatcataatcgggacgtacacatttgatgcatccaagtagtgcgccacatagacccatcattcccgcccagctatttattagtgcattcaaacttgcacaataattttgttgtggagtttgagataaatatgagaggatccaatactcaatgatgcaagaatttgtttatgcagactggctaactgaaacttgatcaataatttgctctaaattctactagttgaactatgtaaaatgcacaattatttgtggtggtggatgaacctccacctctgatgaagtgataattcgtcctggtatgctggaaccaaacaaatattctgttaggtatgaatacaacgatacttccatgattctaggctgtaactgaacaaattcttcttatcctgaacaagtccccataaatcatgaatatttatgatgcttgttatggtatcatcttggagtactctacaattccccataaatcatgaatatttatgcttgttatgtcatcatctcagtccatcctacatcttcccaaaagatatacaatgcgctctaaacggatttggtctttgctttataaaccataattgagccatctattcttgatttgatcttgcttaggtgaattcttagaacattatcaagtcgaatcactcaaaccaaagacaagttcatccagacccataaagctagatactgtttacagtacatataaagcatcctaggacaatgcaagacagcaaagaatgtcatcacattgaactccatagtccatatctggttctagacttctagtggccaagcaactatattgcttaaatactacggcaagaaccaaattcatgtgaaatcaaacatctcactcaatacaagtgcgcatgccagccgtatgcaaccagcacgatttctcagaaattatgcaaaatttctatgattttgaaccagctttgaactaaggcgagagtcaactacaagtactgtactaattagtagagtagatagtaacataataaccaatataactcaaattctttcccccttctaactctgcagaatctgtcgatttggcaccgaggtcaagcaaaacaaaagaagaagaaaaaaaaaagcaagacatgccagggtcgtagcaaccgtaccgaaagttcgtcgacatcgatcttgaagaagacggcgtcggcgaagcgtccggccatgtccttgaaggccggctcgatgaagcggcagggcccgcaccaggtggcggagaagtcgatcacgatctgccgcgcgagcagtagacagccaacacacgctcagatccaaaccagcactcgaggtcgaggtcgatcagattgggggggaaacagcgagagcggagctcaccagcttgttggggttgctcttgtgggcgccccactgctcgtcccaggtggccgtggagtggacggccaccacgcgcgagtcgccgccgtcgtcggcggcgggcggcggcgtgaacatcgtcgagaagaaggagcccatctcggtcgcgtgcttggtttggttctctctctctctctctctcttttctcgccttgctcctcttcgcttcgcgtgagcgcaagcaacaactcttcttgttggtttttgacttgtgatgagggaggagagacgactctttgtagtcttgtggagtcacctactcctcttagccacagaaaatctcacgcccaattttactatcaacggtccagattaatcttgcaaaactaggccacgtgtcagtaacgaaggatgaaaatgatatgaaaatttccgacaatcatttttgtaaaaaataaaaagtaaaaaagtaatagtttttagcatttctatttagtcatttataaaatttagttttctgttttctatttgcatattgaaatcgacaataaatagttaatttataaaataaaaaatagaccgttttcatcctatcgcgtgcctttttaggtttcgttcaatcttgaccgtccacgtgtccaaacaaagcggacaacgatgaccaaccactgactcagacaaggggtggattgtggtgtgccagcatctgaactctgcagatgtgtaaagccaagttgattccagacttgcacgggtatatgcttcgaggacacaaggaaatggagacccaaaaaggctaaagaacccaatggtttcttgccaaggtgcatcctcttgctgtagtagcatagatgatagaaccaccacacttttttacatttccaaccccactggtcggcagccatctacaatttacatgacaggaaagaatgaataaatactacggagaagcttttgttgctgcaggctgaggctgcagaccaaatgtgctagcttagctactggacatgaaggattcatgcttcatgaaccgagcagaagagagactacttgacactacatgttacacatttacaatctaggcacacggagcgagatgagcttccatggtggtatcacatcctacttgaaaaggagtagagcagcacaacgagcccaccctgtgagcgctgctcactcaatgatctccactagttaccagtgacaatgtggcattgagcttctcataaggggttgctgaacaaaaccagttaggatctagtgctccggcttcggggtgcgtgtgacgaattgcgttacagcatcctggtttacatgaaaaatgaacctcatatcctttatctgcagtaaacatcgacagatcagtaaggtgagcgtgagtatacttgatgatgaaaactaatgacattttcagtgaaacatctttcaaacaagccaacgtgaactaccaatatgtactaacctttccaacaattaattattgaaactcagcttatgaatctatgaatcatcattatatctctgaagattattatgagtgctacaccaaatgctaaaataaatgtaaaaggagctaaaggtgagtacttacgctgaaaggcccaataagattaactgtttaacatcagtattttggcatgtctgacgaataaggccaagataaaaatggcaaagggaacatttttaacttattccattatatatttgaaatgtatgtgattatctcaagtaaaattttattttgattcctgagcattagccatttcagtctggtctttatatataacaagcataacactaggcacgtctcatgatacatcgtggatcgagtataccaccacatgccagtcagccagtaagcggtgcaagctgtggtacagtggtaccctaaacaaatcatacatgttcaaattattctaagcactagtactaaaattgtgtagcacatcaaagttaagtatggaatggcaatccttcttgctatctggcataataagaatatgaacagttcaataaccgccctttcataataacaattttcactaatggactccaggatctggtaacacttaacaacaaagcatagtcaagattttcttaaatatctattttccatagtaattacatggataatgaaggatttcaaccatgtttatcagtacaactcattccaagttctaggaacagccatacgtcatatatatcacactgaaagttcaaagaatataaatgcacatatgcaaatttttataacatatgaacacactactatcaaaagacaggaccagaacaattactacagggatcatttcttaatcatgaggttacaaattaattgtgtaaacaatgaggtttgggtagtttactgcttttggttcaatcagtgataaatgaaggaaacaggaaataccagtacctcaattaacgaatctgaacttaagatgatgcgtttgcagcttggtacttccttgctattaacaaaaattgaacatttcccaatgtttttgatatgaaaagaaccagcttcatccatcttgataaccgcctaattttcatagcacacatggatttatataaacacaaaggcccaaagaaaaagagaaaaagaagcagatgtggtaaaacataatcccaggataagtttttttagggtactgcacgagcaaacaatgggggttaggatgtaatcagataagcctactattaattacatgaaaacagttgctagtttaagcagaacgacataatccgatcaagcactagaaaagttatgctgcctagttgtatgttgtttaggaccatttccatgattacagacctgtagttaacataaatgactggaaaatgtattttaaattagtcataacaactcactaacctaaggctcagaattagtgataaatcctacctttcatcatggatcgacgctatgtaattttcttgcttgtacaaaaaccatataaatgtcccatattttaatgtaccgtgtgggcctccctcactgttttacagtaaaaaaacaactcactaaccaaaacattaaagacaccagtttctaactgaaaacacaaaatcatgacattcatgattaatatatatctggaactgccccataaaaaaaagccctagatgaacataaatcatccaccactagatatttgaaccccaaatatatccaatttgataaagttgacttcacaattcgagcaaacattatggccagcatgagaacaacattaatacatgatcaatgctttttttactgtcatcaaggctgcatagacctagtaggctggaaattggagtaggaacaaccataggcactaacaatacattcaccttagaacacaccacagcaaagagcatccaatcaaagcgcgcatgaggaaaataagaaaatataaatttaacctcctccaattgtacatgacatatatgtccttgccttttgtaactcaagtagtcaagtcaactactattgggcattagatgcttttaataagttgtagtttaagtctcataatgtaaactggaggatacgagcaaatacctgtctacgagatattttgtttg

SEQ ID NO: 44681 - DNA, 755 bp, Oryza sativa
aagctactcccaggcggctggtgaatgcacctgacataattcattttaaccgtttgaaaaaattacttctgtagtgtaagtgtttatcctcagtaatacgatacaacaatgtggatgcttgattttctccaagtatacacgggattagtaatgatcgatcagttgatcacccttaccttaccttaaatggtaacctgccgtttggacaaataaatggacggggacaaatcgatcggttcttaattagcgagattaattgttagcgacagaccgatcagttgcttgcttcgctgccgagaatctgtcacgcatgcagacgcgtgctgctgttggagggagcggccagaggaattgatggctgcccctgtcgtttgccgcctgttggctacctgttcccaaattagttgtccaaccaccatttaaatttcacttatctccctaaagtactgcttgtcttactcactccgtctaattttatagagaaaatctataaaatactattgacaagcattctaattccagaaatatcatcgacaaagacaacttcctaaaaataccattgcacgaacctctttctcccaaaaatactatcacaccataagtattgttaactcatctccattaagttatatgaaaagacaatcttaccctaggcatccatttgcacacacatcatcattctatattatttgctcacacaatattattttgcattcatgcatattttttctgtccacaactagggctgcaggaat

SEQ ID NO: 44682 - DNA, 34694 bp, Oryza sativa
tggaagggagtattggagtgactggaaatacagaaataaaactaaaccttcatcatcatcatcatctcatcgtcaatatgtgttgcatccttctctttagcatcgatttcatcctcagattccttatcctgctcaatggaatcaggatgctccagacgatgtagatgcttccgtaagatcgaagcatggatttccctcaggcaagcctgcaatgcagaaaaaggtaagctttcacctattatacactatttaaaccgggcaaccatataaactgcaaattcagaaagttaggcaaagcagtttcacaagttcatataagaatccaaaccaggatctgattatgatgcaagaactaaggtcaaatcaagataccagaacacattttatttgtgtaatgcaaatgaaacaaccaagatagtgtgatatggatggaatcacatttgctacaagaagaaaagaagagtgtcttttagtgtctgcaagcatggcatacctttgctttgtaaatatgaaggcgtttcagaatggcctcccagtattcaacaacttttgctgttccagagcgcatttgggactcaatttgactttgcatctcttctagttctgtggaagtcttaccctccaaaagatcctttacatcaccctcaatacttgcatgtaagcccctctcttccgcaagaacatcaggaggtggttcctcaccacgcaccctagcccgatccaaggcatctcttttccgagcctcacctagctcccagtcacataccaccatgagtgcctgatgaatttgaaataaagagtggaaattggtcaacagccctgagcatccttgctaattagatcaagagagcaacatgaaatcacagaaattattagttcctactgtcatattaggaataacttgatttagttttttttttgtgaaaacctacggcctataggcaaaccatatatacaacaagctaaaaaatatgttctgacatactacggcacaatatttttgccaaagatcgatccaacaaaacataattatcaaaatctcaaaaatttagcattactgttttggactatatgccatttggtactaacctcaatcaacaggaatatacattatgcaacatacacatcagtcatatgaattcatatgattattcaagtaaagggtaatattataatgaatgttgagacaaagacacacctcccagtatttgacatttatttggctttccctgtccagatcaagatgcatcttaatgtcatcgcgcagctcttccatttccttcaccgttaatccctgcatttagcacatcacatatgtttaagtgttaaaaggaaaagggaactctttcagatctgggctagttgtaaagtaagaacagatggagtgattaaatttcaaacccattgagagatacatgtttccacctctctaattagaatgtagttaatgatgaatcgttagaatgtttaaggctatttctaagatgtaaggtatcttaggatatattgaaacattgaaccttttactttgaatacaaggacacagtattcctgcacgttctaaaagggtaacgcttaaggcggatgaagctggagattatagaaggataaacagttggttatagggagccattctttcagaagagaatccagaatgttaatgatgtatatctgaaatttattgcatttgtttgatagtatgaaagaaagcctggcaccaacatcagctaatgattgagtgaacatcatatgtgagaaccagatacatacaaagtaacttctcgataggtgcatccatatagcggctctttggttaactataatcaagtgggtaagagaagttcaatttaccttgaataccaagtagggctcgtttaactcaacatcaaattcttctgagaaattgagattcttcaggagaacatcaataggttttgtgcgcccctcgcgtaacctgatctcagatctaactttgctttgatcaaaatgaaactgcaatagaagacaaaaattgttacataaaagaagtccggcttaattcagcatgagaccaaatgatatttgccatgttgtaaaatatgaacctcttcctctttcttctcccaatcctgaaactcagcgcgtgctctttctctggctaacaatgcctaagaaatacaattatagacatttagttccacaaaaaagtgttacttgaaacaaagagaagattaatggtaaccagagagatatatacagaccatttcctcctcatgctgtgccttttcgatcgctctttcctcccttcttttcttaaccttctctatttcagcctatattaagaataaaatagtaaagttgcaggctagtgacatattactctatcttgaaagataacatcaaatataaaactgcttctgcaaagaaccagccaatggcattcttgcaagaaacagatccatataatctctactcatgtgtaaatttacatgcatccacattttaggctgtagttctttggggcaaggcattgggcactgatgcaaatgtttagtacataatctgttgtttctcactattgttttgggtgaaactataggtattctcaccccaacgtgttattatgtatttggacacttgcataagatgataacaatataattataatctggcaaggtaacacgagataatattgttttattatcctaaaatgaaagcaagtagtattgagtaaatgtcctttgagtcctttatttttgttaatttcaatgaagagtcatctccaagttcagaaagcatgccagtggtactcctatcataagatttgaagttcaggataataaaaggaaaaaagaagtaccattctttctctctgtttcttcttttcacctttaacagaaatgtccaccttttgcccttgagatacatcacgctcaatcttctttcgccaaacaaatctgcaccaatacaaggttgagagtattacttttgaacagtcaaagtaagcaatcagtgcaaacgcaacaagtagggataaaattaggatctgaagtgcagccaacaacatttccatatggtcatatcacatgataacattgttaaacattagaaatcttgactgcaaaactgtctactgataacagtatgcaaaataatgctctacgagatttctcacagttgagagaaagatttctcataaatgttcataactcattctagagagtgcaacaaatgaataaacaagtcagaagacatctaccgtagtcagatgatctcaatcagtagttcactaagctatcaattcaatccttcatacatttgtccagtacactacctagttagacaaacattatagcctcgattttacttgtaagttgttagctgtgttaatgttgcaactgataaatactacctatatctaacgaaccaacttgacgtcttccccaaatacaattaccagttggcttagacaaaccacatttagagtttttttttattgggccacacaagtaaccaagagcattttcttttttttttctatacaagatatatgtatccttggtggctgtaggtgtcaaaatgaagtgatcaataagtaagctcaagccttactaatgtaaataaatgacagtaatcatcaatctgcacacaattttagggcatcaaacaaacaagggaagtgtaacttttggcctcctgtttatgtcatccgtgacacagttcaaacaaatttcagcccaaatttctacttagctaagcaacaccactaatggaacgaataatgtggcaggagagggggacgaattcgcgtacttctcggtcaggttgggatcgccaaaggggttcgagtcattggagtaccccgacacagcattcgccttcatcttcttcgctaccttctctgcctgcacagccaccaccaccatcaacaagttagttagaaatcaaaaccctagccgcaacaatggagccaaccaaacggaaaacccgaacctccaccgccccaataccttcttctgcgccttcttagccatgtactccacgatctgctcttcggtgacctcccccttcttccggcttccgctcctcctccggacccggccgccggagtccgacccggagtccgacgcctgggaatcgctcgcgtcgctggacgaaggggtgtccctccggcggctcttgcggcggttccggctccggctccgccgcggcgagccgctggagtcggaggcttcctccgagtcggacggcgaccggctgcgctgccgccgccgccgccggcggcggctgctctcgctgtcgcgctccttcctaggcatgtcggcgatgggagggaagccgccgatgagtcgtggggcgtcgcgacacgccaatattcataagggcccaaaaccggtaagattccggcccgatgcctcgtttagatgggcttcaatgtaggcccatccaggtatacagggcctgtatgtgggcttatttgggaagacacaaaccgacccatctatatgggccgtaattttgggtgctgcatttcgccgagagagagaagtggggttgacaagtggctcacaccttatttttatttttatccttatcacttacatgtgggacccacttctatttttaattactttgatgaccagtctaccacgtcagcacattttaaccaagttaacttaccacgtcaacagaaaccgcttccaaaaccactgaagaagtcaaattcacctgttattgaagttgtggttgagggcttgagtgatgtgattcgtccagggacaagaggagacggaggcaaaataggcttattcttgggcttctccaacatgcttaaattggagtagtatgtttttgtttcaggttttctttagctaatagggctagtaaatttgaagtaactgaaccttgatggagtggttttctgcaatcatctaccctatagtttgcaaaatcaaatttggacgagagacagcattatatgaagtttagcatatggtatgagaatcaggagccaggaggtttataaaatttgaagcatatatatgaccgttttctgtactcttgtgaactcctaaatgaccaaatctatgtatttctagtgtcaatcagtcaatgttgtcattctgtactcttctgaactgcaatatttcccctctggatccgattcgggggatttgcaattataacactgcaaacattaacttttgctataatgacactggacccacatttcataaacacagatgggcccaattatcatccactcggagtgtccctatgtttgcagtcccaaattgcaattttctcgggatccaatggggttaagttaacatagctttcagttttcagatggtaagaactgcacgtcatatgcgccgtagatatggggatcaagccaagaattgaaacgcaaagaaacaacaagtgatgctaatatgccgtgagcatctctcctggttctcatcaaaattcaaagcttatgcatgatgcaaagaaacaaacgtttgcatatgatggagtgattcagcagcagccaaaaaaagctccacctcatgtttagacatcaccgtcactagcccaggctgtggccggcattcatccatcgcttcatccgtctcatccattttaatggtcaaaccggcctttgccaaggtaattaattacagcataattaagcccatcttgagcagaggcagaagccaatgtttcatcagttaggtggtgtttagatccagtgacttaactttagtccctgtctttagacactaatttagagtattaaatatagactacttacaaaactaattacataaataaaagctaattcatgagacaaattttttaagcctaattaatctataattagagaatgtttactgtagcatcacataggctaatcatggattaattaggctcattagattcgtctcgcaaattagtccaagattatggatgggttttattaatagtctacgtttaatatttataattaattttcaaacatccgatgtgatagggacttaaaacttttagtcccatctaaacagggccttaatcacccaacttcttacagtgacagtattttactctagcttgcagcttactgttgcttgtaatgggtacaagcacagagctgctgcctaatcttgtttactccactagtagtagattctttctttttagccccaaaattttttacagatatctggaaacttatattagcagcaagcctaccattttttgacttttctgctaataagaagtaacaagctcttgtcttttggtgtagtaatctttatatcagtaaactacattactacccctttttactgtcctcgtcattgactaaggttgaccttttttccgccgctgtatcggcggagttaccgttggtggtagcttcgtcggtggcggtgttctcgcggaacttggcgtagatgtcccccttgtagaagttccttgtcctccagacgagcacgagggagatgagcgcgccggcgacggtggcggcggtgatgatgaggaaggccttcctgaagcactgcacgccgaggcaggtcttgtcgccgccggcgagcgagccgccgtgctgcctggccgcctcgacgtcgtagaggtagccggcgacgcggacgttgaggacgtaggcgccgacggggctcgccacggagccgaagttgtagagcgtggagtagtacttgaggccgaacacctcggagatgatggcgaagaggagcggccactgcgccccgaagcagaagccgatgatgacggaggcggcgtagagagactgcgcgacgccgaacgcgatgaggaggtggccgacgcaggcgaggaggagcaccgccgtgagcatcagcggtcgcgggaacctgtagcgggcgaggaacatctccgacgcgaagcccgaggtgacgcggcccgcgtagttccagatgctgatgagcgagatgaacgtcttgatgctcttcgccgggtaccccagcgactgcccgatctgccccatgttgtcgatcgccgtcagcgtgccgccgacgccgcaaatggtggcgaggaacagcaccagcatgtccacgctcaccagcgcctgcaggatggtgtagtcctccccctgcgctggcgggttgaacatgtgcttcaggcaagaaccgaggcagcaagacggcggcgccggcgccggagacgacgacgacggtgtctcggttttgggcttggtggtgatcgctgacatttgcatggcggcggcggctggcttttcgatggtcaccgtggggggctcacggagggagtcgtcgagctccttcttgatctggtactcctgcttgatgacgacgacgagcgggaggaagaggacgaggaggagcgcggtggccgacacgacgtaggcggtgtgcgagaagttggtctggttctgcaccacgatcatggtgagcaggtaggtggcgagcgcgatggagatgtagaggaagcagaagaaggcgtcgttgctggtggcggcggaggcctcgagctcgccgtcggcgcggcggcggcggctggggaggtacggcatgatgcggacggtgtggacgaacaggatggagatggcggcggggagccacgcgatgagcagcaccagcgacttggcgtcgtcgccatagatggcgacgtagagctgcgtgaagatggcgccgctgaggccgacgaaccccttgagcaagccgagcacgatgccccggctctccgggaagttcttgacgcaggtgacgagcgcgccggtgttggcgaacgactgcgagttggcgccgacgcagatgtagatgcacatgagccacacggggggccgcgccgtgcggccgtcgatggcgaggtagatcatgaggtagcccgcgaggttcatggcggcgcccatggcgagcaccacccacggcggcgtcacctcgttgatgaggccggagatgacgccgacgttggcgccgaggtccttgaagaaggagagcgtgttcagcgtccgctggtcgtagcccagcgacgacttgagcaccttggagtagatcccgaagatgtacgtcgcccccgacgccgacaggatcagcaggcacgcgaacaccatgaaccaccgccccagcaccacctgccgcgcgaaccgcgccgtcgccacctcccgcagcagcgccgccgcgccacggccgccgccggcgacgcccgactccgccgtcaccatcgcgtcgcttcttggctgtggctatgcaaatgtgtgtggacgcgccgcgcgcttggcttgtccggtggcgagagcgcggcgcgcgcgcgcgtttttatagagcgcgcgggcggctgcggcgagcaacgggtggatggcaagttggcaacacggaggaggggaaaaaaagaggggggaaagtgttttttttttcttttttcaacgggaaaaaaagggggaaatattgtcttgagctgcttaaatgtggctccagccacctcccactatgttggatatgcattccggaaattctggatatgcatccaaacggtgctagcgctatgtggagatccaaacgtgcgcgaaattttaaattcttttttgactcgtttgcctcaagtttggttttactctgacatggataacctttcaactatattcgatattttggatgcactatgaagatggtttacatctgtagatggtgatgcagtagcaaccaaccgtattagcgtgaggtgaagatccgttaaaaaaaatgaaagttttttttttggcttatttagtcttttttttttcactctgacacggtgactactttttctcagataaggatgatgagatacaaacgcaacgcctaatgggagttggacggtatcaaaagttccaaaacgaaattttgaaagcaagagtgtttgaaaatagatgagaaaatggtctctctgcaaatcgcaatcgctatagttttcatgaaaggggactgcttgtttgtatagtaaacggttggctccatgcggcatcatagaggccgcgtatgttgcagaatattagtgtccatcttttttttttcagtcgagatgatggtgtgattaattctttaattgttgttgcgactttgacttgggagtgtaccgacgaccatccacaatggcgatggaaagcgatctctgctgaccatatatggcgtgctgttgttgatctctacagttctggcagtttgccgctggagcttctgctcttctagacggtgggaccggtttgtcagtgacagtgtgaaacagtctcacagctggtgagatactttaaaaaaaatagcagaatgcccatattttaccatggatagaacaaaataaaaatcagaatatgtcatagaaaaaaaaatcagaacaagatagtacttatttcgttctataatataagagattttgaaaagatgtgatgaaccccagttcaaattcataataataggatgtgcacatccccttaaaattttttatattatggcacggggggagtatcagatatagaagaaagagattctgatagtttgataagtggtaaaagtgccaatctcttggatagctagctagtcaacgtgatgtagcaccatgacatagatgagttgatgatgctcaatcactcgagggaaattaattaattagacggcagcttcagtacttacatgttgccatgttggttagttgtcaactattttcaggttttgatgccacacaattaatagcttctttctgatagtgctatgcaagcattaattgagatagttgtgattggtacgtacttaataaacaaagatacatgtgattaggaaggtccaactgagacaccttgggagagataataataaaccacagatgcgcactgtgatcatatggatagtcttatagttaagaccatgtggcatgattaattaaggtgaagggtgtgaattaattaagcaataagaaagtacaagggtatctcttctcgttatgaaactgccatggccgtctctttccatgttctaatttacaaccttggaggccgagtagccggggagggagccaaccatgcactttcgtaacaaatagtagaagacaatgattttaaataaaatctaccgtgatttgcgacaatttggtgttgttaaggacggcgtaacaagtagacaaggtgtatagaaatgatcatctttggtcatcgcatcttagactgcttgcttagtgaagattttcacatgtacaatacaacggctatacatgttggcggcttggtgaaataaacaaaaataacttttgttagaaaaacttgtctactacgttcacactagtatcctttgtgccaatttatttgttgttactatacatgttgcagtgataaaaatatattccctccgtttcaaaatgtttgacaccgttaactttttagtacgtgtttaaccattcgtcttattcaaaaaatttaagtaattatttattcttttcatatcatttgattcattgttaaatatactttcatgtacacgtatagttttacatatttcataaatttttttgataagacgaacggtcaaacatgtgctaaaaagtcaacggtgtcaaacattttgaaacgaagggaatatattattgagttggacttttttaatactgtcttttcttctaatgaagatcacaaatggatgggtgttttccaaatgccacttcaattctataccgaccgaagtatggattgttgtttatgtacattaagctttcaccaagaaacatccaagggtttttcggctagctttacaagatggtgggctatacgatatggattcgaagtctcaccccttctaattatttgatattaggttattacctaatattctcgtttttaacaaaacttttacttgagaacttttatatgataatatgataacttctatatgaaaaaaaaatatacattagaagcacaagtgcacaaaatcacaattcggatttatatctcagattaaatttgtgtccgaatcatctgcgttgccaaggcactagcaaacactgaatcgttctctctcctgtgttgactgccactgtgagcgagtcaacggattccgggtgccctgtgattgtttgaagcaacggtgattgacctagctcgtcgcattcaaccatgcttgctagcctacacctcagcttggattgactatttgactggactgactcctttgctggctagcttgatctgggccgtccattgcctacatcaaatggctctgatgccaccctactaattatcaatcaagctgcaatcacagatgattattatccgaaggcgccctaacatattgacttctaaggcaacttgcatatataatatcatgtttgcatcgatcctacggaggaggtagcaataggttagttgattccagtattctacttagccttgagtgcacacttcgatcacactagcatacatgtgtacatgtctcggcttaattatcatgtcactactcactagcatcattaaccaagtctatgcatgatctctctgtatcctactaggtcaagtttatcagttagtatcatcagaataattttaaacaattgcactatgtatgtcacgggatcatactggatcttcacagctacacagtacactctacaatattctctgtgttttttagtgaccgggcacattggaagaacaacaacgtgcgtgctaaggacagcgcatacagatcgagttggagacagcgaaatgtttgcatttctttgattcaaacgacgccaaaccctgcttggtattagcacccatgaagttgtgcacattttttttttcaaaacatgagtagattaaacccgtattgcagattccaaaacttgtgagattccatcagaattattcatgctcttctttgcacatttgagcatccacatctcacctctgtcctatgaatttgagttagtctttacagtaacacaatcgacagcattcagagccaactcttgcacatacaagtcaggccaaccacctaccagtaccacctaaaacaccctgctacagtaatttgatacggtatcgagaaaggatcttggtatttcgtaggactgaaaacagaccgaaacgaaagcacctatcaaaaagattctcggtcagtagggaattaactatatttgaagattgcaatacaccactaaaaaattaaaataaattgcactttagactagatttacggcccatcgtttcgcttattcagcgaaatgacatatttacaaacgaaaaataatttgcgaataaaacttttatatacatgttcttagtgatttaaaagcaaaggctgaaaagtaaacttcaattaaaaaaaaccctaaaatcaaccccaaatttaaggttgaaaattcaaaactttagctgataagtataagcttaagcgaaaagatgaggccattaattacccaagttgcacattgaactagacattgacatatgttttcactttagactactccttccgtcccaaaatagctaaatctagaatataatgcgacctatttcagaacaacgaatttggataaaatttgtttgttgttctagaatatatcatattctatcatagataaaattattttgggacaatttcgtttctgcccccactttagtgtccaatattgattctaccctactttctagggttttcgtttttaccctcacttctttttttttgaaccgaaagaggcgtttacccctggtttagatggaagtttgtgggaccgggtttatagcagtaaagaaatagagaaataaaagaaaaaatagtttttgattttgtgatttacctttttacccctggaaaatatctaacccacatattcttctctcctctcgaatataacaacggctgaaacccatccggccatccgagcggtgcaggcggcggcgagcgggtcatcggccaggcgcaacgccgcaacccctcccaccggcgagtaggaggctgcgcgataggcggcgacggggatagttctaggcgatggggagagggctcggtggcaggagaggggtaggtggtggcgagcgggcgtcgacgccgagcgagcggcggccaggcgcaatgccgtagcccctcccgccggcgagcaggaggcgcgcggtatgtggcggcagggagagtgacaggcggcggcgaggagggggctaggcggcagcgggcgccggccaggaggcgttgggcgtcggccaggcggcgacctacaggtggcttggatgtgaaggccgagagggcaaggttgctgagatgtcgttgaaattttgtcaaagttttgttcaatttgtcaaaatgatgctgaaattttgtagaaattccatcaaattcagaatctgtgcaagttgttatgttagtcaatgtgggtcatttaaatatccttttgccaagaatttaaatttccaaagccatgcataaaatgggggcaaaaacacaattaatgaatagagatatgagagggtataaatgtccttttgccaagaatttaacaccgttaacttctccatgcaaaacagaggcaaaaatattgttcggttcaaaaaagtagggacaaaaacgaaaaccctaaaaagtatggtagaatcaatattggacactaaagtaggggcagaaataaaattgccccaattattttaggatgaatggagtagacttattttataagaaatactttgcactttagactagtaaccccacgtgttagtgcctataatagcctttttacttaacctgattcatccaaaactagtcttccccacatggcacacaaagcttctctcgtctctctggattggcgatcctcttctcacattgtgctgactatatcatccatgccctcatattggcaagctcctgagtcctgtcatgcatcgtaatactacaaaatccttatattatgggacggagaaagtagtagcactagaaagaagtggtgtcgtgaatcttaggctaagagttgatgaggcagtgaacacgctcaagtcctttgctgtggactggtgatccctcaccggctagccatggtggcaaagagataccaacaatgtccaatatgatccaatgtgcaacaaatggtaaggaattcagtcaaaagtgaaaacataagacaataattggtccaccatgtaacttaggaaaaaataactagcctaaagtgtaattcacttaaaatttaagaaactaattctatagtaccaaaatgatggcgctttccatcatcgttttcatccttacccttctggttttttttattctagagtgcttattgcttaagttacaatcacactagggaaccggattcttctatgaaagatcattgtgctatatttacctctggtctttctttaaaaagccgggtcaattacttgatctgcttttaaaaaaaagattactgtgctagctttagctagttaagctgttcgttgcataggctcgactgatccatcattaactatattgttgacggatagtaattacgtgtatccctaaatgcggtgcacatcaatgccacaatgccaacagatatttcatgatcgatcgggctcatatgcagggaaaaaaagtctaaagtgctggaaagtgatacgtatttgtgtgtatatacagatagttggagaaataaacgaataaccttttcgagtacaagtcattcttctatgtttacaagtttgaaaaatggcttctagataggaatctggaatacacatgctgatcttcaaagatctttatcaatatatatagcaatacatatattttttgttagacaacaattatcttcaaaagggtggcacaatattgatttgcccaaaaaaatcatgggggagatatgcatgacatttcagttagaatgagcataattgattttttttctatgcaataaactagaaagtcgtatatctttttcggaattgctatctgtctggcgacagatttttgagtcccatatcttgcagatttatgtacgttggatagtgtcaagattcgtgtagcattcttgccgactccatcattattgatttgagccgtgttttccaatgctaatttgtttataatcccacacgtactaattacatcgtaattacactataattacatatgtaattttggctgcgttcggcagctggagaaagagagtgagtttgtttcattttccgctcacacgtttcccaaactactaaacggtgtgttttttgtaaaaaaatttttatagaaaagttgctttaaaaaaatcatattaatcaattttttaaatttaaaatagttaacactcaattaatcatacgctaatggcttaccttgttttgcgtatcttctcaatctctttctcctcaaactcaatgttagtatatttacgatgtaagtctgaaatctacttgagcccatttgagcccacgtgagcttcagattatccacatggcccgtttgtttggtgttttgtattttgtttgtgtatattaatgtcatccgttagatgttcatctaaagtgtaagaaatctgcgtgataggaggttaaaaaatctatcacatgatgtataggcagttacctgtaatttatttccttggcaccccgacgttaggtgatcacgaccagcctcaacttgcaaagtcagatctcgaaacatgcatgatcggaaatgacaaggacacattgacacgcccacggcgaatgaatggacttctccttaattaatatctctaactatccattattccatatgtatctacaaatttgcacttgagagcaatcatatgcaatggctataactgaaataagattgaaaatgtgcacataaagtacagctatttagatgttcatcataatggagaaaacgactgccaccaaagccagaagcgtcgaattcggcgtgtttaaaaactgtttagattagttccttttcccttcttgaaatcgatcgacatgatgcatgtcagtttccatcgaagaaaaaaaaacaaaaagatgcatatcagtttcatgaaaacgtggagtcgtactggtacatgcatattggatatagctttcacagccccacaaatctactacctttttcattttttttgcaatagcaaataaaaccttgccaaactttgctaatcatagcggcttaagcacatgcaacacatgctatggtcttctaataactcttacattatccaatgtataattgtgtatgtaagttgttggcgtctttacttcacatttaatatctgagtgctatctgacaagtgaacaaaacgaatgtacacaaccataaaggcacaaaaacaacttttctgtcagtggtagatcaaatcagtgcaatatagatgtaggagatcagtttgatgcaaatcttcacgcttgcaaagaaagttgtgaagtaatcatttgaagataataacttaatgcaaatggaagataatatgaagggtacatgagaagagatataggcatagcagcagcacgagggaacgaaagaagagaggaatcctctcctttttgtatgtggaaagtgctaccagaagtatggaacttttccactgcgttttcccttttcaccttccactctgatatcgtcattatctataaaatctaggactgataaatatgctataaacttgaccaattgcaaaacctaacagatcaggacatgtacaatggtttttattagcggtctctctttattgtcatacaaacatattttgtgacgtggaagagagagaaagaaggaaagagaaagatggttgctacgcatgacaatggcatagaatcgactcttagcatttattagaaaattttttgttgcattgagtctaataaaagaaagatgactagtaagaaagtattttaatacattaatggttagagaccatattgtcttaactattgtaacatgatagcctctaattaacgtagagaccataccggtctctgcctttgtacttgccctcacatcagacacggagacacctcaactgaaaatgacaggctcttgcacttatctctcttctagattgtcatctagcatctgtctctagcttgcagtggcaatttaggcttttagcaagtcacacattttggaagtgctgtgcagctcctgtttctgtacttggattacttggagtacagtaattgatgaagggtggacacaatccatgaagtagtagcattaggctttgtttagattccaccctaaaatttttcaccttgtcacatcgaacgtttgaacacttgcatgaaatattaaatataggctaaaaaataactaattgtacagattgcgactaatttatgagaatcatttaagcctaattgctccatgatttgacaatgtggtgctacagtaaacatttgctaatgacggattaattaggcttaataaattcgtctcgcggtttactgacggattctgtaattagtttttttattagtgctcgaacacccatgcgacaccctatataatacccgatgtgacaccaaaactttacatatctaaacaccccctaaaagggaaaaggatgtgatgcctgtcattcactcatgagcagaaaatgcagtaaactacagtaatggcagtaggatctcatgtcaactccactattgtgcattttgtgaatcccatggagcatcagcatcagcattcagccgcatgcgattcaagaatgctattcaggagatgaaagataccttgagagcaatggaacaggccccaaaagtctcacagctcacaagttgaacagtaggaaatggaagcatgcggcacagctgcaacaagtctcctgagtctggactgctagtccacgcacgcgtgcagatgctcgtcggcactgtccacacgaagaaagaagaaactgttagtacaggataggtttagtctaaccaatcacagaagcagagtttaccagtcaaaagcagatctctgtttcattcttatccctgtgtgacaatgttgtgaccaaacatgggctctccctggctgcgggactgcagaaaattgttcacacctcacagtgtcagatgacctgtaaatgatgtgccgacaacgtcagatatcccagaatcagattgcaaagcatgctctagagtccacataaacaaatttgttgggtcttggaaataaagaggacaacaaattttggaacgttaacagcttatcagatccagtacaggagtcatagttgttgtcagtatcagtcgaaatggacacagtgataaagaccaaacgcctttgatttattgtggtcggagatacattcagtcattcatcgtcatgaaagagacagttctgttatgtattgacttatcgagcgataaaaaattgtgaaataaattcaggcacaaagctctgatgacaatattttcagggattaagggttggaaattggaacaggtgaacagtcattagaaaggaataatggcaaatagtcatcagaaatgaatagtggcaaatagagcaagcgctcatcatgacaatggagctatcgctgttagccatgctggtgttacaatggattctgaatttctgatcgtcagaaacttatgatttttctcctccagattctgttctttagggttccaaatggaccacgtgtttgaagaacgcatagaataggatggccgacgtgacaaacagacacgagagtactaaccacatttgccacactgcaggggaaaaaaaaacatattggtaaatacttacagaggacaaaactcaatccattgacagaaacgtgtacctttccaatcagtaggaacatcaagtttcgttacctctgctccccatttatgagaagtggagattacaaccctgcaatacaagcagacaattgctactgtaactatccagcagtacttcaaaaatctgcagcattgccatccaaaatgtacagtaatttcagaaaacaacattaagcatccgtatgtttgcttatgaacagagttgatgtgacaaatcttcattcacatatggatctgcaattgcagtgcagactgcagaaatgcagagtaaaaccaatccacaatttccttttaaatttcaggggcaaggtgaactggtggaggacaaatcttgctccatcctgcccccatgtatatgcaaattagccatgcataatgctgataccatagctcgcttatctacctaccatcgtgttgtgtgatccattttttaacatgttgagaaggcatgtgggcaatctaataccttaatgctggatcttcagagtatcttcaagaattctagcactgaacaaattactagtgaagacaatttactgctaaaaatttcaacattggtacaaccagagaccattactaagtgcttggatgcttagtgaagccaactattttactgctagagattttcggtttgtctcactacttcttccaacaaagaccaatggttataattacctttctgtaggacaaaattcaattgatgaaattggagagccaagatgaaccttcttgctcaagtgcaaaacttccatctttttaacatccacaacgcagaaatcactatcatggcttcctctaataacaaagggtgaaaatacatccaaaaatataaaatatgtacgaaaagaagattatgaactaatgcacatacagcaacagatttaggatttcagacacgtgtcaaatttgaaggtgaagtagaatagcaagtgtatatgttccttttatttttatcaaaacaaaacaggtatctaggtttctttcaatatctaactccccaagagagtaacaataacatataatgattaattatgaggtggccagctaacaagttcttcagtcaattgaacacacttctggtaccctccccactactatatacattttttttgtaattttccagaaatatgagactaaacaaatgtcatcagccacagctttgtcagaacatgcataaatataatgatgtgcaagtattctgtaaattctctctaagaacatgcataaatttgtcaaaaggagaagtcagctaaagaagtatacatcaatatggatgagtgattgagtggtgagaaatgcgagaaatggaaactaccctattatgaccagtccataacaccataaaaaggctctcaaatgctacataacagtattgctatagtcaggatgagtgtatggcatgtgacagtaagaggcagaaacaatgaacttacaatgcgagatactttccatccaagcttactgaaagtgtggagatatgcttttccaaaagcctcttgtacccgatcctcttccaattacttatgtccaaaaccacagtcacaacgttatgacctattcaagcaataaggatttgattaaagtggctggtggtgcacatattaacatcctattgagagttatggaatatattacctttcacaagtgtgcagaacaggaaaggtttatttccatccctagaaaagcagcagcactcaatcttctcatcctgtaaaggggggaacaaatataaacaagagagtcaaataaatgactcagtttcaactaccaaaatagaaaagtgcagtaatttatcatacgataccgaagatctactcaaattgacaagcggcgctccctcatctatattccatattcttgcagaaccatcagtggatgttgagactaacaactcggagtctaagctgcaagaaggaggaacaatataaagatccaaatctgccaaaatgactttattttgtgaaataaagttatgttaaaaacgttgggcagtaattatccttacacccaagaaagtaactcttaggcagagcctatatttaaaactaccttgttacttgtgcaatgcaacatattgaatgatattgatatgactaattcagtttatggacaatgtcaaggaggattctgtcgatttatgcttatgtttgtcaaaagaataggcaatgcttctgctttttctcacctaatgtccatgtctctgaaagatttatgagcttttggttcacccagaagcaaattcagatctggccaatgaaatattctaagatgcccatcctgtagttgccagaaaaaatggtatcaggaaaccttgtataagaattaagaagccaaacttgtgactgcagaatctgaagttatgattctactgacaaagagcgaagtgcataataaacagattggataacacggtacctcaccaccaacagcaaacttcgcaccatctgtactgaatgacagacatttctgaggtccaattgattgcagagttggagcatcctttgaaataaggtgaacactggattcttcagtcaccagcttgaataacctacaacagtagttggctgatgatctaacaacgctgacaggtatatctgaatttcaagtgatttgggagtatgaaacatgagctttttatcagcaacagcaagtataaactctgacaaaagttagtgcaaatcaagctgatcagaatgagtgtctgagttagcgggagcgattcagaactcacctgcaccctttcgcggtggcgcagacgaactcgtcgccgctcgggtgcacggcgatcgcgcgcggggcgtcgtcttcctcgtgtcccatcacgaagctcacctgcgaaaacccgcgagcacaaacgcaacgccgcgactcaagctcagaccgaacgtacgcgaagagcagacaacgccgccggagcgcgcgcgtgcgggaggacggacggggagcgctcaccagggggtcggcggcgacggcggaggcgccggcgtcgaacgcgtggaggtcgatgcgcggcggggacgatgccgtggaggcgcggccgtacacgacgaggaggcgtgccgggccgcccccgccccgccgccgcgcccacgccgcgcaggtcgcccttccaatcccgacctccgccgccatgggagacccccccaactgcagcagatcggcagccagtagcggcggcaacaagcaggctcagaagcctcggactcgataagcctcagctctcttctccgtcgggcgctcgccatttgtaggagacgccgccgcgccgcgccgcgccacgccgcgcgtgcgggcggagagcgcgacggaattaatcgtagggatattctcgggccggcatttgtagcttcttccatcggagcagaggatgcaatgcaactatgcaagctcaggccctgaattgtcaaaccgtacgcctatcgcctcgacgcgccgagtgtcagagctcggccatggcggcttggtcgcgcacgccgcacgggggacggtatcctcggcaaccaggtcctctgctgtaacagcagaaaggcactgttacaacagtgtcttgagtctttagcgatagttattttgcggtagaaacagtaaccttatgtacgacaggtcgtatggtgtacggtagcacatttcactgtagaaactgatattgaccgttggactttcatctaatgttatagagatgggactaagagcaagtttaatagtatagtcaattgttggcttcaaattatttatagtcaacttaatagctaatttatataatagttacctataaatatatatactacataattaatatatggtctcacctgttatatacacatgtatatggtctcacctgttatacacacatgtattttggagtccgtgctacagctggctataaatttgtagcccgttgctcatctctctcctattttatctcctagaaatgtgtttatagctggcttatagtctgctattgtacctactgcctagtactttttttgttcttctgctctactctccttccaatccaggcttatctaaaagttgttcccctttgtaattttcttggtacaagactacaagtgccatatcttgttagatgcgatgtattttgattgatggatgcttgagtggtaatgcattagacccactatttttgcacttatttaattttctatattcatgtttcttagaaaatgtcataaagtatcaaggtaacataaccgagaggcaccgccacggtgtgagtcagggtgaggggattgatggctatggggtgagtgcaagatattccctccgtcccaataaaaatcaataggataggatgcgacgttttcttgtacaatgaatctaaacatgtctctgcccaaatccattgttctagtaaacgtcgcatcctattatagattggttttctatgggacgaagagagtattttagaaacacccatgtactttacttttacaatagtatccttataaagggaattttcatcctttgcattatatttcgaagaaaaaacaagggttttttcaaaaaacaaacaacaagctgtcaggccatgggaggatcttgcaaaatagctactaatttctcaatctttaggcttttattggtggtacctggtagatgtgcagaccggctgcaaaccccgcaccgtgcatacccgatccagattggtgacgcgtggacgagagactgatctgacggcgcgtctgcacggctccatccgcaccaggaaaaggcccatctcggctcgctcgagtcggctcctgctcgaacgatcagccggcttcgcttcgaggcggcagggatgccgtacgcggactcggctccagcaaaagcgaaatctttttctggcttcgtcttccttcgccagatcggatcgccgccatgcgcaccgcagccgccaggattccggtgctttcttcacccgccttagtgaacgacatggccagacagccgtttctctcacctgtgcatgcggacgacgtagtcgccggggattgtggagccgatgagaagcagaaaacacatgtatgctcgcctagttatttgatagtcatatttcttcatattggttgatctgtgaccatatatatgttatagattgcacagaacttcgaggggatgactatgatcatgcatgatgaagttgcacaacaggtcaatgataaagctaaacaagctttgatcattcctcaagttggaatggatttcgattttattccatttactatgttactcaactatactcttttactatgttacagtactatgttttacttccatttgcagtgtgttacacttatgatcagctatatgttgtttgagaacgattggcctccagatttgacattcaagattcagattacacaattttccagttttcatttttgaaaggaaccagacagacaaaccacaatcttgtttacacattgatccatcacattctagattttggtatacccagtcgtaagcctttgctgggggtctagacctggaaccagctgcatgagcagcagatgctttgcataataatttttgtcagaatgcagtaaaccatctgaatatccctaatttagcactgctgctatggaagcctgtgactcagtttgtaatattcttaccaacagcctactcagtgtgagcgataaatcgcatcacttttagcaaaggctaatgaactaatctggttaaactatagaaaaaccaaccagcaccctagcattttgatgaaagacagaaagacacgggcaaaggatcagacgtaacaactaaaaaattacaaaatacatgtcacttccaggttttttcttcattgcttgaatggtgctccacttgcattgacttccggcggcgcgttgcagatcctagttcttccactgccttttggcttctgctcgctctcgccaatccagccgctgcggcctacaccaaaggcgtccgatgcccgtggtcaggaggaacgaggaggggaacacggctcgtgctcgccttagccaacccagccgtcgccgccgtcaccgacggcgctcgtggccagggcccaggagggaggccgcgacggcggtagcaggcgagagaagtggccgcatcagttgttgaacggaggggattatgggctaagccaatggcgccaaggagaggcaatcccgacagatggaggcgagatggggaaggagatcgcggcggcggcggaaagggaagcggggatcgccgcagcggaaagaaaatgacgcgagtgagccgcagagccagtccatgcgcttctagttctggttgtgggagtcgacgcgagcgagccgagctgggccttctcctggtgcggatggagccgtgcgggcgcgccgtcggattactcgctcgtccacgcgtcgccaatctgaatcgggtatgcacggtgcggggtttgcagcctgtctgcacagaatttttttcccatcaagggcgcgatgacgacgacaacgaggaggaggcggcgccgccggctccgcgtgcacgcgcggcgggcgcggatggcggcggggccccacgcggctctcggcaggcggcgcgacgacgacgacgaggcggcgccgccgactccgcgtgcacgcgctggatctcaagcatctcctactctcttttttctccatagctgctacgacagcaaagtggtgtggttgtgatgttgaattactggcttccagtctcttgacgatttctctcaagcttgagttgaatccccagccaaaccgctggtggtggctgctattgctaatgttctggtagttgaggttgttgcggtactaatttctccatgtcgatatagccagtgcttgagttcttgctctcttcttgctttgatctcactcggctgattttcctagagattgtttctatggctataactagtactactgcagttgttacttgttttgatttctacgaccaaaatgacttggccgctcggacggcggcgggcgccacgacgacgacgacgagacggcgccgccggctccgcgtgcatgcgtgctggccggcagtggctggtcgaggcgaccgggcggccgtggctggtcgcagcggcggcgcccgtggcgattttcgctttttttatttttgggttttttttagttccgtgcgggcaatataatttgaccgcacgggataatcgattatcccgtgcagcccaattaacccgaccgcacaggaaaatgattatcccgtgcggttgggctgcccgcacacaaaaatattgatttttccagatgttttggtatagacggacaaatcttccgcacaggaaatttattttgaccgcacgggataatgctgtttgtagcagtgatcttcgaagactgggccgacaaatccttgagtttgacgaagtcattacaggcgcctcaccgtttctctttattccaacaatttaattttgatttcatataaaaaatacaatttaccctgattttgggttttgatattgccggatgagtttccatcagttattctttgaaaaagtaccatggatgttttctcctaatcaagctgccctccctcaggaacacaacacgagtattgaagtcaatggcattgggacatgcatccccctccttgcaaagtattgcaatttaattttctcatctaatattattagagcattgtgcaatgcacatgtatttctattttgacttaagttatagctagcatttttatatgtacccagtgccttttaaatctcttatcatcaaatttgcaaacataagttttatactgattcctcgcagcaatctagtaatatataacccgttgcacgcatgttgctagtatttataacaagaggaaatgcttaccttatacacttcatctaatatatacagaaccgatataccaaagcaactagtatatcacatgatacttttcctgaggcacaacatattcccagtgaagtgatgtcatgccagaattcacacaatccaaaaatgtaacacccccatggctgacagctttcttatacaccaaatgaaaatatatttttcttcatgtgagacggttgctgaaataagcatatatatatatatatatatatatatatatatatatatatatatatatatatatatatatatatatatatatatgtgtgtgtgtgtgtgtgtgtatatgtatatatatgtatatatgtgtgtgtatgtatgtatatgtatatatgtgtatgtatgtatgtatatgtatatatgtatatgtgtgtgtatatgtacatatatatgtgtgtatatatgtatatatatatgtgtgtatatatatatatatacatatatatgtgtgtatatatatgtatatatatatgtatatatacatatatatgtgtgtatatatatgtatatatatatgtgtgtatatatgtatatatatgtatatatatatgtatatatatgtatatatatatatatgtatgtatgtatgtatatatgtatgtatgtatgtccagatcaggacacataaaaaagagagagaggggttcttgttccagcaagagacccttcaagagaggagaattcatgcatgaaagaatttacatttgttgagagtgatgactggaaaataaccacaggaccggtgttcaaatgaggggaatataaaacgcttaactattacacttgctgcaatattgcctcaaaagaatcttagtccctgagcatgaatccgatattcaagacatataatacgatcaccaagacatccacagattttccaaacctacatgtcagaaattataaaaatgatggattagtatgttagatcagcaagtaatacaaactaacactattttctaatggttaccgcaactgtcaagaagttgcaaaatgccaccaggaagataaacaatcaatgatactacctcatttcaaaatgtatgacgccgttgatttttcccacaacgtttgatcattcgttttattcaaaaatttagtatgaatatgtaaaaatataagttaaaattatattttattgatgaatgatcaaacgtgtacgaaaagtcaacggcgtcatacattttaaaatggagggagcacttttcgaactgcactctgcttgcgttactactatgtgatggcatggaacaaatttactatgttcgaaatgtactgcccacttacgctggctgccgttgttgctcgctagcttgcgatccttgaagaaaacgaatccactgctcctccttattcggaaaacactcatcacaatgtggaatattcttcatctgcaacattagcttgagaagctccttcttcctctcttcaatttccgtcccaagtgccattgaagcttgctttcttggacaacattttttattattctcttcagcagccactggcccttgcttattggtacaagactctgtgtccgtaccaggttctgtactagaaggcgagggaccctgaacatacaagaagaatcacttgaattatgggttatgaacaagcagtttcccttgaacaaagaacaaggctacacttctgggtattctcatttcttggctgattttttttaaaaaaaaactatttcctggtagattgctgtgacaagacttcatttgaactgggttggacagataatatgccatcaaaataatgctctagccacttcaaagtccaaaaggaacagcgccgtggcttcgacacgattgtgacccttggggctttgtacatttagaaggagatgaacaatcaggtgttcaatcaatgcaatcgaacgtggcccaaagtggttgcggcaatggcgcaggaaactgtcctctggaagtttgcccgaccttggtcgcaggcgctgctagcttagttctctaggttgctaggtcattccttctgttttcacgagaataggcttaagctttccatgtttttcttttttatttcccaccttatgttctggctttcggtttgttctttccattgttttgctctctgtaagttttatttctcttaatacaaaggtgcacaatctttttgcgtattttcgaaaaaaaaagcattatttaatgtgtgtgtgtgtgtggtcgtggggaatttaagttcatgtcgaggtcatgcaacaaaaaacgaacgaacgcacgcaccatagtaacataacggaaatatcaaataccctataaaaggccaatctttaacatatcttgttttaccaaaatagcctacttctgataacaatgtgaatgtcttatgcacgggcactataatgaattgtatgtcgtagagaagaagacttgaacatattcaaccacacatattagttaagaaaagttcatagttttatttatgattagcaaggaatctgattttgggggaagaagctcagaatcgcagattggtagacacattatatttttttggaggaacagaaaataatccaaacgtataaagcatcgacttatctcgatcaattgggagatatatcaacgagaagaaggcataccgtgcgaggtgactcgaaaccgccggaagagaagaagcgatacggcgagagcggcggcggcagggcttcccggcggaggagcccgccatggctaagcaaccttggcgagatgacggtggccgccggcttaggctgtagctgggtgagagcgccgggtgccgatcctactcctgctcgccaaagagcgaacaagcgccgccgccatggtcgccggcgatcgagatcgatgctcctccccgttattcccccctcaaactcctcgatcaatcgatcgatcgctatgaataacgtggccgttcgtgttagtcggaaacgaagtcgtattgtattgggttaattgaatccatgcaattataaattttatggttttaaaatataatattactattcacttatttgtaattatgccattataatttcacaaatattgaagatatgccactacataccccttcattgtattctcttaatattataggaccaaattgcccctgtcttcttcctccctccccctcattctccccaccttctcaaccaatctcatgttcagttgttcaccagcgcggggcgtgggggcgaagctcggtttcggcttataagccaacaaacagataacggaattctccgtaggcagcagtaagttcagacttcagacatgagagaacagagagtatgaagcagattcaagcagagaaaaggcgatggagtatatgcatcaaagctgcttgcttcattacgtgccaattggatcgtacacaaaagggtctaacaacacacagaactatcctttcctattcacacgcgtctgctgactggcatttcgtaccatcttctcatacatttttgaacgaataattttttttaacgaatagcatcttctcatactgataaactcccatatcatcacactttctgatggtcattttcatgcttcatcaaccgtcgaaattgctgcaaaccaagggaaccctgttgtccttgcaagagccgagctcgatctgtctctgctacttgagaacttgtctatggtcttcgtactagcctctggtatgctggctgacttccattcatggctcaggtaacctgtgatcaaaacattttctcagggctgccctaatctcctttagcatctcatcgattccgatgtgcttcctgcagaaccacgaccgtgagttcaaagggaatgatagtaagatcatgtgagggatgtaaaacggttttcgagtaaaaagaacatgcatgtagtttggtcaactgaagagacatacagtacacttgcaccaacaacagcttgaggtcttggatagtcccgaagttccttttcaccaccttcaactttagtctctgatgaggtattatgttcgcctgtatttccgtttaaactgtcttcgcttgtattgttaccatcacattcttcacagcctattgaggatatctcaaaagccagtgaagatagcctgtcttgggcctacaagtgggataaaaagcaaagcgtaaacagtatgaaaaccgagcatgccaagaggcaaaattttcatcaagggattatagtagaaatagaaaaccacaggcttaaggtacaataccttaggaagatcaatcttattcagaaccacaacgtaaggtctctccagatattgggggttatacatcctgagttcctgtaaatagacattcaccattcaacacacatcttgacttgagaaacaaaacatagacaaatattcaattatactgactaactacccatatacaaatggctgataagattctacccaactaatataaaggactatcaaacttctctggcatagtgtgcacgactgttcaaaaaaaaaaaaaacaaaagagctattatgaatgaaggaacttcttacttctctaacaatcttataatcatccacagggtcatcagcagcagcatcaacaacatggacgattactctagttctccttaaatgtctcaagaaattgcgaccaagaccctgcaatgtaatattaagtcaagtgatgatgccaaagaaaataatgaggggaagcaacatggctattgcaaagaaacattttgtatgaaataagcaaagtgcataaaagtaaaagagcaccttgcccagatgagcaccctcaatgagacctggcaagtctgccaatgttgcctctgaggaaaactgcaacgcccctagagcaggatctccaccaagacgaccaagatttggcattaatgtagtgaatggataatcagcaatgtctggtcttgcaagtgttattgctgatagaagtgttgactttccagcatttggaagtccctgaaaatgcatgtaagacatcatgcaaacaatggcgactgcaatgaaatagcataaataaagcctaaaaaaaggaatgtaaagcatctaaacccatgtatgataatcacaacgtagacctttccaaaccaaattcttccaatatcttgaaattttcttatgtatggtacattattttgagcaagattcttgtgtacgatatataaactactaggaatgatctgaacactttcttgttcccaaaactgtgaagcaagcccaaaaccttgagaaatatagaatagagacacacataccacaagaccaacgtctgcaaccacccttaagattaactccaagcttacttcctcaccaggctgaccatgaattaacacctacacaacaagaaaaggacagagcgaataaaaaatatgatgaaaaaagaaaatgaaagctatggaattcaaatgcatgtaatcgtttgaaatcctttggattatcaaaaaccatcatgctgatacaatcacagagcgatggataccagcagttcagtactgttaaataatctgcacatgattgttggcgttagtgcttgagaatctattaatgtcttctcactatcattcattcactagtatatgtcgtggaagttttgacaaacttgaacatagcttaatgccatcgcaagaatcaagaatgcaagtagctgcagtgtgcaaggagccaagaaactgaacacaatcaagtcaactagcttgcaaattgcactattttctctgatagacccattatacaagtatctatgtggaaactacattaacagaaacatgaaactatttgctccagctaatccttcacaaaaactttaacgatccaactaaaacaggctatcggtgaaacaacattaaagctaccatcaattcaaatcccggtgtatcataaggtaacaaattaccctgtcactaacatcacgcatgatattaggtgataaaaccatggctttcctccttctgtactcaggcacatcgatcaagcttatctgcaaaaataaagcccgactgtaaagtcatgacagtatcattcagtgcataaatatttgtaaaagtagtaggtgtactttagttgtaggaagtaacaatttataagatcagtcaactaagttatgtacgccaatgaatcatcatgattaccatgcttcagttaactgccctaatagaacaatgaagtttctaaagaactgctcgaggtcagatacagttctgtcaagtaccaactatatttattaacgactggcaaaaatcaagttataatatttgatatagaattcagcagatgttttggcagtttactagatttttttttttgtggggagtttactagaattgaaactagtacatctcaaaatgttcatatgggatggctaccgcccagtttacacctttgtgtagaaataaacattgaaaaatcttagcatggtagcgaaagcttattaagcaccattgaaagatcttagcatggttctgacttgtgccatctccaaattataaacgcaactcaaaagattaaagacatcaatcgatagaaatgttcgctaagcacagcaaaaaatttgggaatttgaactacgaattcagccctcctcttgaataagcataacgatggtgaacaactagcaactcaccccgccttgtccacccctagcaacaataacttcatcaccgggatgagccaaatcagcaagaacagcgcctttcttgcgcttcacaacagtacctgcaaattcgatgcggcagatattaaccgaagaagactttaccatcacagagcaaaatgctatgcatttccaacaccaccaaaatctacaaacctacaggcacgggtatcctgagcgtctccccggcgaagccattgtgcatccgcgagctcagggttccggtggcgcccacgttgcctcccctcttggcgcagtatcgggccttctcgtggaaccggagcagcgtctcctccgcctcgtcggcgtacaccaccacatcgccgccgtggccgcccatcggcagcgccaccgacccgtcgtagttcctcttgtacgacaccttcttcacgccgctcctcttgcccttgtccgacctgcggcggggggatttgggggcgtccgtcgagggggaggccggcatggcgaggacggcgccgtggccgccgtcgcccgcgcggacggtgaccacggcgtggtcgaagtacttgtgcgcctccttggacagcgccgccgccgtattctgctgctgcggcggcgcctccctggccctggtcgcgcggcacgcgacgttgttccgcctccgcctcgtcgcgtgtagctcggggaggcgaagcgcgggccgcgcgtcgcggtgggcggcggcggcgcggtgggcgcaggccgcggcgtgggaggaggggaagcgcgggtggaggaggagcggcatggcgcgcggcgcggtggcgtcgctggctcactggcggtggcgcggcggtgtgcccggtggaggagacgataagccgcggaggcgtagcgcgtggctgcgaggaggacgtcggcctaatgggccgtggagttggcctgtcggctcggcccagcatgaagagagcggcgggcccggcagcaggttgggccgaatataggccgtggagcgcgcaatttgtgtttggggtaagtctatatcggcttcctcatttcatgtcttgctcttgaatcttgatcgaaccgcatcccttaggtggtaatcttttctcctgaagattaagattaagtttttttacataaaatgaggtggtattcacgtatgattgattgagttttcattattacaaacttgaaaaatagattaatatgatattttagagcaattttcatatagaaagttttcgcacgaaacgcaccgtttagcagtttaaaaagcgtgccacgaaaatctaaatcttcatcggagaaaagaacaggaccttaatcgccattcaaaacagatatctaatgtaaatttagaatttttggccttcgtgtatccctagaattttgaggcaatttcgtttttgcccctatttcaatgttcaatattgattttgcctatgttttttagggttttcgtttttgcccctatttttttaaacaaaacaaacgtttgcccctattccgataatcttgctagcagtgttaaatgtgaggtaaaaagacaagtatacccttagatattttccggtatttttgtaccactttcaaatttgacccaaattttggcacactttca

SEQ ID NO: 44683 - DNA, 2864 bp, Oryza sativa
ggcaaaatcaatattacacatcaaagtaggggcaagaagagctggtaatcgcccatttacctaacattggagacctttttcgggtcaattttttctttcaaatacaacttttcaaatatcaaaaccaggaaacagaacgaacatgaactgatgaacctctcaaagtaaaaaagaaagggaaaaaaaagaacgaacatggagacgacgaacagagaggcaggtagcaagtcgtcaaggtattattgatggacaacaacacaaccacggtaggtagtgcccagtttcatctatcatcatcgcttatgagtttatgaccaagagggagtttgatccctttgctcgagctaactgactgactgactccaagctagtacatgcgacgacgctacgacgaccatgcaaacgatgcaaaaagaaaacactggtaaatatgtacacagtacactggtcactggctgcaagcagccttgcacaggaagagaagagagaagatctagaggagtgatgaggctttgctccccacagaattgttacatccactttggaggtattgagattctgtctccatggcatcacctccgccgtcgtttggactgcacctgatgcaagcaggagcatatggatgagcaaacattggcagaaatgaggaagattgcatttgtaaaattgtatgatatgaattgatccacttcagtggcattgtcaattttgtgcaaattttaaacatctgacatgggttatgttcactgcaacctcctgacatacatcatatatgtaaggcgccctctggttcaacttcaattagaattagatgatcagaactatagatattcatcagtactgttggtgacgcgccaaagttttcatcagattactcagtttaccttttcttcagattgcacagtagcaccattggacttttgtagatcctttccattttcagcaatacagcttttacagtaaaaatgctctagtttcttcgcttctttgatggttatttcaacacaggaaggatgaaacctgcaggaaaatattttagaacttcaacaagatactatgaaattgctaagtgtaaactcaagaggtttctcaggtgtatattggatatagttcctcagttttccttttgttcatttcactttgactttatgagttccattacttctgtagtccgtacacatacttgacataaaacagccataaatgaattacagcatgcgccatactgtccacaatggaccattatacttgtgaggagcaatactgttcttttttctaatgttccacaagtattgactttagtggagctattctagcctgcagaaatccttataggtttttctgtagaatatatggtttgcacatgtgaagcttagcttcttcactactaataagaaacaggtttctagcaagacatacacctagctttactgattgcagttaatgtaaagattttctcaggtttggtaacattcaaaaatacagaaactagttgaatgcgtcagctgtatctcaccagtcagagcaatcctcacattggatcataaggttatcaggattgtatggcatctcacatttgcaaaacctgttatgtcaatcaacaacagatcaaataaattatttttgcaattgaagaattgagcatgtgtcatactagcaaacaggagaggtatgtcaagtttgtcactacaggttgaaaacttcactcatttaaaagggtaaagaaatgcccaagccttcaaccactacgccgattgattgcctaccaatacgtgagagcaaatatatgatatgtgcaatctgaataggtagatcttgtaactgcattctcccaattcaaacaggcgctaatgaacagcactgaataatctagcagaactgcagaaaataacggtttcaagacagactgtgaccccaatgggactgctaggataagaatcgacagggcaacatatttcaagaaattgtgaatggtgtaatcagagcaacaaggtggtagaaagatcccagacattagcattggatagagggagacaatctgaaaactatcaaagctaggaaaaattcagaagaaaatcatatgttaactttctaaagaaagccataaaccatatagcagtcaacaagatcacaacagatgaacagtttgctgaaatatcctgagtgtcaatagttctttctaatgatgctagaatatactagtagtaataagtacggaatcatgtctaacgaatttgaaggtttggattcttacacagctatacggtcaggcacaaagctgcctgtggcagatttgtactcaaagcggcaaaagaagtcctcagcgctgacagatcgaagcttggtgtaatctcgaaaggtgtggacataacacttgccctctatggtgtcagcactctgcgaatcatagtggtcagaaagaaatacttccttcgaaccatggaatggccgccggccaccaatggactcttctgggcggtagtaccaccgcaccttgatcttcacttgagaggcttgaggtcctgttgcctcaatttcctcaacccttgccacatatggtttctttgatgagtcaggtgccatcattagcacagtatccccagctggaacagacatacaacataatcactaaaagactatgccaatattatttcctaataattgttgtacctcacaaattacattaatttgctaatattggaaaacattcctgacaacactagaaactgttcatactgaatcaaagcaattacataaaagtacaagaagtgcctttcgacaaaaaaaaataccaatagttatataagataacaagtagccaagatgagtgtgcttaatatcgaatgaagttgaatgctgagttg

SEQ ID NO: 44684 - DNA, 10695 bp, Oryza sativa
tattatatgctttagtttatacaacatattatatatttatataaaatatgtactttctaaaatctgatagtatcttgatagtatggtagtatcccaatactatgatactacgaataaaaaacgatcctacctagcatctcgatattgattaccttgcttgaattccaccataaattttaacttgcaagaacttttttgtatttaaaatttaaattttgcagggaaataaataacttcagtcttcatctcactccaaaccaaaatgctaacttggttaacccaacaagaaacttggatttataaccaggagtacaccattgctacgtggaagcttatacataatcaagactacctccatcaacttaattcttccatacaatcagatgttacataagcaaataggtagaacaaggttatcaagaaatgtgtctgatcacgcaaatcaataacgtaaacaagtatagttaaacacaaaaatctaagctttgtgatacacagacaaggcaggctctgggcctaggcaggttgtgcgaccgcctagggcccaggccggtagagggcccatcaccatcatagtccatcagcatcccaggatgacctagttagccggttagcccaattgcagtgatgtcgttgccacgtcgattggcagggagggaggcacgccacgcacgcaatcgaggatcgagcccaaaccatcgatcaagggcgaaaccgtgacgcgtcggttcattacttcgttctagatcctcagcgttttctctcctgatcgcgatggccgacaggtgacggcgccacagcacgaccgtgacttcacgatctagagtccggcaacatcgtggcagcagccagccggatgctctcacgcccgacgcccatggcccatgccttgcccgattgtctcatcgtgactcggataaggttttcacttcttctgatcttctcaattttcatttgcatctatttattcctaaaattatgtttcggttttgttttgttctttttgttatttattttatcctatttgagctatttatactacttcgtttttgcacgggtttcttttagttgtctattgtactatgttttttaaaactaagcccattatactatcaacactatttatcgagaataaaataccaaattacaattttcaactacgtattattaatcatgttattttagagaatacatggttacaagtaaaaaaatccttagggcccgtagcacagagtttgcctaggaccttcgaaaatatagaaccggccctgtacacagagctaccgtcctaatcagcacatagacttctttttgcaggttgtcctaaaactaaagaagatctaacattttataggttcaaacttgagatagaacttccatctataccaatatcaataccactatataggaatgtagcatccatgatgtcccccgcaatctatccgctataccgatatcaatacctctataggaatgtagcgtctgcgataccacccgcaatctatccactatagcgatattaataccgctataggaatgtagcgtccgcgataccacccgcaatcaatccgctataccgatatcaaaaccgctataggaatgtagcgtccgcgataccgcccgcaatctcgccgctaccccgatatcaatccgctaccactccgctaacactatttggtacctttggatgaaagtatagattctaccaccaaaaacctagatttaagatctataatcgaagccaagctaacctatacacgcaccaaaatttcccccaaaacaacaaaaacctagataaatagataaaaggatcaagaaaggggtcctcacgcttgatgaccccgtcgggccccttgatggtgaacgactccagcacccgcttctgcggctgccgcgtcttggccatcctacgcggcggcgggattggagcctggaaaggggggggagcggcgagagacggcgagagcgagaggatgagatgcaaaaaaaatcttcccctttttatttcccctttgagccgaaatgcttcacgcgctcctctcctcctcctccctttttctcctcctccgcctgctttcactctcttccttttctggtttcctcggacgcgaacacggccaccggtcggatcggacgcgccgcgacgggagcccactggatcggtggcttggcgcgtcctcagccgttggatcggctggggtggagttcatcctggccgtccatttgttacggtcggcgcgagagcttctagatggttcttggataaggacaggctgagagtggaactgtgactcagtggaggatatctggattttcagctttgttgtaataccctactaaaatgttggccgtgttaaaatctagataagttttggtattatcgagttcttggtaggatagagttgtatttggtttaaggtcaatttagagctaaatttcaagtacaacatagaaagcatcaaattgaacatcgatactgtcaatgatttgacttcaaaccaaaacaatcaggcatgttctaacaccaatataaagcggcccttcaagcaaaagccaaaaagggagttcataggttgatttgataggcataatttgatagttatggttttaaatggctcgatattttttttccaaatattgcaggaattgaaccgtcccctacgaaaataggttagaactgaagtgtttcctgcaaatgaagcattgaaaagtttccgattctacgggcgccattgtttggctgattataagcatgtaagcgaaacggcatatttgcaaataaaaaataatatgggaataaaacttttatatacgtgttcctaatgatataaaaacaaagactagaaaataaactacgataaaaaaaattcctaaaatcaactccaattttaaagttgaaaattaaaattttagctgataagtataagtataagtataagtataagcgaaaagacgagtcagtatagaatttgatctgctgcttgcgaaatatactccattgtagaggagcatgggtaatagacttgtaaacatagttaatgcaattgaagacaaacaccatttcgtactgacttcctgagcatggaacaaaacgcaattcatgccgcaaccatctggattgatgagcagttcatcaaaccacaaattctactgcagttcataggtctctccagtcaagaattaaccgtctggatcgatgaccagttcatcaagctacaaattatattccagttcatagatctctccagtcaaaaataaaccttacaagcaactataaaaattagaagtatgcaccctttgatcacaaggagacccaaaaccaagtacaatccaatatactactccagctacaactctacaaggctcttgatgcagtaggtgcccacaaggaaccagccagtcatcaccgcagcgaaagcaagcaagccgatcaggaatgtcgcgccgccaaggagagtgccgatggtgatcaccagtgcaaatgggaaaaaagtcttcaccaccgacgctgtgctcacccagcgaccccgtaagaacatcacagcagcgaggctgaccacattccatttgtcatggccggagtagaacagacggttcagattgttcacgacgaaggagtggcagttgcaggtgaacaggctgtagcccctgtgctggaactcctgcacgcctttcctcagcgcgtcatcccatgttgatgctccttcaggttcaagaagcttatagcactgcagattacaagagattaatgtttggtgagtgctatacatgattaaagtattcaataattatacattacatgttgataaggtgtcactaggaggcggcaatgagagtgatattaaccacataatactaagtactaacctcatcactgtttacttgaatatatcgtgcaactgctccaaacgcgaagttatcaactgatacaaaattgggcccagcaaaatccaaaattacaccatcttctctgcagatgccaatgtgaccgataaaggggatcaaccatgagattaacggtaatggtgtccatactatacaacaaggaaagcgagctcttcttgggtcaattggagcaggctggcttctgtcggtttccatcaggacagtataagcacaagctgttggaaaagagaaacgggttaacattaaataaaagtgtcacaagcatgttgataggggtgccggcaaatacacatcaaagcatgctaggagcctagtagttgattagtaaacagtagtttattatcaatataccatcttatataaagcctatacatcaaattttaggcagagagcaagtgcaagtgcaagtggtcaacagcttaaatacattggtggaatgtagggatggatttgaggacagctgcaaataaaagaaaatcatactaagttgatttgtcatcagatagatgatagaacagaattaaatctaaaggccaaaaatttgctttcctcttaagtacatcccaaaacaaaggctgatgttgttctcagaacaggtcaggattcattcataatatttctctgggttttcatctcagaccgagtgacttcaaaaggtcacagccctttgaatggaataagtatgatttaccactaattaccttgttagaatttagaattgaagcagcttttcttctaaggtgataagcatatggtcaggcacctagcaactagcattactacacagccacaagcccagaacaaagtagaggacccccaaacctaagcctacagaagacctgcctgtaacagaatgatctatcctccactattagaggcacccaatatttcaatggttttgaacaattaacaaaaaaaatcttgcacaataattcaacatatggtaatccgcataagtcctctatccaatttataaaggggaaaacctacaattccatccttcaacaagtactagtaataaacagatagagcaaaatgcagcattctgttccacagtgtattcgatcccctaaaaactgcatcctaaccctcctctcttttttactatcgtaattgctttaacccactcgatccagctaaaaagagggaataatacgcttcctctctgcagattcagtaatcgaaatattcaagtgaggcagtaaaattttagacctgtcctggccgttggtcgccggtcgccggccgccggcagcaggcaagccccgaccacgcctcctcagtcttttgcgctccggccaaggtcgccggcggcggctcccaaacccttgcgcgcctccgccgctcggcccccctcctctcctccggcggtggctcagactcgactcaacgcgatagcgagcccaagccgagcgaggcgtggactttgatggactttggtgggccttgtagggggaagacgagagatcgaatgggcctcgtgtcttcgtgggccgagctggataatgggcctcgaatcggacattattcccagatttttgcccatgacacccgggaaaattcccgtggcgtccacgcgccgcggctggtaagagcaagatcatccttgtccgaatcggactccgaatcgaactccccaccggctacaaatacaccgatcccccaaaccctacacatccattgccaaggaggagaatccgagctcgcgacacaggaatccttccaattcgatcgctagcttgatcgcgagagagagagagagagagagagagagagaggggatcatccgcttgtccgcggttcttggagccgatcttgctctggttctttgttcttgttcttgccggaggaggaggaggaggatcgcgtcgagctccatccatggcgatggggaagtacgcggcgtacggggacctgctgggcatgaccgcgagggtcgccgtcagggcctactcgcactgcccccagacggcgcgcatgtactacaagcccccgccgacggcgacggcgacgaccgccgcgtccggcgacaagaggagcgcctccgctgccaccgcctcgtcttctcgctcctcctcgttcggcgccgacaatgccggctcgtctaccggcgcggccgcgtcgccgtgcgcgagcacgaagcagcaggcggcggcggcggccagggtggcgttcgacggcgcgggcttcatcctctacggcgtcgagcgcgcggcgtagcgcagccgcgaaaatcgcaagaagagcaagattagtttgtagtagtacgtagcggatcaaattctttgtgcgatcgagttgattttgtgatcaattcgagtagtttcgatcagtttcgggatatttgattgattcatgtgctcttgcattcttgtaatattctgcaagaaacatgcatgatcgatgttcagctgttcgtcggtcttgttttctgattccatgaacaactagtgattcgaatcaatcgaatgcgtaattcttcttcgctcccgtgtctaacttaatatgattgaattatgtaataagctgttgtgtggatgttaatggtgtccatgcatgcatggaaacaaaatctcgtgttctcttggaggtagagtattctcacatggctctagtcgaattaaaaacaaacaacatctcaaacaaaaactaactcatcaaagcttatagtccaatcccctgtcaccagtgctccctagttagcgtgtttggtcgttcagtcgtcacattgtattagcgagagtaggcttaagtctttttttccctttcccccttttttccctatctctcttctttgtttgccatttgtataaatttcatttctcttaatataaaaagtgcgcaaaccttttgcgtattcccgaaaaaaaagcatatagttcacaagcacaaacactcttcatgcattgtgtttcctcgcctgctgatgaacgattctctcttggcatatgtaatacggagtactagccagtagtaagtagtaagagcatctccaacagactctctaatagactctccaagctaaaatttagctattttgatgaaaatatacactccaacagccttgctaaacgaatggcaagccatttggctggccaagctggcttcccaactagccaaatttggccatcctccacggctggccaaaccaggttaccaaccgtgggccccatgctgtcagacactcatttgcccttttctctgttcccatgcccctagtcagtgtgagaagcaccgacgccaccatcgtcatcgaggacaccatcttccattgctgccaaggtctccatcgccagccgccgccgccgtcgtctgcaccgtcgccatccattgccgtcgtctggaggcctccggttccacccgacctcgactcggggggaggggggattcgggcagcacggcgtggattcgggaggagggggcgacctccgccgcgcggcctcctacctcgtgcatattttgctggcggggtggattctggggcagcggcggcctccgctgcctctgcctatgcctcccggggccgccgtcgtcgttgccatttgccgccgccaccatcgccatcgtttgcgggggagagggcccgacggcaagggaggccggtgaggagcggatccgcgtgatgcatcccgccggctcggtgccatctccgctcgacgttcgctgttgttcgcgggcccgcctcacgtgcccgccgtcgccttgggctcccacgaggcgtcgctgccgttcgccatcgcctcacgcgcacgcgagtcgccgtcgcctcgcccgcccgcgccttgcgcgcacgcaagtcgtcgtcgccgtcgccgtcgccgtcgccgcaccgaggtagagggtgcggggaaggggcagtagtacggaaggaagaaaggaaatgtagtataggtggggaaaaagaatcagtatggaagaagggtagttgaggctgacatatgggtcccatttgtcataaacttgtaatggagatgatagatggggaggctgttggagtaaaaaagagtttgagttgtcaaattagatggagagatggccaaataaatatttggagagtcagatttggagagcctgttagagatgctctaactacttctgttcgagcaaatgattgctatgatcaaaacgcaaatgattgctatgatcaaaacaggttcgcaactaatgcttaatgtttataattaagctttagtaaagcaatggtttgttgggtatatatgcacgaattgtttatccatcctctcctctgaacggctgagttgttagctgcacatgtacgcaatgagcagtacaagaaaagaaatactatatatgtgtcctctacatttcatatttcacaacagaaactagctgacagattctcacgactgaaacctgatgaatctgttaaaaaaaagatagtctgcttcatttcctatgactcagtccgttcacaaataggagtacttgccattcttgactgacgaattgttaccaaacaagataaggtgacactgtaattagcaaaattatagtataaacgacaagtagtaaagtaaactgatactgcagttaagcagactagcagagtaacagacaactacgttgaaattattcgacagagcgagctgcaaattaagggacgcaaaagctgtcaccatatggaccaaaaaagcccatggcccagctgaatctctccatgggctcggccttgtgaatcgtgatatcttgatctttgatctaattaatcatttaaagcgaattgatcttggtcgaagtaattaatcatttaatccaaaccggcgaaatgaacttgcacgaagcaattactgctgtttaaccatgcaacagataattacagtatattaaacaggtgatcaattcacccgactttttacctaaaaaagttaaaaaaaaatacaaccaaaccaacagaattacagactcaattgatcatgcaatcaccttcaagctacaggaaagattaatactacatgatcggatgaaaaaaaaattcacaagattaatacaatatctaatcgtaattacgcagctcagctgcacgatttgatggcagcgacgtgcactgctcttgctaatggccagcgccgggagtgggagggcactggccgccgacgttgttgccgtaggtgcagttcgacggctgcgacgacgcgttggtgccggtgccggtgccggccagctccaccgccacggcggccggcggcgcgccggcgccgcccaccgccgtcggccgcgccgccgtgctgctcatcctcccgccaccggaggtgaggaagatggcaacaagaaccgccgcgaagaaagtaacatgcctcatggtcgatcgatcaatcgactatgaactatctgtatctgtatatatatacttgctgttatctgaattatgaacaataaatgaactatgaacaatctgaatatatacttgctgttatctgaacaagatttgcagtgccttttttgttgtgttcttcagttcttgtgcgtgtatatatatacacgcacgcaggtgtacgggcacatgaatgcacgatcgagcgtgcctcatttggaaatgagagagacgtaattggatcgtggtttgactatcgctagcagccgatcattcccttggatgctggacgaacactccacaggatgcgactaattcagcaaatcttcttcttcttcttcagagcgagaagaaacagcaaggaaactaatgtaatgcgtggtgaattctcattcctttccttttctcacgtgtcaatctctctctctctctctctctatccatctctctaatttctctctcatcgttgtgcgcgtgcgtgcattgtcgtgtgtgtgattgtcagtgggattgaagctggaagagaagacgttgtcggcaagagttttcagagaaacggtaagctatgcacgcactttggaagctaggccaattggagatagatttggagtccacctgagagaaagagagatgtacgttacgtacgcgtggccgcttgtttatcaggtagaattggatcgatcgattggatcatgcaactcgcctaacacattgctctctttcggttaatctggtcagcgtgagtgtcagattcagagacttcagagctcttcgatctgtagcctgaatctgcgtgtcacacgcgctgaaaccgaccggtgcggctagccggctaccttagctgcatgccaaaattaagtttcgacaagatggtatgcccggtcagccgaaaatcgaccaaccgaattgtattaagagagaaagtcgagtcgttttttttctaccgggccaaccaaaggttggccgaccaatttcaataaaatttagaggaaaaaatacggtaaaaatgttacaacgacattacaatgtcgcagcagccagggaagcacctcatccaaccaagaacgagaaaagaaagccaaccaaatcgagtcggtttcaaaacaacattatactgtcgaagggcaaaaagccccaagaaagaaaaataaaaacaggacccaggaaacaactggcatgtataatgtcttcgcctccgtctctttgagcgtgtgttagtggtgtgtgtgcgtatgcgtcatcggtacaatcacaaaagaaaaaggtttaacgatgcaatgcatgagcaaatttttgcagtcgattctttgacattttggcctgattgactcaacctgtcgtcgacttgtcgagatgaaatgctggattgtttgacaatatatacagacaacctgacaatcccacttaaaagtataaaaagaaatacatgaaagatgtgcaaaactgcaaattaagca

SEQ ID NO: 44685 - DNA, 907 bp, Oryza sativa
cagctaatcacaatccttccaagtgatccccatcttccggagctttgtgagggtgcaagcgatgccatggaccagctcctcgcggtcagggccatttctcagcgagtttatgctgtgctctaggaagctacgatcttcttccagtgccttcagctttgcagtgagttcagagatctcatcttcaaaattaaccaagtcattctcactgaccattgcatagtactgaccctcaggatcatctttaccatttgtcaatccctctgtaccattagataagtacctgaagttgcgaccatttcttatcacattggtcatctctgaattctctgaattggtcatttctgaatcttcatcagcatcttggtatacatcctcactgtttgtgacatcaaatgtgtcttctttgtcgtcaatctttttcgggtcgatgaacttgccgttgtttgagaattggtggagattctgtcttagtttcttcaggtgttttgatatatacgccttctcgtcttcgaacaatgagagcgatcgagctgttcttgacatgctagtctcacattcctctgaacgtgaaatgcgcatcgcgtcgcgtatctcgttaacgagcgattggtctctcagcttggtcttgtagccttcgatctcggcttcgagctcttgcaccatggcagccatcttctgaagatcctcacggtcgtactggctttgctcttccatcatcctctgatactgcaaggtttccatctgcattgctgctttctcttcttgtagcctggtgatcatggacatggtttggtttgtggcaatggctgaagcattcctctcttcttctagctctttccagagaagacttatcgacttccggtccaattcgatttgcttcttcagttgatcaactgtacaatgttct

SEQ ID NO: 44686 - DNA, 12225 bp, Oryza sativa
aattgcggaataaattttacctttccaatagcattgctgaactttgcaaaagcttcaacttgcaagaattctggcaatacctgtacaattcatgattgtcaatagtatacgcaaattttaccatgatgaagtggtttagtgagtgcttacttcaggacttgcggcagcatagcttgataacctgtccatgagttgagacagcacggttttgatatcaacatttggctgccacaaaatagtaatgagtgagtaacaatcgcagtgaaaattggacagaaaattacatcccgattcttatatatcaaaatatacactgagttgtattaatttattctacggttgtggatttttgtgttaaatgcagcttaaactacagatcatgacagaacaaaatgtactacatgtacatgataaagccttttgcaaaattatgtgtcaagttcactagtcgcattttacaacaaagtagcaagtgaacaactgacacggtcaaagaccctatgtaaagctactagcatgcgcagattaaaagtgaatctgactcgcttgagttgattccctgattgagttgtattttgagacagatggagtagttaatagaacatcaggcagtgcaaatcaaattgatcaagcagacaaagacataaggatgacttggtagttaactcatttggttgacacaatcaactaaatatgtcacattataatcatccacatcagtgtttaatttctaacatgcaacgatatgcagagaacaatcaagttaaaataacataaacatgccaacctgtagttgcggaaatgcgctcaacaatgtttccaatgtctgtaaatggtattcgtctggaaagacttgtattatgcagtccatcaggtagaattgtgcaagttcatccttacaattaaccacctgccaatatatttcttcttcagcttccagtagaatcatggatcattttataatttgtcaacaaatctaattgcagacctgttctaatatccttggaaggacagtttctttgtacatgtcaaggtcaacaccctcaatctggcttagaacgtgaaggtttttgcctacctagaaaaaagaaagaacagtagcaatgtcattgaaatgacaccaaaaaacatgtagtgtagggaatacatgtaattgatgattaccaaatcacccagttcattttttttttttccccgcttttccttctctcgaacagggccctgcaaaccataatcatcaaggccggtttaagttattatctggttagataatcttgagcttcctagaggtgacatctgtgataaaagcttgtattcatgaacagcatgggaaacaatgtatgcatgcgcagaaacctaaggcggtaaatgcatggtaggggaaagtatcgcagcacttgtactcagacttcagcttgaaaagaaaaaaaaaagcttcaagttgcaagctgaatcaaacctgatgttgcattcggacccagagtttgttcatttctatgaaattctgaagaacaaactcaactgcgacgttaatgctgtcagcatccctgtgtgatgaaagttgcaaaaggcaggtataaagaaacaattaggtactgtaaaagagaagaacataaatgtgaagtagcatatactttcaggacaaaacacttttgcgctctgcatgtcctaactcccagatataataaagtgaattgaacttcatgttgcctctagtgtactgatacatgatcaagcagcgctactggcaaagtggcaatagttaagacttccaatatacagttggtcctaaataaggattggtaaattatatatgagatagatagagcagcgatgacaaataaatgaattaatgcacaggaagtcacagaatcaatgcctacaccatagcatgcacgattcaaaacgaagagcaagggaactacgtacttaacattaatttgtctatcagttccctttcatttggattttgtgattacagcctgttcaaaaggtactatatgaatgccaaattaatgttgtagaataagacaacattttacatacatatgaaacattagtttatcttcagttactgaacatttaaacagcatggcatggagtgcattacccttcatactcggaaccaatatctggcagtttgtctcggcttatctgagataggtagcttcttaggaaaagcccacgaagaggatgttggatgcctcgacacatttcaacaaggtctttaagaacgtctttcgcaggagcctcttttgatttaatgtacacagatcctactgtgcagaggagatagctaggacatgaacaacaccaaatcaggttcataccataacagttcttcagcaatttcaaatgagtcaaaatcacatcccattgtacatgcaagcatgattaaccgttggcctcacattcaggtgtgacaagtgtattcaagttggtcacagtaaaatcaccagggatcagtgttctaaagtcagtgctaggcaccgggtagtcatcgtgattaggcattagatggtgcatttaggtggctaacctaccttgggtggtgttttgttgctattttagtgttatattgtctgaatttaagtaatatacttactaatttcttgggtttgactagttggtttgacctaggcgccagcccttccaactctctagcaccttcttgaaccatgtcggcaattgaatgatatggcttatataatgtctactggtatgagcactgatagtcaagcaataagactaattaagttcagttgtaccaagtaaatatacagtagttcaaacttcaaactagtcttttcaacaaagttaaagttactcgaaagttaaactatcgaagtaccaagttctgccattgatctagtagctacaagttattactagatcgtatagagttgtaatgatctacaggactgcaatacccaccacaaattcggctccagaaacctcacagagcaagtaaaacagagctaacagcacataattacacaaagttaacagctgtttatgcctgacaaggggtgcattagtcttacagtctgggcagtacgttgccagcatgctgcacaagctcatacaaatcaacaacggagcagctgccacgacgggtctcctccctgaagaacatctccagcttccgcatctcatcaaacgccctcatatctgcagcaaaatcaataaacccccatcaaatcccagctgaaaccacagccaaaattgggcgcactgaggaatcctgacacataagaaacactcacatagatcataatacttgtgcggcgagagccgcgaggtccgcagctcggagagcatctgcgccgagtacttgagcgcatccttgaggttgttcgaatcctgcgcacgaattgccgatcggggcagatgataagcgagagggggcagtcacagaccgagggagctagggtttggcgggccttacgagggcgcggtgcatgtagaaggcgttctgctggacgccggcgatgccctcggcgagccaccgctcctcgtcgtcggcgccgccatccggcagcatcctgaccgccgccgtggccgccgtcttcgctggctgcgggggtggatctggtcggcctctggtggctcgggttggggttggggttggatctcgcctctcgcgcgtgggcttgtcccctctcgggtttggatcggggcgagtgtttgtgttcttcgagtgtttttttatgatcggttttttcctcttttttttctgttttccgaagtggttcgatgattcgatctggatcagatgagttgacggccgaactgggtctggggtgggctgacttgtcggtaaaggccctgttagtttcaaaaactttttcccaaaatatcacatcgaatctttggacacatgtataaagtattaaatatagatacattaaaaaactaattacacaattaggggggaaatcgtgagacgaatcttttgagcctaattagtccatgattagctataagtgctatagtaactcacatcgtctcgcggtttccaggcgagttatgcaataggcttttcattcgtgtctgaaaactcgttccgacatccggtcaaacgtccgatgtgacactcaaaaatttttcttttcacgaactaaacaggcccaaaaacgaatttaggcctctttagttcccaaataaaatttttcacgctgtcacatcgaaatgtttggacatatgcatggactattaaatatagagaaaaaccaattatataattcgctgggaaattgcgagacgaatcttttaagcctaatgacgccatgatttgacaatgtggtgctacattaaacatttgctaatgacggattaattaggcttgataaattcgtctcagattcctagcggaatctgtaatttattttgttattagactacgtttaatactttaaatgtatgtctgtatatccgatgtgatatgcaggggcaaaaatttttgccaactaaacaggcccttactatctaagtgggtttaaaaatatgaatttactccatctgaaacctgctctattttttttcttctaaaaaagttagctatagccttttatctctactattataaaagttgaagatgtttttatcaatactttggtacgtcctccgtgtatgagtcggtttttaagttcgtttacttttggaaattcaaatatgtatttgagtcgagttttaagtttgttcgcttttggaaatacaggaggagtcgtataagaaatatctttttagaaaaacttgcatgttaacttagatttatcggactcctaattgtagcttatgattttctacaaaataatatatccaagcgatgatcgaactcctaattgcagttcatgattttctagaaaataatatatcaaagcaaattctcacagtaaatttcaccttaactagaccgtataacaataataaaattaaaatagccttcacccgttgcaacgataggcaatttttctagtaacaccaaaacttaatacgatcctttagccgatgagagatttattcttaagagacggagttcaaaaataatttaataacttttttttatctttagaaagttttgtctaatattcaatcaggactagtatttttttcttttatttctataaaacttgtatggtattcgattaggactagtctcaacccgagagtataaatatatacacccagattacacccggagtctttgtaatctatctccacatatcaatacaattgcttttggcccatcgtcacggactagtctcaacccaagagtataaatatgtacacccagattacaccccgagagtataaatatgtacacccagattacaccccgagagtataaatatgtacacccagattacacccggagtctttgtaatctatttccacatatcaatgcaattgctttcggcgcatcgtcacctttattccgacgggactagtatcaacccgatgagttcttagttttaagtttgggttgtatcggttaaattcgatctccggcaagaaaataaattctgtcatgcaaggaagtaaattcatcatcttcgcttgtatcagcgtagttaaaagcccagaactttctcggttaagtccaatattctatagttttgcctatcagagaagacaaaactagtcatttaatacaaattatgcctaactcatctttgaactgaaccagtagtaggggcaagacactgggataacacatcagaataccatcaatgattttgtcacacgatttcattctcatttcttaacaatctcgagtgctaaaatacaccgccatctggagtagtcccaaagggaccatccaagagaattcatgcgtgaaatcgcgttgttgagagaattcatgcgtgaaatcgcgctgttgagacatcacgcatgactacgtagtagtagataaataaccacaggacgagtgttcaaataacggaatatatagaacacctaattattacacttagtgcccatacggatcttattacatcagtgcatcggaaaaaaaaatcttactccatcaatagtatgtctgagacagtccagacaagtaacatggccatcgaggaaatcacgagcttcatagttatatcaaacctaaatgtgagaaaatatatatataagaattaatatggttagttaacaagtactagtaaagattaatggataggattcaagtaatatatgctaagggttatcgcaatcatcgacaagttgcaaaataccactgcgaaatagaatttagcaatggtatctatgaatatgattgcggtaatactttgtattgtcccacttacaatgggtcctctcgcttgatagcttccgattctttaagattctttatcaacgagagtagcttaagcttctcttcatcttgcattctaaacagctcctctccctcctcagtttgccttggtgctcttgaagattcttgcttaggcgagggactctgggcaataaaaaaatatatttgaattaaggtacaacttacaagcaagcagtttcttttttacttttatgagaacaagtaatttcccacgaataaggatcatactccgtgctagcaataagaatcgtaagaagagctcctgtctaattatgtcaagataacacaggaaaacaagatggctagatagacaagaaaatgaactgattatcataatttaacctatcgtgagtacagatgggagcactaattttggttaatctaaaaaagaatcatttatttagatccagtaagagagagaagcatttaccgtgccacgtgactcggaaacactggaagagaagaaacgatacggggtgagcggcggcggcggcggcggcgtcaggtgtttccggcggagaaggccgccatggctaagcaaccttggcgggataaccgtggccgccggctggggctgaatcttgggtagagcgcggaggcccatcctactcttgctcgccagagaccgaagagccgctgccgccatggtcgctggcgaaatcgatctcctctgtctatcgatccctaatcccccctttgtacttctgtgttaaccggaataagactatgagacatcttagagttggacttggacttgggagtcttggacacgaacatgtgggctgtggctgaggccttcacctcaccgtacaaaggaatataagttcactttgactcccagtaactgaatcggattcatatccctctccctctctctttctctccccttcggccttctgcaagaggcagtcagtagtgacggcgggagggtgggcaccggagcggcggcggcggcttgggtggggaatcttggattgctccgcctagaaatttccccagcaaaaatcaaagcaacagagtcaaaatcgaagcagtacaagcaaacagatgaagcagagaagggtcacgtcctcacgtcggtgagccctggaattgaagagcaagcaaatcaaggcagaaggaggcacaccttgagctcaacgttgaggacacagcagagcagatggcagatcgtagaggcgcatctggttgtcgcaacttggttcatggacccctcgacctggaacccagcacaatcaagcaaagcaagccaaaatcagagcgttggccctcgccgcacgccgcaggagagagagagggaggggggaggggctctgccgctcgctgccgtctccgcttgcccaccgccgctctggccttgccgccgctcgccgccgtcttcgcttgcccgcgccgctccggccctcgtcgcacgccgcgggagaaagagagggaggggctccaccgctcgccgccatctccggttgcccacgccgctctggccctcgccgccacctgcgggagaagggaccggagggagggggagagagataagagagagacggcgccacaatatgcgaatgacattggggtcccacacatattttttttatccacctaggcgtcacggcaacgccatgtgaaacgaagaccaggtcaataacaccagtaaacgccacatcagcgaaaccattctccaaaatcaccaatggagtcaaattgcatcggtattaatatttggggatcgagatatctgatattgtggttgagggatatgaatcaaatttgatcagggagttaaagtgaacttagggcctgttcactttgatgccattttcaaccttacaaaattttggtaaagttatcaaaaaagtggctacatttagtttgctgccaaattttggtaactatataagaaatcctgccaaaattttggtaagttgccaaaattgtggtaaggtttttttggcatcaaagtgaacaggcccttagactgtgttcggatgtctgagttcccaactctaacagtgtgcacggaaaacggagcggtctattagcgcgtgattaattaagtattagctatttttttcaaaaatagatcaatatgattttttaagcaacttacctatagaaactttttataaaaaatgcatcgtttaacagtttgaaaagcgtgcgcgcgaaaaacgagaggagagtgttgggaacttggagttttaacacaaccttattccgccgtacaaaagtggagagggagagaaagaaggtacgcagtagcagctcgcttcctcccctctggttgatcttctacccttcggtcggccgaatcagcaagcgggaaggctggggcttgctcgatcccaaagccctagcctcctcgtcggcagatgcaaaggtttctgggtggattcgtcggcggcgatgcgcgtgaggaggcagtgaggtggatggtggaggcgggggatagatgagcggatgtgggggattgagactctgatgagcagaactgaggtgtggcaacgggcaatcggatccagaacaaaacgggtccaaacccaaatcaagttgcgggcccgataatagttgcacgaatcatggagcgatctacttcctccgtttcacaatgtaagtcattctagcattttacacattcatattgattttagtgaatctagataaatatatatgtctagattcattaatatcaatataaatatgggaaatgctagaataacttacattgtgaaacggagggagtagtggttaggaattcagctgaaaaaacaaaaaaaaatcagcaaggtgttacgtagcaaatccttaaaatttttattaataaattacttttcgtttgcaaatatgttaagccaaacgattgggtccacgaagcgtacattttttcctccccaacatactaggaaggagctttggtttggttcggtttgttattaggaaggagatatttttattattatatatacttccgtcattccatattgaaaaaaaaaaagagggagcgatgatgtggacacactgacatactccattgttaacgaccaaatccctcctcttcccatctctcctcctcctctcttctcccttactcggttactctctctcattcttctttgggcaggccggcccacgggcacgaggcgggagaaagggagggcggccggccggcgatggccgacgcgggagaaggcgagacgatggctcctcctaccgcgggcgcgaggcgggagagagggagggtggccggtggcggccgatgctggggcgacggcggccggtgatggccgacgcgggagaaggggagacgatgggtcctcctaccgcgggcgcgaggcgggagagagggagggcggccggtggcggcgccggccgacgctgggccggcgatggcggccgacgctggggcgaacttcgcaagcagacgcacggccccacacaggcacgactcctcccttgtcgcgaacttcgcaagcagacgcaggcactagcgagcggcagcggcgagtgagcccttgttggcctgttctgctgcccccatcctctgcaacctgcagcttttcttgagcggcacttgtttaagggagtgtttgggaactagggactaaatttaggcctctcataaaaatataaatccctaccataaagacttattcttttataagagggactaaaatttagccccactttagtccctctaaccaaacaccgcctcaatattgtttatgcatcgggtgtcatgtgctaaaacaagctagactgctgttgtgcttctgcaaacaaggaatcgcccaacagtagcaagaaagaatggttggagatgctttgctactgggtttccttccgacactgtagcggagctcaataatgtcagggatttgagctgatgagctttatctctgccctgaatgtttccttttgcagctatggttttggacttttggtgttactgacgtgaacatgttaaatgtatgtttgtggcttggtgaacctgcttaatggctgctataaaaccgttttgttcttttcatttggtgttactgatatgaagctaactgtaactgagtatgatgtacaaatacaagctagcagcctagcaaagcttgatcgatagcaatggcggcgaaggcgatcgactgcccgccagcgccgaggccgacgccggcgtcgacgcccagcaccgggttgtcgtcgtgcccacgcgacgcgctgaagctgcgtgtgtgcgccaacgtgcttggcctcgtcaaggccaaggtcggcgcggtggcgccgtacgagccctgctgctcgctgctcgacggcctcgtcgacctcgacgccgtcgtctgcctctgcacccggccctgcctcctcctccgcgcccagcaccgcggcgcccgcccgcgctgggccgcttcgccgccggcggcgactcagcgccgtcgacgccattcgagaccggccgccgccctcgccttctcccgcgtcacagccgccgccgccgccgcctcctcctctcccgcctcgccccgacagcctcttcccagccgccagccggctttgcccagagaagataagagaagagaagagtgagagagagaaagaggaggaagggagaggaggggagagagagagaggaggtgatgatgtggcatcctgacacatggggtcatgtgttctacgctgacttagctgtcacgcaggataaaaccgggtcaaaaccaccgaataagatattatgatcggttttgattagttaagtgacatcggatatttggttttgctgtttggggatgaatttgtaactcgatgataagttgagggatcttctgtgtactttttccttccatatcattatctaagcaaatagtgtatagagataaaaaaaaacaattaaatcttagtcgttctgaaataatcctcgtcggtccatactgcatgatgatcggagtgccaatggagtcgcgaatgaacgatgtcgtgatagaggaaactacatgccacggacaggtaggactccatcgtttaggttatcgagggaataagcgtaatgacatatttataactagaaaataatttactcttccatatacaccttctatacacctacacctaggtgtatgtattccatttattagtggatgatccattagcattaaattagccatgaaaaagaataaaattattaatttccaaatcaccgcatgcatatggcctagctgcccagcggatttggtgcaaatttgaacaagggcgttggcatgcatttgctttcaaatttgataacgtaccatagttatacccgtttttttgacaaattgacccttttggaaaacttatttcgaaactaacccctgccaaaaacttcaaccaaaaataggccgtcgcctcagcgccaaacacattggcgctgacgttggccgtgtcagcgccaacgggactggcgctgacattgtgccaccgtggcggccgggccgatccccagctgacgtggcagctacctcagcgccaaccggactggcgctgaggtgggacttggccgcaacccccaaggcctagaccagcaaggcttctggatggcttgcgggcttggacctcagcgccagccataatggcgctgaccgtgggacactcagcgccagcccacaaggcccagaccagcaagcctgctggatggcttgcgggctgggacctcagcgccagccataatggcgctgaccgtgggacactcagcgccaggtgggccttggccgtttcgagccttctggatggcttgcgggctgggacctcagcgccatccataatggcgctgactgtgggaaactcagcgccagcccacctggcgttgaggttggacttggccgtttcggccgtggcccagctcagcaagccttctggatggctgggctgggacc

SEQ ID NO: 44687 - DNA, 9243 bp, Oryza sativa
cagccctgctaaactttagcaaaactttgcacacaacataggcaaacatcaaatcacagaaatttacaggcagtaatatatccagagaaccatacaaaacatacatccatccatcaatcccaacatcattccatacatccatagaatccatcaatacatccatgtcggtgacatgggaccgggagtatcatgactagaggcttgaggcagacacaatcgcccacgtggcctggcaccctcgggggacgtcgggcccgagggtgatgtgtgcgcccacctcttggtctccccgagggggggtcggaccactccttcctcgcccccgagggccgaggcgccccgacccctcgcgtttctactccacgtgtatgagttaggtgagcacagcggggctcacctaaccgcatttattgcgccgcggctaagcgtgtcacgccacacgaagtgcagtgcagtgcactcgattatccggtctgtgaccagtcacagaccggtcaaatcgcgggttaggtggcgacaggcggtctgacgcacgcttcgccccgtcccgtcaagacgagagcttctaggcactcgtccccggctggagctagcgtgttacatcccagagatgacacgttagccccgatcaatatatgccaggcttcatcctaaccattacaagcaagatgttgtttgaagaagggcgaacatgcatgttgctaagccaacgcgtggtggacaagaatgaccgatttgtgactggtctgacactgctcatgtcgtcagcacacggccaccttcccacgatgtgcctgtctcaggcagaagtggaggtaggtgtgtgccgtcccgtcaggaggatgttcggaggacgaccgtgcaaatctccgtccatttatgaagagaagaaaagtccagtttggaaagggaaaggggcatgtggtatccccttgaaatataaaaggaggacctggcccatagagaagggggatgatctttttctagattgagaacctagaacgagggttggatcttttacagattcgggacctagaacaagggagaggttggctcacactttgtaactccttcatacacaaatccaccaaaacacaggagtagggtattacgcttctcagcggcccgaacctgtatacatcgttcgtgtttcgtgctctttcgatagctggcaatctttccacatacagagagagcttgggatcatcaccctgagcccccggccgaaccggcaaaggggggcccgtgcggtctcccggtgaggagccccgcgctccgtcaatccatatatgaagtccatatatataagaaataaaaacatcccatcgatcctcgtctatacatccagtcgagtccatacatccagtccatacatccatcgaaccatgcatcaagtccatccatctatccatccatccattgaaccatgcactcacctcctcctacctctagtgcgaggacgaggcacgtcgggggtgtacctccagtcctgcgaaggagcccgccggcgtcgtggtcgagacgggccgggctgcgagatatccggctgtgacgactctggtgcgtcctctagctgcgagggaccgagctcatccgcctcctcttctctgtcctcatccccttcttcctcctcatctccttcctccgcctctttgtcttgctcgccctcctcgtcacccacctccccttcttcatccccctcttggtgggcatgagcatgttcgaccacatcagtcgacctgcagccgagccttgctgccaacttccgacatcgctgccgtagtctctgcataaaaaataatccatgttaagttatcgcttttggaagaaaacaccgtagtttcatctctttccaacgattacctgtagggcgttgcggagggtgccgccctctccttcggagccaggagccgtgcctagcaccactcccgcgtcgttgacggtccgcaagagctctcgagcctgtaggattgaaatgaagtaagtcacaacatatatggcattgaaatgaaataatatacaacattaatgctagaaactaaccactctgtcgcgaacaggtcccgtctcgaccgtggtacctagacgggtacgagtatcgtactcgttctgctcctcaacatcctcggggtcatccgctatgtcggctagtgtccaagccggacgtaggacaagacaagacggtaggtcctgtggagccacgccaagtacaactcgaactccgtcccgttgtgctgaccctggtctggtactccattctcctcgaacttctcccattgcgtgatatgatcctgatggtagtaagcccaatcagtcaccttcttgttcttccgacggtccaccctgcacgtatgcaaaatgtccaactcaaatatgtagtaaatgttgaagtgactgattgggcaagcaaaataaattgttaagtgaaattactaacttgtgtaggtcgatactcgtggagaaacggtgcgggattgtttgaagcctcccgaattgccgcatcacgcggtggcacatctggaactccactgcatagaagcagatcagtgggcaccgtagggtcttcaacgcatcctctatatggcacatgggattcagttctagctcgagcacttcctgtgcctgatatggcatccacaccacctgcagcaacaaaaataaaacacattgaagcacatttagtactatatagtaagaaaccatcttcatgtgtgatagaaccccgaatagcttacatgttctggctgtaggtagtccatctcgtttgtgtagtggtagtacgccaaattcctgcggcctactactggagatgggaccgattcccacaggtgagctacagtgggacatcggtctgcatcctggtgcggccaagcctgatgggtcctccacatgggccgaccaactggaagcctcatccacatccaaacctgcgtcacatacgttagcttccaacatgttagcaagaaattgaaatgttatgaaacataacatgcgtgaacttacctgtagcaaccaaacacagcctgctaggttcgcgtccccgccttgccttcggcaagcatcacagagttgccggtacaaccaggctagggcagccgacccccagctgaaggtacccgcctcgtcccagtccgcgagcaacggcagccacatccaagaagccatgtctccaccagagtcagggaacagaatactgccgaagatgtacagcacgtacgccctgcagtatcgctgtactgtagcctcgtctgcctcagcgggacactgaccgaagttggctcgcaaccaactcaaaggaacccctgatgtcttcgtctgcctctgaccatcaggtgccactggaggctccagaccaaggtactcctcgaccctctccctccagttcccgacgctgtgtcacctgtaaccggaaattaaatggaatcattagtaattgcaaaaaaattaacaaatgaatacgaagactcgttagtaattccctgacgctgtgtcacctgtgaccgcctgaccccggataggaagacccaggatcatggcgacgtcctccagagtgaccgtcagctccccgcacggtaggtggaaggtgtgtgtctctggacgccaccggtccactagggccgtcagagcagcggcgttgtacagaggcaccggtcgctgcgccatggtcacgaacgccaagagcttcgcccgccgtaggtacgggacgtaccggtcgtcgaacagtatgtgcgccgtgtgacctctgactcgaagggtcttcaagcgctgcatcaatagacaaacataataacataaagttagcgacaatatatcatatacaagggttgtggaaaatacatcatgcaactaggaactttaattttgggattgagcaagaaaactgaaaagaagatctgtgtgtttacatgctctgctttgaggctcctgaactttgatttgagatatctctatgatggatgatctatctgtacaaactaaaatcaaagaagaaaaaataaattcgatcataaaaaaaatggaatattgttgatgctaacctctccgctggcaatctgtggggcccggtgcttctcctcgtagaaatcctccaaccccggaaagtgctccatcctgcaaatgaaaatggaatcattagtaattgaaaaaatattaaatggaaaaatcacaatgagaacggaaaggaggacaacagaaagtaaacattgaagcaacaatatgaacttagcaaatgaatgtcatccaatcccacctgtgtgctaccctcaccacctccccccgtcctacggcgctttttcggtcgatccttagacttgtctcgcttcgggcacctagttttcttatggcctagttcgtggcatagcgagcatctattttgcatgaccggctctgaatttgtattgttcggcttttgtgaccgtcggttggctgagcctttgtatgctttgtccatatcgttcttgaaccttcttgtccttcttcttcctcgtgtgttgttctttaacgacaagtcgggcacgaagaactctccatcataacttggccactgcgatggatctaggtaaggttcaaacctaggggagtacgagtcctgcacagccttattggaagcttcataacacattcggggggccacctccacatccaaacctcgcaacttacaaacggttatcatgtgggagcatggcaagtgatggagctgagggaactgacaactacatgtgttatctctcgcaaccacgacgtagtgacgtccaccccattgaaccccagccgccgtgactccgccttgctcgctgacctcatatcttcatcgaagggaaatcaaaacatgctgctctttgccccaaggttcgtctttgctgctcctccaacatgtccttaacttttgtgggccacttctttccacacaggatatctacagttgcctctttgtgtctatcgacaaaccaactattgcacttcgaaaatgtgtatgccacaatagctgtaaccggcagtttccgaatgcctctcaatacattattgaaactctcggccatattactagtcatgatgctatgacgacgcccgttggtatcaaatgctcttgcccatttgaccttaagtggcatatggtcttctagccacttctttggcctctctccgaccacacccatgaggcgttttatctcatctaggaacaatgctttctcatctatttgacatatgcgctcaagatctttcatctgatcagtcgtagctccagctgtgtagaagttagcacagaagtgcctcatgcaccacctgtggtgaatggttaggtgatgaggcatgatgtggatgatggagttcaaaatgccagggtgtctatcagaaattatacacacttctctattaggaccgatcaacttgtttctcaacatgttgatgaaccactcccagttggatgtattctccttctctaccagagcaaacgccaagggaacaagatgtaacccggcgtcgacccctattgccgtgagcaatgtaccttggtatttaccggttaagaaagtgccatcaattgctagcaccggcctcaagtgcttgaatgcttctatggactggccaaatatccaatatgcacgtccaaatactcgcctctgtactccatccaccatcctggacttctcgggatgagcctcaacacggaaatgcatggtagggttctttgctttgatggcacgcatcagtgtaggcaagcgaacatacgcctcgtcccaatctccccaaatgaccttcatagcaacttgcttagcacgccatgctttgccatacgtaggccaatagtgccatatttgctcaactgcctcgacaatcgctgctggagataaagttggttcagctcgcacaaatgcctgtaacctgtttccaataaaccttgaagtaagttgcaaatgcttgccggttacttccgcactacagcatgtgtggtcttcgcccaccctagtcacccgccacctatctcctccactcttccttgcattaatctgccatttgcaatggcgatcgagacaagccacagtatactttactgacgcgttagattccttcacatggtacggccggtggacacggatagaataactctgtagccatattttcagatcatccatcgatcgaaactccaaccccttccttggttcatcacacattggttcgaaggcaccgtcatattgtggatccccatcagcaattgctagcccagatctggtaagatcctcgaattgtgttatttccgggtttctacccaccagtttcgcaaacacagtcctttcatgctctgacatcttacgcactggacgatcatcatcggagtcggaagcggactcatccaattcatcctctgtatcatactccaaccagcctgggttcaatccactgcgtatcatagcctcctcacactcctctcgggtatagaatttcagcctagccaactcccttaggcccatacttacattcttagcattcgcttcttcctcaggcaactccacatcatctcctacctcccgaccatcctcaacatctccttcctctcttaccggcacattctcctccacattaacttcctcccttaacggcacattgtcctctgcatgtacttcttcccttaacggcacattctcctctgcatgtacttcctcccttaccgggtcattctcttccctgacctccacatccgccatatcatttactccctcgcccccctccacgtcttcctcaatcaattcttccttcctactacacctctccgacagttcgtgacagctaatgggtgattctatgagtggactttcattaaggtctataagttctttcttccctatcctaccatctttcttccatgcaaacacctcaagagatttgaaatgtgaccccaatactatatctatatatgtttgccattcgatctctccattcaagtctaacataaatttatgtgacatgacaccgccgcccacatcgtatctcccttgcataccaaccgactcatcattccaatccaattcatgcttgatgcgagacattaactcctcaaaggtaggcttcgcaaaaaacactaattgtctaactgtcattccctcaaattggcttccatgtgtactttcatctaccacacaaccaccataatgaagccggaccaatctatccatctacaatttttaacccatgcataaacattaattacttgaaaataatatgtaattaccattgcaataccaatacttcaaaagctaacaacatgtctaatttttccaataaataagtacattactcaaatactacacattattgataaaaaaaaactctactcctacaaattacctacccttcaccacacatcaacccctttcaaaccctctcaatcaccacaaatccatcccacatcctaggccatcaccacacatccatctcccatcaaaccctagtgcatcaccaaacatccatcccaaatatattttgtcaaatgtatcaataacaaccaaatggataaagatatgccacctccacatttcatccccacccatattatccatctaataatccatccttagccaactattatcaaaccacgtctacaaccaaaacaatgcaaaatatccaataaaactttggggaacttagggtttatagaggggtttaccttctcttccgatcccaaactcaatgccgcacaaatcaccttcgattagagaggtttttgggggagattgggcgaggagaacgtggtggcgaccgaaccctaggcgggcggctggggaaaaaacggaggaagaactggctggggcggcctcggccgggctctaagtagccaaggtcagcgccaacttacttggcgctgaggttgggcacctcagcgccgaagcggttggcgctgaggtagctgccacgtcagctaggggatcggcccggccgccacggtggcacaatgtcagcgccagtcccgttggcgctgacacggccaacctcagcgccaatgcgcttggcgctgagccgacggcctagttttggttgaagtttttggcaggggttagtttcaaattaagtttttgaaaagggtcaatttgtcaaaaaaacggtagttatactctcttttctagtaagcaacagtatatactgttttttaggccagtatatacactctttgtagtgatgagcagtaatatatatatactagtttttttttgtgtattagcagtacatggtaaggattaccttatatttttgttgtagcagtgtatacttatttttgttagcagtcgtatatacttacttcagaattaactagtatatatactgattatttctttttttaatggtacgtgcagtatatactgttagaacgactgaatgagtagtatatactgatttttcttggaatgagtatatcctgatttttttggaacgagtgagtatatactgaattttttttgggaatgattagagaaatccgattataaacattgtagtatatacttttccccacttagtagtagtagtataaactttactcgttttacttaattagagcagcacatactaattttcttttggttcagtatatactgatttattctccgaaagagtatgtactggtttctttcccaaagtatatatatgaatgtacatatgtactgctttctgcatactctagtagcaatgtagtatatatagtatgttcacatactcttataagtatatactgtttactgtttattggaacagtatgtactgttttgttaccagtatatgctacttattcctttgaacagtaactgttttcttgaattttctggccagtatatactacattagtattgacggagcatatactagtgttttcttaatttggtcagtatatgctgctatacttttgttcggtcactatatactgcatctcatcgctaaaggagataatactgctttcttgtttgctcagtatctgcatatactactctttttttcttcagtatatatatgatgcatatactgcttaaataagtatatacactatttcttagatttagtagtatgtaccactattacttagataaaccatatatagcttttcatgtgtgcagtattatatgctttttcacgagaaaaatttagaagtatgatacaaaattcatctacaaatacaaaaaacaagaggtatatatgagctcatgctcacatgattcaaaatcaactagtcgatcgaaaaataaagaaaaaagaaat

SEQ ID NO: 44688 - DNA, 6774 bp, Oryza sativa
tctgtatcgggagagatatgtgtcactttaatgaaaaaaaaaatcggcaatggtaattaaaataatccttgaataattatggattaaatcttattcaaaatattaacgggccagtgcagctatacccgttagggggaggttcatcgggtaaatcgctggttgaatggatggacggtaaatgggagcaggtgtacttactcccagattcattttctctcactctctctctctctctctatatatatatatatatatatatatatatatatatatatatatatatatatatatatatatatatatatatatatatatatatatatatatatatatatatatgttcatgtgtgtgtatgatgaaaactccaatattaactctaaatttaaagttaaaaatttaaattttggcttatacgtgttagtacaagccaaaaagataaggctagtaagcacaccataatctacacagagatctcgtccgtgtcgtcaacggtttgttacttgagctgtaataaataaatatattctacgggagacttttatgtgcttggaatatatgagatccgttgatcacttctatgtgcgtccgaatgactcacacaactgacatcaatgaaaattaatctttgagaaaaaaaagatcaaaacagtaattatttgtaggtttaaatgtttaatccctgtaaattggcgcacctatatactccgactgcagatctaatagaaaatcatatactccctccatatcatattataaaagtctttttgacttttgttcctagtcaaaattatttagatttgactaaatttataaaaaaatttagcaacatctacaataccaaattagttttattaaatataatattgaatatattttgatagtatgtttgtttcgtattgaaaatgttgctatatgtttctctaaattttaagttttaagttttaaccaaatttagagaaacatatagcaacattttcaacattttcgaacttaaaaaaagtttaactgaaagaaaaaattaaagtgacacatggtatgaaaccgagggagtacattctaattaagttcgaaagaggggaaaaaaaactcattgtcgacatattgaagaaaaaaaaagcagctgaaatatcgtttttgacaaatataaatgcagcagcagtagatgcaaatagcaaaagtatacggatgtactgaataagaagatgaattgagctgggaaaattgatgagtatagccactcgtaaaaatccttccttacatgcagatcgtgtaccccatcgatctaaatccctttatgaccacacacaaactgtcatagaaactaaccaaacaacgagatttgacaaccaccaaggcaccaagtgaccagacaatctgctccgagtgacgatcatcgttttctcagttcgagtgataatccagagtctgcggagaagagtaagatcaagcttcaataagcactccagcaagaaaattaagaaccagaacaaaagtttaacacaatgatctaccagtatgaagatctatttgaaatagaatggctatagagcttcaatcatattaaatcgaatgcatgtatattaagctattaaccaacaaaatggtggcataaaaagacaaggaactactttttcccatcctatctagtacttccatagtagctgttgcaatggactcataaacaaaatcaccatatttaacagaataatatggacttcttaccgcccgtacctatttgccatcgattctggacctcatgagggcctccagcaatgttaggcagtaatactccgaccacacatcaggacgagccttgcatttctggaatgcaaccactgaatctgccctaaattgagcagacttagcaagctctgaggcgatctccttctgcatcgcgttggctgctgcttcaatctccagctttacttcagcacgaaacttgatcatatcctgcttgaggttagtctccatcttcttcatcttgtaatgaagagcaaggtggagagtcaagcaagcaagtcctaggagcataacatactttttcctgttccaaaaaatccagtcacatgaactatctacgactaaagttcaaaaggaagaagggggaaagagttgcggacttacataggtgggatgtcctggaacttcgtcttccagcctttgaaagctgcatggagaaccaaagccatatcctgcatttaacagaacattaatgcgcataaacagacctttgtggaaaaataaagcatgtagagcttttcttttaccttgagaatccccatgtcctcgaaggagtttgtaaagaaggcccttcgatatccccttggcgcagacgtagagaaactacagattccagccccaatcgcctaccacggtagaaaataaaagcattttagatgcatgcgggatgcacggccctcagcttgaagaggcagagaaagaagagataattaccctagcattgctgagactagagcatatgtttccggcaaccttcttggtaatagtgtcttcgacctaaaaacacagcagttagaaagagttaacattaggagaagaggagacaaaaggacaagttgcggcacccccagctagttcaaaagcaataatgtgttaccatagtcatcagcagaagcttatgcggattaatacatatggtcttttccttcatgagagagtgatagtactgcaaaaaaaaaaaaaacataacagtgcaatgtcatgaatacagacaactattctttcaaacctcacaagacagtgaaaaaccagatttactggatgagttgaaatccctaaaaccaccaccaccaacacattgacgattttgggggatttcaacctaatctatgagagaggagccaaaaaggaagccaaatttcatttctggatcaaggtaaatggtttcaagcaagtaatacaggaagcatggaacaaggctgtacaaactgatcatccagtaaacaagatgctcaacagcactgcaaaggccctgagaatttgaagcacaacacaatttggccaactacaagcttcggttcatatagaggctagctaggccttgcacaacaaacaagattgctgagtcctgaagaaaaggtatatatacaggaaatatttaaaagccaggaccctagtactagtagcagtgcccagggcaatgaaaaagcaatcaacaagaatttcatggctcaaacaggggacgcaaacacatagattttccacacaagagctacagccaggcctaggaagaaccacataaagcacaatgggagacagtattagtatacacatggcaagacacagcaagacaagtcaaaaagctattgacgatcactttcaacagattttggggagaaggtttacagatcatgcacaataaacgatcactttcaatagattttggggagaaggtttacagatcatgcacaataaataagttgggacctgattcacatgagatgagcagactccaaacaacagacaacaaacatggatgaggttttcggcgatattgtgacaatgtgaccaaacaatcaaatgatttcatattaggttctcaccctcgtggatccaggaagaaggaagcggtggaacatggcaaagttcaaaggcggagaagggcagaacagctgcacaaacaagagaaactcgtaaagtgagagaaaccgagatggggaagacggatcgagacatgcaacgcgagatccggcgccacgcgtgcacctcggaacccctcctcttcccggctgtcgcgatcaccttcacaaacacaagaggaggaacagaataagtgagaagagaccgagacgggggcggcggtcgtgatcagcttcacaaacacaagaggaggaacaaaataagtgagagagaccgagacggggagagataataaacctcggagcccgcagccatcttgagcaccttcttcgccgccgccgccgccgccttcgccatggtgagctctcacgacggaatcgaggccttggacttgggagagagagacgaagtgtggacttgggcgagagagagagacgaagtggaggggtgtttggtgatgcggattaaaccccagttctacttgagtcacccgaacccaagtacccaacccaaccccatcgcggcgtctggattttttttacttttaggtcccttttgaaaacctattttataaataaaccttttaaaaaacttatcctaagaatgttacccttttcgcggcccaacgggaagggtcaattcttgaaataagtattttagggatctatttgaaaaataatttttcagaaaggtctaaaatgtaaaaaaatccggtctcctcgcctctctttccaacccactcactctccttcttcctcctctaaaccctaaaaccacacggttcctgctccctcacccatcggaagcggcggcggcggcggtggtgggcatgggcgccttggcggcggcgacgtcgtcggcgatctggctcgtcgaggacgacatcctcctcaagaacgccgtcgaggtagacgatccccccctcccctctctcgccccggtcccttacaattcggggcggctcgaagtctgttcgtctcgccgcgtcgcttaggttaggcttcgattggagagttcgggcttcgttcttaagttgtttatggcggaggtcgacggagccatttttctttctttaaattttttgtcatgatagtcaggtcgtcagggtttaacactttaaccctcggccttgcgaaattgctcagctgttagtccgtatctaatttgggtggttattccctgtgcggagtcctgaacaccgttgtactgaatcgctttgttggggaatcaaaatcttgaagcagcatagggatttgttttcatagcagttcagtggctctgctatcatctagccaagaatttaatgtggcgcgtgtgcaaccgggtcaggtttgcaggacacacaccaccgggtgcaatttctattgaccccacacagagaccagtcgcttgacattttgcttgggagaaatttgcatactcagtgtctgcaggtagatcctatgtggtggaggaaataataatgagtgttatattcctctgcaagagtttttgaccgttttatttgaatttattttcaataaataaagcaaattgtttaggtcttgtatgcacctaccatggtgtgattgatctatagtttttgtacaagactgccctgattaatctatttaatcccatgcgttggtacctgtaattatatgaacacattccatatagtgccatgccaaattctgtgattaactagctttgcaactcaagacaatgaatactgttttatcttacatggcaacttgaccttgtaatcatagtaagtgggcttatcatattaacattattatgcctatctatgaagtatgcgagatatttagtactccaatcctgagttagtcatgttgaatactagggatttgttcaggaaaatttgatctgaagttagttaatctccagtctgcagggtcaggcaaaccttatctgtgagacattcttcatataagttttaagtgtctagctgcatattcgttgtgaattctgatgttgtgaatggttccccatctcttcctaactgattgttatgatacttgtagactggtgcctcattggaggccttggcaaaaggagccgtatgtttctcccgtaaattcactcttaaagaaatacaggatcgttggaattctctgctatatgacccagagatctcaacacaagcttctgctcgtatggttgagtatgagaatgatctttccacttccaatcctctgaaggctaaagttatcaacgcaaagcaaaaggatttgtcattccagaaacggaaaatagatagtgtgaagaatcaatattatgcgatgagaaagagagtccgcaatgaaccatgtagtactgtcgaccttggttttcttattgacccttgttcatgtacaatgaatggcgggcagtgtgtatgtggaggcctagataaacattcacaaggtcaccatgtggttcataatacagaaccaggggtaagtacaatgaactgctttgggcaacaggatggaagttacaatggtggacaaactatgtttgttggaatgaatggacattctttccctgcaaagcatgctgagactgatagcatggttaaaggtggagatattgctaatagtgtcccgtatggctattctgatgtaagtcaaatatatgagcaagatgcatacacgcgaaaggaccctgatactaatgaagggaacaatgtttctttaaagggtataacagattttcagggttccatgcagttccagaatctgggctctagcaatcaatgtggcagcaaagtaacagaatcaaagacaatagtgattgctgatcactgtggagttgaacatgtccatttccctgtgaacagcagttcaagaatgcaagaacctggctcactccaggtgattggccaaccagagggttctcaaacaccagttggttcaatctggactgaggttgacgaaagaggcacatttactcttgacgatgataagaaaataaagacagacaacagtgaccctctagcattgcaaccaaatttagatggtgggatttgtgcagctggtttagatcatgcagccataacagaaggtgatttcatggattttccctatttcagcaacagtgaagatttagatctcctgaatggtgaaaactttttgaatattccacatgagacaaatcaggaggatttagatgatcctgatcatgtgaaa

SEQ ID NO: 44689 - DNA, 1085 bp, Oryza sativa
ttcctgcagcccaatgaaagcaatgggagctatggaggaaggagatgctgtgtttggttcaggagctgaagtgaaccttgattcacaggtaacatgaatttttttatatctagagaaacagcaatgctatcactgtaccaccttgccttctaaacagaacagtatctgatacccatattgcaatattctgtgttgtaaaaactttgtggttggaatgcttttaccagagtccagctctaactctgcatactttggcaagtttttagcccctacagagctcataaccacccatgtctggtaaaaggtggtcctgttgaatcatgaaccttatgcaggatagctttacactaatttgttcattgaacaaccctctacaacatggtctgtcacaaagaccttcactgcacttgttatttcctcatttaaccccaagatcatttgatctggattgtgcacataatattagcccaaagcaatattgtggaggctggcttgcttttacatgctagaagatttatttaacaacttaagtgcattgatctgcttccagtgaacttgaatgcaagctgactttgtttctgatgaaaatatgcctgtttaatgtgctcacaggtatattggtggcacgacaagtatcgaccaagaaaaccgaagtacttcaatcgggtgcatactggatatgagtggaacaaatacaaccagactcactatgaccacgacaaccccccaccgaaaatcgtccagggctacaagttcaatatattttaccctgacctggtggataaatcaaaggcgccaacatacacgatagagaaagacgggagcaccggtgagacatgcctcataagattccatgcgggccctccatatgaggatatagtaagcctctattcccatatcttcaaatttaatcctgtagagtttcatgggcacttcacttaattactctgttttcttcaccaggctttccgtattgtcaacaaggagtgggaatactcacataagaagggcttcaagtgcacattcgaacgtgggattctccacctctatttcaacttcaagcgctaccgctacaggcgataaaa

SEQ ID NO: 44690 - DNA, 2797 bp, Oryza sativa
  unsure (1)..(2797): unsure at all n locations
cttgacgttctccttgatcttgggaagctggcgcacctgcacagggccctatcgcgccacagcctgcccgctgctgccaggggtcgagccaccatccgaactctctccttccacgtagtagcgagcgcggaatgcagcaagatgagcatagtaggccggtgggactgcacaggaaagaaaaagagcaatacatcagtgaacaaatgcaacagatttgaaaaggagcaccacgtagaaaagaatctctgtagttcaattgctagtgcctagaaagtagcatgagagcatcgcatgcgaaatgataggattcagcagatttgaaaaccacatgtttaggaacagttaacatgatgacattgatggtgcttgacaagcaaataacactaggttcgattcacttcaaaaagcaagatcacatgatgtgcattacatacagtagacagacacaatttcaatcttaatgaaatttggtcggctccttcgccgacctggcaaaaacacaatttcaaaacatgctaaattgcacagataggaaaatgagtactacatcagtgaatagaaaggaaaatgtttcggtagttcaattgctagttccagaaagtaacatgggagcatcacatacaaaatgataagatacaaatggaacacattcgaaaagaaaatgctgaggacaattttgaaaagcagatgttgtggaacagttaacaagatgacattggtggtgcataacaagcaatgacagctgtgcagttcccttaccacatgatgaattgggtgcattacagtaaacaaaggtccatttttaacacaagctaaataaggatttctactgttgagaacaacagcctactcctagcgcttatcttttccagttcacagttaaaccaatgccaaaaattttggtgtacacatttgcttgctcatcgaaggaggtaaacaaagctaagcaaactaatgcagaaatgagaaacaaagatgcaagaaagaagactcacccacagacactgcccgggtgcatcgcgcatagctgcattttgccaacagtaggaattatcagagttggggcagccgaaataataaggcagctcagcaactaagcagaaacagagaaatgaacttacgtatagcaaagattgttggtcagggactgaagtgcatcggctgtaaaatggttctcatcgtaaaggacatggtaatgagttggcctgctagtaccctgagaaaaggaatgtcaagagcacacattaactgaaaattttgttggctggaaaattttgtgcaatctgcaaacagcttccagcatgggttttacctgtatgccagcatggctacacaggtagaaatcgaactctgtaggatggcaaatctgacggtccacgacagttcctgcaggaccaaaaagaaacggaatacaacgatatatccaatcatcaaatgcctgaagaagtagcagatgtatgttctcagtagcaaccaacaagaaactgaccaggaaggatgtttccgctcttgtcagtcatgtctcgcctcccatgaacctctgggaaaagccttgtgtgatgccttttctgaactactacaaatgtgacaggtggtagatatccctcctccaaagatgcacaagccttgcaatgtaaaaggattaaattcagaaaaaacaatgaaattggcttgtccagaatagataacacagacagatgtatcatgatgcgaagctcacctttctgatggcatccatttcatgaagaagcacatggctgaactgaccttcacttacaccatctctgcagaggagaatgaccactcaacaaatttcatttaactggacacaccactgaacagaacagaatttcaggancatacctatagaagattatcctctcaggctttctgccagtcttcttgcggaatgcgataagcaactccctgtaaacaagagcaggtcagttcccagttgaacctacaataatatacaattgcaataccacattgaccacaaatttacctgatcatcccaccatttacaaccttcactggatctttaccaacactaaagagatcttctattatctcctgtctatgtggttgagcagagaccagacctcggtatttggtgatttcaggccaatccatagatgccacaacctacatgaacacaaagaaaatataccagtaaagtttgtatatgcaaagcaataaactttgggaagaaaaatatagttcatctattgcatcaagttattcacaggatagcccatgatcttgtattgtaggacaacatcaaacagaccaagtaatgaattgaagaaccattagttaggagggtactacccgcagcaatagatgatgcagagtcctctccaggtggagggtgtgtgacatcagcgccaaagatgattgttgggacttctgacacaaatggtatgccattgcggataaaggctcgctcaagaacagtgttgcgccctccgacctggttatggcacagaattgtcatacttctgggggagaatactaaaagcacacaagatatagtccacagaattggtatagttctagggaaaaaaatacaagcccagcagaattacagaccttgacattgattttgagtgcaacattttccaaatattgcttgttcggcctgctggcatgccttggcaaacaacattgagatacaatgccaaggtcagtctcacagacccttttaattttccctgtaaaaaccatgcatatacgacatttaataaataaatcagggaatggaaaagttacccaaccaacaatatacataccataa

SEQ ID NO: 44691 - DNA, 12888 bp, Oryza sativa
  unsure (1)..(12888): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatagattgtatggaggaactcatctatcagtgactggtgtgtcatcgataaggtaaggggactccgctaatgaatcttagtgttgctctacttactttaaacaatgctgagttaagggttgtacttctggttggtttcatccaataacccttcagttgttatttggcatataggtcagatctccggacagattaatcttgttagcatcatcactggtagttttgcaatgacatgatggcaatcaaaattgttgaggaatatttattcgagctctatgcctctattgctttcctcctgatatgtgtctcattagttctaaaacaggattcaatgtttgttaagccttctcaaaatagctaacatcactattaggctgtttaactgggtattctatttggggtcactaagtgacaatatttttgtcgcagagttcagtcgattgaagtagcagaaaaggaagttagtgctgacatctttgtgcaatctgatggggagcattttggttttcttccaaccaaattttcagttcttcccggtgcagttgatttcttctgctagattagtatgcttcttcctgtgggatacaaaggtttcttaatccttgtcaagtcactacgtgtactttgaactagctgtgttattttgaagtgatatcgtaattgaatagttacattcattttctggcaatacatgggataaaatctgttgtcacccgccatgtaatgactataattatatgcaacatttgctaatcaaactaccataaaaatttggtggtgacggtgcactatgaactgtttgaattatactggaccaaactggcatcaatgtaaatgacacaatgacttttaggcttgtaccctgtgtaatttatacttttgccttttgctcaacaacagaaggacatagttagctgcagtttcaatacaaaatttatttaccttcagcttccaacttcgaagttactattcttactcatagtaccttatgaatcagtcacacgatgtactcctatatgagactgatgctgctagaattcaccacccaacgttttctcaagagtaaattgcactttacactggtaaaacgcacctatttttgctttgtactaattttagcacatactttcagtttttatcagttgtactccctccgtctcaataaaaagtgcacttagtattgggtgtgacattttatagaacacttatatgaaatgtcacatccgatcttaggtgcacttatattaggacggagagaatattgaaataagtttcactttatgttaggatacatcatcaaacctatagaaaattcactaacttatataaaatttgaataaaactttgtgaaacatgttctaaatttgaatgggtccataaattccacttgtgttttataagattttctttcaattatgtgctgcaatctagaataatatacctgcatggaagtcaaaatatgtactaaagctggtgcaaagccaaacaaagatatgctctacccaatgctatgtaattcctccgtcccaaaatgtaaagagttttggttgaatgagacatgtcataatactacgaatctaacagtagtcttacggattaggatgtgtctcatccaactaaaacttcttgtattttgggattgaaggagtacaatatactcttctcttaatttgtttggttcatctattattttttaatgggtatagtattttgttagggggagtactaatcaattacacggccgtacctgtgattatgaagtcgatttaaaatttctttcttgtgaagtgattctcaagcagagtatttgctgtttgttccttccatacgtaaggaataatttctgttgcttgaaaatttaaatggccattgagatactcctagaaagtaccctgtcccctgatgctgcggcaccagactttaaccctgtctatgacttgactttattctcataatctgccatgttctcctgtagccctgtcgcttgaccatgacgacgtcatacttatacgttctgaccttgtaaaacttgtactccctccgtcaaaaaaaaaaaaaagacaaaccctgggtttccgtgtccaactttgactgtccgtcttacatgaaattttttataattcgtattttcattgttgttagatgataaaacatgattaatattttatgtgtgacttgtctttttaatttttttcataatttctttcaaataaaacggacggtcaaacgttgaacacggaaaccagggtttttctttttttgggacggaggtagtacttcctccgtcccaaaataagtacagccatggttttccgcgcccaactttgaccgttcgtcttatctgaaaattttttgaaaaaatttgaaaacataagccacgagtaaagtactattcttgttttatcatctcataacaacaaaaatgctaattataaaaaaaattaaataagacgaacgatcaaagttggtcgcgagacgaaggtagtactacttacagcagctttggtcatgaacagcgtgaaaagaaagtgtgttccttctccgctgccgcctgggcaaagaagacgaaaataatggtagaaactggaaaaaggaaggaaggcttgtccaaagcataatccaataatcctacgtcgtgacaggtacggtatccgttttttccccgtacgtccttcccatgtgatgcgtcaacagttaaaaaattgccctcttttgctcggctcatccgcgcgccgcgcgcgtctcggccaacattggcaaacacgcgacgcagccaccgttccgtccccgcatcctcctgcgtctcctcgtgctcgtgcggctctcgcgctcgctgcgcgcctgcgccgaatcgagcgaacgccgcagccgcaggttgcagcgcgcgcgcgcacgtcgtgtgcccgtggctgcgtgccgcgagtcgcgacgccatgctaaaaagaaaaaaaatatcaccggacgcatcgcgtcgtatcgggcggagcacacgagtcatggacctgtacgacgttgtgggggcgtgagttttactcgtcctcatgtcatgtcgtccgcgagaagcaaaaggaatttacgcacgcgctcgtgggtcgggtcgtggaacgtgaacggcttgtacgtcggggtatatggggacaaaatggccttctgttgcgttgctacaccccgtggttggcgttgcacgtaaggcatccgatcgagcagccggagcgagccggggtccgggggtctgattgtgtgaacgaatcagtgatcgcctgaatggtgatcggagcatatatgctttggctggcccggcgtgatgattactgcgtagcacagtagcaggacgcactggaacagtactagtaagaaggccatgattattatcgtgattagagtacacagcctcgtaattgcacatacgcaacggaggcgctgccaggtgtcgtgtaccattcttttggtattagacttgccatgactatcgtgtgaatgcctgaatggcaattccgagccgtagcttgcgtacatcttaaagaaacccactcatcgcgatgacgctatcagccacatgaacatcaccagccagactgtatcctcagggagcccggccgccaattgagaaaatctgcaaatgggtacgactgctaattactactatgatttaataacacaatagtagaacagtgtgaaggtgatactaccaaatattcgaagccttctctctctatctctccacgagtccatgtcaaatggagaaggaaaagggtggagctcttttttgcttggccctgcatgcgtctgcgtcagagcgcgcacgaccagcacacacacccccacattccgttggtgcagtgcagtgcggtgcgcgcggctcaactttgaaagcggacggccgactgactgacggctcgacgtcgccgtgccgccgagctgtcacgcagctagctgacagccaatgctaatcttggaagcgcacgtcacctaactcctctccagaatccaaatcacaaggggccccggcacacacaagtttgcaacgaggtggtggtcctcactcctgaccgtctgtcctagtaatgcaaggggaaattatcctctgattgttgatttgtctccacatattaggccccgtttagttcccaaaattttttcccaaaaacatcgcatcgaatctttggacatatacataagcattaaatatatataaaaagaaaaactaattgcacagttatggaggaaatcgcgagacgaatcttttaagcctaattagtccgtgattagccataagtgctacagtaaccacatgtgctaatgacggcttaattagtctcaagagattcgtctcgcggtttccaggcgagttctgaaattagttttttcattcgtatccgaaaaccccttccgacatccggtcaaatgttccatgtaacacccaaaaattctcttttccctaactacacatacccttgggagtgttcgttaggtggagataggagagattgtctatcgttttccgcgcgcacgcttttcaaactactaaacggtgcgttttttgcaaaaaatttcaataggaaagttgctttaaaaaatcatattaatccatttttgaaatttaaaatagttaatactcaattaatcatgagctaatggcttacctcgttttgcgtatcttcccaatctcctcaatccccttctcttcaaacactccctagtcactttcggatactaaggaagagctacggcttgaacaaaacgcataatttccagtcttatcctctattcaactcctcattgtattaattgctgctcccttcgtttgaagttaaaataattatagctatatattattcagataaaaataactatattttagaatattttagaacagagaaagtagaaaggagctctcacgtttggccataccatctagtaactatgtcaaccaatagatcatacttcctccgtattagccattaaactgatgagtatcggtaaagaagttataaaatctcattacaatgcgtgggatgcgcgatatagtcattactatattttaactcagtgttgtggaagattaagggcggttgcgcaattgtcatgtatctcgtgtactgtcaatcataagtttcaattcatctatacccctttaaaagtctttaatattggttgcaaagaatttgccctcttaccattgcttttgtagtttttagaaattgcatcattatgtttttcatgacaattgctctatccatatttgaatatatgagattattcggttatatctttgaaaatttaaccgtcaatagctctaaaaacagttagtttgaaacacataacaatcatatgggaacatttttatttatatgtagttttacaatataataattttgttacttcctcaatcccaaaatatagctatctattactccaggagtacaactatagatcaggacaacttggtagctatgagccccattggttgtcctaataaatcaaaaccaaagccagaacttgaatttttaagttgaatttaagatattttcaatgtagttttttatattgggttttaagtcgctaataacacatatataaaagtgttacctataaattaactttcattctctaataagttgtttttggcttattatgatatatgtgcaatcgatgaggtcttatattttgggacggagtatttaaatagaaaacaataggtcaaataagtctcagtaacacctgagatcctgggttcgattccccacgggaatgaatttttcaggatttaacggtattgtgctttcagtggtaggcgacgtacctgtcgacagcgagacgcctgtggtgacttcgtcaatcctaatggatttgccggcccagtcttcggagatgctcataggggtagggtttgcgtgtgtttatagaggtgagtgcatgtgcgttgtgagtgtctgtgttgtactgtataatttttttttaaaaaagaaaagatagatatggtttacatgcactcttgctcagagattgaatttcagtggtgctgtagacctgtggtgcacaccatatccaaattaccatcgtccctactacagcactactcctttcttagctcactgtcggtgggtccacatgacaaactgggcccacctgtcatacgagcgtctcaaatcggtaacaacaaactcgctagcctcaccacctcaaaactcaaaagttacccagaacgctccccacgccgctctctcgtcgtcaagtcgcatgcctatgtaaagcagagcgaccaaagaatccaaggaggccaaagcgctctctctctctctctctctctctctctctctgcttcatcagctccccgtggcggcgatggcggctcagaggaggctgctcgccgaggcacctccgcaccagccgcacccctcgcggcaccagcagggcgcgccgtcgtcggtgtggagcgccgggtacctcaacgggtggctgtcgcagcgcacggcggtgttcgggctccgcctctgggtgctcatcggcatcgccgtcggcgccgccatcgtgctcgtcctggtcctcgtcttcgtctgcctctcccgccggcgccggcgccgcgatgacctcgcatccaatctgtacccggccgacaccaagattctcaagcagcatctccagcagcccacgccgccgaaggacatacaggagatcgttcgccggcagcagcggcagcagcagacgccgacgccgacgccgccgcagccgcctccaccggcggcgcaacatggggtgcagctcgccaaagcagagactccgccgccgccgcagcggacgcagccgccggtgctaccggcgggatccacgcggtcgacggcggccagcggcatgtcggccacgacgagcggcgggagcgagcgggacggcgccacgccgaggagcacggcgagcggctcggctgggccggaggtgtcgcacctcgggtggggccattggttcactctccgggagctcgaggaggcaaccgacgggctcgcggaggagaatgtgatcggggaaggcggctacgggattgtttacaagggcacgctgcagaattccgccatggtcgccgtcaagaatctactcaataataggtactaatcctgtgccttctcttggagcttttcgatttgatttggacatctccagcctttccatccttgtatagcctagaattcgtccttgggtgagtagaaaggatggagaatatagttaggaatacccgtttttatttttattttttaaagaaatcaattttccctttctgtttaactgggggtgtgtgatttcgtttgttcgtaaaaatgccactgatttcgtctgtttaaccgtgtttgtgttcttgttcatcggtttctttggctgtttgctccggttgtattcttgttcatcgaattgatacgcagatctctaatcttatcttcttctgcgataatgggttgttggacttggatatgatcagtctgatggaccaggaagtgagctgtcaaaaactgtgaatttccatttgaagaagggaaagatccttttttttttctagtgtatttgatcggattttttgtgcatagaggtgcaacttgtttcagtttattcatgaagcagtggtctgctggtgaacggttgggtcgtggggctcaagaagtttcaaattgctgtcatcatttacctcttctgtgcgcccatctccattccccattcgcctcgatatctgtgacgcaatttaatcctacacggctttctagggactggattaccgtttcattttctcacacattttcttgttctgttttatgacaacaaaaaatcaaattgttttcctgctttgccaggggccaggctgagaaggagttcaaggtggaggttgaagcgatcgggcgtgttcggcataagaatctcgttagattgctcggctactgtgtagagggcgcttataggtacaatgaaatctcttcatcaattttgtgcattattattccctctctgattaatggatgttttactcacattgccgttttggttgaacaggatgctcgtgtatgaatatgtagacaacggcaatcttgatcaatggcttcatggtgatgtaggggaagtgagcccactaacttgggaagtcaggatgaacataattcttggaactgctaaagggtaatgcttctctcactgttgcacgccaattttgccaaagtgggtaccttgaacagtgttatattggtatgccttgcctgattctgtttaatacttcgacattaaagattatgaatattatgggcaaatataggtcatgatcattcagattttagaagacaggtgctagctggcatgggaggcttgttttgttgtgagacatgcatcatagttaggatagtagagtctaattctggtgaaattgattgtcgtaggaattcaggtgctttactcaagtttgttaggttgtgttccttagcatgcacatattcccaaagacagctgattctaacccatgtttagcagatacgaaaaaaaaaacatgtttttttctttgttagcattaggcatcatttggttgttcagaaaacaattagaatttcatgtgcatttaaatagtacaaacgccaaagtaaaggtgtcgaatttcttggacattgcatgtgctcatcttgcattcgtcctttaattgctttcctgttgccagcttgctttattttaatcaaagcacccagtctgagattgttttgattcgctctatagagatttaagatactgcatgtaaataactaaatacttaccttgcacatgcgttcggactagaacattgtgaccctgtttgacagttaaaatctagattaaagcatcatgtgcattgataagcactctaccgataatattctttgcctgaaagcaatattgtcagtggcttgcttaaacaacatcaacagttcttttaaaagatgggtttgatagggaaacacatgaatactgacacccaacttctgctctctaggctggcctatcttcatgaggggctggaaccgaaggttgtccatcgtgacatcaaatctagcaatatccttcttgaccagcaatggaatgctaaagtgtcagattttggtcttgcgaagctattgtgctcagagagaagttatgttactacccgtgttatgggaacctttgggttagtattgacaatccacacacaacctttactgtacataaaagttagtacatcttatcatgactgaaattggctatgttgcagttacgtggcacctgaatacgccagcacggggatgttaaatgagaggagcgatgtttatagctttggagtacttataatggagattataacgggtagatcaccagtagattacaccagggcacctggagaggtcagtatcctacctattctttcatgaatctcttccaggatcgttggcatctgatggagctaaattgtcttcttttcaggtgaacttggttgaatggctgaagaccatggttgctgagaggaaagcagaggaggtagtagacccaagctgcccgagaagccttctcccaaagcactgaaacgggcacttctggtcgcccttcgctgcgtcgatcctgatggccacaagaggcctaaaatgggacatgtaattcacatgctcgaaatggatgatctactatgccgcgatgtatgttctactcacttatgaactttttgatttcttccatttactaaacagtatagttaactcattttctgattgcaattgttcatcatacaggataagaaacccggaagagatgcgcctcagacatcggacagacacagctcaagggatggcgggaacttcagcaagcgtgagaaccaacggtacagatgacaacagcccagcactacagttgaacatgagtttgtatggattgccattagggattgccaatattaaccatgttgtcattacataattttttcccctctcgttggatctcataaccagctctccttgctcttttgactgtattatactcgagcatcattctatgacacttgacacttataaactacacaagtgtagggtggtgttgtgactgagactgactatgccccagctaatgcttacagtgttaatgtgattctacctaatgcaagtacagttgtctgctctaatgcatcttttaccagtccactcctgataccagctgcctgctttactgcactgggagaagtaatgctttcttcttgtagcctaatggttggtgcctgcttgcacatgatgtcacatgaccattttctgcatctcatctcatctcacacttccatcctgcatctaaccctttgtttatgatcgccattagtagttggctgcagagcttgggacttgtatattctgctggcaaatgcttttgtccactatactgcatctggtgatcagctgcacagcatttgcgccagttcttgtcgcttcgccttgtcttgatctaaatactaatcttcgtttccatgttcagttgctgtgactttttcgtactagtatattcattagttcttttttacagccaaccagctctggatcttgtgctaataaacttgaccgctgacagtactgattaattagcaggtgatgatcctaccatcacgtgaatacgtgatcgaacaactactgtgcaatcaccatgtatgcaatgaatggtcaagtactaacatgataccatgccacaaattagtttgatcatgctgattcatttatttgacactgtacagtctgtactactgaagtggaatagcatgagagaagtttctttcatttttcaacggttagcttggagctactgtgccctggaaatgttcagagatggattcttccattagaaaaaggttgagttatgacttgtgagttgagagagtagtgcaggacacagcacactagtggccaaaaaaacggcttggaggattcatgaaccgatggcagaaaaaaacaagaggaaaaaaaagcacagcgaaaggttatccggcacaggctgccgcaaatactaaatcttgttggacagagacatttttgggtgatatctgacgcgttcttcaccctttccccactttattcgatagaataattgaataaacattcacctatcttgataatgcttaatgccttagtctaattattgcacaaagtctctcaacaacctgaaagacgcagctaagcctgccactgccgttgtgatgacttgtgaacagctgctgctgcttcatcaagctgataatgcacaatcatatgccatggtacaggtacacgcattgtcgaggtctacgtccacatagcttcaggcgatctccgtcctgtagcgtagcgacctcgtgaacacctgagctgttccgaaatggacgcgagcaatatccacaaggcaccaggttgtcgggttgccgccgttggggttttcccggtgggccagtcgacggcggcaacgccacatggaatagaaccagcccgacgtactagaagaaggcacgggcgccagtctgttgcggctagctcgccccccatggcctctggtccagcctttaactcgtcgtgttcacctcgcggttcgattcgattcttcttctgccagcagcccagccttcaccgtgagtgctactatactgatacgttgtgtagccatcgatatgcaccgtccgattagtgaccagacggccggaattacatcgatttcgatcatgtttgatgaagcttaacattctaaaaagacaatcggttggtagtcagtttatagaaatatgaatctactagtttttttttaattatgcaattgcaacttcttaaatttcaaataaaaagctgaattgtttcgaaaggttttgttttaggagaagtttcagctaccagaaactctctcaaatatgcccatagcccatccgcagttggccgctgccgttgttacggctcccgtcacgcgcggtgtctctcacgtcctctgcggcggccgctgctgcttagctggatagcaaacgccgagccgtgcacgctccgctgccatggacagcgactcgcgtcgcgcagcacggcgccacgagcgcacaacgcgccgggccagcctcacgcgcgcgcggacgacggcgttccactggaactcggtctttctcacgagacgccgacgccgtcgtctactcgtcttcgttcacagatggatagggaaaaaaagggaaacaaaaagggcgacgcgcgtgagcttgcatgattgatatgtaccatactaatataatctgacaaaagaaggtaatgctaagagataagagaggcaatgatcactttcagcctttggaaagctgacgctgaggcaattatgtagggaaaaatggtttcatcaagttgtgctagtgtcggcataaaagactgcaatagtgctagttccgtatcaaaggtgccgcactgacactgaggatgagggtgtatgtacatgcatggggagctcttttgatcaatcacacaagagagatgatgacactactagtaagcatatgcctgaacaagcacacacacatacatacaggtagtatgacatgcatgctgtcagttcagcagcacaagagatgccggagagaacaacagctgcgttttagcttctaccacttgcagttgcctggctaccaccaccatcagagagagggcctct

SEQ ID NO: 44692 - DNA, 2288 bp, Oryza sativa
aaaaaaagaggtgatttctgtacagtaaaaaagaaaacttggaatagttggggtagttctggtaggaatggacgagagcccagaaagaaccaaaacgaggtaaagagagcgagcaactatcgagtctgatcgactacgaaaatatctaagagcaggtacaatagcaggctattagccagctgtaaacatattttaatgagagaaaggatgagagagaagagcagcgggctatagatctgtagccagctgcatcgcggactctaagacgcaatgtatgtatgacaggtgtgaccatatattaatagtatagtaagcaactattgtatgaattggctattagattggctatagatgaattggagttagcagtgggctatactattaaacttgctctaatgaactaaagcactcaagaattcaccactatcagaagcaatatcccatgcacaggaaattcaagagggaataggcagcaaaaatacggaggggctgttcagattgttgccaaaataaaccttacctaaaattttagcaagttgacaatattaccaaaattttggcaggatttcttatgtatttaccaaaatttggcaacaaaccaaatgtaggcacatttttggcaactttgccaaaaaatgatatggttgaaaatggcatcaatctgaacagcccctgaataaactggaaactaaggaactagctccatgcctgcaacggaccaatgaagtacaatgtttacatagaatatctaaaaacaatgttctttttttttagataatggaaatggtttacatctttggcctctgccaacaggcacacgggcaatgagtcgagaagaaaaactgtgttctataaatgtaaccatccaaatcatattggcaatatggcataaacagaacacttcaataaaactatgttggcagcactagaggaagatgactaatatgagaggttgctttggttggccagttcatttgctccttactaataaattgcccagcttgcctatagttttctttcatttttcttttgtggagatggtaagcagcatgcaatcaattttttactgaatacctgtacctgaaatctggagatagttcagtggacaggcctgaaagcaaccaggatgtttggtggttcggcctggcctgccaaaagattaggctaggaggaaaaaaaggacttaacagaatgctcatacaaaattgtaataggtacacatagtgggtcagagcaaagtctctgaggcgaaaatactaaattatgttgattcatcattaggaaactccaacctctagtccaaatagatgttgctctagcatgtgttattccaaaatttgattgctaaaattataaaagcatttaacttatcaaatcaattcaaggggactcaactatgaaggtgtaagatcaggtttagttggtctttccagtttgccggctaggccctggctctctgactctcaaccttttctgctctccctcataaagtcatactccaagagaaaagtttgctttgaagctataaaaaatgtaccagaacaaaggtcgtaagggaactacttgaaagtaagctgggcaaattagccataatgtatgtgagttacatatcaagaagccaaaactacagtcctagggaatgcaaaaaatattgactttgaagacatatctaacagtccaacagaatctattcatggatctatcactcagaagatactaaagaggctgcattactgaaaacagtatagatgattggagttaaatatgccagccatgaaaggcaagatagtcactttttggctcagaccaaacaactcagaggatctgctatgccatgtagagtactactgtaaaaggaatttgatgcaatgtgaatgagcagtcacattcaactatacacatttgaacgtttaggaaccacacactcagaagtgaggagcagcacagggaaatcagcattggtaaaagaaacaagggagcaagataccttgaccgggaggtggatccgtcctgtgtgttgcaatgtaagtggctggtacgacattctgaaacacaaaaaaaatagggataagtattggcagtttcgcaccaatgcaacatgtccggactccagagaataagttaccagcttgatactctgacgagaaacacaaatatgacaaactgaatatatgctttgcaaattacaatgcaagtggctgcctggaatgacattcggagcaaaaaccgactagtaattcatcaccacaactgaaaccttaaagggcgttggccatgagagaaaccaa

SEQ ID NO: 44693 - DNA, 11867 bp, Oryza sativa
  unsure (1)..(11867): unsure at all n locations
attcctgcagcccgacttagaaacaaatagtactaaccaccttttgttaatcatgcgcactggaatttcagacacacgctctgacacacaataggactgactagaggtaaagctccggcgtgagggatcaggcacacaattcatggcatcatcaacacaatcaacctaattctgaattgtacttggcggtcggaggcatgagatcacgacagctaagcacagagatcgatcgcgagtgaggggggacagagtcacagaggggctgaccgaccaagggctgcgcggaggggtcggcggggacgacctggctgaagttttgcgggttgtaggacggccagccgcccagggagctctccatcgccgccgcggagctcgccgtgacgtctccgactccgactccggcgacgccccctcttggtttctccacccttttccagcgaccatggattcgtggaggactataatggagcacacagagtcaacattaacttttgggtttcggcccattattgctatcttttgggccttagatttcactggccaaatgggctttaaggcccattttctacctatacatttgacttagcgttgtcttgtgagattgtgttattatcagataataccacgattatacgaatgaattaattcttttagataatggaatgtaacattccagtctttactcaaagagtccagccaattattacagaactcacacagaacaaaactcacatagaaagttcacgatagcacaaacaaagctaagcaaacataaactaatacacaccaacagaagaaaaatatgccataactattgaattgtattagagaaccgccacccgaagttggcaaatatatgcataattgtcgtcaaacgaatgaattaatgaattaagacagacaatagtacaagattcataagttctttttttcgaaaaaaacaaaanacatacaaccacgcacgttcaattacatacgagcccacttaccaaatgcatacatatatacataccctatccgtataaccacctttaaaagtatgtcttaataatgacaaagtcaccacaagcttctcgcactcatcgaatgtgcaggtaaaaacgcattcgaggattggaccggtatattttaaaattgataaaatcatcaccgacgttttcctatcaacgtatagattgtctatcactaaaatagtatatgtactaagtttgcaacttgaattcagatggtgggttcaaaggaccttgccacaaccacaacccacaagggacaacaaggttacccgaaaatgtgagttctttaaaagcaatgagttttgtttctgtaaataggggtgatagatccatgatctattgttgcaagtaaaccgcaagataagattcgtgcaggagccgtatccttagacagatactaaatcaagtcagggctagctcagagtctcgatcattaagaagggacaattgccgctaatccgacagcgatcagtagcctgtcctttctgttaccagtcgtgggagagttcggattctccacaatttgtccaaatggagtggtatatcaaggtaagctgaagagagaggccggcgtttcatcatccattgttttttttcctgctgtatcgaatcgtacaaagaaacaaggagacggtctctttctagtatcgattaggctgtgacctcccataagtgatacaagaaccggcatgctgacatttcaagaggatgcagatgcagactgaaaactgaattattgacatatatgacgacatctatgtacgaaaaccttgagcaaattggctaagtgaaacagcgaaatctaagatctttttcggcggattgatggcgtttcgagggtggccaagggcccgtctttgctgttggttacggtcaaggtataactgcttgcgagacatcatgganattctgtggccatcgatgtgggggtgtttgtgtgagtgatgtgaaatgctggcgaaagccttgccgggtcttgggccggttcgacgacgccggcgcccatgggcgccgtttcccttcttggaggcgttgtcatggcattctttcatatccccacaaatttctaggtgaaaacctccttccgactttcgaacgagcggcggtggcgttacacgttgtgtcctccttgggggcgtcacttcggagaagttctaacgcatcgacgactgtcgatagtctttttcggttcaaaagctttcataccttttgttcggtgaggccttcgccttcttgggtccgcttctttcttgtggtgggcaacacgctcttcggttgtttctgctaatgaagtcgaagctgcttgctgatgggggtgcggcgacgctcggcaatgatgacatgttgcagtctcttccaaggagctctggtgctggccgtgtgaaggaagttgctcttcggtggcttggctgacgtccattgttggatgtcggagctacttttcgctttggtgactttcgtggcttcagtgttgctgcagttgtggagtcggcgctgctaggtcgcttgggcggctagcttagcaatggtaacacctcttctgcaatgtgggagctgttgtgtcgcttttgtgtttagtttggcagtgacgtcctacgattaggctccgccgtcgttgttagttgtgtagagcggaaggttttagctggttttcctgtaattaaccgtgcagctgtatggtttttgggcccggttttccttataaactgggtcaattttttttttctaagtataacagtggaacaaagttcggcattaggttaaaaaaagatcttttttggggcttgcgaggtttggacaaattttaacttataagaatgtatttacatattaatctgtaataattttcaggaggcttttccctcctaatgtagatagagttaccctcattattatttgatggcacatactgcactagtatatatgataataaatgcagacatgcaaataaacagttaaatgtgaagtgtatagcacatgtaagtaaagtaaaaaaaaaactcaaacctgcactagtaaatgtagtagaacaagtatgtaggagcaaagtatgaaagttaaaatgatatgtatacatgagaacagggggagtagtagtggctcaataaaacctccatgtttagtccttaattagaagcagatgttgtttgagagagataccaatcacaataactttaataacattttaatcctgaataacttatacagtttcatgctgtatatcttgcacgactggagcgatgaggactatgtgaagatcttgacagtgtgcaaaaatgctatttgttaaaaaaaagcaccatgaaaaattaatatgtatgaagctatgccgaaacaataaacctaaataaatgcatgcctatccatataaattttaacccgctgacaacccgacaatgagttactgcatctatcctaaaatataaaaaaattaggattaaatacatgtattacgaaagtaggcagaataccaataataagttatcatctcatccaaaaatataagaactttaggattgagcacatgtattatgaaagtatgtagaattaagtaagagaaagttgtgattcattgagaaaacgaagtaggtagagaaattaaattaggaaatgttattattggttaaaaagagtagaactactattaggagcgctagagcgtggaatattgttcatagcgccaaacatgcgttagcccaggcccaccccaccccacgtcccgtcatcccactcctaccgatccgagtaaattgtttactccgatcgggtgcctctaccacccacctttatttgagtaaacaatttacttcgataataaaaacaacttccatgctttcgatctcaccccatgtcccgcatcgtgcacccaccattatcggagtaaatgatttactacgataaaaacaacttctctgcttccggtatatattctatttttcccgtacccaaccaaccactctcgcccccactccgttttttccttttttttggatctgaatcgatccaccatcccagcccacagatcggcgacacaccatgaaggacgacgacgacaccgtggtggttgatggcggtggccggcgagcagtggccggcggcggttgaggtgaaggcactacttcaggcctcgctgctggacgctaggcagcaccataaccagcaaggaggtgttcacctgagccaatagcaacaaccagcggctactccacgtcggcgacattgatagaacaagcaagtaaggaaatgacactctaatttgcatctgcatactctctttcaacttcacgcatgaagccctaattttttttgcaaatcaaattaacatgtaatctccaatattacctgatctcaattgataggctgcacaggtcctacatttgcacatcgtgctccatgtagctggccgcagaggttaaggtggagtccaccggtgatggagattgtttgctatttttcttttgctcgtcatctgtattgacatgaacgagaatatttttacatttttttgtgcttgttagatgatggatggctgctactgtgcaacgtcaagctcaactctataccacaccgctacattcttccatgattccatgatggatttttggctgaatcattttttttcttttctagtttgattcacctgtgagtaattttatcgcttgtgtgtgattgagcctgtaatttttttcattcatacaactattttgtgatacagatcaacaatactcttagtaccagtttttattcttatactgtatattgaacacatcagtaaacatattactacatggtggctatgagatcatggctatatcgagaggaatgtggaaattgttttactcgcagaccacaaaatctaaataatattggtaaaagaattactagcgttgtaagcttgtagtaattcttttacgaccatttaggtatggcgtcatacgatgtggagacattcatgagaataaatttgttactttagaatgagcagatgtgggaggctgggagtaaatgaaaaattccacggagtaaattcgttacttttcaaacgtgcggagatactagaaaaacggaaaactcggaaagaaaaactagacggtaaatattttactaaaacgcgaaaacagaaaaactatagagaaggaatgaataacagaaaaatctggatggttaatattttacctggaccattgatgaagcacatataagatggaaaagagaaaaaaagaaacacggaaggtggggtgttaaaaaacgaaaaaaaacgacccgagaaaaggtgggatgcggaggaaaggtggggtggtaaaaaacgaaaaaaccggaagtagaaggcggtgtgcagcgctcgaattattattccgcgctgtagcgcgtggaatagcgctaccgtaaaagagagtataagtgaagatgttgcaatattttaaggtaaattttaaatgctagaagttgttatattttagatagagagagtagctaaagttatttcctttatgtaactatacattgagagcgttcatattagccacaatatatcttttattaagagaggtcaaagatgattcatcacaatctctttaaagacctatagatgtcagaacaaaaataagaaaaaattaccctgtaagatcatggtgagttcatattataacggtatagattcatctctataggtgtacaagtataattgtatctaaataaagacatgctaatagctgcatatcaaacttaattcttttttatatattttatctatataacatgagttaagagttgtttatctccgattcaattttaaaggtatattcctgtgtaaaattgtgtgaaaaaaagctagtttgccaaaatggagcacatggggctaagctgacgagagaggccagcattttcatcctctactattttccaggtcttttgaatcgtgcgaagaaaaaaggggatcgtctttttccatggatctgtaagtcttccatatacgcaccgtcatgctgacattttcagtgatcggatgaatggcggcatatatctgggaccaaataaaacctggtgcaaattggctccacgaaagccaagatcttattcagagagtaatcgccatggaacatggtgagattggcatatactatgtaagttggacagttggtcgatcaagtcatcaaacaacttacagagaagataaggtgcgaatcgatgaagctgaaccatgagtgcaaaaacgttcgtaaagtgtattgacgtacattcattgaattttcaggggaaatttgtctctaaaattgatgaatcaaacatttgaaaatttcagagaaattttccagggaataattttctctaaacttaactgccaacgtttggacagttggtcgatcaaacaacttccagagaagataagatgcgaatcgattaatctgaaccatgcgtgctaaggtttgtaaaatgtattgtcaaggattaattgctaacctataacgtacattcattgaattttcagggaataattttctctgcttgcagacagtcagtaaacccatttatgaatacttgatgtacatgtcctgattcgttctcttctctgtcaatgtggatgatgtattgatgtatatgtaagtataacagggtcagtctaaaattaaacacaagacgactttcccgacacgcttacgcgcgtcgcgttgaaaggattcaccgacttattgactcatagtgcaaatctaagtggcatctgccttttattttcaaattagtttggcagctgaagataaagcttccggctaactgctaggttatggggctaataacacacgagaagataatataactgaacagacaccactaactacagaaaaggttgcacatatgcaaatggaaaatgacatgccccattaccagcactgtgcgtgataaccttaatatacccacttatccctctatttctttcctgcttcaacgtggaattgggccatgcacgttgttttcatggcctaatatgtttcctgatttgttaatcgtgactcaatcgctgaccaagctcaactctgatattgaccaagttaggtaaagtagggtagtatatcttagatacactcgataatacagtaatacaccgataagtggaatgtgatttcaaccctaaaatttcgtatttaattctcaacacgcttataatttcttcgtgaaacccttccaaatctcattttaggtaaagtagtgtatcaagtaaaaaacaagccaaaaggaaaacacttgttttttttagtttgttcgttcgatgatgaagtacccacgttccactccaacagaagaggccaaactaaagatcaggcatgctgtcctaagagaaaatcgaaggtcagactgagtcctacacaccaagggtagcttctgaaacggctgggatgatgaacaaaagggtgtcttttgtgcgcagcatctaccggccaatattcctttgcaggcgtgcgcctggtgattcaccaccagcagccaccggattctccgccttgcaacccatgcaatctcgagaatatgctgcatcatgaaactattcttaatgccgagaacaacgagagaatcattcagagttcagacatcttttcgacagtcatatgctagctcctgctattagagcaaatttaatagtatagtccactgcaagcttaaaatcatctatagtcaatctaatagtcaattcatacaatggttatctagaaatgtatactacactattaatatttggtcctatccgtcatacacacattgcgtattggagtccgtgctgcagctggctacaaatctgtaagagcaagtttaatagtatagctcaatacaagctcaaaatcatctatagccaatgtaatagccaattcatacaatagttgcttaatatactattaatacctgattctacttgtcatacatacattacgtcttggagtccgtgctgcaactggctacaaatttatagccagctgttcttctctcttcctttatctctttaaaatatatttatagctggcttatagcctgctattgtacctgctctaagagtaagtataatagtaggctataaggtggctaaatgctgaggtggaggagagagaagagagaggagaagtgggctgtaaacttacagccggcttggatacaagaaccaagaaactctgtgagagagacaagcgggctctgtattaattgtaaagagctaactattatataggcaggctaagagaaggctacaaataaccttatagccaacatgtcggctgtattattagagcaagtacaatagcaggctataagcaatctataaccacatatcaagaagaaaagagaagagagagaagaaagcggactacagatttatagccagttgcaacacggactcaaagacattacgtgtgtatgagatatgagaccgggtattaatggtatgatatatttttatagttaactattgtatgaatgagctattagattagtaatagatgatttggagtcagtagttagctacactattgaagttgctcttagccttgctctaacccgctttcttttctctcttatcttttcttctcgatacgtggttatagctggtttatagtctgctattgtacctgctgttagaagtattctatccatgttcacgtgtgctggtggtgatcatgtccgatcccagctcagatgggcctaaatgagcgtgcaattcttggtcctcggaataggagctgtgcattgtccataggagtacttcatgattagagagtattgggcgtgatcgaccaaaaaactacacaatctggggcatccttttcttttattagaccgatataattaaccatgcatcatgcaatgccaagtgcccaagtatattgctttcaccacaacgagggttcacgctttagcttttgtcgcgctcattcaagtagcaccatccacaataatcaaagtaactttccttttgactgaacctgtcgagagtagtaaaaaacagagaccgtcacgctgacgaccagcgggacagcaaccgccacgtgggcccccacgatgccggtcggtcagcagatcgggcaggcgagatttgcccgcacgttttgccctcaaacccctgatagtacgtgcctttgacagcaaaagaagccgtggcagatcgacccaacaatgtgtcatcctcctgcccccatcgcacacagaaccccccttgcgtgaattgcatcgcgagaacccgaaacgcctcgtcggtttagctgcaacgtagattcaccgatcgatcgatcccttccaccacgctccactccaccgggggaggtaaatccacgggaaaacgggtgtagtgaagcgagcgaggcgcgcaccaaccgcagtcaccaccaccggcacccaacacccagacgcgcggctccccggttgcgccgcactcgggctgtttggatggtatacgaagtttatcatcattcatcatactttttacgtcacatttgtttaagttgtggcttacaagtgtcacactttagggagttaatgacatgtgaggtcataatagatgagaagaaatcttgtcataagtgtggctataaaccaaacaatagactaacttaatcaatcttgtctactggtgtggtaatctttagtaacctttaggaattaggatcaaaccaaacagcccctctggggagaggccgttacgttatcccacgggggaaaaatacgagaaaccgcaaccgaaaagagaggaggaaaagggagccgcgcgccgtcgacgccgtgccacttaaccaaccagccaactcaagccccgcccgtaataaagcgagccccccgccgcacgcacgcacgcagccgagaccaccctgctgcagctgctgtgctgcgcgggttaaaaagagagagatctattaactggccctcctctcccacagcaaacacactcgtgtcgtactgagcatctgagctcggtggttgccgaggaggattcgccggcggcggcggcgggggggagatgtcgcagcatgcggtgtgctgcggggcgatgttctgggtgtacctgatgtcgtgcgtggggctggtgatgttcgccgggctcatgtcggggctcaccctcggcctcatgtcgctcagcctcgtcgacctcgaggtcctcgccaaggccggcaccccgacggacaaggacaacgccggtacgtcctcctctctctctctctctctgccccccctagctctactgctgctgctgatcgctgcgtgtgcgcgcgcgcgcgcagccaggatcctgccggtcgtcaagaaccagcacttgctcctctgcaccctcctcatcggcaactccctcgccatggaggtacaaatctctcctgctgtttttcgatcccctgtatgcacgtatccagattggagctgatggctttgtggcggcggcgtgtgcgcaggcgctgccgatatttctggactcgctcgtcccgtccttcggcgccatcctcatctccgtcacgctcatcctcgccttcggtgaggtgaggcattgatccatctcgcgtgtccatggactatgggttgctcacttggggtttggctggctgattcggtttctcctgtggtcgcagatcatgccgcaggccatctgcacgcgctacgggctcagcgtcggggccaaggcggcgcccgttgtccgggtactcctcatcgtcttcttcccggtcgcctacccaatcagcaaggtgcgcctgctggcttagcctgtttcgttgctcttgtttgcttgcaaagaatttgggggaggaattggaaccttgtagttggtcacttggccggggtgtgctcacaatttggatttggatgggacactacaagtggctgaccgcgactaggacgcagatcggttacttactgattcattaattaattttccaatcaagggacttgtcccattctcatttagtcatctgtctacaaaattctttgtagccggtgactaattaattagtaaatgtaatctgtcccattccccattgaaccagaataagcaatcatagccgtgaagcaagaaccctgttttagtgttcttttttcctttgccagactaggaaaaatgccttcataagcgtgtttgattgctcctgaataattttagatgaagcaattcaattcgcttcttagtttaattatttcctgctaaactaattgttttctgaatcatattttacaaagaaaaaagaacagaatttaattggggctgaaacacagcgaactacttattgtcgcagatgaatgttttgagttgcattcaactaaccatttccttgtttctaatgcaaaattagctataattagaggatgcatagatatgcttgtgttttccactaatgccatgtcttaatttgattcatgtccatctttccagttgttggattgggtactcggaaagggccatgttgcacttatgaggagagctgagctaaagactttagtcgatatgcatggtaatgaggtaggttttattcttattctcttatgcatttctggtaagttgtagctctttacactatgtagtttgcatcaatagtggttttttttggttgcaacagctgtgtgcggcgtccaagagttgatctcaagaggccatgttctatatagattctagacaactttttatgacatgttatagcaccttaaatgagtccggttataatatttgctgctatatggacaatatgattgggcatttctacatgccttgaatattttcttctggctctaatatacatatattctctgggctacttgtgtttgcaatagctattggtgctttcctcagacaaatatgaataccattaaacttctgctggttcacttgttcttaggctg

SEQ ID NO: 44694 - DNA, 3250 bp, Oryza sativa
aactttatgtattattaacttttttggtgccaaaaatcctgttccctagaaacttatgactttcatgttatttactcttggatgcatgttgtcaatgatcaatctttgtggcttgagttgccggttctaactgctgtgtcagtcacactttttattgtgaataagatagcacattacagatattcgatactgaatctgctagcccatttcagttttaatagataaatacttgaattagagaagaatgtttttgttgtgatgaaatatattttataaattcattaatgatattctagttctctggttaaaggaagcctttgcagcagtcattcaaccatgacacgtcggtaataaaattgtcataaaataattgttttcagttgattgtgggatcacatactctaacgaaatacagatatgagtgactaatttggcagagtcttgtgtacttccactcaagctgcccttagttattcaaaacctgaggcaacattcacaaatttaagcctttctaaacatgcccttatgattgcttatatttttgccgggtcggccgaaagatttggtcgaccaatttcattaagtgggggaaaagatttaattgcctataagtaattcacttttggaaaaataacaacaataactttcccgatccttccattactgtcacttcctggacatcctatatcccaatgaaatagccaatcttgccactttactttcatgtgtttgttatttactatttgaccaataagcaaagaccatctcattttcaggttaaaaacttaattacttgccaacctgaggatgaagtgcccattcgaaatgttactatcagaaaaatcccaaggtatgatcttttattgctttatcaaattggctgtttgccccctaggcccctactgttcctccctaaaaagctactactatgttttcattggcttgattaaaaaatgtacccactattaactttctctgagtctgagttggaagtcaaaatctcgtgcagatacattaggcatgcttcaagaaagctcaaggctacgcatatctactactacttaaaaaataagaggtgcttccatcgtccgtcaaaaaaaccgggtgaaaaaaaaccggaacgaatccgattcatcaacgcggtaaaagaaaaatcgggaaaaaaaaagaatatgtccgattccacaaaaataggaaacaaactcccatctgttataccaagtcctattcggttagcatcaccaggagaaccgacaccattcacagagagagagagagacgacgccgccacctctcccgcccccgtcggaccgcagccgcctccatgccgccgaatctggcggaggcgaggtccggcccgccgcccctcccacccccgccgggctgcagctgcctccacactgccggatctggcggaggcgaggcccgaccggcgttccatgacgtccgccaccaccaccactgccgcacctccccaccatgcacagagagagagagaaagagacgacgccgccgcctctcctgccctcgccggaccacagccgcttccatgccgccagatctggcggaggcgaggtccggcccgccgcccctcccgctcccgccgggccgcagccgcctccacgccgccgttgttcggggagagggcgccgcgccgttggttgtgggggagggcgccgccgccgccgctcgcgggaagaggggcgccgtcgccgccgctcgggggcgcggaggggagggcggcgatgtgagatgggagggagggaaatgggctagggtttcggcggctgaggagaaggaggggttttgtttccccgatatcgacgctcggccgtccgatcaaaaccctaaagatcggacgatcggtgtcgtccaggccgaaatcagcccaagagggatcgagagtgaggccacttttctggcccaagcccaggttgtggcctggggaggggaagtgcacttgcgcgtgcacaaaaggccgtggaccgaccggcaagggccggaaataagtctattttaggtccctcaggcccaaaaaaagagaataagttcatttttagtgctcattttttcagaagcattacaacaattataagttattgaatgtgtttatttcgaagcaaacctaaaaggaagtattttctttctttttccaagtaaataattgttaaatgacgtttgtattaataaaattaacaattaagctctgaaaaattcaaatataatttcaaagagcgtaactaatcatggagaatttaaaaaaaattaaatttaaccatgtcattttatttctcacacttgctttacttgtaaatttatttaattatacacatacctacttaaaaataccaaatatttcagcgaatttgtattttaattaattgcatatttttctaatctgtacgcttcacattgtaacacacaggcacttttgctagaccaaacaacacttttggtcaatatacacactccgtaatcacccggtgcaacgcacgggcacttttgctagtataactaaagttgacaagttaagattatttccatggcttaaactgagggcacccaaggttgctacatactgtgatatgctttggaattgattcaaatatgcacttctgaatacttaatgcttctatgctcttcataacaagagaactattctcagatatttggaatctcttatttaaggaagctatactccatgttgccttgtaatttgcgtgtatctatctccatacaaaatgttcgtttgtcatcttctaattttcctttggtgttgctgctttttggtatatcagggtgtctgatgatcttcctctctacgacattctaaacgagtttcagaaaggtcacagtcacatggctgtggtggtcagacgcataaaagaaccaggagcatccattgaaaagacttatagtgacagatcagattacaaaactaacagcgacagatcagattacaaaattaaccacagagatgcccatgctgatggtacatactttccattagccatgatgatcacttgtttttccaggaataaatatttgtttggctgtctgatcatttgaaaataccctcaggtttgtcaccctctcgtgtcagcattgctggaagtcgtcgaagtaacattgaaaagaatggagaggtgcgcttatataagaaatcagaaaaaaagcgggacaatattcttgattttaatagcggtccacttccaagctattcattggtcaataaacaggggggatccac

SEQ ID NO: 44695 - DNA, 12532 bp, Oryza sativa
tctccatttatactcttgtttgttgtataaagattttagtgttctccaacctatgggagcaacacgtttaattcagcatgatgttgcatttttttagagtcatctagtgttttccaatagttagaaaagaaactagaaatttttcatagatgtatcgttctttgtaaaatattttcgcttatacatgcaaactggcataaacttctcttggcaggaagatatcttggatgaaacagatgaatatgttgatgtacataacaagtaagtggcttgaaccctgttactttttactcttaacagaacctccaaatgatgagagaactaacatttctttgttttgcaggattaaaataaacatgctacctctgggcaaatcattatcaccaactatatctccaagtaatgggccccattcccaaggactcaggaggacccctatgacttctccattgtcatcataccatcatggtggctccatcttacgttcccctgcttcaaacaatcctcagtctcctgggactttgccgacaataatttctcctgaaagatcgcctgcttctcaagcaccttcgcgtagttcacctaattcaactcaggtgagtagtcactttgtgtctatgcgggttatataggctatttgtgacacatcacatcacatattattttattttcattttatttcgcctaaattgcaaggaacttattttcatctacctgtaaagatttaggttgtattttccccttgaatgtgaaacagttgttggtggcctacatcataccatgctcattgttcttctgtttccttcataggtctcaaggaattcgtaaaacggcgttgagagctaaagagctctaaggacaacgtttcctgagaaatggtaaaatgtcaacataaacagattaagacattttgagcttaggactgaattatacagatcagcatatctcttgtactgttgatgcttatttgttgattacatgcttgtatatacgtatggcttagcatctggacatcgctatagatggaagtctcactacctactgtagatgtatttttgtcagcttgcaattaccattgcagaggaaagcttgaagataaaaatgtaaaaggaatgcactagtatgcatttgtgctgttcttgtatgcatgcccccatcattttaatgatcagcaagcagatgttggtgcattcactgatggctatccacaccatttaagcactgtacaagtcctctcatattgtatcagaaattcagattagtgataaggcgcaagcttatgtttgtgatgctagtttggtgatattgagcagagtgttgtgactaaagtcaaagttacataatgagatcagatcataagattgcaaagggcaaacctcataattatcgagtgggccatcaagagagaagctagtggatcagccggaccatcaaggacagttttacctgaaaagataaagggaaatgtagggcagagaaatccacttcaaccttaaaaaaaaatgtaccagacacatgctccttccgtaaaaaaaaaacaatatagaaggagacgtgacctctcctagtataacggtgatctctcctaggttgcttttttttttcttaggacggagagtgtgtatataagtgacagatccgagacgtggttctcgatccgacgaccctcggtgatcgcagttcgctccttctatacttttacggttttaccctgttgtatatgaacagaggacgaacatgtaaataaatactacttccgtttttttaatagatgacgccgttgattttttctcacatgtttgaccattcgtcttattcaaaaaatttacataattataaaatattttgatatgagttgttttatcactcatagtactttaattgtgatttatatcttatacatttgcataaatttttttaaataagacgaatggtcaaacatatgagaaaaaattaatggcgtcatctattaaaaaaacgaagaaagtacaaaatattcaatgcgtgcaaccgaaggcatggatgaggtcaggatcatccatccggaaaaacaaaaggacaaaaaagagaagaagagcttctagattccaacgctacgtatccaaccgcgatcgcttcgtcaaatccgcgcgcgcgtcgtgtcgcgtacgcgcccacgcccactcccacgccttcgcgcgcgcgcgcgcgcgtcgtcgtctccctcaccactcgccccgatcgatcgatcgatcgagtcgtcgtcgtcgacccgttttctctcctcttctcgatcgttatatcgcgaccagtacgcgctactacttctcactctttgccgctcgtttcgctcggagtagccatgctccaggcgagctcggagttgcagcagcagccggcggcggcggcggcggcggccgggatgtgggtgcccgggatgagcccgcaggcggtggacgccgggctgtcggcgagggcgcaggagatcgcgcggaggcgggaggagatgctcgggatgctgcatgacctccccgagtccgagtacgagctctcgctcacggacctcgtcgagaaggccggcggtgtcggcgtggcgccgccttcgccttcgccgtcggaggggaaggcagagccgggcccggcgcggacggcgtccggcaggcagtcggagcagcagcagcaggcggcggcggcggcggggaggccggagaggagggggtcggcgaggcggtgggacagcgcgggcggcagcagcttccgcagcagcagcgacggcgtcctgctcaacttctacatgccacgctccttcacccgcagcttcaccgcgccgcgcaccactggccccggccggccgccgtcggtctccggcggccggaccgccagtgtctgctccgatcgcaacaagaggtaatcaatcaattctgactccaactaacactccatctctatgttctccatcagtttgattgcaaattaaggagattaattagtactagatcacgaagaacacacagaaattcgttagaagaaccaactttttcaacacaaatattgtactatttagtaaattcgtttttattcagctagcgataatatagtactcccacagcataggaccaatcaaacccgtacatagacagtcaacaaaagcaaaacgtataagcatcaaagccggcacggcaattccaaaggtaaagtaaaacgagtctacatagaaatggtcctactctagatgccgcctgctgatccgcgcaatctgtaaaacgaagatcaacctgcttgactgcttgtacgttccccacatcattccacctgttactgtttggtatatccagtagtacatgctacagattactgttttacacgagtagtacgagttactgtaaatgcgacgacctactccgatggagaaagcaagggaagcgagtgtcgtacaaacggatagatggttaccacgcaaccacatgagtcgggacaaggggacgcgtccttgtctcactgaattcgtggaccagatagcgtgcgcagcgtctggtttaatgccggcaattctgagatcgacttgctaatcgcgacgtgaaacgaactgatgatgacgatgatgcagggagagagatggcgagaccgtgcggtgctggtcgctgctgtgggatcggcggtggcgcaagtcgagccggggagatcacggcaacgagtccgccatccgggccgcgatcctcaaggcggcgaaacacaacgcttcttccccaaagaaaatctgaatgctgctgctagcgtccatcgttttggtcttagatagctagcgcagacttatctgcctgccaccactgggtgtatcaatactaatgtatggttttgtacatacttatgagtgtccattttgtgcttgtgaactgattgtgtgtgaaaaactgaagataggcatattggaaatgattccataattgcgtgcacatccagggtatcgttgtgaactcaagttcagtttataatgggaggcagtcgagatgaatcatatgtattgtttctgaagcattttacaaaattgagatgcaacattgaacagatatactgtatagctccgttttccttccacgccttgcactagcacataatgtaacgggcactaccaagatctctaaacaagagtcatctatctctaaatagactagaaaagaagctacaatcccaaccataaccttataatctcaccccagatggcacttggaacgaacatacataaatatgtcactatggacaaagataacctaaaataatccttatttgccatcattcctcaggtcttattgaagaatcccttttttttctttggtgaggatcttatcgaggaattctgttggccaaccaacatcagtctcagcaactctgtatcaacaattttccggagggcgtcagattcatatttagctgacagacaaaatgtgctttgcaaatattaattatcagaagtacttacattggaaatctttatccaggattcaagtgtgttgatggcctccccggagcgttgtgtttcctgtgctaacgctacaccatcatgcaaagtatttactttaccactgacaagaagagatgctgcagcattcagcacctatgaagaaaaaaagattgattaatgttttgcatagcaaagcaactcaacgtgtgcaaggtaataattaagtgtcatatatgatttgtgaaaaaaaatctaaacaaaattaaatcctatcatgacaaggatcggtaagctgtttatgacagggcgcactgcaaacccccatctattgaagaacttcctatgaaatattcgtatgttaaagataggctaaccactgcagaattctgagttcattgtaaaaaaatgcattacaagaagtttagaaggtagaaagtagaagtaactagaaagagaggataactgtaatgattaacttacgagagcatcagcaattgaacctctttgaccagcaagaacatcctggagaacttttgcgttgaacgctggatcacctccttttagatcttccagcgtgcagcggggtataccaaaatccactggattgtaacataattttaaaaagtgagactaaaaaaaaagtgtatcatatcgtcataatgtatttcagaagttagcatgcataattagaaataagtataatgtgcataaaacatgcaattgatgagactaaactcgaagactcgctcaaattacacaagtgagtccaataaacagtctctgtttctaaaaattctgagaaaaacatagaaaaaaaaactcgtacatggatcgaagagcattttttcaatctttcttggtgtgacatcaaggatatatccaggccctacagcattgataaaagaaattctcagttaaatgcagaacacttagttttaatattccaaggtatttttttgaggaatcatggaattttagcagcagtgtagcacagtggtgaaatggatacattagtatgtgtccgtaccaagtgggcttatttcatccaaacccttcgaatggacaaccaatgctctcttcattccaaatttctgagctgccttagccatcttggtaacctgagtaaaacaaaatatgttcattagggatgaacaatgaacactagatggaaaaccagcaactgcaatatagcttttagcggggctgacatctcaagaaaaaaagctttataaccatgtatctgcaagtcaagtaacacaatatttgctaaagatgaagttcactaaaaattggaaaaggagaatcttatatctgaactctgaattgagcaacatcggttcaacagctcaacagtagatgtctgatgcttgcctttaaggtctttaatataaactcgcatcatttgtcaacttaaaaactgccctacacctactttaagtataaaaccaagacaatagtggtgatgatgacgatcatgtgggtcaacgaaatattaaattgtcactttaaaaaatcttttcttgcatatcatactatttatgctttgatgatttactagaagaaaagaagaaatgaataaggaacttactatgttctcgtggtaaacaccaataacagcataaggcacccttgctggatttaagagaggaccaaggatattgaaaactgtctttattttcagcttcttcctcacaggtttcacgattttcattgctggatgatagtttgcagacatcatgaatccaacacccacctcattgacacatcgtttaataccctgaaaaaagaaaatacaataatatatataaaccccaccaggtttctgatgccataagatgcatataatagtgaataatgtaaaatttgaaaagccaggggcaaccagcctttctgtgcttagaagaaacagccacattataaataaatggagcgactacatctagaattcctaactactccctttgtccacaaatatctagagacgagtctaaatatgtaacaccattcagcctcagtttgtgactacaagaacaagctatgtgtatctgcacacagtaacttcaaatgttgatgttcataatccaattactggaatccaacaattcaattgtgcctttttacaccgataagcaaacctaaacaaatgatagaaccataaagaggctgatctacacatctatgtagtagatctgagatgtcaactagacaaatggggcgtgcttcgcacctcagtcagatgaaggttggaggtaccaacctcagtggtcagcacaaattttcagtaagctatatctgcttgcagtggcagagagacagaggactggcaggggccgtggctacccctatccccaagtatcgtactattttacgcggtacacaatttagcactagaatgagtatagatctatcatttggaacatgcttatataattcctactgcatggcctgctctacaaaattttctagttccgctaccagcagcttggtggatgtgcagctctgcagtcagcaccctcagtgttggagcaaaggtttgaattgggttatgtattatgggtatggatactggtgttgtagttctaatgtagaatctctccctctgtttatgtatctcatgaacagaccaaaccacttgtactggaactttgtgatccactgagatgcaggtggcctgcttttgtagcctaaccttttattcccagaaaaaaaaatacacatgctgtaaacatcacacgtgtctttagacgaaagggagctatggtcttcgactactcttcatagccttcttttctttgggtggcttgcaaagggaccatgctgtttcagcttccatttcatatgtacgattatgtacttgacagagaaaaaaaaagtcaaacacagaaattacttcaccaaactaaaggttaaaaccacacgggtgatctaggcctgcaacccacatcatattttagaggtattcacgaggtaatatcacttgccagttgccatgaagcatgaatagtgctcctactagtgctacagagtacaggagtacaatataaatgcatgaatataagatcctaaaggcaatactagctcacaggaccaggcagaaagcaatcagtggtcaatcaggcaaaggcaactacctcgggtcccaactcgatgttgacaccaaacgcctccagcacatcggcgctgccgcaggccgacgagctagctctgctcccttgctgcacaaaacgcaagcgagaacacattattgcatcaccactagtagtactactacctaaatccaattggagcacaaactgaagggaaaatggcatgcgcatgtataatctcccataaacaaatgaaaggggcgaggagccagtaccttggcgactttggcacccgccgcggcggcgaggatggtggagccggtggagatgttgacggtgtccgcgccgtccccgccggtgccgacaatgtcgacggcgtcatcgagcccgtcgacccggacgcagcagcctatcatcgccttcgccaaccccacgatctgagaacaaggcggagaaatctctcactcccatctctggaccagaacgaaatcaaaattagcgccgcggctgaggcggcgcacccacctcttcgtaggtctcgcccttggccctgaggagcacgaggaaggcggcgatgcgcgcctcgttctcctcctccagcagcagccgcagcgtcgcctccgcctcctcctccgagaagtggtcaccgccgatcagcgtctccagcacctgacgtcaccaccaccacaacaaacaaacaaacaaacaaacaaacaaacggctgagacgagccccggaccagatgaggacgaagagggggagaagcgacgagacattgcggggcgcaccttgtcgaaggaggcggtgcggggggaggcatcggaggcccgcgcggcggtgtgttgcacggcgacgcggggcggcggcgggaggcgcgcggggagcggccgcgcgtggtgcgcgcggagggggaggaggtgggagaccggcgcgggggcgaggggcttggcggaggaggagagcttgatcgacgccgccgccattggtgcggcgaggcgacgcgaggggcgagtggattcgtgcgggttgggggtggggttcagacttcagaggaagagagaagccagcccagtgttccgtgtgttggtgtgaggcggagacctgcgagcgagcggattttgtagggatggctgcgaaactgaaacagatctgctcgccaccaacctcacttttcttttccacttttgggtgtgtttggatctaaagtttgcaaaattccatcacatcaacatgtcatacacacacaacttttcagtcacatcatctccaatttcaatcaaaatccaaactttggacggaactaaacgcagccttgttgcataggatgagtactccctccgtcccaaaaaaagacaaaccctcgtttccgtgtccaatgtttgaccgtccgtcttatttgaaaaaattatgaaaaaaaattaaaaagataagtcacgcataaagtattcatcatgttttatcatctaacaacaatgaaaatactaattataaaaaaatttcatataagacgaacagtcaaacgttggcacgcaaacccgcggtttgccttttttttggacggagggagtatgcaggaataataataatctgtactacagttattgaaagtttgaaactacagtatctgaatatctgatctactgccgtactaactctttttattaggcaactatttccttaaatggttaaccccctttaaaacgtattataggaataaagaaataaaggataggaaaaacatataaattgaagtagcgtgtttctttaatcctataatatggagtagaaaacacagacaaggttctaagatatctaacctctcacttaattctctttagaattgattataggaatgtaatactatacaaagtttaacgtccttttcctataaatcaaaggatatgggaactaaatgttgattggttggatagcattaccgtcgtgcacgtagcccatccaggttggatcctaagcgctcgcaaaactggcatgttccatcaatagctgtgttactgtgtatatctgatttatatatagaggccggatatatccatttttttttaaaaaaatcatagggtatataggaagaaaaatcctaagaaaattattcctatgattattttttttaccaatccttcgtgggcccttagtatagaattacaacatggtgtaatttaatgcctctccaaaatgcatttggtacaatcactttgatacttttatcttataagaaaaaccgtgtaatttgatgtttgggagtaggttgcagtcgatgagtgctttagagcaagtttaatagtatagtccactactagctccaaatcatctataaccaacgcaatagccaattcatacaatagttgcttactatactattaatacctagtctcactagtcatacacatattacgtcttgaaatccgtgctgcagctgactatatgtagcccgctgctcttctctctcttcttttatctctttaaaatatgtttatagctggcttgtagcctgctattgtacctgctcttataggactatgcagcatatgtgccatacatcctacactatcatcggattattccaaaaaagaagaagattattataggatgaattattgcgcacgtggaaatcgcgatgtttctacgctttggttgttggagagacaggacgaaaaactcgttctcgtgagctcgtcctgctgatggtactctccctgcttcttccgtggcgaccttttccaacgatctggctgtaagattttgctgattcgttgcacaaacaccacaaatccaacttgctcatatcttttgtcgcgaccacgatatactatgttatgtttgaattgatgaaactgatgagactggaagattaagttaacgcatgtaaaatgaaaaaaaaatcatcaacatacgactaattatgatttaatcattataaatttgacaaatagatatttgatattttaaagcaaattccgtagaaaaatttcgcaccaatcacatcatttagtagttactccatacatctcattttaagtgtgctgtggacctctgtatccaatatttgatcattcatcttatttaaaaaatttataaaaatattagaaaaataaatcacgtgtaaaatattatacatgttttatcatctaatatcaatgtaaatactaattaaaaaaaatttaaaataaaacaaacaatcgaacgttagacgtaattcgacagctacaaggaggagagagtatgtgctaacgaaaatggacataaaatctagtaatctttaactagaaaaggacagttgctcgaccggttccctatctcgcgtgcgtatcacatggcttgttttcaattcgagagatttcgttttgacgagacaggcatgacatgacagcacccgtgtttagatttaaaatttagatactcctttttcatcacatcaatatgtcatatacacaatttcttagtcacatcatctttaattttaaccaaaatctaaactttacgttgaactagacataaacacagcctccattaatccggtcagagaggacagcgagatagaattattttttgccagccaccagtacgtgcaagcggttcggtacaaactacaaagtcagataatgctcgcaattgcgtaatgttggattaaaaataggctacgacttctgcagatagtacaacatttcttttctcccttggtgacaagcgcggggagccggggaggacgagtagtacggctgcacggcaccgcgcttggatgtagatgaatggaacttgactactaggtgtactcctacctctcttccgttcagctccggttccgggcaagataggttgtttgctgtgcgttcgtagtgttgttgcctgcgatggggacatggggtcacggcagaattttcctccagtggttggtagatttcaggttgccggtgtttgcccggcgcctgtggattaccaataacatcagggagggatatcagaactggatgttgattttttttatataaatagatttaaaaaaatcctattttaagaatagatctttttcctcaacatcagttcattaacacgaaagttcaatgcctcgacgccaataataactggcaccctaccatagccctctgtaaaagcaaagtcaaatagtcaatgatgcaaatgggatcggtaccaagaatattagcaccaaggacctactccgtatttataaaataaactagggctcggtttagattttaacttttttttttaaactttcaactttttccgtcacatcgaactttcctatacatttaaacttttaacttttctatcgaatcatttcaatttcttcaaactttcaattttaaggtgaaactaaacgcagcctaggtcctcaagcgccgactcctctacatctcggctgctagagagcaagggtgtcagtgtcaaaacattggatcttggtgccagttgtcctgttgccaagactatttatgaaatatttttttctaggggtttatttataaaataaaatttaaaaaggaccagaccaaaatgtcttggtgacgtgtgcttccgctattacacataccgatcacgtgtgcgcatccggattcccaagaaagaaaaacattgcataatactccctggattctagggagcttcgacacgaggaaatctgcaaaggacaatggctaacagcagttcacactgccgtcgaagagtcgaaggcttccccatggggaatacgagcatcaaacgtgcaaggataaaaatcaaaacttactacagtgttgaaggtcaggtttagcaagacaacacgtacaatcatacactctgtgcccacaaggttcctgtactacaaaagcgaaaattgaatactttaggcagaaaaagagagttggcaacaaaccaaaccaagcaacaagaacgagtcagtccatttttctgtccccagcggcctaatctagccaccgagtaactccatcttcttcactcgcagctgcaaggatctcgatacagacgtccaata

SEQ ID NO: 44696 - DNA, 17110 bp, Oryza sativa
aaagttgcactagtagccctataaatgttgcgcatttgagcaatcaaacttattacttttggttgggtgtatctgcttgtacagtgcaacttgtacaagtagaggtataaaacctaagcattaaatagaggcacggacaagtgatgaaacaagtcgaaggaacagaggcatcagattaactatggaaagtaaaatagatgaccttacaaagctaagattgaggcctaaatgactattcgatcatgagctttttgctaagtttcgataaatctgctaaaacaccaaaatagaaaagaacagattcataagttcgcttggctagaagtgtcattaatttcaaaggaaaacatgatagcagaccttaatatttttttaagcagtaatcagcagctaccagaaaaggagagatgatacctgcaatagtttaccaccagcgacgaaggaacgtaatcccatggtatcctgaaaggcaaattgggtcagtagaagtgccagtgccagatatgcgtcacattaaagtaaaatttgaatgggtaactgaagcaagcacaaaaagggaaaggctaaaactatattaccttgtttttgaaagtgactaggaactgagcagcagggtccctgtttgtagcatttgacacgatatcaaggatccaaccaccaccaccagcaagtctctgtcttgcaacatggaaccctgaattatcttttgttctcaaggctacaacaaaaccatctttgagtgtatcaggatatttccttctgagaactgtaggcaacttcgtctcagaagttatttccattggggattcagcaggagatttctgcttgtattttgagtcctcaggagacgcaaatcgtgaactggaactcaatacctggtcccttccactcattgcagtatcatcatctctgcgtgaggaataattactgccactctctacagcagataattcatctgttttctgttgagatctgcggcgagcaggtctctttttccctttctttccagaacggctgcgccttccttctgatcgggggacaatatgttgagatctagcagatgcttgaggctctttatgctgggatatggctctcctcttttcgtactccatttttaactgactttcatctgtctgctgctcagaataaaaaacttgtgaactgctaaccttttcttctagctgatcatcttcatttccagcttcgctaatttcctcatcttcatcagatattgcactacttggaacagcaccatcaaagaaaaaggactgcaatatcgtgattgctttctctcttatttccatccacacttcttcactgtagtctgcacttcgaggaagaattaaaacatttggcatctcccttacctatgtcaaataaatagtatccatcattttgctgaacaacaagttctttttttataagatggatgatgaacaagtggcaccaccatagcaatgcagaaaagggcacagttgtttgtcctctactactagcatattggttgttgctcttctgtacaatatgcagaatcaagagagttcaaagttatccctaaaatagtaagagctcaacaggtggagtgcagggaacttgaaatacttgatgctaaactaaattaaatatttactcattttccatatgtttttcctagagattccttttcaacatccggaagagcagagcattctaaatggtgatgttttgatcttagatgaatttcatccatcgcaaatggccacttatcaacaaaaaaacacatcaaaagctgatggacgtacccacgcttccatccattgtggaccttcagcaccatccaatgcacaaccagctattgtaccatcaatcaatagctgtttgagtgcacaatcatctataagttggcaacttccagtatttactatgaatgctcctgtgagataaacaagaaaattatactgtgttttacggctgaactaaaggcatgataagcattatttcggaatatataatgcataaagcagaagaaagaaaggggttgaagataaaccttaccaggttttacatgctgcagacagtcagcattaagtatatgcatcgtgtcatttgttaatgtgcagtgcagtgaaacaaggtcacttgctgccaacaaatcattgagagtatccattctcctggcggcagaaggaaatacaatggaaggccgctttgcttttccattagccttcagtagacatgctaattcagttagaatagtcaaaataatactttaccgcctagcatttcttaaaatcagtaggtaattgcatacaagtgcgacaagatatatatcatgaactttggacataaataatgtgaactgaacatgaatttggggagatttcttaatgtaacagaaagttaatagcccatgaaaactttgggggggggggggggtaataggttataaccagataagatatacccatcaagatgttcttgtcacaatgtcatcccctcctttgcattttagcataagttactactccctccgttccgaaatataagcacttctagcattttaaatttgtaccaaaatatagcccttctggtgtactacttgtcccatcaccccccccccccccccgaacacacacacaccaaaaaaaaaaaagcttcccatattacccccaaggccccaaccatacctcatctatgagggggcatcatagtttcttttctattcacttaatctttgctaaaaccctaaaaatgcttatattttggaatggagggagtattgttcttacttctttatccaacagctagcattcgtaccacagcttacagagaatatatagttgtctcattcagaaagctgaagaattttgctaaaatacagggaatgagatcattcagctcacaacattacaaagggacgtctcatcataggcagaagcagtgagatcatttaagtcataacattccaaatctttggactgtctaactgttcaatcacctattccaacttaatatgttcaaagaagtttgttcatagcagaacattactaatcagaaaacaactcattctagaattgggggtgaaactgttccagtcggttgctaggtgtatgaccaaatgaaattaccacaacaacaatgcgcggattaagatccagagttttagagctgtgcaagtatacgtagaacagtagtaagaagaggaaactacaggagcgtagcaagtcgtagatccagtaccgaatggcgcggatcgaagtagaggacgtccatccggaaggcgaggctgcgagtggcgaggcagcgggcggcggcggatcgaccaatgatgccgagcacgaggccgcggcagcgcctcatgccgcgacacatcggctggacggagcctagccacccagcggcgacagcggccggggccgacgaggcgtggcgcgagagcaggtgggtccggcggagcagcccgaggaagagcgccatgacggtgtcggccacctcctcggctcggttggcgtcgacgtggaccaggcggaggcccagctccgcggcgagggcggcgtccgcggcgcggtcgggcgacccgaggcagagcaggagctgccacgggcggaggcgccgctgcgcggcccgcgggaggaaggcgagcgagggcaggagcacggccgcggccgcctccacgcgcccggaggcgacggcggagagggggacgtgctccacccccgccacgccggccagcccctcctgctccagcgacgggtcgtcgaggcagttcagtgacaccaccagcggctggcccccgccgccgccgccggaggccgccgagcgggccatccctgcgcctccctctcggcgctcggatcgggagcgtcgcgtggcgcgggttttggtgcgggcctcccgtctccgggccgaggggggctttttgtcccgtgcaaagggaagaggaagaagagggaagaaatgctctgctgctactacgcttgtcagagtggtgggccgcacgggggccaccactcaccagctcacgagggaacggtgcgttgcaaaccgtcagattcgcattgttaattgtttgcagcttgtgcttgtgtctctcgcgccactgccagtgactgagcagatgcaaacaaatcttgaattatttctttaattcattgtgatgattcgaaaacattatttagcatggcaatatttatgaagatctagtagctaaagtccagaaaagatcagttggcatatccatcaaaataagagaagtttgtttcttcgtacttaatcatggagttttgggtaccaagtaaagcactctctgcttttcttccctccaagcaaagcctggtttagttcccaattttttctttaaacttccaactttttcatcacatcaaaacgttcttatacacacaaacttttaacttttccgtcacatcattttaatttcaatcaaactttcaattttaacgtgtattaaacacaccccgagagaaagattgcctcacatcatttagctgccaaggatagacagctgcccgccgcctgtgtacattgtaacaaaaatgccggactgaactcaagtgaagagttaaaagatagagacatagagttccatgatttccatcaagtaacccaacaagttagcacaacaagatcatgccatcgagcatcatcattcattatagtgcatgcgcttaataccctgaacatttaccaggcatgtgatatatcgtcacaatcaatctagaacagaaaaaagtatgcagagcgcaaccggcatggaggcatgttactcctccggtgcattgattctgctcaatcacacaagcagcagtacagcatggttgctttcttcagagccctcatgaagggggaagtaccatccatgcatctatcagtgaaagctactaacgaacagtatttgtcagtgaaagctactggacagctgttcagacaaaccaatttgtcactttacgaagctgacatggatttttccttcaaacaaaaatgcatgaatattaacagtaagagatgacaaaactgtcgtgtagtatgttctgaacttcgtgctgcttgtttgtcttgacaaccttccaacattcgcacattcactgagttcaacttatgcttcacttcgctatgctacttaacttcagaaacaaaatttgagtgtggctcaattaccttgcacttctattccttgaacatttcagtgttgcatcagaggcatatgcctaaaacacactttgaacaaataaccaagtcagcatggtattaaagttttttaatcaatcagacaggcacatagtacccctagagctaataatcgagtgttgttacgttaacggtacataatactgtctgcagctaccagctactactcaccagaaagagagccatcaacagagggggcacacaagttgttgaagcaaatagggtacatctagaagaaattgttcattctcaacctcaagcaagttcgcaaggtacccactgtttcacttttgtgctcatctcactaggaactgaggtagaccactcatccaagtttggaagaggacccgtcaatgcaacgtaatttacactctctttctctgatagtctcttccagttgagctgtaattcaggtttacgtcaggtgggcattctaacaacagtgacatggcattgctcgtatacgtagcaacccaaaacagttaaacaattaccattccatattttattgttttaaacttttccatcatctagtactagaaactatacaactacagcagtcaaaatatggatatttctgtggttcatgtataatcttacctgccccggaaatgcagcacagagtgccttaattgtggaattctgaacccaggacgaaaggcccgtatcattagcaagagatacagcagcatcagctccaccacagttaacaatgatccgtccatctggcattagctttttcgcgatttccaaccaggtttcaacctgtaacaatgttgaaattaaatccagtagaaaataaaaaactgtggaagtgttccaaaaagttaaaagaatatagatatacaaaagtagcgtccaggaattttctctcagctgcacttttacatgttttgaaaaattgttcaaattatttcaattgcagagaatcatatcagccatttggtcaattaggcttgaaaggaagggtcgcaaaggagagtaatccatggatgccgaagacactaaggtcacgtaaggttttttgttaagaacactaaggtcacacaagtagcttacttttgttggtgtatccaaagcaccctctattgatattgggatgcataagattttttgtcgacaaattcacatatcactatagcaagccagccaaactaagggtaataaatcaacacatcatgagataaattaaaatttattacaaacttcaagatatgtagatatcaagtaatttcatccatgcttgaccatgcattcaactgatccaaggaataagaaatacatgctcaaaagcatgaaatctgatgcaaccaacgtagcatatagactggtaaaaaatgaatagaaagagatgcagaggaaatttacttcttgtagctgaggtatgatcttcccatcagcaaacaaatcaacaacaatacctgtacacattaactagatgttgttaggccagaaaactttgagatgcacttgatggtgaagttgcaaggagtgtgtggtttcaaccccgacgttttttgttcaatctccaacacgctcacaatttcttcttaaaaattgtttggagagatgtctcttcctccaaactcttattttttaggccagaaaactttcaaagcctttgaaaactcaaaaagaaaaacattaatctaacagtacatgctttccaatatactacagataatccaactagcatactccaaaaatgcatcatccaagagcgttgtataattaaatagtaacaagagagtaaagcatgtattccatttgcatcaggtagtaagcactcaccagcaaaccctccttcaattgtcagcgttgtataattaaatagtaacaagagagtaaagcatgtattccatttgcatcaggtagtaagcactcaccagcaaaccctccttcaattgtagctgacggagaaagtgcatcaccaatgcgcacagaaagtgaaccacctgattctgttgccttttctaaatcagataaaccaaaataatcccttgacagttcaattatctgtcattcagtaatgcaaactgagagtaagaaatgggcatatgaaaatggatgcgtggagcacaagggataagtctaaagaaaaataatgcaaagaggtgcttgagctagcttaacagccttaactaggaatatattactgaatttctttttgcaacacaataagtaacaatgtgaaaatatttcactaccatctgtgagcctgtggtcaccaaacaattaaaaagagagagaacaatgaaaagagtgttcaccttaggatcaatctcccatccaacaagttgcaaccaaggataaaattttagcatcagatgtgctgcagtcccagcaccctgaaaaagaaacaggggaaaagacaggaatcataatgtgcattgaatatccacaagcgtgtgaagaggtaagttgcccgtgaaaaaaatagaagtgagttgttcaaatgaaaagcctccgtaatgcttgtggatgtatgctggaattgtgatgtgtgctgataatctaattgcaattggtcggtaagacatccattcaggccttcccaaaccctctaagcatggcaggaattttgctttttatgcatagtagttatgcagaacaatgaagtatgatgaacaagataataggtgaatcatgcaccaagtgatttaccaatcctagaagagcaacaggaccacgtggaacaacagctggtaggctcacgaactcatcctgtacaataggaaaagcacaccgtattaagcatttacattgagcagccatttttaaaggatgaaaaacatcatttcaaacagaatagttggcgtagaaataggatgcgttttgcaaagaaaccaacccatcacatagataacaagtacctatatgagcatattatagtctttttttttttttggtactaaactgctatccaactaccaggagcctattactgtccttctcaaaaacttgtttatcatggatagttgacgggatagagcgtcaaattcctaatgcatacaaggcgctcaacaatattatgcttgtatgtcaaaatggcacattagtaatctaaattcaactcgatcagttcagattactcatacgataaatgcataccctgtcagcactcccgattgaaatcgctctcaaatctcacactcaactcaaactttcaactggatcaatttgggaacactggacgaacagcttgtaggcatgaaccttggtagacaaaggttttcgtgctttgctagttaatctgcagcttttcggttttcttccctccgttttgaacgacaattacaacaaggttagggccacgatcccatggtgcgctccgtgaccggttagtggtgaatgctatcccatacgccccgggtcacggcgcacgacggcacgacgcgctcgccggctcaacggattcagcaaaagcaggcgaaacaaaacagcaaacacctcacatgcaatctaaactacgctataaagattagaagcaaaggattacagttctatacccaatatgagttggtccagactccggtcttggggagaacgctgtgaacattccctgcacgatacaaccaatcgggagcacgaactcaccaaacgaatccaatttcgaggcggaggaagaaatcgcagtgtgcagcgcaatacgtacggttggtgtcgaggaggaggtagcgggtggcgggcgagtcgatgatcatgatgacctcgttgaagtcgctaccggtgatggcgaggagcgtgtactcctcctcctcctccttcgccgcttgctcctgctgctcggtggctggaggggcggagacttcgccgccgccaccgggggcgcagtacagcggccgccgcgccgaggccgctccccgtcgagggaggagggagactcgggtggcggagcggcgttggggcttggcttcgcggcggcggtggcggtggaggaggcgaggcggggagaaggttagcggcatggtggccattgctgatgagatagaatgctaatgcacggcgagggattgggttcccacgatttcaagccgttgatggagatggcgggttaggaattcccttttgataactgcaaagcgtattagcgtaatcggttcttctcttaaaccatgattatttcttaagaggccttttcggatgaggcccgataagagaaaatttcagaggcccagcagatatagtcttacaatgttatgggccataattgggcctgagtattctagtgtggttggtttcatctgaaatcaaactgcgaagcaagcaagcagtaaactcccagaataatagcatttcaaacctgtacaagacaaacaatcttgatgtgttgtattgattcgaaacttcgaacggctgtttcagaatatgagcaattttttttgggacaggaagaatatgaccatagtacttaactttctcgcaggtaccacctactccaggtgattgtgcatgataaaatgaatctgcagctaacaacctagcctctccccaacttccaatcagtttggtcaattggagcctttggacacatgcatcggacgccaattgacctgtcgccggccgccgggagacacgccgcgacaggggccacgacgccgccatgacatccgtaaaaccagcaaagctgcaaagacatcgcggccgacactgacgcacgcaacggcgcacgtcagatgagcccacgttccttgagatcgccggcaaatacactgggaattcgatgtttcaccgatccgccggcgccgtctcgcgcaccgacgcagtttctatcaaccactctctccatccaccaaattagccaaaagaaaaaggttcggttggtacttggtaggctaagctttctagctcgttttctttgtgctttggctcgctatcaacgagcagcctcccgcacttcacggcctaatctccatcaaattgcagtgacaataatgtactcttaaacgtatttaatgacacgtacacatgcagcgaatcccgaggacgtggatttatactgcaactgtagttaacgtgtcagcgcagtgcgtgcatgcgtgcgtgcaagcgtgcaaggtgcaactgtactgcatgcagcatgcgtggacaagacgtacattagctagttggtagtggcgctgtacgggagaggtttcgttggccggcggcgagggcggtggtggttgtgttcgccggcgccggcgaagagctcctcacagacgtcggcgaaggcgcggaggatgaggtggtggtggcgcgacgagttgagcgagaggaagcgatgcagcagctcccgcagctcgggggtggccgtgatctcgttctccacgatcatctgcgccatcgaccgccggaagtcgcccagcgggtcgtccgactccgtcaccaccggcacgctctcctcctccagccgcccgcgccgccgcctgccgcctgacgatgcatcgctcgcgctcctcctgtgccgcggcggcggcggcgtcgccggcctgatcccgcggtcttcccggacgcccagcgcgcgcacgccgcgctccagctcgcgcagctgcagcaggagcgtgcccacgctcggcgtgccatccgcgtcgtgcacggtgttcggcgcgggcgtgggcacggtcaccctcgtcgtcttcgccgacgtcgcggtagcacttgacgtcatcgtcggtggcgtggtcgtggcgggcgagatattgccggcggcggagagccgggacacgacggacaccgacttggcgccgccgcagccgcacatgaagccgcgcgcggccgctgcgctcgaacccttcttcttcttcttcttcgatggtaggccctgatcggccatgccgcgacgtgtcgtcgctttcatgtccttgggttgagagcaagtgagcttgtgcgctgtttgttgtggactagctacaccagctatagtggggagctagggggacagacttcttaaagcctgggcttaacaagagccagctaggtgaatttcagacatgctgatgcagtagcagcaattactcaactacagacacatttataattccaagtcattaaccaaaaaattagtatcacgctatccgttgttaggaggtcagtgtcagattctggtcgatttaccagcggtaatcttgggtcaatccagggtgaaaacaacattgacttacaaagtatagctcaatactatttctgaccgttcagttaatcggttactactcctatttgtttcagacttatacgcttaccattctgttcgtgtacagatgtactgatgctttcagattttgcataactctatttgcaagggaagttattacaaaacgcacgcaaggttgtactgctacgtcagaaacagggcaaagaacacatcagacaaatgaaaaactaacataccatttcccaagcttgcgcgcgatttgcgcaactaaatcccagcgaatagaacaaaagagcagatgacacgagacagaggaaaatccaagggatgtcaaagcgaagtgacgggagatttggatgggcctaattaacagatttcctttcaaggtcagagaccctactgcaaacagcaagattacactacagagtacagtacagtgcagaggaggagagatgccttggaagaaacactgtgctgggcctggacgtttgtttgcttgcttgtcacatgcatcttctgctggtaatacattccggccacgctaggcaaagtgctccccgtgctctgctgctcatgatcatgatcatgtcctcaacagaaggccaccaaacttacatgcttgctgtccctgcagctaaccgagattgaactagtgaagtgaatcagactgtcaggaggtaattgatgcagtaggaacaccaaacagcaggtgtaacagacaagtgtgtcttctttagagatactgatcattagatgatggtaatgtggcatacatcaaaacgaaaaaaatgcttcattagactgctggcctattctgcaaaaaataaataaataaataaatcgcattctttttaaattggcatgtcctgcctttttgagttttgactctagcacaggcacttggtactcgatcaaacatgttgtctcctgataaaaggtggcaactcctgtatcagatgcatcctggggtgattgattggaaacaagaatagttgtcttcgatcgttgtgatggacaaatggtgtggaatctcaatgatgtcttgattggcttcatggctgacggctcatgtctacctgggtatcaggcatggagcattacgaccggactcaaatgatggtatcagcgccggcgaaggcaatgggccaaactagggtcatatccagagaagtctagccaaacactgatcttaactcagcccaactgattcttggcccagtactacatatcatttctcagcccatctagcataaattggtagaaacagcccaaatacccgcaaaaaacagaaagcagcccaacatctgccttgtgaaaattgggcctgaaatactaacaagcccattatatccacttacaaaggccctaagtggaataaataaggaataagttcatctgaggtcccttaacttgtcaatgaatccgatttccgtccctcatccggaaaaccagacacaacgggtccctcaactatcaaaaccggtgcagattagttcattcggtggttttgaaagcggttttagctgacgtggcgcctacgtggctaatttaactcggtcttcatttgacgtggcattaacgtggcgattacgtggcaattcgatccggaaaaataataaaacccgtaagacccacgtgtaagtctcacacagaaaataataaaaaaaagtggtgggacccacagtcagtccaactcacctctcctcttcttcctcctctctccccatctccctatcttcatctctctctcctctcctctcctctcttcaggcgacggagaggcagcggcacgcggcggcagtgcggccggacaacggtgcctatgcggaggagctcggccgagcgacggctcggcgcgagcgtggccgtgtggcggcgccggccccggcacgggtcgcggcctcggcggtgcggacgggcagcggtgccgatgcggaggagctcggccgagggacggcggcaccatttctggcttccctgcctcctccctccccgcccacctcgccggccgccgcgcgccgcccgtctcccgtctccgccgcgcgctgctttgctgctggtgaggtgagagaaaaagaaacagtgagagagatgaccagttcgctcgcgctgcccgcaactttctcctacctccggccgtccaactcctcttccctctcacaggctcacacacttggcgcgccccttgatcaattcgttccccttctttttcttcccccttgcttgcagatgggggcaactagaggaagcggctgagacaggcagaggcggcgggcatggtggcgccgcatgcagaagtgtcgttgcagccgcaggcgcaggggcaaggggcacaaggtagtgagcctcgcgcagctgcacaagcggccggcggtgacggtgctcagtctcgagttagacgatggcgggtcggagcacgtgtcgacgacggcctcctccgcatcgtctctcctctccgagacgagctcgtcacgcaattcgaccagtacgagaacgagatggtgcatctgtttcaggatcatgtgagggtcgtcgttgatcgtgttgttttgttattgctatgttgttcagcgatgtttttctgatggttgtggtgtagctctgcttgcttgttgtagacggagaggctccatcgcgtgctcggcaaggcgaggcggcggcaataccagtcgctgctcggcgcggcggaggcgcgcaggatgagggataaggaggcagaggcctcgaatgcggcgcgacacatcggcgagctagaggagcgtgtcgcgcggctgagggcgtaggcggcggctcggcaggcgaaggcgcttgccgaccagttcaccgcgcgccgctccgcccaccacacgccgccactccgcttcgccccgccgcccgccatcgatccgcccaccgcccccctctgcgccgccgctcgccgttctgtaggggagagagagagggggatagagagaaaagggggctgacatgtgggaccacatgggccccaccttttcttattatttttttatagctgacatgtgggtcccatggtttttaattatttttccaggatccaattgccacataagtgacacgtcaatgccacatgggacgaggatctagtcaaagggagccacgtaggcgccacgtcatccaaaaccggacataatactgccgagggacattttctgcacggttttgtaagttaagggatgcgttgtatccggttttctagactgaggatgaaaatcaaactgggtgacaaattgagggaccgaaagtgaacttattccaataaataaacattcctgcttaacaatcctccagaaatagtttttctccgtggtactgggattgtagtcgtcatgctggttgtcatcctgggagcgaactcttgtgtttggaggtgttcgttctcgctcggtggtcgggttgtgactacggttttccaaaccctagtcacaattgtggccggagccggaataccatacggtaaccgtggtaattgtggcaaaccgtataaaatttatcaaaatttaaattatttttaaaatttatttaaatttaaggaggtttaccgcggtttttcttttaacgcaccccgtggtaagcgcgataactacgataaccacgtgcttaccggcggtttgggaaaacttggttgtgaccaaggtgttttttctctgttttcagaattgtgctgtcttgaactgtgtcttggaaaagctggttttcccagtgaatgatgccgtgatagctttctgtaaaaaccgggtcatatgacctactacacagtacgtatgttttatcgtttgtcttatttaaaaaaatatgttattattatttattttattgtgagttattttattgctaaaagtactctaaacatcgcttatatcttatgtatttagaaaaaaagtttaaataaaacgaatggttaaacctgtatacaaaagtaaactgcgtcatttattaaaaaaggaaggaggtgctttctaaaaagaacaatcttacagaaaagaaaataaatacggaccagctaaatatgttttagcagcccgccagtattcatggagtgcaacatcctacctgtataactatagccttgaatcttgatgtgaaaatggatgttctggccttacttagtttcaaattttttcttcaaattttcaacttttctatcacatcaaaacttttctacacatataaacttccaactttttcatcacatcgttctaatttcaactaaacttctaattttagcgtgaactaaacacaccctctgttcagaagagaaaacaggagttttgggacttagtaatgtctttccaacgccagcgccagcgtcaccatctttcttttccgatcacacggtcatcactcggtcaggttctcgtcttgcaaatccgctcgtctgctagctcacattcggtcaggctcctgccgttggaaaacgacacgacccaacgttccaacaagggggcagcagagtcgctccagttgggctgggagtctctgagcaaggcaaatcagtcttagctaactaaccagcagagacgtcaagcaattggtctcatctctttcagtttcataccaatctgttatcccccaaaaaacaagaagtttcataccaatcgagacgttttgtttgatgtcgcaacaatagtagcccggctcatgttctcccctgttggatgtttgcacatgaacatgctctgcttagcgatgccttggggagttgggatttttggcgatgtgggtttcgtacaccggcaggtgacgggtcgtgtccacccgatcgtataccgtcaccagcacgtccgcgtgccgatcgtgtccaccgaaacaacaacaactactactactactgtagcccaagtcgcagtcgcagccgcagcaggccatcgaccaccactacgccggtggcccaagtgatagtatttaggacgctttcgtcgcattgcattgcccgctcgcccctctgcttttgctgctgttgcgttgcgtgatacgctcgcctaactttggctaattctgctgatatttgctcttcttctgtcatatcaccttgccgctgcttctgatcatctcccgttcttgcattcttcttcttcttcttcttctccggcgtggtgtgctgctgacggctgacgctggctggtcgtggacatgtcgaaggtgaggctctgtcttttgctcttggattctcatcctgattactgtagtagcttctgtgggataaaatgatctctgcttctgaatccagtaaaatatacatgttgtttttgtccgttacacattgcgagcgttcgtataccatggtggtgcgtaaactaacactgatgtttcacatgttcctctgctgcagaagattgtggtgaagctggatctccatgacaacaaggacaagcagaaggccatgaaggtcgtctccacgcttgccggtacgcatcgtgttcgatccatcaaccgttctgcccgtgttcagaaacgatcaagagaaatgactgctgttcgtttatgcatgtcactcatgtcaggcatcgacgccatttccatggacatggcgtcgcgcaagatgacggtgatcggcacggttgacccggtgaacgtggtgagcaagctgcgcaaggcgtcctggccggcctacatcgagtccctcggcccggccaaggagccggagaagaagaaggagggcggcggcgatgccaagaaggatggcggcgatggcaagaaggagggaggaggagacggcaagaaggaaggcggcgatgggaagaaggaaggtgacggcaagaagggtgaggcggc

SEQ ID NO: 44697 - DNA, 7970 bp, Oryza sativa
agaaagacggcagaatcaccggggcttcaaaaggtgggtagattttcatttccaacatgacgaaaaaactagcagaagaatattggcagcagctgtggttgtgatgtcccaattcccatttgcatttgcagatccattttgcatcctataataatcaaacaaacggggagtgaatcgcttgtcaatttttgcggtttgggtgagtcggatgatcctgactttctcgtcacccctgacgacagcattggcagctacctcttccaacgctgaaggactagagaaaggagctcaaccgttcagccaaaggcgacgcatctttttcgttttcgatgaaacagagccttcgtactccagatatatcacgaaacaattgttgttaattatagattgatgcagatgtgatcatgtgatgattaaaaatagtgattttgtgaggtcatgttcagcttccgatcatcaactcgcaaatatattagagcagaaaatacggaaatgaagctacgtgtgtgctgtggtcggtgaagatggcgatggaagaaaatcagaaataatgccattgaaaatttacctggctgcctgctgcggtttttatcatccagcctcacctgacccgcctctttcgttgtcgcagagggtgaaaatgaaatcgctccactcggcgacagaattttcttggacaaaactacatggacagttacctcatgatatcctagaaaccatcgtccgtataggagcagacattgacagataagtaaatttatcgccgtgtttagttccaaaatattttttcaaacttccaacttttccattacatcgaaattttcctacacacataaacttctaacttttccgtcacatcgtctcaatttcaaccaaacttctaatttcggcgtgaactaggcgtgaactaaacacacccatctttggtttctccagcacgagtctatgtcatatgactctgcatttttgtactccctgcaaaaggaaaaaagaagtcggatgaatgatcgcaacagcaaacaaaagcagccactgttttctggtttaaatcttgtaaccatcggcgcctgtatttgagctttgcggttgctatcatcgcactcaagcaaaagccgtatcaaatggatcagcctcgtaatacaactgaaatacaattagcagctgataaaagacaacttatcacacgatgaactactgtattaaacaaatgaactgaaaagattgcaaatagaaattaaattttgatgcttcagttcccatctgctaatgagttggagaacaaggaaacacaggtagtgcagctaactccagggcgatcgcctgtagcttccgtgcagcaacgccggtggacggctgacggagctccggcgaccggcggcgtggcagggagagccgcgagcagatcaaatcaaactctctcctccatccgggccgtattaactcatgggctggtgagaccaaacccgactagaatcgcattggtaccgatccggcccaagaggatgtgatggttcataataaatagcatgcaaaggtgattactattctttcttttatccggccaatcagattgcatcatgattgaatacatacacccatagctcaggtgtgaagccattacagtttcacaaaagaaagaactaacaaagttacactgccattctgctgctaggtttctcaagaacagagcacagcttagtgttacatagcctcccaatttcacattttgatcttattatatacttttcagcactaaaagaaaaggcacacaaccctactggtcaccaaagcatgtaggacacctatttgacatcccaactgcaaatacaaggtgcatctccgggagggccttatacatgcatgtgagcatgtctacagttgcgctaagggtaaaaagaaaaaaaaaagcgctcccttttgcaaggattggcacaacaagatgtgaccccacagaaaattcatcaatgtgcacaagaccaggaggacgatatcctttggtatcacctggagaaatggtgcaaacgctacaaagggggaactacatccaggagcattggatagttggaatactaaagatcacctcttctttgctgcttttgcgtcagattcagatttccacactatgtcttttaactctgacgagaaattgttgtagaactgcatgcaatttgatagaaatgacgttaatcgttctgaaatcatcaagaaacaactagatgctgggtactatgaaatgattttttttttcaatgacccactatgaaatgatagaatatacaaagtttgataacatacattgtgaaactccagcgtgtcccctccagttttacgaagctcaaccatgtggagtgatggagcaacctcgaaaacctgtgagatagcatgtgaataagttcttttattaaagcaaaatttactgaagcattgcacagacttaacaggatacatgtcaatttaatttccaatacctccgttgctacagataaatagccttttcttccagtcttatcaccttttaacttcatctggagcccaacaaaaaagaacaaatccaagttacttctgaatggcgaacatactgatgcaaattctcaaggaaactaacagaaacccacataaagcaaactagtcaatacatagccgtctaaaatgctacaaaccttataattttgtttccgcacattgaaaccaagaggtccacaagcttcctctattttagacatgatctcctgtggtgtacattgagatgtgaaggaagtttcccgcttcaccattccctatatatattaggtagactcagactatttagtaaacgactaaggagtacaactaataggatgataaattgatcaaaacataattgttctgtcggacttagcacataaagaaaagaggaaaacattagcaaaattatattaaccgatacaagcttccagaaagaagcactccaatctatctagcacataacatattctcaacatggaattataatattggactctatcaaaacctaccatcatttccttctcaaataaatttccaaggttgaatccctgtgaccttgaaattagagcaaatgcattcatggattcaggcttttctctcttctctgccacgagattctcctgaaaggttaaacaaacaaacgtaacaaacaaagaagtggttttaactcaggttacaaatcgtatttttgggaaaggatgcaggttacagataaatgttcagctagcattacctctgaacaatcgaatgcagcatcaacatcatcaaggctcacatcttcaccttgctcaaaaagtggtggtttgtaatcctttttgaaccaatcatcttccaaaatttgtgcaattgttattctctgcaaagaatatagctcattgttttctgacttctctcaaattgccatcataaaaggcttcaaagaggatatacaatgaaactcattggactagcagcagtcagctggtcaaactggttagctgaagatatatgtccttaattgtcacttactgtgcagggattaggatcaagtatgcgcttaatgaacttcttcgcacctgaagaaaaccaatgtggacaagaaacttttgccttgcagatctgtgaagagaacatcaaaagtctatcaagtttaccaatgaaattcacaagaaacattagaatgcgtgcatgttacacatacttaccagtttgtaaagggtcattaggttggggtcatcgaaaggtaaatatccagccatgaggacaaataagattatgccgcaggaccatacatcagcagccataccatcataacctttatcagcaagcacctgagggaacagtatgaatatatgattcttacatctttttggagaaaatacacgagtttaatcaaaggcaacatgaatcacctcaggtgcaacataatttggtgttccgcaagcagtatgcagaagtccatcctcctaaataaaacaatcaaaatagtttaccaaagttacttctttcaactttcttgtcaccaaaacaaataattatgcgtccgaagttcatttgaggtaatagtgcaagttaaggaacaagtcaattaaaccagaaaaatgctagaaaacccaaacacatcacattaggataaagaaactggttaattttttaacaactacaaaaacatacttctgggtactagctagatatcatacttttgtttgtggagcaaacgcactaaggccaaaatctgaaactttaagagctccatgtgaatcaagaagcagattctctggctgcaaatggcacataaaaaatatgaatgagaatacatccatcccagtggagattacccagaaaggaggtaagcaggataattcaacaaaccttcagatctctatggtacactcctctgctgtggcaataatctactgcatttataagttgatggaagtatcttcttgcttcatcttctcctagtctcccagaattgacctagttgataataacatgatgataaatgggtcaacttgtatggtccaagaactgcggattagtcagtcagtatcaaaacagtcaaatgtgccggttcaacaagctactcttacagcatgtaaaagcaatttgtacataaacaaaaataagaatcgtgatatctggcacagaaagttcatgggccttacaatcttatcaaaaagctcgcctccatcaacatattcaagaaccatgtatatctttgatttgctagccatgacctgtcaaacacacattgaatgtaaaattctcattgaatgagatgagataaaaaaaaaaagaagggtatgagtggtaatgacgctattgttcctgcaaagatagcaaagtacctcatgcaactggaccacatttggatgttttattagcttcattgtggaaatctcccgtttgatctgatagaagtggaatatgaggttatcattcacaatcgaaagctcaagctggaaaacagaacagctcgagcagggacatttaattgtgccaacacatcatatggaaaatcacatatttaaccaaaaaaaatactagtttttccaccaaacaatgcatcaaccaatgagtgatctagcacggaatgtacaatacccgagtttccccccagtcagactgaatttataactccccgagaaaaaaaaatgaatctagaacaactcttgccactcctacgaacaccaaagctagcacagctttttgctaggcagaaagcatttgattaagacagggttggcatcaccgcatcggagatattgttatagttacatggcccagcttgataatctgttgttacatttccgattcaaacttgatacaattccatctaatttcctttagatcagagcagatttagcccgctggacaggcggacacatgacctttcttcaatcacaaacaatccaaacagacagaatcttgacaatggtagagacgtagtaagcgcatattctcgtttaatgtttattaatccccatgaaaatccatcttttataataatctagcatctatctagaataatttaggattcttaattcgatcccctccgagaaaagatccaacttgttattacctgatgtctaaaaaaagagataaatattcaattttgaggatgattaaggcggcggacctgctcgaccatcttgtggcgaagcacatggttgcggtcgagcaccttgatggcgagggtgtcgccggtgcgcgtgtcgcgggcgaccttgaccttggcgaagctcccctccccgatcgtcttgccgagctcgtagcgccccaccctcgtcgtcctcctcgccggccccgcccccgcccccgcccccgccgcctccgcctccgcctccgccatcaatccctcccgcagatcaatcctccaccgcgcgcctcgccgccttccgatgatgggatcgaggagtgcgcgcgttggtaggtcgcacgcaggctggatggcttgggcgccccgtgcgcgcgcctcaaataaggcggagatgcgttggtggcaggtgtggtgtggggtccggtcgggaaccgcgtgggacgagacgtaggcggcgcgcggcgtgcggcacggatgcgtgcgtgcgtgcgcgcgctatcgttttggccgtgtgcaacgcgacgcgattcacagttttcacaggcagtggcccgaactctatcccaatcccaccaccaccccggcaaaaaaaacgattaatcaaactcgaaagcaacacgcgtacgtaacgagcacgcgcgaacgcggcatttaaccgtggctcctcctcggatggataaatccaaatgtggggcgagattttacgtgttgccacttggagatcgctcctttcggttttctttacgctggagtagggaaaatctcgccgtcgtccaccaccgtggccacagcgacaggcaacgagctagtagtaaccctgaacatgcgtgctttgcaccttcctcgaaggagcacccgtacggtgccgtactctcaatcattcctccgttgaaaacgacgcgctgatccatccgtgctccacacgtcctcccctgaacaaactctggctctcctctgaacaattcaccgcgaccgcgacgacgacaaaaacgaacgtgtgtgatcttgctactgtatgccgtttgctgtgttgtttttccagcaatcatgcacgcaattaaccttgcctgatgtggtcgcggtcggaagcggtgcgccacgaatcagcaagcggctagcaatagcaatagcaatagcagtaggccagtagcagcgtgaatgcatgattgatgccgcgatggggccgagagccttatcctgcggcgtcacgcgggggcaccacaccaccactagcgcctcgtgccatgtcccgttcgtcgtcgctgcctgcactgcacaccacattctctcaaatctttttcctcgccgccatcaaggcattaccacgacagggggcgtgaccgatcgacctgtgtgtgattgctgatttgaaatcgtaaccgtcacattacatttggagagaattgtgattgcaactcttgtgttagtggttgatactgcagcagctttcgtgactttggaagtagacggcgagattattgtgacggggacagcactgttgttctggagtgagagttccacgtgcgactttgtttgcgttgtcagcttgtgggatttcgattccaggaggatacgtacttcgatgagctccatggccggtgatttttgtcgagttatacttgatggttgtcgcagaaacactcctaaccgcgagttagaagaaagtagaatcgtgctagatagaaaatgcttagttttctattttaagaaggctatgctaagagatttctgaaaagaaaaattaaaaccgcgattttatacattttgacgtagttcgtagatattcagctcccaacgtggcaggttagcagcagaagaaatgtcataaacccaaaaccctctgtttgggagcccataatctggcgagaaacctggcccaattctttcaggcccagttgacaaacaggccctgaaaccggactctctctctctctctctctctctctctctctctctcgctctcgccttacaaaaacaacggtgggctggcccatgatgctctctgtcgacgagtgaaagaagcccagcccatgagaagaaaaggatcgtcgtctccagaccatacgatacatgcgcgcatgattcatcgccccgacgtggtcaactaccccgaatgtctccatcaacatgtggtacaataagggcacccgcaataattatctatagattttctataaaagatacatgtcagcatattttcctacttgaaagagattaaatggagagagagagcaaagatatctactaatctggagatagtctatagagaaaaacgagacatggattagagagctatagatacccatatagacatacaattaaagtggtttactattaatctagtctattactgatatgtatatattttatgggctgcaggaat

SEQ ID NO: 44698 - DNA, 13204 bp, Oryza sativa
ataatcgagctgaattgccacagctatcgtgagtgtgagtgcaccgctgccgcagcggcgtcgtcgtcggaactcgaaacacagcaacggcttggccggtttcccgtttggtgcccagaggtaaccgtacgtcggaactcgcaactcgcaaggcggcttttgcatgcaactagcgtgcagaattcgtgtagaatctggcccgctgcgtacgctgccgccgctgtcctcgtcccaagaaagaggaggaagaaagcttagccagaataatgtgatgcgaacacacatcatcagtatttgtactggagcagtagtagtagtagtagtaatagtacagtgaagtactggtccactatagatactcccgtccccatcaaccaggcgcaaagcttcggccgcctgaacagtgaacacgacgagctcgatcctaagatagattcttcagcgtctgttcggttgcagtcttgcagatgggagagcctcaacttttgactaggtttttattcaccgagaatgagatgcgaattctaaaacgtgtagacgccaccaaaccgcactatctagttaagtccatgccccatgcatatgtggctttgtgcccatcgatccgttcgccattatcgcagtttgcaacgtaactggaacagaccaacatatatattactagctagcttccgtccaaatctccacccataatctgccagagccccgagacaaatgttagcgtgatacacacacatgagcgacgcgcgtgctacatgcccagtctcattgccagtcagccttgcattattgaaggcgacgtcgattgccaagtcgcgacttgtgaggaataattgggactttggccgagttggcaccaccatcagattcaggccttcgtgctccaactgccaagtactagtcgctgcggtcactctgtgtttccaagctgtggcagtgaccgcgtaggaaagaaaacaacactttcttttctcgtgcctatgtgtggactatgcggcgatagtagtaaaggagccatcatttttgtgtgactatgacaaatcgctgtcgggctgagctgcatagctctctctcaaaattcgatccggagctgtcaatgttaactcgctgaataaaaaaccttgacaacgagaatttcttcccacgtacttgatcgactagaatataattaagtgccaaacttatctgcaagatcaatcgaagcatctgaaatctgcaggtttgtactagcaagaacttttctttagaatttggatcccattctgatcacattccgatcatcttaggaaaaacgacgataagaaagaacaccgaagaagaataataagactaagaaaatgtacactcgacggacggacgacagatcgaagacaacccagtcatctctcggcagcgaagggcggcgggacctggtcctggacggcgcggaggctgccgaggcggcggcacgcaccggaggcgaagagggagagccaggcgacgagcggggtgccgaggaggacgaggccgacgggcaccatccacagctgctcatgcgccgggtggaacgccaccgcccaccacaccagcacggccgcgcccgccacccccgtcgccgccacgcccgccgccacggcgaggcacgaccacgtcaacctcattctctcccccgccgccgccgcagctcgctgccgtcctcctcctcctcccgcctccacgtccaccgcctcgccgactggcttcctctcgtgctgcgccattgcgagctagctggtggtcgtctcgtggcacgctgctgctgccgctgccgtgcggcgaggtgaatatactacgttggggaggggggcctgaggcgggggcatgcgggcggggttatctggtgatggctgctgctttggcccacgccacagccacagcccccaggcttccatttctactgcagacgcgacgcgacaccaccgcttatcgctttccacgccaggatcaaaggggctttgatgggtttcttgccacaaaaaaaaattaaagatcaccaaaatttactgctgtcgcattttgtaaggtaataaatcagacatcttgtagtaagaatttcaacattttctaccccgaaaatcaagggcttcattggtttctcgttaggaaaaacaatataccatatttcggttgcgtaataaatcaaatatactatcttctaaacatatatgaaccttaccaaataggagtttagtagattctgagtatttactcttgagatttccaaaattcagagcaaataagatctctggtacactttttttttaccatgtatcaataaaccaaaatttggtattcctaaagttttttttcaacagactaatcatgtcctcactttaaccccgtccccagctcggttactccgggcgcaatctgcatccagctcagctcaccccggtcgattccgcggtgagctgtggcttggtacttactggccacgaagctggcttgttcgcttctgtgagagggattcaagaggtgttcgtttcccggccggccgttgcactgctcgcatacatccagcttcagctggaaagtttgtcgtatcgtgccggacgcacaacgtgtagtcgaagcaacacgcagtgtctcgtttggaacgtataaaaatttctgaatgaaacgtttccaatcaatcctgtgttactcctaatttccataatttcgggtttactattcccatttcagatcgttgttcttccatttccatctaggatagactgcccgtttcttcaggatcagcaaattagataagcgaatacacaatgtagaacgactctgtaattgtcactatcccccagctatgggatgcttcaagtagtgtactactccagtcttccagagagtgggacaaaaaacaaacctgaccctgcaaagggtcccttggtcgactcatcctcagaatcaagatagccaaactcttgtctctgcccagcgtactacacccataaagtccatcgattcatcgatcgatcgtctcggatggtcctactccgtttgtctgaagaatatttttcagcaggagtttgtactagtcaacagaaatggtttacttgccatgcagattgcatccattcaggaggaacccaccctaccccaataaaagatgctcaaatgggacgcatggcatgtgcatgtgctcctctttctttctttctttccggatgctgcaacaggcaactgcaatgattcttttttttatttcaagaaaagcctcagacatgtttggaatgcaaatattttttactgatgaggatgacaattcaatccctatagattcaagttttcatcacttgatcggctgatagcacgaccacgcacgatctccttcgatatactgaattactgattgcgttgctcgctagcaggacagagcaaactgtaaggtcctgacaagtgataacacaggttcagccgttcaggtatcagtatcaccaaacaaggtagtagtatcagttaacagtccagactggcgtactaagaaggttctcttagaaacgaagggacagttaaacactgatgaaactataccgcgggtatcaaaagcaaattatgctgtcccttggaggggtcagcagatgggaagctaatgttgatggagcatccgacataggattgtcatttcagaggaacattatctgctgtgcttcatgaacagtggaaagaaccttatcttttttcactcacactgcatttcagaggatcatgatctacagtgcttcaggaacagctgaaaatctcctcttgccgtaaaaaaaatcaaagtcagagctcgggcaatgaaattatgaaaatattagagggaagaatttctgctgtgactatactgctaatgagaaaagagatactcctttcagatatggcgcttccacttcctgattgttgtcatcttaaagtcaatataaaaagcaattcttagatcatgcattcacttttaaaacaatcttgtattgatgtctcaatagatgagctcaagttatttactaattacaaaaatatgaactaaagttgcaaaacataattgacacaagtttttacaaaagagtcaagttatggtcaaacataccacaagcttatagaagtacaaactgacaatgtgtgtcgtagctaataaaattttggccttaaaacttactctagtcagagttcagtttcttctcgatgcttgatttgcttaggataaaaacaccaacaatgataagactagcacctacaaaccactgtatgaacatacatcaaattcaaaagctgagtgcagttcagttacaattttgtatacatgtaaactcaaaagtggggaaagtgatgtatcagtattctacagtctgagatacacctgataatgcagtggcaaagggtgtgtggtttcaaccctgaggtcccgtgttcaatccccaacacgctcacatttcttcttgaaactgtttggagggacatctctccctccaaatgtctttttttattattattatattttacagactgtacataaattcagctgtacagatatagtaggcaagtgatatgttattattgttgtatttatgacagggtttggcttgtatttaactggtatacaagggggcaagtcattgctcatgatataaagcacaagaccatctatttctctatctgaaaaacggcatctattttagcataacaacctaaagatccagtgtgttttctttcctatcaaccaactgcatgcatctctcaagaattttttcatacaacagtaaattataagataatctttgtatgctatgtgacttttcaagcgagtaatatgaatccagataaagtggcctagcttaataactagatttaatcctatttataataaataaacctactcatactactaagaagcaatgtgacagatcaacctaggatactcttcccatgtttgaaagggaagaaaaagcccaatctaacagaggacataagctaacacaaataaatttgaaaatttttagctatttgatctgcatgaataactagcttgatgtgcacgcactacacagaagggagaattctcatattaccttagaaggcagtggctcctcgaacagaaagtaccctgcaagacctgatgaaatgaagttggcagcaaaattggtgacggttgcttggagggatgacagtgctttgaggctgttcacatagcagccccacattgtcacattgaaaagtatcaccatgctgtatttcagaagctgtagaaggcaataataaagtcaagtctcaagtaacaaaatagcaggcagcactagactacaagtacactggtaggaggaactaatccggagtacaggttaaaccggtatcatttgatttgaggtattttcacaatctgatcctaaactaattgaaccacacatgatagttaacttttgatcagcaatttccacattatcccagttatacttctagcactaagtcattagctgaagggatcacacatctaacctcgaattatctgatgaatccgcaacttcggatccaagtaagtgactgtttcatgcccatgaacttggtaaaatcatttaatcgaaccagcatgaacaaattaaacccgaacaaaggctgaagcggcctattaaggttacagcggcagccttccaagcaaggtatgaacagaaaacagaatgttcagatcggagggaggtagagagagagctagtagagtaccggaggcgcgaagaacttggcggagatggcggcgagcgcggcgttgaggcccgccgcgagcgcccacccgtagccgcctccgcgtgccatcggagctggagctcaccggaggcggagatccactccacaactctgtagcagtcctctcatggtggagaaaactgaagacggaggggagaactgggccaacgagcctgggtttcgctaaatgggccttagttgcgaggaaggactgatgaggcccacataaaaaacggactacgtgggctttgctgggcctaaatgatgtacagtacaagaccgggaggtagagggattggggaagagaagcggcggcctgatcaggcgtcgtctcgccgactcgcggtgccgccgccgccgccgcggccaatcggccatcggagcgcactccggcggtcgcaccaatcctctcgtttccatgagggccggcgccggcaccgggcgtcaccgccaccaccggccgatcgattggcgttggcgcgcaccgccgccctagttgtactggtttgggcgtgtggcgagcggcgagttacgatccgtgggtggattttcagaagctgatccgatcaaccggagcaattcagcaggtacacccttgaatccttgatttctgcagtttttttttagaataggaatttctgcattattttgatcagactagttagtgataatatatattagaccaacatgaacagagattttagactgagttcattatcccggtataataattgattaatgggtagtaagcacgcactacggtataattaattagttgttgatcccttctacctatcacgagagaataggcctcctatttggaagatcatctgttgtcgtatataataatcttacggtagggatgcaagcgggttttttttaagcccgcttatatatctctcttctagtttattttttcttctaaattttatactatcgtgtaagaaatgaactagtaaacgggtttttatacgggtaacgggactaactactggcatccctacttacggcttcgtcgtttggcaacaactgggaacaagactgaattaaggtctagggatttgtggtgattgagtgagaccgcactaataacaacataggagtatattgatttagcgaatattttgcttcagatctactacctagagcctgtcactattctatgcaaatcacatctgtattctcaggtagtcacaaatattctcttctatcaaacacgccaaatttgcataaagccataacacgtactccattcacctccccttttagtaactgtcaataggactatttatcttcaaaactttgatcactcgtcttttttaaaaaaatatatataaaaatattttagtaaattgtagtgtattgtgttagtaaatttgtatatcgaattgatacgtggatttatgatgtatgtgtggatttgtggtggatttgtgatgtatgtctggatttgtggtggatttgtgatgtatgtgtgaatttgtgatgtcaatgttcgattttgtgatgttgatctatgtgattttggtgtaaaatcaatatgcaaagaacaatgaaaaagaaaaaaaaaaagaggagaatagggattagagagcctggcgctaccctcttttgttccagttggtaaccgggaataaagatcaatctttactcttggttattttaacatctttagtcttgaattcgtggtccagttgcaaaaccaggactttagagggttaccaaccgggagtgatgcccctttctccagcagtgctataagaatctatatatataatacaactttgttttggaatctatgattatgtatatagcctgatcaatcgcacagccctcttgactagtgatcacaatctaaatttcctagagttttttcttgataatatttgtacaagttcaacgagttactagctagtgtgctgagtcagagtagcattttgttctgcacgcgcacctcttgctttagtcgtttctagcaagttatgctgacttcaaatattatgtcattaattactgtagagagtacagtgtactatatatgccacccagctgggagtcaaagacatttacaaagtgccaatgtaggatcacatcaactgggaaaaaaaaagcacattgcaatgccatgcatcttatgactctgcacaggggacagatcgattaaaggttacaatcacatttgggaacataaaaagtaagctgaagaaaaaaaaagagaacaatttataaaaatttcagctataaccatatatcccatccggttgatgtgatgaacacatcgtgctgtgaatgctttgtccctcatttgtcaaacacacagattccgaggtcgccgtcgacgccgctcgcgccggcgccggagccgagcaaccccgtccacctgtcgacctcgtctctctcgacgctgttgagaaacagcaatgctgccatgtcgtcatcgccgtggtccagcggcgagctcacaccggcgactgccgccgccgcggcttccgccgttgcctccatgctgccacactccccggggctaagctgcgacgcgacgaacttgtcgagcgctctccagtccgtggtcgtcgccaccttgtcgccggcggcgcgggctttcttggccctcctaccgccattatcgcccttgcagtcgtcgtcctcgccggcggtggccagctggctcgggttgggctggagcggcgccgcagccgcggaggggctctcgagctgcggcagctcggcgaggtggctggagtagtggaggagggctgtggcggcgccgtccagctccgcctcctgcttgaaccgcccgctcctgtgctgccgcctcatctgcgcgtacgccgcgctcggatcggcgaacgccgccgccgccgcggcgctcatgatgttgcgctcgtgcaaggagtagtcccacgtctccaccatgctcctcgccggatacgccgtcctcttcttgaatgctcggcacaccacccatccttcttcctgtagtacacacatgcaaataaagttagatacttaggtggtgtttgagtctcccgaagattaagattaaatatttcatgtaaaacgttgtggtaataacgtataattaattaagttttaattattataaacttgaaaaatagattaatccgatattttagaacaactttcatatagaaagttttcacaagaaacacaccgtttagcagtttgaaaagcgtagcacaaaaattcaaaatttaatccattgttttaagaggaaacgaacgggggggatgtgagctgcattttgcaaggttgacattgacaccaaagtatttgccaatcattcgtaaagttagctagcttcccactgtgtgatagtggaacaatacgagctgataacttttttagttttgtggtgacatgtttgccaagcagcatgcaatggttttgatgagtactagcacaagttgcatacagcttgtaaacaatatatggcgcatgttaggacgttcacaccaggggaaaccctaactaggccatgcatgcgcatgcaattgtctagggaaaaaaggttttggtgttagtggtaaggtcaggatggcatcaacactggatgcaggctacctttatttgggagagaatagaagactttggaaggctcacaaaaagggaggccaatgcaagacttatctttcaagaacaaaaagagttgtggtgctgcttagtgctactgatatattcctatctatatggtccattactagtggtacatgaattagacatgcttgcacgcatgtatatcggcggcagatctctgtgcgtgctactttagaaatctctgggcaccattagaccttaacctctaataaggcctaagctggtatactgcattttatcttcagttgcaagttgcaacacacatatataagtatataattcagatatattttctcagatatataagtatgcaatgtggtcactaacaaccttaaaaaatattttcttttttttttgataaacccagcctatacatccaaccggatatatacaactttttaaaattaggaacttagcctatcaagcatggaaccagtttgctagtttatgtagagctagctagcatgcagagaaaattaagaaaccaattagctagtgaaatcggtatatgtatatacctgtggcggcgcgttctcgtcggtctcgaggcggtactcgtgcatgatccagtcggtcttctggccattaggcgccctgcccttatagaagacgagtgtcttcctcatgccgatgagcctgctcttgtcgtgcaccgccttgtccctccccgtcgccttccagaaccccgccattgtcgccctgttcgtcctcgtccccgtcgggtacttcctgtccttgtagctgaagaagtaccactcgctttgctcatcgtacccgatcccacaatgttcttcatcaatcaacaaaccaggcaacacaattaggataaataatgccacaatgatcatctctgaaactcaaattaatcatacgatctctagttgtaccttggagatcccagggttcgatgcggtagacatcgatgtcgcggatgacgtcgaggtcgatcttctgggaggcgaccttcttgcggaggtagtagccgacgagctcctcgtcggtggggtggaacctgaacccaggagggacgcatgattccatggcgtccatatgatcaccaacctgtgcctgcactgcaattgcatgcaccgtgcatcagattcagcaacaccgtcttctaaatatccatccacacccaatgcatgcatgcatcaaatgatatagctcgcgagtggcactagtagtaaagaacacatgcaagtgctcgaatcattcggtgcaagcaggctggctatcttgcgattttttataggacacacaaatgcaaaagctatctgcacagaagggctagtagcattggtttggtctggatactgaatgactagctacagactgactgacaaggagtatactactacagtagtgtgtatgggtttcagtgctttggtaaaatttaatccagccatgttgggtttgcactatggactttctaggataaaaaggcaaagtacggcagagcctgggcaagaggccagcagggacaaatgtaggaaagctacaggcctgcgaatgatactgtcgactggtgatatctcagaggcatgtgggctatagtcagcaacgaattatagctgttgcagcagcagaaaaatggtctgctatataagagcaaggtcaatagtgtagccagctactagctccaataacatccatgtcattttatagccaataccaaaactaactagtacaataggttggctattatatcaacatgatctcattattcaaacaataaactttacatgtgcatgatcagaaacgccctcaactctgtggcttatatggccatttgtattatgtaataaatatgggttatctactactctacttgaaaaattaacgaataacaacacacttgataattcacatagtatatcacaacccactgctgcccaactgcataatctatacatgaaaaaaggagaagaacaaaagggaaaataaaaggagctataggaagagattagaacggactagatgcaacagatgagacgaagaatcggtagaacaaacatagacgacaagcattcaacagacagtgggagaagaaaagaaaagaattagaccaagccaattcaaatcaagaagttgcttattgctttgggtgccagttgcatgcccgcaccaagcgcctctcaatcctcctctcgctttctttgtcgctgagaactgggattactaactttttgggcgcactggagctttcacggcggagtttcacgtcgcgggagaaaattccggcgagacaggggtgagcggaggcggcgtgaagcggagcaaaatgcatcgggcggatcggaagaggcacaacagaaacaaaacgatacacgggatcggcggggtggttgcgggacccacaaatgcatgcgtatctgtgtatcgctcggcgctacatctagcgcccgctttgttccctctctccagttatctctcttccacgtgagaataatctgagttggaatattttggagcctgctgattagatttattgtaccttctctgattagtttgttcagagttcagtaatttgtttagagtaataaaattaggggccttaatttgtagcaacaattagtgtgacttttatactagagagtgctgcatatatgtttttgaagtgcatgtgtgcgctagatacacgctagtatagctagtacttaagaacctcaatatgcatgattttctactcattctgatcatacagctctcatgaaaatggattcatgcatggctcaatgcaaagcactgtacgcagagcttgccaggcctttattttgtacatatactgtacatagcttagatatacgtacgtactgtatatagcttagagcatcaagtatatatgcaatgcaatatatctgcaattaattctagaattgaatatatcttaatattagcagctttttatctagttcgcaaactaagggcccctttgaatcaaaggaatgaaaaaacggaggaataggaaaaacatatgattctgacaggaatgtaagtgtaaaacagaggattgcaaaccacaggaaaaacataggaatgaccgtttgattggaccacaggaaaaacacaggaatttgaggagagataaagactcgaaggatttcttccatgaggttctacctcttgttaaaattcctccaaaacttgtatgggaagaggcattccataggaatttcataggattccatagtgttcattcctttgattcaaaggtctttgtaggaaaaattcctataggaataaaatcctctaaaattcctatgaatttcctttgaatcaaacggggcctaatgccctctttgtttgggcttgggcttattggcttagacttttaagtcagcttattggcttatatgatttataagccggtggatttaatgttctaagtttaatggtggagtcatgcatctatctcacataagccaaaaaaacttctccaacctagattttggcttaatagtgttagagtggcttatggcttcaaaaaagccaaacgaaaaagctgattgtttgtttaggcttatattttttgacttataagttggcttataagcctaaataaaaagggtataaaacatatggcatttatacatggtgcgtggatgctggggctaagcttaaaacacaacaaccaaaacgagaaagctgcatcgctagcatttgccgggcggatgagcacgcgcctgcatgccgtggggcatgtaaaaaaatttgacaaattaaaggtggggctgggagcaaaagatggagagaataaaaacgtgaggagaggaagctagctagccaatgccggggatcggagggcccttcagcgatcaggcctgcaaattaaaggagaagaagaggctaaaaaagcgcc

SEQ ID NO: 44699 - DNA, 13811 bp, Oryza sativa
attcctgcagcccaaaaatcaccgatctctagctagctagcttatcaaatgcagatcgatatatgcaatacagacatgtcctttcttaatttgactattattattcatgtcctacctagaattttgtgttctcagatcagagagcaatatgcaccaaggctgatgagggactaattgcgtctgttagccttagccattagcattaaatcaattatattccagaagcatgatcagtgggaattatgatgtcgataacacaggggcgtaggcatgcattacacaaaacatgttgtgctaagtatgatgccacctaccactgttaggagccacagggaaacaacaaatccttgcgtgataagattggatcaaatttgggaaccctcgcatcattccggttctcattgctggctagctgctgatcaactcatgatcaaagaaaagctatttacaatgatgcaatgaaagtgaaacaattttagatttatttattaacaaattgtgatctgtatttaattaagccaaaataatttcttcaattcattacctcagaaagttaaaagttttgccaatatgaacaatggcataactttctacatgctgtgcagagctttacaacaccagaatccaactctaactaacggtatcatgagcaaagtcaaggaaatctacggagtagctagtgtgctataattgttgatgattattacaaatgtgttctaattcaactgggtgaccacagagacaaagcaagcattggtcaaattttggattaaggtagtgtatctatattcgatctttctttttcgtcaagcaaagaaagcgaaaaagttgtgcttttttccttcaataataaaacctacatactacaccccattctagtccccattctaatcttctggatgcaccatcttttgaaattttcaattgtaaattaatcaagtggtaaactcactcaatcttcttcgtcacactgagtttgtctgttttcccccataatataaatacttagtattaattagacctagtactccattttcaactgcaacaacgtactttaattagattaattaattgccttccctgaaaagtatatatacatgtttgtagtacttgatgaacaagtgatcagggaacaaaaagctagaaatatatggagtccagctacagcataacatacatgtttgttctcttttttttccaataaatatagcagacactggtgtactggaacaaaacaatgatacacttttggtttttggaccatatgaatgtcgtaacacagaactttcaaaacctaataaggataggtagtgtgagagatggaaaaagattatggacacaggggcccagcagccctgcaaattgcttgggtttgcatcatgttcttgcggccgggtgactataataatgccggccccttcatctatctatagctagctactatagacatgcattagtttctcatgaacttttgtttcctcatcacaaatgttttggtagagagagatggagaggtcaaatgggaggaattaattcaggtaggacatagcaggcgagcagctgctaatgatcatgtaacctcaaaacaatctcacgcggcgctaatcccgatgggagctgctctccacgctggagcacgacattcccctgcacttttgctccccggacgacacgtcgtctgcagatcactctgggattaaaccctaattaattcagtgggtgtgccctgggttacccatgttcttgctgcagggttagagtggcgcagcattagggaacaggggccagtaggatattatgtatagacgggttcacttttcttgtctctgcaagctgtttctgttcttggttgacatgttgataaatttaagatatttcttggtctacacgagcactttaaccttactgtctagttagtagttcattatattaagaatgtacattgccattagcctgcgctgaagagtgattagcagcttaattagcatatacctgaagggaaggcaggtttaatgtgtggaacagagttccaaattgatcatctagatagaggacatgttctggtttctggtcagcttctaattaataaccttgctaatgttctatctcccggcctctagctatggaatatacgtactaattcttcaattcatcatgtgcttgacagttgacaccgtatgcagcagcattgaagctagctagctgatcaccacatatttcttaaagcgatgcgcttttcatctggcattgcacacatatttgcacattactactatacacttcagcagctgcatgcgatcgaaacatacaggaacaacagactgatcaatcgatcggaaagctgtaacggcacgccatgtttctttcttttctttcttggttaaggctggctgatgacttgtcctttcttcccccaccaagcatgtaacagcatctccccaaaagtgcacttaacaataacaggataagcttagcagctgttacgcctcacccgtacataagcataaactacaatcgtgtggccaataactgggcgtccaggtatatactaatcatgctactcccgatgatgcatctagaactagctagctagctcccaatatattcatctacttttaggcccacacattgcagtactgaatccatgtgtctgaaactatgtactcctagcagtagcagtatatagcagtagcactagtaatgtagtataaaacagggtacatatatacgtagcaacatcaagcaaaatacagacgtgttggtaggacaagaaaaggaggtcaagttgcatattgcctggggccggacaccgatggacaatggtgaccctacctgaaacgatgcaactcgtcgagaggtccagacatatggaaaacgtctgaactcgacacgtacctagctgcagctgactgatgctgccttggctaatggtatggtcgatgatccaaaggctttacgtacaagatacactagatgcaaagtacacatacacgtcgtttttgtactcgacgtcgttttaggctacgaggatttccacttgtaagcacgaaggtacgtccatgagagtaacctctgacaggttattttacatgtggcaggcttggagcagttgctagctactccagcttgcacaaatgtgttcagacgtcgagttgcaggcagtgtgaatgtgccatttgtatgatcagcatgttgatgtgtagatgcagccatgcatgcagatattgcgaaagcagaatgaaagttagctatcttgccacaaatcgagtgaatacagtgttttgtttgcctttcgtctattcctcagaacgctaaaaagcgctgagattttttcccatggaaaggttgttcttttcacagtacagtacaccggcaggcacatattgttgcctctagaaactcgccattgtggcccaggccagccggcgatgcagaaaagtcaaaagttgttcagaactgtactttatctgtgatgtgacgggcacaatacatggatgctgtgttcaagatcatatctgctgttagcctgttactataagatcatatcagaccgagcaggaatgcaggatattaaggagtatgcataaaaagttatttttcatacttaactttcattggttggtcggcaccatgcgtatctttgaaatgctgtaactaactcttcttaccttggttaattaatcgttttacttaaccggatggcgactgaccaaaatatcctgcagccccagagtaacgggctaaacgtcgctatcaaagttaacccctctgcttcactttgcatcattagttacctaagcatatgataacatttacaaagtcccatttaaactcggatagtgtgtcggcgtccacggccgccccggcaggtaacattatattggtttctggatgggaaaaaagacagacggtccccatatacaattcaaactcgatcgaaagtcatacatataatgttacatgcgtgcatgcaccaatgcagatcactggccggacgtactgtaagtttggactgtaacagcatgcagctggtatccaaccacgcggggcaataaccaatggaacggtggtaagtggggcggtgcatgcatagtgcggatggggacggcacggctcgtcgcccatgcaccgcgtgcgctcctcgctcggtcgatcggtcggtccgaaagattagcccgggcggcgcccatccgcccgcccaatcatgagcacctcgcgggtcgcggcatcatttgctcgagatatatatcgctacgtacgtacacggccggatcggtgcgcgcgagcccgacgccgggtagccccggcccccaccccgcgcgcgtacgtacgtaggccccgcctcgcaccaccaccgctcgtacgcgcgttgcgccgtccgcgcctcggcggctctcgtatatccacaccaccccgcgcgtttcgcgtgccggccaacgccgacgcgcacgtacaccaccaccagcgtgcgcgcgtatctcgcttgttttccgcacgacgcaaccgcgcccgcgcagggggtgggctatagctgcaggttacgcgcgaggccggcgccggcgtgacctctcccttttgcggttttgccgagaattgagcaggcaggcatgccgcgcattgtactacaggttctatctgtgcgacgggatggagaccttttggatcgtttggtgaggaaagatacggcaagttggctagcgagaatacatgtgtgagatccttggcgtaagcggcaaaaaggctatagcatgcttgtttgctcccttagtgcatgcataaaaagcctagctgctgtgacagtaacacacacacacacacatacaaattgttctcttctgtgttgtactgctagctagttagctacatatgctcgcgctttcatcctctctagctgcttcaagaaaaagcctatttacctttgatgtaagagtgatgacgtgctaaaaatgctactgatccggtgacccgactgactaagaaagctaagcttgattttttttttctggactctcactttcactggcggcacaagtgtgattgatttggcggcacgcttataattttgaagcggtgtgacatggatgtatatacatgagccgacttatatgcatgcctgatgtagtatatctcagatcgatcggctagctagtgcgaggagaggtgaacggcaagggatcatcagaaggatcgatatcgtaggttgttacgagttactattgaattgctcctacgtggacagaggctgcagccatatatggaggttggtaaagggaaagtgactgcacaacacgttggctactgagaaaagggcagctgatgtaggatagatagatatatagatagagggatagatacttgttgcacactactcttaccgcttttgatacatgtgatgtgagcatcaagcttgtttctttcttttcttttcttcttcccttcatcctttctcttccctgtacatgctgtccctgcatgcatggcttgtcgatgcttccttgctatcattgctcgccggcctccattcccgttccattccagggtatggagtgccatggttgtgatctcaaaagctagttggcgtgagcatggcattgtccggacaagcatgcatgagagtagttaagtaaattgaatcaacttcgattgttaacttgatagcttccctgctgtgtggccaaaaaatctaccatgttgttcgcttctggaacggaatcattcaggaaactggcagcccctcggtgtgcgtgaggcatcgatggatttcgtggactaataaccagcggaatgatcgcgcgctacctctatcaaatcgatcgtctctcatgacgacgagcaaagaaacgacatgatacggcacagaaaagctcgcaaaccgtagcagcagctcgcaaagctcataagtacaagatcctctctgatctggcctaatggcagacagacaagtggaccattcatcacatagacgatcgagagcaacaattagctagtgacagttcagtggtaagatatgtagttactaaaacttacaaggtgcgactgcatgcaattgcatgcctctgcaagtctgcagcactgaatgcagtgggtggccggccgggcggtgcctttgatctcactgagtcactgccaaattcagctggctagctggacaccgcgcgcacacgggcggttgccgattgatgctcctcctccgcgtcggagacgtacattacatcatttcggcgcagtggaggaggtggggagcacaccgcgcacggaggccgggccgggcggccgatctacatgattcacaccttgcgagctagttctcaactcatgcgagcaatcttttcctgcaaagttaccatccattctttttatctttctagtttcgtatatctatgatctccattcacacaacaatatatggctgtggtgaaaaggctctgttaaaaagcggcatccattgcagcccactcgatcctgggtgctcttgcgatcgatccatagcagcctcctctggtagctagctagctttcgtctctctgactcttctatcctgtaattgtgcccattgtgcattattctgcattgacgtatgcttgcctttcgctatagtcttttcctgctcttctcttcaagatagctagctagtcttcagtgattgtactgttcctttcttgaaaaagaaacgcatatacagtctgaggataagatattgagatgcatgcacacaaatgcaataaagaagagatgtagaaactctgaagaaagaaaaaaaatagagagagagatgttacgggtagcagcttccgttctcccttgaaagttcaaacggaggacaaagaggccaaattgctgagttggctgtttaaattgggcttaagttccccctcggcccaaagtagggcttcagttgttttcttattgggctagtgtagactgtaggcttgacctgtttctgatttctgaagcccatgtattctttcttgtttacattttttttccggagtcgttagaaatatggcgccatatgctacagtcgattttttttcagccacttacatagtagttatatctcatttacaccccacttacatatataattagtatgtattttttgaatttacatatgtaattttagtacttacatatgtaattttgagacttacattgtaaatacactatgaacttacaatgtaaatacatgccgattattttttgatgaaaaatatggcaccataaatatagctacacccttttttttatagctcgaacaaacaaatctggagacactgccaaagtgctagaaaaatatcaatcgaacatatgttggcgctatgtatcttaggaattgtttagttaggtaaaatttttaggtttgattgtcacatcggatattcggacaatatagactaataacaaataaattatagactccccatgaaattgcgagacgaatttattaagtctaattaatccgtcattagcaaatatttactgtagcaccacagtatcaaatcatggcataattaagcttaaaagatttgtctcgcaatttacacgtaaactgtgtaattggtttttatttttatcaacatctaatactctatgtatgtgtctaaatattcgatgtgatggatgaaaaatttttattttagcaactaaacaaagcctttgtgctacatggctgaatattaagtctttcgaagtggtcatacaaaaattctcgtttgagctgtgctgcaagaaactctgcatctatcgccctgacacgcgcttcattacgatgaggttggcaagcctgcaggacatcctcgtctagtcgtttgcacatgatgtagcctgtagcctgtagccatacaagagagcacgaccaaattactggagtatggtacgttgctgcaccgcgtactgttgggaatggaaggcgactaatcaacctcagaggccacatcccatgtggtcctcttcttgaagacgtcttttaccctctactggaacggcagcagtaaatcgcattgcctcccagtagtcaatggccatcgatcacgagcaagcaaggcattgatacgcgcgtacgtacagtcagtcctacacacatccgtagtggtatatactccctccgtaccaaaaaaaaagacaaactctatttttcgtgcctaatatttgaccgtccgtcttatttaaaaaaattatgaaaaaaattaaaaagacaaatcacgcataaaatattaatcatgttttatcatctaacaataataaatatatgaattataaaaaaaattatataagacggacaattaaaattggacacggaaatctagggtttgtcttttttttgagacggagagagtatggtacagtggttcatgccatgtcaatgccggcctcacgaggacggctagctcgccgtgtcgaccgcgccaccgcgaacggggcgtcacggcctgaaactgcaagtgtgttccttattctcggttagaattcagaaattactgtatttcctctgaaacctctgcaggtgtacgtacgtcgtcgcgcttggtcggtgacatgaataactagtccagtacgtagtccgtacgtacatgtacgcggatgatccccgtgctgcgtggtccgggtgcagcacgtcatctccggcccagccagcctacgctcgtgacaagtgttgctcgatcgttcgttgcaattgaccttggagctagccggtcgggccatggcttcgcttaagaacgaccgtcaatgtctctgcaaattaagcccaaatccagtgcaggatcagtgcggagacaaaaccgatggcgatataaccgaatcggccgatcgatccattccatgtgtcgcgctcgaccatcgctacgccttcacgacagcccggcgcggcaggcacgtcgtcttgcggatcgaacaaaagtgggcgatgtgttcggcaccaccggccgccgcccgcgcgtcccgtggagaatccgaatagaataatccactactactagcagtgttacatttcgcctcacagaggctcacagcttccacgggagaaggcgtcacggggagctacgcccggacgccccccatcgtcgtggcgagcgcgagtcgcttgctcgatactcatcgctcggtgtggcagggcagcaacggcagcgcgcgcacggggggggtccacacggtttcctccgcaaaaaagccgctttctctcggtcgtcgtcgcttttccaaccgtgaaatctcccttcttccacaccggcctttggaggcttggagctactagcttttttgttcgtgcagccatgtggcggcagtgcgcttgcctgcctgcctgcgctgcggctgcgcaatgctctgcacttgaccagatcgtgatgtagtagtagtatgatgtaagggcattaccaatgtatatgttaaaagtggtttatatagatgggacccatataaataaactttaactatagcaatctcacaatgtatatggatacaatgtaacattaggagaagagagagaagtagagatatataatattatttatgtcatataggtagtgtatatgcatatggatatcttttgctattttctttatatggactagttgcccagtgttactaaatggctaaatggaatagtttattccctatggactacttttgtagcacattgtggatgccctaactgttgtagattaatcgcgactaacaaaatacctgtcttgccttgaccgtgtgcttccgataatccgatgcacgtgatgtgtcgctaaagcggctcactggctcaggatgcaccgtgcgtgttactaccaccgactgcaaatacacgcggatcgacagctcagtgtggtggtggcttcagcttggcggccaagaaacttcaaaaccatattatggcatccttccaaaattttagaagggaagaagaggagctatgatatagacagtgcgagccggctaccatgtacacttgataattggacaccttcacagttcacacaatgccaccatcatatcaccataagctttattaagggatactagtcgaccctgccttatgcgcctagaaacttaagcacgctgcatgtacgaatgactaattaagtgtgtgaatgtacattggcgaatctagagatcttttagaacatgaacaaacatatatgtccaaaggattatatggatgccattgaacatcagcgatggaagctattacattgatgtgacttgtcaatgagttcggacggttgcccgaaggtaaccactagccaggtcttggatccgctcccaaaaatatacaattaattatttctttaattaattaaatgtggaaacaaaactagctaggcattatgcagttggtcacaaaacgacatgtttttttagctggaagagtacattttactgctagcttgaagtgcacgagctcgggcggtcgtccggggtcaccaggtcttggatccgccccccaaaaaaatacaattaactatttctttaaatgtaaaaacatatgtgtgtgaaaaaggttaaaaactagctagacattatgcagctggctacaaaacgacatgttttttttcttggaagagtacattttactgccagctgagaaatagtgtgaagcttaactctaggtgcacaaattcggacagtgccactcatggtcggcaggccttggatcctcccccaggaacatacaattaacttttttttgtttaaatatgaaaaaaatatatgtgtggaaaggtttagaactagacatcatccagctggcaatagaacgacatgtttttttttacatcatcgagttggcaacagattgacatgtttttgtgactggaagagtacatttttactgtcagctttgaaatactatgaagcttaacgctaggtgcacgaattcggatggcctcccgtagtcgctaggccttggatcatctcacaggatatacaattaactattttatttaaaagagaaaacatatatgtgtgaaaatgttcagaactagacatcatgcagctaacaacagaaacgacatgtttttaatttgtcataggaagagtacattttacttccagcttagaaatagtatgaagtttaactctaagtgcatatatatgaacggtcacccgtggtcaccaggccttggatcctccccgggaatatacagttaactattttgtttaaatgtgaaaacatatgtgtgtgaaaaaggttaactagatcaccatgcagctagcaacagaacaacatgttattgtgaccggaaaagtacattttattgccagcttagaaatagtatggaccttaactctaggtgcacgagctcggacggtcgcccagggtcactaggccttggatccactcctaggaatacacaattaactatttctttcaatgtaaaaagcatgtgtgtcaaaaggtttagaactagacatcatgaagctggcaacaaaatggtatgcttttaactagaagaatacattttactagcatagaaaatggtatgaaagcttaactcaaggtacacgaatttggatggccactcggccttggatcctccccaggaataaacaattgactattttgtttaaatgtgaaaacatatatgtgtgaaaaggtttagaactaaacatcatacagcttgtaacacatcacgacatgtttttatgactggaagaatacattttattgccagcttcgaaacagtataaagctttaactctaggtgcagcaggtatgaaagcatactatttattttactagaaaaaaatgtaaacatgtaaatatccaactttgcagcggaatatgatcctccgacgtaaattaacatgtgacaattgccacatgaccccacttgtcagccacaaagttatggttatgttatgccagaggatctgattcggcatgcggatccttgggctggttggtttgcatgatattttcgtagcaaaaactagttgtagttgagtccatggctctaaaattctcctaaggtccgccattgatctccccatgcaagagggaggcatgtctcagagaggcctgtagcgactagcgaatgagcaggggtccaacaggccaacaggaagctcgtaccaagacttgcaggcagaaacctacatgaatgaatgccttgattgcgtgccgggcagtctccccacattcgcagcagcatgcagctgacaccgatcgaacagggcgcacgtacgtacgtccgaggttggccagtggaaagtgcgctgcgctgcgacgggtggcaacggaacgcaacgcgccccatatgcatcgcatccgtttcgtcgcttccgccttgccggtggctgccaaaattgccatcccctggccagtaaatcagcaaggggcagtggcgcagtgtgcaagctggcctgggtgtaagacggtacaaaagtggtgcgtagcgcatgtgaaactgatggtgaaacacatgtgacgcgagacgagacttgaggcggggagagggctatcaggcaaccccaccgcaccaccggaaccaccacctcacaaacaccgtcaccaaacgccgacttaatacccttaaaagcgacccgatccccagtccgggcaacgcaaacccccacattcctccgctgctgctgcgtcgcgcgcgcgtgtgtgcagtgcaccgcccgttcgcggagccgattgattttacaacaccgcgctcgctcgcggtcgcggggggggcggaagctggtactactcgctatcatgaacggtggcattggcgacgcgctgatgcagccgcagcacgtgcaggtcatgtcgtcgtcgttgccgatggtggcgtcgacgttcgtggcggagccggcggcggcggccaacaagccgagggccgcggggctgccgcccacgccgccgcaggtgttcgccgcccagcgcgcggcggcggcggcgggcggcgacgtgtgcatggaggagtcggcgcaggggggtggtggcgggctgccgccgcgcaaggcgcaccgccgctccagcagcgacgtgccgttcgggtacctggccgggcagcaccagctcctgccgcccaaggtggaggccgggtggggccacctcggcgccggcgccggcggcgcggcggccgccgatgacctgttcaacgcgtacctgaacctggaggggctggacgggctcaactcctccgacgaccgccacgacgaaggggacagccgcgggagcagcatcaagaccaacggcgccgacagcagcgagaacgagtcggaggagtgcgccgacgacacccgcggcgggatccgcctctggtccgccgacggcggcgagaggagggagggcgtcaagaggaacgccgcgggggagccggccaccgcgccgctggcccgtcacgccaggagcctctccatggacagcctcatcgggaagttcaacttcacggcggggacggcggcggctgcggggaacggtgtcgcgttggggccgaacaggttcagcctggaattcggcagcggcgagttcaccccctccgagatgaagaagatcatggccgacgagaagctggccgagatggcgctcgccgacccaaagcgcgtcaagaggtaaataatattcgatcactctcccatccatccatatcgtctcgcaaatgcaaatgattagaaaacgatcgatgattgcaatgtatattgagcgctacgacatgaggggatcgatcgactgatcgctgagagctttcttcctccggtgacagggtgctggcgaacaggcagtcggcggcgaggtccaaggagaggaagatgaggtacattgcggagctggagcagaaggtgcagatcctgcagtcggaggcgaccagggctgcaggaat

SEQ ID NO: 44700 - DNA, 4533 bp, Oryza sativa
cgcactgatcccttcgccttcccgctttctcgtgcaattgccgtctcatcgtcctgatcgccttttttcctgcgtgaaatccacacggttgtttacgttgtctgtgactgttttggcttttggcagcgcgactcggcggggctcgcgacgcagaacaacgagctcaagttcaggctgcatgccatggagcagcaggcgcagctgcgcgacggtacgtgcctcccctaaacctcctcgatcactcgctcctcccatgtttgtgctcgccaacgtcataagatactttagatgtgctcggcactatgatgaacagtcttgtgtaagttattgacgttgacatgcttgtttgtcctagtgcttgtcaactgttgccataatctcgtgtttttgcgcttggaggttggtagttagcttttctttatgcatatatttttctctcgggaagccggtggtcgttagtatgtactcctactactggtagggaggaggacatgccttagcaatcatccaagaacgaagatttgctattgtgcgtgccttttcccccaatcaaagataaaatatatagtatgccctatggcgtctctgaagtctgaatccgttagttgctagcatgttaggagcctgcagtcccgtgtaggagaagaatgttttggagtattcaatattctgcggtgacttctccagattgccaccctagttttcagggctttcacgtatcaaatgtttctccttggatgccatattgccatgtgattgccacatttccttctctcacaaggagtctttcgtttcaagaatctacactgatctaggatgtctactgccttttacatgatgacttcatccttaagggttaatctatctattaatgttatgagtagctgtatttttaccaagatgaattcatcctattgcaatatactgttaaacactgcaccatgaaagtatgccacgaatagagttcaggaattgttcacttgttagttctggttttgatgctcagttcctcactgcttcgccattatcttatgttcaacagcgctgaatgaggccctgacaaccgaagtccaacgcctaaaactcgccaccgctgagctcggcgattcttgctcgtccagcagtctagctcagcagatccaactcaatgctcagaatcagatgtttcaactgcagcagcagcaggctacgcagataccattctatcaactgcagcagtcacaacagaacggtgcagcgaagaacaatgaatcaaaagaatgattccagaggcattttgggctggttcatggaaagagaatattggtttagatgagcgcaattcgcatattcctaactcatttgttttaatgttgttaataatcaccttgcatttttctagtaggtggtggttggtgaacctccttttacctttctatgttcattgattctttggatgatacagttgtcatttttaagttaccaaactgatgaagttgtaggtgattgttattcttttgtactaatatctatgtcgagtattttgagtaccccggttcgttaagatacacttgtatttatcgacaaaaaggaatgtggggaacattacataaaattgccattgccaaccattcacaataaaaactagttatgccaggtcatacgaaaatgataaagagaaatttgaaatgaaatgaaaaaaaaatgcacattgaaaaaaatggtacaagctcatacccgagtgcagggtaaaatggttaagatatttacgaggaaaagtagctgccttatagcctatccaacagaatcttcaaccatggcctcctcactgtcgctatctgtatcattcgcctcactgccttcctcagtctccgcatcagacatcagatcatcttttccaacaccacttcctgggagttgctttctgaaatctggatcaacaatttcgatcatagcattaagaacacgatgatgatcggttattttactgatgacatgatcaatattactctggctcccagcagcctgtccatcagagttcactaaagcatcagctgctgagctccctctgacattttcatcctgctccccggcatggtctgtagtctcccccaagctcctaggagactcattctccccattgacagatggacctgtttccactgcccagctaccagcaacttctgaggccaacaaatcagctgtaccaatggttctggtctgggtatcctcgtgttttctctcagaacagttaacctcaagtttttcttcagaatagtgaccaatgccatctttgagggttaacgaggcttcctcatttccttgtggttgccctctatctttgcaaatcaagatggactcatcattctcttgtggttgcacttcatcatctagctgcatggtatcacctcccatttcactaaatctttgaagagctgaattgtgatcaccacagccaacattaccagcttggctttctgtctcgggaacttgctcagtatctgttggctctagctcaggagctgtagcagccagatcaccatgagaatcagacctgaatctctctgttgccatttctggactattgcactctacctcttgagtgtttgccccttcaactctggtaaaatcatcctgttgttcagtctccttggaatcatcacttgaactttgttcacttgcctgggtattctctgttgaagcaccagaagcttccattgtattttttgagtagtttactctcgtgcgggcatcgtcagcagttacagttgccagtggcactttattgagatcatcacccatgatactgttctcataattctcttcatcctccagagttctctgcattgctttaagctgttcctgctgttttgcaaacagagaagatatttcctctgtagttgaatagaaagcacgcagctgagtctccctgcagtaagcaacataggaaacaaaagaaaaggtaagctgatttgtagtttcacaaacttggggttcacctctatatgaaactcaaacaatgtttcttaccgtaaaataattctctctcttgctccttgatacctctgtttctcgattgatagatctctaattgtagcagctatttcaagctcaagagctgagacctttgcccatgcttcttcccgagcagcctgctaacagaagaacacagataatcagctagtaagtaaacaagagcaatcctctatgcatgcgaagaccagggtagattagcttatgtgatgaaaacatcagaggaacttgaaatctttttctaccttctcgtgttcaagttctttcttcacttttctcagatccatttccagtttatctgatttctgcgattgcaaggggggaggaagtgaagaaaagatgttacatacattcaatgaactacaaatgaaacaacttgggcttaatagctctaaacatgtttacgactgtaaccttctgattgttggcggatacaagctgttcatcctgaagttgagcttccagctctcttgcttttttctcagatgtgacaaggttctctcgagtatcttcctgaatgtgaaggtaaataattgtagaatggaaaaggaatgagtgttcaaataaacaacagcaaaaaagcataccagcttagatctcaatgtttccacaagcaaacggatttccttttctgattcctgaaaataaaagagaaaggtccacgcaatacattatttcccaattcctgatcattccctagaattggaaagaaaaggtaaaacctgaagcttgctaataacttctttctgttcccgttgttgtctaaggtgagcctcagcttgtctcttgatttcttcttgagcttctgcattcactttatgcagtgcagactttaagtcttctgcagccttatcacgctcctctcttcgcaagtctctctcctcacttagctgtgcctcaagctcacatatatttgatttctggctgaaaacgtttgaatgagtggagagtgatgttaaaattggacttcctatatgctgaaaaagcctaaatgtctatccagaagaacatctcacttttctccctggatcaactaaagtgctatataaaataatacttgggcatatctgtgcatgaatttcacgggaattttctaggaagcagtacgatccctccagaagttttatcaaaatctatcaaaatcctttattccaaacaaggagtattttacggtttgctgaatccatgtgccctctaagatatgggaccctcaagtaaaccagcaaaatgtcccagttcaacacaactatgctgtaagatactacaatacatatacctgtaatttgggaaacaaaagggtgaaatataccagtgtttttaaatgactttagtgatcacgactgaaaaatatatgcgacttttttctctttttcctaacgctaataacaccatatacggaaaactaaaagttatgagtattgccacaaagcattaatcaaaagaacagaaaaaataacctctgaattatctcatcagcctcagcacgtgattgcttatatgcgctaagcctctcatcgagat

SEQ ID NO: 44701 - DNA, 12869 bp, Oryza sativa
aactcttgaaggggtcaacttacagcattagatttctctagccgacgaacatcatctagtgaaacaggaccatcagaggaaccaatcccaagaccttttagtctctttctttcagaatgaatatcctctttaagatcaaatacaaattgtggtacatatatcattacttgtaatgtagctggaaaaatgtaatcaccaaatcttaggaaagcacatgttccctcttacctgacttccttttaaggatggtaacttcattctctgcacgactgacagcattaacttcacggtagacaaatgcaaaggaagtatctgtagatgaaacacgcaatataaatggccaaaaaaagttcgatatcgattatatacaagaaaaacaatgcaaggtaaacagggaaaacacagtaaatataatcaagtacacagaggtaaactagcagaggccatgtgcaggaaagctctaaaaaagttacaaggcaatgaatttatcataattgtttataagaacagtagagttggatcatagaaagtgaaaaaagctcagaatctttactgtcatgaggagcggagacaaatgatataatgtccccgtgattaagcttggttggaggtgaaattttcttaagcctggtccagttgatgaatgtcccatttgagctgcagtgctacaataagttaatttaagaaagggtgctgtttattgtaatacatgacaagataaccagaagcacaagaaacctcgagtccttgaggaaaacaggtacaggttcattgcggttaagctcccccaacacagtgtccctatatatcttgcaatgtttcccactgatctgcaaagaggaaatcttgaagctggattcctgaacggcacggcctatgtagtgctcatcggcgcttaaaagaatgttcattccctacaattaaacaaaatggctccaatcagctaactcagcacttttttgggagctaactcagcaatttacgattcaatatctcaacctcttttcatggcaatgctgaattagtactagcagttacaaaaggaaacattgggggtttagggttagggtttaagggagggggacctcagggcgcaggcgagcattcttggagatggccgtcaggacagcccagacaccgtcgtcggggttctgtacgggttgctcggcgaacttgcgcgccaccgcgcgcatctcctcgggggacaccggcgagggcttgggcggggtggccgcattgcaggaggcggcctcgtccttcctcgccgtcttcggcgtcaccaacagctcgctcggtgggtccagcgccgccatcgcccggcggcggcttaggggggtcgacgagtgacgcgcgcggcggaagatcgcggattcgcgggaaaaggaggacggcgacgggggcgggtagggaaggggagtggagtgggggggaagggggtgtttgtcgtggcgggtcgtggtggaagacggagagagggatacaagttctgagattcgcgtgggggtgagattagaccatcgtggccgttagatggagaccagagagggtccacgaggcgtcaagttgaccgaatcgtagtgtgcgggagaaggaaccagagtccacattgcgtagcagttgcaatagcactttttataccaacaagcccctctgctcgtgacgcatgagattttagattttttttttcgattatctgattttatgatatggtaatttattcacttggcctgaaaatcttgtgtttaatagtgcaaatcttattcgacacatgtaaagtttttgtcaagtcaaatgctatatttgctacagagacaggaaagcatcactcgtgtgatagttgggtcatgggtgcatgactactcactagggttaaaattctggtgtatacgaatattaatcatatgttagcatgctttcatcaggaatttcatgggtccaaggatgtgttgccagtctccatctccttaagcgtgtgttcgggggcacacttactagtatgtgagcgcggtgtgcatggtgtgcgcacgtttgcgtatttcttgcaattgaaaaaaaaacgctacacttgtttctcttgtaaacacgaacatatacaatccatgtgaagaaaccacatggaccttaggccatgcttaccggtcaacattcaagggtacacaagcttcattgacccacgtcggaaccagagctaccatagtggagaaaaataaaatggcttgaagaaaggttttgtagtccatagaggacatggtgttttgagagtggaaagcaactatataagaaaaggcgtttgcgttgctgctggtaagatgttactttatcaccagcatttcaggctggggtgaggaggaaagctgatgataagagaggtaaagagcttaccacttgggagcttgtcgcctctatctacatatgtgtattgacctgtgtccgtgccacccaattattgctatcatcagctatagttacctctattgccgttgagctcattcctatcggctggagctttccagtgctactgctaaagctcgttcttgatccaacgactaaggcggaggcaacgaggatggaaacaagcagtaatggcgggaacaagcctcgatttccttgatcacttgatgctaccacctcgactatcatggcctagcttatgttctccttgtcatctgaggtcaccgttgaggtgttctccttgtcatctgaggtcaccactggggagagagggggaagatgccacaacccctctttactccttaaaaagatggtttaacttcttttgaaattaaactttttattgttgtgagtcttatgactgataagctaacaagtagacgatgagagtgtaagctataatgtttgtcttgtggtcttgtacgtgatatgtttgtacacattgggtaacagaagaataattaagttcaacttggagtacttcagacctcaaatgccacattgctagatcattacttcatgcccatcgaattcatgaacaatttgatggctcgatttggttgccgggatcgatttagatgttaggacttggtacccctagtgtaaatttgaacttaggggcggagggagtacttgggtatcgtagcaaagcactataacagattagacctttctattctgaaacagacatgtagagtagagtagatgaggtagcacgtttctttccttcatttccgccaagtttgatcgtgccgtttctgttcatttcaatttttcaaggatctggtactatttgaggtaattaaggacccggtgatggcatcgttttcatccatggcaatgcttttgtggaggttggtaaccaaatcttgacagagaccttgcagttcaggctttgagagtcgaaagccatggcactggaacgcatcatcggggtaattagcaagcacgtcggtccatgatgatacgttccgacgaatcattgccgacagaaaggcacgctgaactccaaaccccaacaaactttctccatgcgaccatgcctactgcatcttatgttggtcccatcaatggcatggcatggcagatggcacatctagctagtagttaaatcgtccgctcgcgcagttgcgccggcggatgatacaagaagcccacgcagcaatatgctgatctgtttgccactcacgcttgaatgaatactagtagtagcagtactagtagctttgctattactgtagatctgtgcgtacagccgcagcacggtggtagcaccatagtagtagcaccgtaccggcacgacggacgagcagtgaataagctcatttatgcatccgtggtgtacccatggtttccctgtaggccacagtactacgacctatacggacgcaacgcgaaacgggcaacgacaccacgtccgcggccgtcggttgacgtgaacagcggcacgatgcgtgagcggttgacgtgaacagcggctgcggctgcgcagccagcgaattgaagagaaaaaattcctccccaaccgcgcgtcccatgccgtaccccacccttcgctgcgcctgcgccgcgcacttcctgcccacctcaacatgccggcagattggcagtgtggcaccaaaccacgtcgcgcgcgcgcgcgctgctgctcccgatcgcgttcgcgttcgcgtttcggtttgaccgcgcgtctcgcctagatttccacgggtaaggtgaaggtaaacgccgcgcgcgccacgcaccaaacacccagaagaacgtggtttctggccaaccgacgtcaaggaagaaagggctcatggccgcgcggcagcaccacccgcacattaacgcacgccacccaccgccacctactcgccactcttttactcggcgcgccttgtctctctctctcagtacgaggggagtagtagtcagtagtcacagcagtagaagtagagcgccggtgccgtcgccaccgcggcgggggtaatgcatgcgctcgcactcgcactgcgcctgctcctccagctgtcgcgatgaggcagacgcgctcgctggcggcggcggcggccgttctggtggtgggtgtggtgctgcattgggtgggggtggtggacgcggcgacggcggcggagagggggatactgctggagttcaaggccgccgtgaccgacccgaacggcgcgctcgcgtcgtggacggcgggaggggacccctgcgtggacttcgccggggtgacgtgcgacccgtcgtcccgcgccgtgcagcgcctgcgcgtccacggcgcgggcatcgccgggaagctcaccccgtcgctggcgcggctggcgtcgctcgagtccgtctcgctcttcggcaacggcctctccggcggcatcccctccagcttcagcgcgctcggccccacgctccacaagctcaacctcagccgcaacgcgctctccggcgagatcccgccgttcctcggcgcgttcccgtggctccgcctgctcgacctctcctacaatgcgttctccggcgagatccccgcctcgctgttcgacccatgcctccgcctccggtacgtctccctcgcgcacaacgccctcacggggccagtcccgaccgccattaccaactgctcgcgcctcgccgggtttgacttctcctacaaccgcctctccggcgagctcccggatcagctctgcgcgccgccggaaattagctacatctccgtccgaagcaactcgctctccggcgccattgccggaaagctcaacgcttgccggagcattgacctgctcgacgtcgggagcaaccatttcgccggaccggcacctttcggccttcttggcctggtaaacatcacctacttcaacgtctcgtccaacgccttcgatggtgaaatccccaacattgcaacgtgcggcaccaagttctcctacttcgacgcctcagggaaccggctcactgggccggtgccggagagtgtggccaattgccgcagcctgagggttctggatttggggacgaatgctcttgctggagacataccaccaagcattgggaaattgaggtcgctttcagtgctcaggctcgcaggaaatgcaggcattgccggttcaatccctgccgagctcggaggaattgagatgcttgtcacactagatcttgctggtcttgctctcatcggagacatcccggtgtccctgagccaatgccagttcttgcttgagctgtgagtgtctgttaactacgcaacccagtccaattcgtttgaattacagtggtttcatgtactgacagactaatttgaactactgcaggaatttgtctggcaaccaattgcaaggagtgatcccggacacgcttaacaacttgacttacctcaagttgctcgatcttcatcggaaccatcttgtaggggggattccagtgacacttgcacagctcacaaaccttgatcttctagacctctcagagaaccaactgactggaccaatcccctcagagcttgggaacctgtctaacctgacccatttcaatgtgtcctacaatggactctcgggcatgatccctgccttgccagttctacagagtttcggtagctccgccttcatgggtaacccattactatgtggacctccactgaacaatctgtgtggggctagccggagggcgaaacaattggctgtgtctgtcataattgtcatagtcgcagcagcgcttatacttattggagtttgcattgtttgtgctatgaacataaaggcttacatgaggaggagtaaagaggagcaagaggggaaggaggaggatgaggtgctggagtccgagagcacaccgatgcttgcatctcctggcagacaaggctcaaatgccattattggaaagttggtgcttttcagcaagagcttgccttcaaggtatgaagattgggaggcaggaactaaggcactgcttgacaaagactgccttgttggtggtgggtcagttggtacagtttacaaggccacctttgagaatggtttatccattgctgtgaagaagttggaaacactgggaagggtgagaagtcaggatgagtttgagcaggagatgggccagcttggtaaccttagccaccccaatctggttgcttttcagggttactactggtcatcatcaacgcaattgattctgtcagagttcatggttaacgggagcttgtacgaccaccttcacgggagtcctcatacattttccggaagcagcagcagagttggtctctcctgggagcagaggttcaaggttgcactcggtacagcacgggcacttgcataccttcaccatgactgccgaccacaagtcctgcatctcaacatcaagtcctccaacataatgttagataaagactttgaggctaaattatctgattatggatttggaaagcttttgcctattctaggtagctatgaattgagtagattgcatgctgccattgggtacattgccccggagttagcatctccaagcttgagatatagtgataagagtgatgtatttagctttggtgtggtgttgcttgagattgtgacagggaggaaaccagtggagagccctggggtggcgacagcagtggttctgcgtgattatgttagggcgatattggaggatgggactgtgtcagactgctttgatcggagcatgaagggatttgttgaggctgaattagtccaagtgctcaaattaggtctggtatgcacttcgaacacaccatctgcccgaccaaacatggcagaggtggtacagtacctggagtctgttagaactaattcatgatctcctgacgtcacggtacagtagcagaataggatgttaaaacaggaaaaaacgttttctggtttttgaacagatgatcacattgtttttattctttattgtgtccccagtcacatttgtaaaatgtagatttgcatctgaataagtggttattttggtcaaattaccaaaccctgtgaggatttatctctgtttttttcgggtgctccctacaccctcttttctttctagtactgtggaaaatgcaaatgtaagatcaaccactctgaattgagtacctctttctgcatgtctgagctaaagaggagttggtagttggtactgtctaattgtgtgtcaagtttgcagggtagcgaaggatcagttgaacaagagcattgtggtacaggagcagctcatctaaaccacctgttctctcctacttatatcagcagtgcctgaaagatctacaacagctcaaattccattccgaaaccagtaaaaccacacatccaaaatggatgagcttgaactgtctgaattcaatccaagggagcgcgtcaagcagcagatttcagtcccatttctctgggaggtgaagcctggagcgccaaaaaaggactgggccatttccaatccagtgccatcagccatctcatgcccatctccggcgaaacttgtcgtcagcgtgcccttccagtgggaagaaaagcccgggaagcctctccaagatgcatctccttttcatccgctgtttgatcatgctgatttttctgtatctccttcctcgctaaaccctttcttggctgaaagtgaggaagaatattctctagggtttgatctggaagcatttggatttccagacagcaaggaagcatctggaactgcagaatgcgcaggtggttccagtcgccatggcacatggtattcattttcagaaacagaagcttacagcaactcaagtggagacacttcagcgctagattttcagtttccacgggcaccatcagagaaaagctgggaggttgctaatgacgatgatcagctgaagaatccgtggagtcctcccaagagcacatttacactggaggagcttatgatgcttagccgcaaattgtgctgcgggcaagggatgccagttgatgtcaagaagaagaacctctccctctcatcaacggtaacgcctccaaaattttcattgaattttgttttttgcatctgcaaatattcataccaaacatttttcgttcagaaatcagaatgaacatcgcaattctcaatttgcaagcatggtatctctattcttcttgacaacttaaagtttttttttgcattacgatttagaacactaaaaaaatcatatcactgcagcatattgaaaatataactcctatccttacgagaatgtgacccattgcatctacatttaccgttgaggaatcccacggatgcttcacctgattggcactcaggaattttttataacgtgcaagcggcatgtgatgcagacaccacaactgctcccgttttaattaactgtactttgtccctcctcttgctttgctgtttcaggaactcatcaagaagtttttaattgtgtgttcttagctgcaaggcaccatggttgcggcacatggacgaactgtactgtgtgcatgtgagatcccataataattgagcaagttcagcaaggcgtggcttgttccaagtgtaaaatcctagcggtttcggtgttgtttgtactgccatgtagctaaacttgtgaagctattttctttttgtgttctaagagaaccactaaattttcaactttttatcagtcttgtaattcggaggaaagcactggaagtggaattggcaagctcttatacaagcaactgaaacgattattctggtctgctgatgagcttaggctcgcaaaagaacaaatacatttttgctaaagaacataataatattggaaattgcatttttcctgagagtattacacttttgctgaaagtgaaagtgtaaaaaaaaagaaaaggaaattacatgtttgatgataagagagaaaaatattgcaaatatgagtttaaaaaatttactgaaagagtaaaaaacattagaattacagtttttatgatgagagtaaaaaaagttttttatgatgagagtaaaaatgatattgcaaagatgagattaaaaaattaaaaggaaattacatttttgatgatgagagaaaaaaatattgcaaagatgagtttaaaaaaattactgaaagagtaaaaaacatttgaattacagtttttataatgagagtaaaaaagtttttttattatgagagtgaaaaagatattgcaaagatgagattaaaaaaaatactgaaagagtaaaaaaacatttgagttacattttttgtgatgacattaaaaaatatattgaaatttgttttgtgatacatttgaattacattttttgaaagagtaaaaaaaacaattgagttacattttttgtgatgagattaaaaaaaatcgctagaaggagggctcgaacctccgaccttatggttaacagccatacgctctggccaactgagctattccagcttttgcactgtgtggaacaaaagctttctatgtctacgatgaagtttgaatagtgaaaattgaactctacccctgcaaaggccgaccacgtgagcatgtgcgtcccgcaaccactgaaacaagattcgccacaaagcgtcaaatgtcagcacctcgggccagatcttctccagctcttcagctccagctagcttggtcagagcttctcctttaataattgcaccaacttgtttaggatttctagttttctactgctccgactacgagccagcacaaccattacccactggacagacgcaccgaaagtttctgcaaaaatacttgtccagggacctatcatcgcaatcatgcggatacaccaaaaaagcccagcgctacaagacgattctaacaagctgttttctccagaaaaataatgttcaccacacaaaaaggcaggagaagagaattaaccttcacgggagaataaaatgctgctactttccaatggtagctcatactaggacaagagaatgttgtgacaaaatgtttatccatacgacaagaacagaacaagtcacctggcagctcatacataggacaaatggacaatatatactaacatagagctttcccatggtcttctgatggggaatcagcacatatcggttctctcggtatatctgatagcattacaccaaaaatcctacctaactcctaggttgagttggcagggatgatacaaaaccaaggcttggggccttacagtctaaagaatatgctacgctgacaacatgtacagtatgtacaactcaatttttcaacttaaatggtataccaacagatccccggcctgtcaaactgtgtctttagtcatcgcttgtgtagacgtattgccgcaaaaagaaatgatggaattgtctgtccaatgttccacggcatgtgcaaagagttaatgcacgaataaatcattgtcagtcaaatgaatgaatgtctgtggctttgtaatgttagagtgatctgttgtaggcttcaagcatggttgctttatcctgtaaaggtagctgaaatatgatcagatatggaattaaaaagatactaatgacagtcattgagcatttggctttactactgaaatataaatcttctcatggatatacaaagcatttcaatatcatggttttcatgaataataagaacacttctaatatctacttccaagcaaagatagaacaaggtggcttatttaatttctgcagaaaaaggatgttgattcatttagtaattggtgatgaaagaatatatctagtagttataaccgcaaccatcagcaaagaagctaagaaagcatacctcattctgcatactgctttccgaggggaaccagcgcataagaataccaaggtgcattaccacaggaattagtttgaaaatgagaggagttgtaacctgccagaaaaagcaaagcaaaacaaatgatttctagtgtgtattaaacaactaagctccatcatcaggtaaaaggaatttaccaagctaagtgcagttgttcccagtaataatagatacatttttccctgaaaaacaaaatttcaacaagaattttacatcatgcatgtattgaagccagaatggctaatctttagtatgaagtatgtctcaaaaaaaatcgatgaacaaataaagaattattcaccccaacaagatgaagatgcgaagcacggctaagaagcacaaatgcaaactctcctatctgtgctaatgatagcccaaccttgtgagagaagaaaaaccaggagtgagaatttatatcattattggcttattgcagaatacttatgaaaaaaccatcaagaaagagatacttacaacaaaagctgttctgatgctgtatccaaatgctttcaccacaactgttacgactacgctcttaactattataaccagtataacagctgcaagcaatatgtcaacatgattccacaagaacttgacatgtatgagcatgccgatgcttgcaaggaagagtgctgcaaataagttacgaattggctccaccttgaataaaaacaaagaaattacatgttagagagtgagttcaatcagaacaaaatgtactgatttagctacaaaaacaaaattacactagggaagaaacttccagaagttcaaatattagcaaactgttatgcagaccatccaaattggtctaaaccgtttattcttaaatcaataaaaagaacaggaaaagaaaaacattgacacccaagtcaaatccctgcataaaagaatcaagtcaacagtaagtagcatattacctgctccaaagtatgatgagcaaaatctgtggttgagatcataacgccagcaagaaatgagcctagttcaagactcaatccaagataatcactacactggaaatacaaagaaataacattactctatctacagaaatgatgttgcatgtgtaagattgctgatcgaagtgaaattaatagtaatacaactagtttgacagtaaaaaaaagtcactatgcaaccatttatccctcaggttagagacattgtacagtagcatgggcagaaactctccttgactatccatgtatcacctttaaatagtttgtgaatataataatcaagtacttgttcggcaaacattgggattattgttagaatattatttattgataatgacaaaacactagccatccttaacattttgggggaacatccccgcactagcgcacatgcaatcattcgatactgactgcatttgtcctgtagcttcctctgttcccatttacttgccacctttgaccatcaataacttctaaattataagattttgctgaataaaaattgtatggttatatttaaatatttaccaatttattgttaaaataagagtgatgaaagtcattctgatgtcagaatgagctttaggcaataaagttgaataaccttacccaggctagcagcaagcagaaagcaacagaagccaactgatagagttcatttgtctgcatatttgaaaaggtacattagcaagtgacgtaaaacaacagaatcaaactgcaacatatt

SEQ ID NO: 44702 - DNA, 782 bp, Oryza sativa
ttgaaaaaaaatccaaagtgactgaaactgtcaggggcttgggatcacatgcaagtgggacacccatgttatttttcaacttacatggtactgagaacgaactattcatgcattaacatgtataaaaggtgaagtacataagaaatatgagcatgaatttatacatatgaatgcaaaaacaggaacagaaacaaaaaataacaagctaattcatctaacctgcgatgatagctgaatcatcagtttcaagaatcgaggaacaaatgaccaagtcatcatatatgcaacagttataaatacggataatacaagcagcctgcatattagagatatttgaggttactgatgaaccaaacaggcactaaaacataggcatgcatcaatatgataatgaaatttagattttattttaacatagctattctgataatagccatacagtttagccattgacatcacgcctccaaaaatgccactagcaccacccagaactggaaggagagcaaataatagtccaacggcacagtcctggagtaaaggaaacatggatgtgacctccaaaaattgactatttaaattccatatagaatattaaaagggcaatgactatttaaaattcatgaagaatattataagggcaaatgtacatatttgttgattatcagcactttgttcacatgagcagtatatatgagaattgcccaggaagttctaagtaaaggcatcttattttattatattttctgttgaaaagagtgagaacaaacaggggctgcaggaat

SEQ ID NO: 44703 - DNA, 11352 bp, Oryza sativa
  unsure (1)..(11352): unsure at all n locations
cctgcagcccattaacagcattagtatgcttctgtcttggaatgatgaacctcgggctttgattccatcagacattacagctggttccaaatttcagttgtatagagttgttgaaatatactactcgtactcacctgcacctttgtctgtgaggggaactttcaacaaatctctcctgatcatgtgagcgagtctctacttgtactataaatctttgtataatacagtagcatcgtgtatgtgtgatctgattttctttataatggataaatatctggcccctatatccacttgtgatctgaatactgcagtatatattggtagtaaatcttgttgtaatttatgaactgtctttttcctggacgatcgattgattccaaaatcgtgggatttgagtaccagtatctgactcaagcgatctgaatgagtggtggtttagcgttagttgggagaaaattatcaagcacggagcaacagcgacccattgaaagttgtagctcaactagtaatcctggtggcttattggaggcctaggtggttaggacttgggagatcgcactcagacgagtatactcgtggcagttctgtctgtataaatcagaatcactggtctgtatgtgacgcactgtcattttctagtagaccaatggagcagaaacaacggacattgttgctagaacaccaaactagcatactagcattcacgcgtaaatcggctgaaaggatggatttcgcaatcagacggcaataccgtagtgggtcgtgatgatgatgagatattgagatccatccaacattctccaaaccacttaatcacctaagactagagtagtagactgaagaggcttaagctcagctaatgctcgagtcgtcagaaaagaaaatcaggagtgaacagaatgaaagcttggttgataatgcaggttggcgttggtccacccactcaactagaagtgacagcttcttagggtgaaaatccaccaggcccacccaataaggccaccagcccaatattattaggaataagttcactttagatccctcaattgccgagtctaaaatttatccctaaaccgcaaaaccagacgtgcccctcaacgttaaaaaccagtgcgaatttcagactagtacctggtattggaagctgagggacgcgctatatctgtattgcggctgaggatgaatttcagacttgacgacaaaggacttaatcggttgtgctggctgcagccagcaagccattcacagctgccgctctttcgtttggattggggctgactggctgcagttgctgcagccagcacttccgattagggccaaattgagggatccaaagtgaacttatccatattattatacccagccgcgcgcagcctatactaattgggccggaacggcccatccctctggaccacagtattgggccggaaagggatcgtggtgtatgcgtggcctatgaatattgggccggaacgggatcgtggggtatgtgaggcccatgtgagttcggctcgaacgtgtttgttgggccgagagtacggcaggttggaaaaccatggcaatgcgtcgctgctgacagcggttggtgagtctacttcaggggatcagcattccggaaccttcgaaaagagcgcctcaccttgttcgccgtcatcggatggctacttcctacctaagaattgagcttggaacgcaaatgctggtgcgctgatccatttcgccaatggaagcacgaaccgacaaggcggcaatacatgatgcggatgcatgctctcaagtctgaatctgatgaaccaatcaagttttcctagccatgttaatttggagagatctacatctactccaggtgactgacagacagatagcaagcagcaatatatactccagaacggtaaaatctatgggcaaagcagtgaaatcacgtgtatatttatgaccttactgtactttacttgcaaaatgtattgtagtagtagttctttaaaaacaacatgcagcctcgggattctacaggtaaagccccacttaaatcaactagctagtcgtcttcgaatcaggtctaccctcgtccctcgtccagtggttgttctgtagaagaaaccactgctttgtttctttacggcagacgtgatctgaaactggcaagaaacagtgccaacgcccgtccaacgataacgagatacacgcaacagaagcgtataaccaacaatttctggaatcattttggaaggatacccgacacagtaatggtctaccggttttcatccaaatggcagagcagaacgaacagtcgaaacacccgacccgacagaacggcaaaaaacgggcctgaatgccagcctgaaccggcaccgcgccaccgccacgtcgtcatcgtctcgattggcagctgccctctcacttccccaccaatgctagggcctgtttgttggaacttttacctgctacagtttttctcaaaatcagaaacttcccccaaacaatctagctttgatttgtataatctagaaaataactataacccaaaacttaaaaaacctagcttctttaattctcataagctagctaccaacaacttctcggaatgcatgccctagatctcctgcgctgccatgccgcatcagcttagctagcgccttcacgtgcgcatgtgctcgctatattatccaaatcgcaaaaccatccaaggcgcgcggcctcaccaaccaccacgcaaacccattgttaattaattagcggcacactgtcacggcgcattatttgctagctccagtgacagctcactcctcttcttgctgctgagggcttagctagccagtccacctcgtcggtgtgtgtcggtgtagtctagcagctgcggcgggaggaggagttgccggccggagatggcagcggcggcgcagcggcttgtcgccgctgtcgtcgtcttggtggcctgcctggcgttgccggcggcgcgggggctgaacatcacggcgatgctgaacgggtacccggactacaagatgttcaacaagtacctgtcggagacgaaggtgtgcgacgagatcaacgcgagggagtcgatcacgctgctcgtcctcggcgacgggccaatgtcgacgctcgtcctcgacgccgaccagtcgctggcgggcatcaagaacgcgctccgcctccacgccatcctcgactacttcgacccgaagaagatccgtggcctccccgacgccgacacgatgaccgacacgctctaccaggccggtggggacgccgccggcaagatgggcaacgtcaagatctccaccctggacaccggcaagatcgccttcgcgtccgccaacccggggggaaagtacgaggccaccatggtcaaggccatcaagcagatgccgtacaagctctccatcatggagatctcggcgcccatcgagttcgacggcctgttcgacacgccgtcggcgaccaacctgacgaggctgctggagaaggccgggtgcaagcggttcgcgtcgctcatcaccagcaccggcgtgctcaagacgttcgaggatgccatggacaaggggctcaccctgttcgcgcccaacgacgacgcgttcgacgccaagggcgcccccgacgtcaagaagatgcccagcgccgacctcgtcacgctcctcaagtaccacgcgctgccgtcgtacaaccccaagccgacgctcaagacggtgtcgcgcgccatgcgcacgctggcgtccaccgcgtcggggaagtacaacatcacggtggacacgcggggcgacgccgtgacgctcaacacgggcgtcgacaagtcccgcgtggcggccaccgtcatcgacgacacgccggtgtgcgtgctcacggtggacaacctcctcatgccggtcgagctcttcggcgacgcgccggcggcggccccgagcccggacgacgcggcgcccgccccgtcgccgtcggtcgcggacgcgtctccgccggcgccgccgccggccgacgcgccgtcgaagccggcggatcacaaggaaatgaaggcgtcgtccgccgtcgcgttgcggtcagtagtgctcggcgcattagccgcggccgtgtgttccttcgtgctgctttaagcacaagttttttttccctttcttccatgtccagtgccggtgattgtgattgcacgagctgcattgccaattattcctctgtataatgcgagcaaactgtgtacattttgttctaattctgatatccttttctccgaatcgtctgcgccatttcggtgcggtgaatttggaagaattcatgtcgcgttgagctgtacaactgtagatcatgtgagttcttgtcctttgagcgcgtcgtcatgcaggcccaccacagcaaatgcgggtgtgttgatgtgatcttgaaaaaacagattcgggcgagagagctagtgcggctgccgctgcctccttgtgctggcattggcagctcctacggatttcgatcaattcgccgtttcaggaccaccggtgccagtaatgcccgttggccgtgggttatttgataactctatctagtctttaaatatttttagacaaaaataatagaaatttaggtcatcctattttgaacgcgattctcaaatttaatagactaaaaaattaaagtcccttaccacctaggacaaccacaatgcagaaatacaaggggtattaaggggctgtttggttgagcgccaacctttgctacagttgtgacaattaaatttagtgtttggttcatgccacaggtgagttataccacttttttttttagcaagctagcccacttgtcattgagtaatttttttaccataacttgccacaattgtggcaaataaattcttagccatataatgtgccaaatattttgtggtaaactatgaaagttatgaaagtcatccaaactatggaagcctctaaagtggtccttatacattgtaggagtagttcatatatatataatgcctagccataagaataaaataacaatactttcttttctctctcacataacatacaattgagtgggaccagtaagatctatgctaatgcctcatcttatcatagcatattgtagcaactaccataattaatatcaggtcccatcttattacccaagtagacattatacattaagcatgccctaagggcatcagcatcagcaatgtttattcccaaaccaagcaataagggtgggcccgttgtcagggaaaatatctagcaatgtgtgtatgtaacagagggggggaggaataagattggtccaccttcaaccaacctatcacaaagccttgttctgacttataaaagtgaggtgggacccatcatattcccttactaccggcaataaacttgtaacctggtagtaactatttactactgtcacaatgtttattacttgataacaaacccctatttaatgcttattacctgctctagcactacattgtggatgcagttgtgagcactgtgtagttaatccacggaagagtaaattacacttctagggctcgaacttgcatggcagagaaaggagtacaataatttggaaacgctttttctgctcaacttgttcatgcgaaccaagaattcaattgaaatgcgggatgcacgggtatagccgttcagcgatattagtacagatttaactatttatctgtggagaataatacaaatttatacacatgaactccataaaagtaattaagaactaatgtcctgaaccctgatcattgctaaaggtcgtataaacaaatacggtatttacacacggaattgacatgctggcgtttcttacacactacactatccaattatacatcttatgttacaagtaagaggatatatttcactgtttgagcgaagttgtaactacaatagatacaatatgccctgtggaatatttacaacatacatacgccaaaatacttaaatcttgaagaccacaagcacaaaatgggtagagaagatcagtccttgttgcgagaggaccgctcccgctccttcttctgaccaccaagaatccgagagatttgcagtcctctactgaacgcttgattaaatagcatccgtgtctgaaactcggacacaaagggaaaccatgccaaaatagtaattggtgtaaagagaagaactcccataattatctcgtatgcccgagcaagggcacgaacagatccccatagccctgctcgccgagcaagaggcttgcaagcttgtgcaatctgaaagagattgagcaacaatgagaaatcaactaaagcataaatgaagttaatgagcagaacaagtaggagaaagacaaaccagcaatattccccatccggaaggtaagaatgccagaaagcacacaaatatatctcgtaaggtcatatgaagtattgctatcagtacaatcaagatggcgatgaacgaaacaaatatcataaacttaatcagacggaaaaatagctgaaaatccgcactaaatctccgccttccgacagatacagtctgaaaacagtataaacaatttaggtaagcaaaattatagataagatgctatggacagcaaatagtgttgttaacgtggccaccaacccgccaacagttgtatgatcctttttttttcttgagaaattaattctcaccttcataacaagcaataccaccaaaatcacgagccacgaaattaaatatacctggaaagaacaaagtagcaaaaaatgttacaaccaccccatcacttgttcaataaaaatgtagctctaacgatctttcaaaaaatgcagctttaacagaacaataaaattaacatggagggcataccaatatacttttgtcgcctgtgatatttaagtggtaaacaaggccatactggtatatgaaaaacctcagggacaaaattatctcaacaaaaagtccaattgtcccagaatatttcaaatgctctagctcgatctcccaccaggattcccaactcttgtctggtgacaccccaatgccaccacgattgctgatccacttattccaatcagaccaatcatccacaattttcgtccactcaaatcccgatggattgaacaggaagggtgcaaaaagccatgtcaacactaggaaccacatagagaatgtaacaaaaatataggcaatggttgagcggtaagattgaccaaatagttggtaaatgatgagcagaatcaacaactcaatgcctttaacaaagtgactgcgagaataaagcctgtaattctctgcaaacttagcatgaaagacaacaaagcccctaccagtagctctgtactgagcacctccatggagcaacattcgtccatagtagtgagtcttagtgccaagtgaaaacgtaaagaacacagctgccaattgcaagttcatcatgataaattcacttagtgcttgaccaaatcctttttcaaggccaatttccatcatcatgggcagggccatcagaaaacctagctgaaccagagattgtgaggcaagagcaacctgaagggggtggttatgaatgtatctcctttgtgttaaaagcccttcttcaagtccactgagagcaagataaaggcgtccatacagaaatacataaactgtgacaactgtcagctgtagaaaaagtgaaaagtattaaaaacatagttaactgtgctggcgtactcaaaacaattgcaaatacaagttattttagcttagggcattaggaattaaggcctcaatcaacaagggataataggaagatgtgagaccaatgtggctcagttgtacagtgaccaatcttcagggagtggtcgacgcaaagcagacataccagagtactgaaataaaatcccacagtagtgaagtagcatgaaagcattctgaagaaatcgaagcggtgtccaagccggtagatatcacggctaagagtctgctctccatttccattggccaccttagcctcaaacttagagatctggtttaaccctacatctcttcctttaccaacttgcacatattcatgatgtgttatatttcctccacggagagttgaattatagcctgtaacataaaagacaagaggagcattaccccagttcctgaatatccagttacatctggaaagaaattaacatacagggcattcgtattgaagcaatggagatatataattactgccaaagaccatgataattgatcttagccacttcattaatcagcaaattgaaactttcaggaaacaaacctgcaaaaatatcttcgctcaagttgatactccttgatgccttactgacaccacctcttgttagatgaaaaatcctatcaaatacgtcaggatggccatagtggaatcgaaccctagaataaagaaagtaatagctttagatgcaatccaaaaagggaaattctgtacgttttattataaaattcttatgtagaactagttatcggaaagtgcactataaaatggcttgctcaatatgtttataagctagcaaatgacatggcttagttcatcacatgcaatttcagatttagagaatataatatatgatcacttagcctttttcttgtgattgatgaaaataatgtattatgtatccattcaaatgtatagtaacacacatgtgaggaggaaataatcagataggagaagaaatctcacttcagnaagggnggnntntntgncannagcagccgttgcccaatagtcacaaaactatgctcctgattggacataaaccatgcgagagaagagacactgcataattgaagagaaaggtgcatgaatgaattactaacagaacctgaaaactcaattgagcaacagaacaaagaaatagcagaatgtgaaaactagattgagcaactcttatcaacctgccagtaaaaatatgttccctaactccaagtatagatgggcgccgaactccatgttctgtaaggaactcttgaagcaaatttctcattttaagtgcttcttccatatagttatcctacaaaattaaaggtgtgcacaagtaaatatgagtttgaatggaagcataagtgctgcacctcctttggagaaaatgacagcataaagtacgattctacaaacctggttcatgtctatggtttgcaggccttcaccacgggtgaagattattgcatgattttgattttcaggctttccttctcccaacattgcaggtcctggaagttttatccggtagataaccttgaaaacaaaaaaatgcaaatgttgcagcttcacaggatcacagaaagaactttcacacttgatccacttctataaaagaagcccataacttccagcatttatcagtaaaagaagtttcaagaacagcagttgtgcaggaggttcctaaaagtgtgtacacgtccacttgaacctttaaagttaacttcttgagcatctatcagttagagagagtggaaaggaattgtggcactgctaagcaagtcccgaaggaactcaggacacacttatcactctcattgcctgggaattatgaaaccatcggtgtgattatgttttgaagttttcaataggacagcagcattcatgtggtcctgagatccatttctcatgaacatgaaggctttcgttggtgcttggctgggcaaaaggacttgcgaatttgcaatactagctggccattccaggccattactacttggtggcttggtcgttcatgagtggtgtgtgctgcgtgtgtaaatatgtttagtgtgtgtgagttggtttttgggtcagaacgtccttcttgacctttttgtactgtgttttctccttattgaaatgacatgcagctctcctgcgtggttgaataaaagaagagagagtgaaaaaatctcactgcaaaattagattgttgaggatacctcttcaaatctaaatagtgttgtttggtctatggtttgtatcacttgttttagaattaggctgggaatcctttgatccttctattaatagtgtttttgttttgtgcctaacatgatttgccaaaatttatgccccactacctaatcaggtagaagtacggttacctgataagattttttttgacaaggaattacctgatcaagattttgaactggatctgtagattcagaatccttagttagagcaacctttaccaaagttgagtaataagctggctccattttcttttcttccactctatcttcgacctgatcgatatatgctacacgaagagaagggtacctgcaagaaatttatcgctaacaattagaacttgagacagaaggaatgacctacattatccaatcatggaaaacactgtactatcatgtctacaattgtgcaaattctgcagcaaagctttggaaaaaaatccattggttgatgtgtgtgaaagagtgtgatataactgcaaaacattaaatatcatgatcaaacatgatagcatcagggagaaatgaaatataaatttaaataccaacaattaaacagtgtattggcattcttctttcatatctctctctatttcttccaatacaatccaatcatgcaatttttgtggtcaaaataatatcttctatatgcccagtagtattgtcagctatttggaaacttgcacacgaagttcatacgagttagattgtatctctagtgtacacctaatgtggctccaaaatttaaatccagaatgatatgcagcattgaatggattacttatagtattataaatattgaaatcactacagctactacaatatgatgagtacttaactaatctctacatctacagtattcaggtaaatgcaatatccttatttacgttctcatcagctgtaatatgtcttgggcattaggaagagcagcacgcttgtcatttccatattgctggcatgataccacataggtaaacttcatatcagccactgcttcacattgcgcaaacaaggaccgctgtaacttccattgttcatcagttgactcaactgctttatacccttccatgagatctgcagagtggggaaaaatgaaagagtgctatgagaacgaaatagataagaatcatgctgcaaccataaacccatgcactagcaacggtttgctgctaattgcatcacaatggtattgtacccccactcttaacacacatatccaagatcatgatgtgagcaagagccctgcacagacatgtgtattaccttcatgtttggccatatctagaaatgcttcaagaaccaaagcttttcggtagtacatcattcccctaactgtttcagatcaatcacgcataaatttagaaactatcaagaggtacaaatttggaaacttttttttagaggaaagatcattttttgatgcagactttgtaagaaactaataaaggttaagggctgcaggaat

SEQ ID NO: 44704 - DNA, 8969 bp, Oryza sativa
attcctgcagcccatagaagacatagacactcatatgctacatcaggacaatggaaaatagtttcttctcgacctgggtaaattttctgtaggtagaatagggtggaaactccatcctcattttcctcctgcagctcttttatcgaaaaaagaacaggttcattgtaatacggggtcaacgcgctgcagatagaaatagacattatcagtttgacaagggtgccatgagaatactgaacatagaggcactgcaaaagtaatgtcaaaaggaactcacaaaaaataatgagcagcatacaaggacttacgaaaatgaaagcatgtttctgactttgggagcatcaggcatgtccataaacaaagaattggtgaaaaaggtaagacgccttctagcctccagatttgaggggacatccatagcagactctttcacagtgagtaacagttccagcctttttatctgcagcaagaaaaaaacattgttgacactcatttagaattaggaagtttagccaacaacagcaaatggttcagtctaagatatagtaaacctgaagcacacaggcaaacacaccttctctatccaggcatctgtgaattgtacgggaaacttgatagctccagccggttgaaataactgatattcttgatcccatgtcgttgtgccttcaggcctttggtatgaaccaccatgacttgactccaaaatactgtcatgttgcaaacaaataaaataatgacaaactgctggaggtttgaacaggagcaatcatgtcatacaaaactcatagcagcagaatttatttcatatctcgtctacaagcctcctgcctctatattttttctttccttcacatccatgagtcttgtttttctaaacctgcacaaatattgcacatggtagtgaaatattcactatcatttcacccacgctatcaacaagcatggttggtccggaaaccttgtactaagacactaagtgatgatggttctgtgcatctccgggtgcagaagccaggccattttattccactatctaaaaatagcaaaatattccataattttattgtccattgaaaaatgctacaacagaagttgctcatataatgatattaaacagtaaatcgtcatggttcagtacttcatcctcatgatatttgcacatgtttaaaacaatagttgtacctagaaagttggtcttccattatatctcttgttacaacctccagcatatcttgaaaaatctttattacagcatccctatcattcttatcattcttctcctgatatatataataaacagacaatgagacaaactagaatctggtatacagacatatggacagactccatgaagtttgcatgtataacaagcattgcgaatatgagcttaccaatcatcatcagtaattgctaaaaaaaggtcatcagtagacagacagtcaatcatgaaaaggcaagcatgtttctttacgcgttgcattcattaagataaaatgcctagcttctcatcaatttacgtgccagaatgccaactgataatcctttgtactaaaatactttccggcaatataactatcttttagatattacaaaatatatttcgattatctaacatttgaggaaataaacagtacattttgcagtaatttgctgataaatggaaaataagctacatttctttagaaagataaataagctacatgttatgatgattggttagacaaaaaagatgttgaccttaccaaatattttaccaattcaacaaacttattgtaaagatctggcaaagcgtgcatattcaaatcagtaataactttgtcatcagcaatatacttttcaacttctgcaaatatagtatttatgaccctgaaaagcatcacaaaatgcaccatggatcaggaaattatttcttcacaacaatattcaagccttttggatattccttagaaaggatacataacttaatagacaaagcctaggagagacaccttttctctggttcaccttgtacaagatccttgatgatatttttaaatgatgcatagcattcttcaattgcacatttaaaataatagtcgttctcaagcctctttttcaggtcacggtctttgccattgctatctttagccatgtcaacagctatggggatctaacattcacattattcaaaacaggagtgaggtttgttcaaataaaatataaccaaaatgaaaaaagaaagagaagagaaggaccttgctggcaagcaaaaaaggaggccactgcataatctcaagagcctgatcagccacatacggaacaagcagcagctccttctccctgtgttaaaatggggtccacaagtttaaaggtagaaaacacaaatccaattggaattaagtagctatccatgctatgcactcacttgttatttataaggtcctcttctcgaaagctcgtgataatttcgttccacatctgtgcaaatcttgcggctatcttctccttgtctgtgtgcttcctctgaaatgttgtaacagtaacataatatttcagaaattagcgaaccaataaatataaaaaaacaatgtagaaatatgtaaaagaagaatagagagacctcaaaacgactgtgcaaataagactttagacccttcttcctttttgcatcagattcttcagccggaattagacaggcattaaaggctaaaggtattgaaccaaagcgagatcgcagcattcctagggtgcggatctgtctcaccagaaaaggaaaaaggaatgtaaataatgtttaacagatccgcagtcattcaaatgaaacccataggcagtggtcatgctggggttgcacctacaatttaatgactgttctcattttccacaaagaactaattcaattaacagaaagtcagaaggaagtacttaatcaagttattggcaccagttatctcaataagagtaaatttcacaaaactacatatactttgaccaaactatcgcaaaactacagatttaagaagatgtatcacaaaactacagatttagcaccaaatttatcacaaaattaatacacgttttcttttggtctaaaggtttccagttgtttcataagcgaacaacaaaaatgatttgcaaattgcattgaaataagaagactgaaataaataaacagctactcccattgttcccacaaaattgtcactgtttcaattttgaccatttatatttttaaatggttagtctatcatgatatgaggcttaatacaaatgtttacaatgcaaaacactttgataatatagaatatttttaggtacttataatttctttttgcagaaaatacaaatgatcaaagtttaaatatgaatagtgcttgggataaatatttaagaacttgagggagtattgctgttagcatgaaaatattgggaagcaaaagattttaagcgtactagtgtactacaaatagtaactggtcactgcaacatggacaagctgtcgtacaacaaaagaaaagacaaatataatctgtttgaaagatctattagagagagatatatattatgttctttattttaaaattatgtgaggggttttgttgcatatttgcctgtaccaatacgtgtatatatttgagcccagagccctttgatgaatacaagtgatcttcgcaacaagatccagacatagatatacaaaagtataaaaaggaaaattaacctctccaagtcgttggaaagcaccataaattccaccaagcagtgtcgagaagattgtataccaaatttgtgtatccatgaaatagacctggaaagcaaacaagaatgcagaaaataattgtatacttccttctacagcacaaatctagcttatcacaattatcttgccacaaacaaatggagcttcctaagctaaaacaatgcgagtgcttaaaaactttctaggaaaacaaaggagaaggtcgtaccaaaatgattggagcccaaagcgcaatcacgacaccaatgtttccgttcgctacataacaaaatttaggattgttataaactaatatacagctgaaaatgttgagtgacatagttaccttttgggaaaaactcatgccactgaaaagtgtgtataggtaacttcatgatatccttggtaggttcgacaagaggcttgatctttaagaataaatgcaagattaagttggttcatacagttacttcaacagaattgatttctaacaaggtaagctcacaataattgagaaaaaaaaaaggcattgctcaacatgaactagattcagcataatcccatgatttcaaaatgtaagtccccttaattgaaaggttcttcaatgatcagatcgtcatggttaccagttttattaggtgcatcttgtgtgcgtcaaataaatttatcataacattacactagaggtttctaaacttgtagagaaggtccaagtggtgttaaacttggaagcagaaggtcccaaaacatattgagtgctgctcaagtctgcaaacttaaaaaacgccatttatgtcataaaggattattttatctgacagaagttataaaatggaaatagaacagattattggatatgtgaaactaatgcggatcatttaaattgatgttttctatagccatattgggtattgtgactttcaaattggctgaaagagctgacacagcactagaaaatggaggtaagcagcgcacagtgcagtttcatacattgtgacactacaccaatactattttagctctcgtaatttaggtaaccaagcatgtgtacttgctctatcattgccatctgctaaccatgatgagaacatttagatattacacataaaacatatactatcaaaagcattaaggcagatataatgcaacatgctcttaacagtagctaaaacagtcgaaaaaaatcatatagcaacatcaccgagcacttatattccaaaaatatatatctatatctaatgtgtccaaacaaaactgcagttccaaatccatagtaattttggtcaaatggagttattgagataaatcaaaatggaaagtaaacagataattacctccacataatagctaaatgcaaactttatcaaaagaagagcaatccaaaacatggtgtacctggaaaaattgagataagatccttttgttaacatgcaatgttgtatagttactccctccatcccaaaataagttcatttttcacccatcccacgcataccaatacaaaagcaaaagattaaaatacacctattttatctactcccaatgcaattattctccactttcacaaacttcgatgcaataattactcaaaaatgaacttattttgggacagatgaaaggagctaaaaatgaacttattatgggacggagagagtgctagttagtgtgtattcatggaatattcacatactcagttatcattgatacaatataatgaacagtaatgtcaagttcttacatgaaaagtgagaaggcactttcatgcattcccctaccaacaaatagacgaggctgcaccaatacacacaacataagttcacaatgttcaactagatcagaaaataactgcaaaacctatactgaaatttccagagaaaatcagtaagtggcaccaatatctaggactttgatacaagaaaggaattgtataaacaccaaacgagttgctaaatcaatgaaataataatttaatcaaaataatccaaaaaagttaaatagtagtgcgtccaagaatactaatagaatatttttaaaataaaaatgatattaaatgtaaaaacagaactgttagaaggttgtaatttcaaaaccactgtttcctcatattataattgtttacacacagtattatttctttatttctaaataaataatgtttttattttgttaaataagtttactaaataaataatatttcatcgagagttaattacttatatttttgacccaaaaatacattttgcttcgtcatatcaggtctccttctcaggtagtagctcacaactatattttccacattatcttggtcagtagttaactgtagtttacaaagaaaaatcgagaatatcaagttaattccctgcaaaagagattaacaaatttatgcctaaattttcttgatgggtaaaaatgatatgatttaatgagtttaaaatgcaatgttgataaaaaacgaagctatcatgcaattcactaaaatgtaattatgtaaatttacctgtgaccaccacatgacgaacctcacaaacttgtagtctgaactttcaagtatacgccgtagaaatgggagaagaaaaagaatagcagctagcaaactgggagacaaatatataactactgcaaggacaaagagtgatgggtggttttgaccatttccaaaccagcctttgatggccctgataattcctgttggattctcccaggtgtatgcatatgtaaccggcagtaatactacccacaaggctgctagtgtgaactttagaacatatctcagtttaactgcaaattccattgttctcctggccttccaattaaagattatatcaagtgtagctgtaaataccaataagaattattcaaataccaagaaattacataactatggaaatggttgtgctgtcttgtgctcactcaaagatcttatcactacacaaatataaattggaatgactaaatatctaaattttctttcacataaaatatacaggtgttatatttcttccatgctgcattcactgactaattcgcagaaaacatattagcttgttggcataattatttcatgtttttcagaccttgcccgagatttagaatagcagaagtaataaatatgctcagaatcttcttgaaaacaacaggatcaaaaatatttcccagcgagcctccattccaagccagaattaccataacctagtatagaaagatcagtaggtagatgagaataataaaaatggttttataggtatctattattctattgcaaaggtaaatatgattctgaaatctgcaagcactgcaaactactagtattctcagaagagaataacgtagaaatggaggttcatacctgaagagctagaataaagaaactccacattctatcgaaactcctgaatatgtgccaaaaggagcgtagctcaacaaagttgacctttcctttctgcttttcagttcttgtggtctgcaaaaaggcaattacactactattgtttcaaacacccgaaaaaagaagacatgatactgaagtaataactaaagtgggctcacttcatttctttgatcaggtgaatttaaatgttgacaaaagaaatcagcatccgcacgcataggccaacctaaccgaaagcactcagcagacctgcaatttaaagaatgtaaaatataggcaacaggggtacaaaggtgtaagataaactaataccagaaatattcatttagatcatcgtagtttctccactcagaatgatttcctttttctcttttgctcctttcagcttcctgaggaatgatagcaaaatactaattttagcaaagtagtgtaaaacatatattgaataatggaatgatagctgagaacaagatatacctttgcaatggtgaggtaaattggagtaacaactttcttcagaaaggcttctttctcacccccataggctggcttcacatattcacccgtcaaggcactcacatttccaactagcataccatacatttcaaatgccatctatagagttgtaagtgctagagttgtcagcacctcaataagctatcaaagtccaacacaaacattgttgtgggcacagtagaagaaaaattctgagctaaaacattcttcgaaggaaaaaaaaacttatactaacacaataaatgaactccacgaatattggttgatatggttgcaaaattagactctccataggatcaactatagtatcttgatagaacaggtcgtagagttgaactgtagattagtataaattttgctcaatatgaatgattgcatcctcatttacataaaggaatttacttaaactgatgttgctcaggcatacaattagcaattttagctactgtccttaacaccttgtgaagattgatcattcatgaaacaacaattacagaaaaatacttcctctatccacaaatataagcattccaaacgtttgaaatttgtccacaaatataaggattctagagtactacttgtcccatcaatcgcctctcgttcaaaattattcccatattacccctaacgacccttccattcccatccatccctcatttagtgaggggcaccaaagtcttttctcctcaactttaacctctgctagacaacctagaaatgtttatatttgtgggcggagagagtaactgtaaattatgagttgtgtgatctcttagactgaaacaacataaatttttaattcgattttagcaaaatgagatgtcacaacagctgagttgaaaggagtgaatcatatagaagataaacatcataattgagttatcttatgatacagggtttgtgtaactgcagtgttcataattgttaccgtacatcaacatgtagccacttccacattctttctagatgttcatatgatcaatggtatcaataaaatgtgaaacagggtaggcaataagaagatggtcaacatcttttttactagagtttacccggaaaacattttacaattgaaacataaatcacacattaatacctgatgactattaatctaataaccccatgtataataaattttacagcataatgtattgcttaaattattgttagtgttattccaaaaaaacattggttggctaattgcaaatgaagaaactatactccgaactgcttacctacatgtttgttcatgcaccaacccagaactttgtttacaggtcaagtggatgcaaaaacgttgacccacgcacggttaagacaacacaacactaatgctttgagtgt

SEQ ID NO: 44705 - DNA, 3140 bp, Oryza sativa
  unsure (1)..(3140): unsure at all n locations
atgacttggctcactatgagtaacttttccagttgatggtggcagattgtaacatggaccgttcaatttaatgagagcccttagatttccatacacctattgcttttggagttttagtttgcactagatatgtccctcaacacatgttataatagttaaaactcctggtaccctaaaactaaggagaggatgtccaaaccagccatactcaaggtcattctaaaaccttgaaccacaatggaaggccttcggcaacatatagcaatccttgtcttcttttttttaacactaatgcattaggtgcctgcttctttccatctaaaagtttgcccactaccacccttctgggtctgtttataggttacaaattatgagaactacaaccctacaaagttcaaaccatgctgattgtataaatactatggtatcatggccataaattcttctgtttattccatctaaggctcaccttactctgtgtgtttaatgtaaacatgggtgcagacttacgacaccagcaagggacgcgaaggaaaggagaagatgagagatattgccttcaattggtagggtgacaacatatgctttgaactaataggctcacagaccaggaattacatatataaccggtgtcggatgttatggagtactgattgcactaccccttttaaattatatttacaaatttccaccttcacctttaatatctttcaaattgttttaccttttgcaactgcagagcacagagatttgtgtgggctttctacattattttggttgcttcttatgaacattcagtccatcaagcagaggtaaggtaatgaaacacaaagcactaactccaaagtccaaacagatatttttcaaaagcaataagaagaaagaaccaagtacaaaagaacagtaagataacaatgaagagattctgaggtagtcaccaaaggctactcttgcgatcaaggtatttgcaccactttttgtagttcttaaacaactttttcatcacttcattcagcgcgttatcatccaactgcaacgaaaattgctgataactcaggcttcagagaaaataaaagggaatatcaaaagggataaaaaatgtttatgtaaacatatgaaggaaagaaagtaagatttttaatctgttcaggctcagggtttgaatattttcagggaagaacagaacctttgattgtggatcagtctttggatttcgtcgtatgtgtacgttagcaagaagtaaaatcagatgctcacgctgattggaaacattgtctgtctgtatgtcaagaagtcgatgagacatcaaaaccccagataatgggtaggttaagagtcagaatcatagttatgaagaacaaataagcaacgaaaaatattcaaacaaagtgtggattgcctttcctgaaaaccaaacatagattgtagccagtccaagaggtcttcgttaaccttgtgttcataagttttgggccatggaagacctctagtattgcgaagagcaacagcggcagcttggatcttgaaagtgagaaagtatcagaaagtccttcactttgatagcattaagtcaactcaatagaatcgtaatataaaagaaacctcaggaaatttcatgactgcttgattgccactgtctggatcaagagggagtatattgaaagggagatatatctttgtcttctctttaactttatcagcggcttccaagatctaaagatagtaaaacagatgatctgattggtaaatactactacttggtagataagtaatatccatatgaacatgaatgatgattaaagttcagcaacagccacgggaaaaaaacaacttggtaggctatacctcatggtcaacttcaacagaatgctgttgagtgactgcctttaaaacctcaaatagaacattagcagtctggtatgccttggtaagttgagcactgcatgaataaagaaaaattggcaacaatgttgataagaagaagattatgaaatggcaatataacgcaccgatccacttggtcggagacattttgaagtgcttgaatatatttcttataatagtgttgatagaaggcctgtatttcccgtgcatcactcttgcgggcccttcctctcaaggtgggttcattctcctaatagaaaaaaaaacaacaggctattgagaatttgagatatatatccctgtgacatggttgggtttttaattcatacgaggcattggtgtggtcacctaaaatctttcaacattttctggacaaaattaactacatatttttttagaagctaagactaacctcctatgatgatataagatataactcttaatgagcacaatgaaagattcatttacacgatcatgtaaatgttgcaattattagcatgcataaaaatgttgaaacatagcactggctaaggggctatgtgtaaaggaaaaaggtagaggaaaggatataagcagaggcaagcagtcaatggcgccatcacaggacagttgtaggataaaacaaaaatggatgcaaacaactgactagagctagaagtacttgaaatgcataccctttcaagccgttgcaaaagagccgtcttgaattgccggacaccccggccacttgaagttggatctaacctgtgagccttttcaaatgcatagaatcgacctatccattattacagacatacaaattaatgtgatcaaacacattgtgaagcagaataagattagtattctttttttatggtaataagcaatgagtgaacaatgtttgtaagtggatcaccaagacgccagtgtttttctgtagctaacttctttgtacgtattgtggaagtgtcgagataggggtccccccaaaattcttatccaagaaagaagtctaagataatgatagcataaagcatttccatcaccaaggcgcaattaggcaagagagatgttcgtttgtgcattcaaatttttaaaacaaaacattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 44706 - DNA, 848 bp, Oryza sativa
tgttcacctcagtaatctgtaagcatgatttgttattttccaggttattgttggctatctactggccggttctctcgttggacctggaggcttgaactttatcagcgaaatggttcaggtaacatgactagttgacaactgtagcttacaggccacacttctatcttcttcgtagcctattttctccatcttctgatcttatttcactttcttcatgtagttctgttaaaggcaatatcttttgtaaaacgtctcgaccaaaaaaaaaagttaacaggcacatttgaaacaccatattttgtgcatacaaggaccgtattttgttagcctaaatgaaacacattccatacctattcctgtgtttattttacaatacatgacagtattgctaaatatagcatagtccataatggtaatgaactaatgacaacacaagagtaatgccatgtcaaccctaagctgtgctacttgatagaagctctacatttatcatgaatttgaactattatgttcaactgcaggtggagacttttgcgcaattcggtgtggtgtttcttctattcgctcttggccttgagttttcactgacaaaggtaatcgtgaattcattgccattatcttttatctaatgttttctcttttctcaaatatgattatgaaactatataatgtgtcaaaggtttactgacttgtctttcattcatcagttgaaagcggttggacctgtcgctgtaattggtggtctactgcagattgttctgttcatgttcttgtgtggcctaactgctgcggtattaatatttatttattgtccgttgatttttttcgttgtgtttgcttcatcatat

SEQ ID NO: 44707 - DNA, 2036 bp, Oryza sativa
aacaccaaccggtactaaagattggaaactaccccctagagctttaaaaccgggactaaagatatttttagtcctggtttttaatataaccgggactattgtgaaatctggtcgaccgaccaaagatggtttctccaccagtggatgtgccctggaaacgaattcgcgaggactgaaacattggtagcttgcgttacctagtgaggcaattccggtggaaattgtgctgcaaggaagaaggttacaggaatgctactccgatgcctgttcttggactcccaattgaacttgagaccagaagtccccctgattatgctcatgcttaaaatgatccatatgtttctttatattatcatgtatttcactttctcagtttatgctttctacagatggttgaagagttggagtgttgtaggtgtaatggtattcagaaatgctgtgagttgtgatcattgtgtaaaaaaatgtggaatggcgcataatattataatgcgattataaaaatagatgcctaagaggttccttttcttttctttttactaaaagaggatctacggtatgccactaggtaaactagatgaaacctgacgcgttgttgcgtgagttttataggataatagtacaaataacatgcagatagctacacggtataactttatatgtttttcatctgtgatcaaccatgggaaaaaatataaacaattaaaataatatggtttctaacaatttaaattatatataaatatattattcgaaagcaaaactaaggtgatatgcctcaatgacagaaggaaaataaaacgaaaaaaaagacgatatagattaatcattcaaagagaaaacaaatatgatgtgacttcgtaggagaaagaaaggagggacataatttcgaccataaatcaatcgttcaagggctagaaacaattaaggtgatgtggctcaaacagataatagagaaatagcattcactacacgtagtggggatgactttatagatttataggatgagccagctggttactttatctggtatgcatagaagaaaaacgataatgcaaaattacccataagaaaaggtaatactctataatcagtaatcacaacaaatcagcggtaggcaggtgatttccgccagtttgggcccaaactggccttgggctggtctgaagctggctacccccatcatgggcctaggctttttttcggttttagattttttttttaatatttacagaaataatctatcgaccaaaaaaattgcagaaatagcccctgccgcccacctctgaggcggcaagctgacgtggcaaacgggggaggaacgggcggtgacggagggagggttttttgcaggaaaacccttgccgccctctggtggggcggcaaggggcccgaatgcaaaaaagccagtcggggccggttattttgcaggcggccccttgccgccctctggccgggcggcaggcctcgctgcctataaaaggcctgctgcccagcccccagccctcattcttctctcctcaattccagtgaaaaaaaaagaagagaggggaggagaagagaagaaggggcgaagccctgccggattcagacgctgatttcaggtaatattcatagatcctatatgtgactattgagttaaatagtgtgtattctttaaaaatttgtttgaataaatgcattatatttttagggttttagttgtactaacctagaagtgcgtattgtagatattggtaactacgtagatctgctagttcggaattaatacattaccgttgcatttggcttacacaagaagatattacgttgtagatgtttattgcatgaaagagtaatatgatctagttatttcgttgacagatatgtcgaacaaacaaatattccaagtttaccatggaccaggaaacgtccgttacgggccaactggggtagatctgtcagattttattgtatcagaaaggggaattgatagaccggctgagaggagtgtaccttatataaaaggatggttaatgaggggcttgagagttggg

SEQ ID NO: 44708 - DNA, 1968 bp, Oryza sativa
gttaactcaaaattaaactaatcaacacctaatatttcggaaaaggagatagcaaattaattgttagtgggcaaggggtatacaactatacatacaacacttacactaccataacatcgcgcattagcaggacaaagctgtatcgcatccatatatatgatccaaataaagcagggaaatccaaccgagccgtgctcgaagttaattaaaccgtcgcatcgagcaggtgatggaccgccgcggcagaggccgggacggggcccgggcacgtatactacatgggtacgtataggccattatcgtcccaaccaccgctacagggcaagcagagaccgacgcacgcatcatgcgtcgtcctacttactctacgtacttcctatagtaaagaaagtcatttagcacagcgatacggtctctaaaatacaattttgactttttgtttctataaaaatatttattgaaaagtgatatatgtatatctttatgaaattatttttcaagacaaatctattgacataagttttacatttttcaaattcaacaacttgagagttatttatgatttatattcttaaggtttgacttaaacattgtcctaaacgacttcttttacgagtacgaagatagtacacccttcctttaaatactttgtcctacttactctctaataattattttcacctattttttaatatcaatatttctttatatcaaaatataaatcacaaccattttttcaatatttaatacaagatactcatgcatgactgcaaataaatagcaccttcgtcttctccttagcttaccttttaaatacttccaccctcgaagtctcccgtcgtactgggtgcatacatatgaatacctagtcacgatttggaatttcgagcctaaaaataattgagattgagggagtgtttgattgggactaaaattttttagtctctgtcccatcggatgtttgacactaattagaagtattaaacgtaaactaatgataaaacccattccataaccctggattaattcgtgagacgagtctatttagcctagttaatccataattagcctatgtgatgctacagtaaacatgtgctaattatggactaattaggcttaaaaaattgtctcgtgaattagctcttatttatgtaattagttttgtaagtagtctatgtttaatactccaaattagtgttcaaacatccgatgtgatagggactaaagtttagtccctggatccaaacacaccttgagggcccctttgatttaaaggaaaaatataggaattttagaggatttcaatcctataggaaaatttcctatgaagccctttgaaacaaaggagtgaatcatatccaatcctttgaaattcctatggaatggacaatcctatagagattttggaggaaatttagcaagagcttcaacctcttgctaactttcctttgagtctatctctctcatctaattcctgtttttttttctgtggttcaatcaaacggtcattcctatgtttttcctgcgttttgcaatcctctgttttatacttacattcctatcaaaatcctacgttttttctattcctacgttttctcaatcttgcgattcaaaggggccctgaatggttttacgagagaagagataagagataatttgatccatatgtgtatcattcaaaggctagaaataattagggtgatgtggctcaatgagagaagagataaataacattaactacacttagtactaatgaactatataagtatataggattggattggtccaaacgagaagatgataataattctttattgatacctgtgttagtaatagttatggcttgtatattgggatggagagagtacctctttccatatgaaaggggtaaaaatttgtatttggatatgctacatgacactttcattattgaacatcggatggattgatttattgtatccaatgcaa

SEQ ID NO: 44709 - DNA, 18115 bp, Oryza sativa
taacttgatcaggtctagttccaactagatttagaccaggggagtaagaatggttcaaatcagacctaatctccttacaagccgatggagcacacaagcaaaatggtactttccacgttatttctctcttcgtttataccaaatatcataagataacgtgtaaagtgtccagcagctaattacaatattttctgtatcattcatcgaatacgcgtttttaaatatcatgtagtaaatatcataaactttgagtatcttatagtaaattttgtaaaaaaaaaaacttatatagttgttggctagcggttgctcgtgtcgtctccttcctatcgtcgttgatgatgggctttgggcgccgcgttcctttcgcccgcccgtcgtccggccggtgcggtccggtccccgcgcgtggcgtcgtcgcgcgcgtaaatgctcgcagctcgcaagagctaaggcgaacacgcgtgctttgctcgagctcgtcgatactcgataggcgaggcgaccactgtgcgtgtgcgtgcccacctgcgttgcgccatagtacttgtattttccgcatgcgtccgtccacggtccatccacgtatggcctggccggcgcggctagctaccagctgcagctctcatgctcacacacgcatttccgattgggcctagcctctccattcatcaggtcaggatatgagcatttaagcacagctgttctaattagcctacggtcattgtaaatcatcttattatgtagtcccctatttcacaatgtaagtcattctagcattttccacatttatattaatgttaatgaatctaaacatatatatctatctagattcaataacatcaatatgtatgtgagaaatattagaatgacattctgaaacagaagaagtaacacgatggtaaaagtacgagacaaagggatatggtctatacatcaacaagccgatcgcctggtttctttcagtctacctacacctcaatctacatttttacggctaagattattttgagattcgtccaacaatcgtgtcctgataccctcttctctcttcccccgatctccaatcacactatcgccactcgcccatgagtcggcaacgcacggatgcgatttgtctatcctcctcaccaccttctacacgctagtgccatcaccacgagccccatcaactgttacctccctactcctctccatgcctccatagtcacatatcttcatcaactccaacgactttctcccaccctggttctcatctcttgtgtctgacggctcgcgtcactaaatccattggcatccctttcccttgccaccaacccctttatcttgtactccctccgtttcacaacgtaaattatttaagcatttcccacattcgtattgatgttaatgaatctagacatatatatctatctagatttattaacaacaatatgaatatagaaaatgttagaatgacttacattgtgtaacagaggaagtaactccgatggtgccatcacgttgcctcattgcccgccctgcatcttcatgtccactatccgccgccgtgctctagttctttgccacccaaaccattaccctaaagcggccattgttgcccccttgctcactcccatcaccaccaaccctaacaccaagatttcgcaagctagagtttagaaatcattgatattgagggcttgccaagaagaaagttagcgtgcaattaattgctaagccctcaccatcctcctccctctctcacgtctagctagaggctaaagacgttgcccaataataaaatctcagtcgactgatagtaaagacggtactacaagtaattaatgattggtcttaaatacctacggactatattattcattgtacctccttctttgcctctaagggtgtgtttagttcacgctaaaattggaagtttaattgaaattggaatgatgtgacggaaaagttggaaatttatgtgtgtagaaaagttttgatgtgatggaaaagttgaaagtttgaagaaaaaatttagaactaaactcggcctaaatcttgtgaattatatctattcagctagggcggagacatgggtaggacaactaggggcacataaccgtactccaaagtctggatgaccatgtcaatacattttaaaaatattacactactggaaaaaaaaacatttttactggaggccaaaacatatttttcaagcgtccataaccttcgcctgcaaccaaacacctgcaaaaattgattttcgcaggtggccaaatccaccctcatgcaaaaatatttttaacgtaaaaaaaaaaattggctgccatccagccctacccgccgccgcctcccctccggcgaccgccaccacgagctgtgccaccacaagggttttgggagagagggaggggaggggagctgcgccgccacgagctcaccgcgccagcccgccgccaccgccgaggggatgagaggggaggggaggaaaggggagggaagtcaccgtccggatctgggagtgggagcgctgccgccgaccttcggcctccgcctcctcgccgcctcagccaccgccctccccatgatgccgccagatccgcgaggggaggggagcgccgccgacgaccgccggcctccgctgctgcatgcagccgccgtcgccgtcctcccccacgatgcttctggatccgggatgggagggccgccagccggatctggaaggtgggagcgccgccgctgacctccgtcctcctccgccaccgacctccctcctccgtcgtccgccccgcgccgccggccaccaccggcctcccccctcccccctttggcaggatctgggagggaggggaggcgagccacaccgggggtgcaccgtccccgcctcgccatcgcggatcccaccgcccacatgcgttgccgtcgccggttcccgccgcccccgccgctaaacgcccgtgaggagaggagaggaaaggaggagaggtgaggccggctaagggagaggagagtgaggacttagaaaaaatctaagtgatgagtggtccatttatactccacacctattttcgcaggcagaccacataagaggtccgcctgcaaaaataaatggtatttttgcaggcggaccgcttaagggtccgcttgcaaaaatagattttcgtaggcagacaacgagcttcaccccagtttatatttttgaggcggtcattttactccgagggtcatgttcgcctgtgaaaataaaaccctcacgtctgtgaaaatgctttttctagttgtgttaaaaagaagagcacagcacgaaaatatgtaaaccacactaaactcatccctaggctcgaaaataaaatcggttgtgcccctgcgtcggagaggttcgtttggtcccaaatcaagtggccatggacagacgaccaattgttacttaactcgctagctactagtccgtcaatgggtctcgtgatgatgattgaccatagatgcacatccatgtagccatgtgtgacattctggttcaattagcatatgacatttgttgcttatagatgttatgtgtgtatgtttaataacacaatgctaattcagtaaggatggaatcaacttatataagtggttgtctctctagcactatatctctggggttaaccctttaatctaaagtgaaaatataagtgtaaatggggtattatatgtgtaagtgggggtgcctgtcaaatagagtggagtgcgcaattttggaggcttgggtgttacaccacgcgagtgacttaatttcgctcgcctttgctcttgtttctgtatgcacatttggaccggaatcgccggatgcatacttgcaatgcacacacggacacacctacgcgtacagacacaacaaactctcgcacatcatgtatatacgcgttctcgattatctgtttcttatacactgtagagcaaacaaacttcccccaagctgtatatgggacaattcatgcgaaactagtgtatatagacgcgcattcgcgcaacattaaccccctctatattgagctcctttacatgtttttaggattcatttgttctttttcttcaaataatcaaattgtaattaaatcattagagtatatttataaattaaatagtttttattaaatgacttgagtgttcatttacaatattacttattgttcgtgaagtgagcatagcttaatcgttaggttctagaacctacactcatattcaagttctagtactaagatttagtactgatactcgtatttatggccaattattctttcagcgatagtggatgtacccatttgcattgtgtttcttaaataaaatcttatttattgattaatactattattaataaatacatggactccaacataacatgtgcagtggctaataaattgtacataattaaaaaaatattgggaacatattgaatttatcatcttatatataatttttttgaatgttttagagaataaaatcattaggaggtctacttagaatgtaaaaatatttattttattctgatatgtaatgaatgaactatattagcacgacaacaaacttttattgcaattttatccaaaccttatattaatatgtaaaacgaagtttacataattttattaatatttgttatcatctttgtcgtagcataagtcgttgccttctcgccatctatgctacagcattacccttatccttcacttatttttcattagtgcacaagtattatagcatgtatacatttattttttgcgggtttattatgtatatttatatttgaatcgtacaaacctaatgattcattatgaacgatctggcatttagctgcctgtttgtaatagtaataattttttcgttgatataaccaagtctctgccgtgtatttttccctccttttatttgctctttattatgtcccatgtgtgaggaagccagggaggttctggtgttgtattggtatgctggaaagctcgagagaacgccctatcactatcaggttcctttactgatatgatcctacggctctctttaattttttcatcatcggatggcctgggatttttggcttacgtggacgtatcaggtgatccttttggatttagtaacattttaaccttcacttatagagatttccaccttagatctaactactttctacattcggttttctttttaactctttttttaggtggacaaccatagccaacagctatcttgtcaagcagccattaatcctctcctacttgtgcagttgtgcgtgctgtgcctgcctgaaacatgtcgattacggcccaattaagatattgttagctatctgggctttcgagctggaataacgaactacgtgggcttcagtttgccctcttgctcgacagcacgtataaagcccaaattaaaaaaaaaaagagagtacctatacatctttcgaaagatttttatgatcgtatcacacagatttttaatctttggattaaaatctgatagatataataaaaagcaaaaagcaattaagaaacatcataatggacactaaattaccatatcctcaagaaaaagaccaaatccaatacaaaatttaaaatttacatgcgaagattcaaaaattacagtgtaacttacaaaagttacagtgtaagtttcataaattacactgtaacttacaagaaaatgcactgtaaatttgagtgagaaaatcgagtgagagataaaaaaaatctttcgattgagatatagcaaaatcgaaaaaaaaatactacggcccataatgtgtcgtttgatattcttgattaaatctactcttttgatatgctcaattagtactactacagtattactataaaacctgcatgctaataactttctagcatccctgcaaaatattaattctagcagacaacactcaatgcatgtctgacagtgtagcacgcagggagattacaagattagtccctgcatgatgccaaaggtgatcatcatacgtcttcattggcaacaacaaatagggacgtgctaaccacctatttctatggcgtttctttgtttttttgtttcagttgcagcgcaagctgtttttgatgtgtcctctgaacctacctcaccaaccatggtgatcatcttctccaaagctgcagcagcagagcagagaacattcatgccatgttgaactgtaaatttactcttgggaattagttgcagactgcaaacaaatttgcatcacaaaagagtcgggtcgggtgttgattcgccattgctattagtcattctactcgtgcctactgcttactttctcgatcgatggaatcggtgattcatttggttgggcgttgttagtacaaaattgaattaacgaatatcaaatcaaataatgaaaatggagggagtaactagtggtagtaatttattcgaatgtatggaagatgcacacataattgcgagtggcccttttactcgtatcttagtgggttaattactcacaaaacaacaagtctattacattatccatccctgatttcttcgtaaaaatagaaaaaaaaatctgtccttggttggattgttgctgctacatgcatgcatggtcctttgacaacttgtcatatgacagatgcagagtcttactccaagcagatgaaaatggaatgaactcctcaacataaaattgacaactttcaaatcagcccagagagatcagatatcgtcaaacggatagaatcatagaagtgcattttacctaaaaaagttgatgttttccacctttttttcttttcaatattagtatgattgtactggtactggctgtttgcttggagtttggacttgcatttgtacaattaaattccaccggcaacttacaaaggacagaagaaacctcgaccgacacccagagaaatgaacaaattcatgggcccaacataattattctaaagttcgtggatacttagcttctcatcgtctgattattaatttatcagtatcaaccaaaaaaaataaatttagaggttattttgaggtttcatcgtaatttatttttcagcactataacttttaaaacactaagctttgttataaattattttttattttgcttcgctcctagagcaaccagcttattggcagataagtcacgaatttggaaattattcaaaaattttagacgataaaaaaccgcaaacatggtgtttctgggagtaaacagcatggtgttttgctccgtacttctccacttgtcagtgagtacttccttcagttccaaattcttgatgtcttgaaaaaaaaatcaacaagtacactacactgtctcactgacaggtgtgcccaggaggacactctaattaaacagcaccaaatcatttgaacggccatttatttttccagctcgctatagtacactcctataaacccaggtaacccagctactaatccctgacaaggtggccccactctctaccacctcagtgggccctcactcctctaccctcctcctcatcgtctcgactccaacgaatcttgagccctttcgccctctctctctctctcgcctccgccctcctcgcctttctcccccacctccacctcctccgctcccgaggcgagatctcgccgccgccgccattccccaatccgccccaaaacccccaccccccaaaccctccgatcgatccgagggaggagccaatcccgcgctcgaattcgttcgccccgaatcagccgctggatgcgtcgagctcgaggcggcggaattcaaatctgagctcgccgttggcgcggatccgacggggatggcgacggcggtgtcgaagtcggcggctaagccgcaccccaggtcgcccaccaccgcgcagccgccgaacaacggctccgcggcgggggcggcggcggggggcgggggcggtggagtgggtatggggcccgcgggggcgacgccgtcgaagaacgcggcgatggcggagctcaagtcgagggtgctcggggcgctcgcgaagctctccgacagggacacgcaccacatcgccgtcgaggacctcgaccgcatcatccgctcgctgccgtcgcccgacgccgtgcccatgctggtgcacgcgctggcgtcggactcgccgggcctcgcgtcccccgcgcggcgggagtcgctgcgcctcctcgccacgctctgcgcggcgcaccccgacgccgccgcgccctacctgcagaaggtgatggcgcacctcgcgcggaggctcaaggacaccaactcggactcctccgtgcgcgacgcgtgccgcgatgccgccggccagctctcggaggtgtacctccgacccctggcggcctcggctgccgctgaagcgggcaatgcgactgtcacactgttcgtgaagccactgtttgaggcgatgggggagcagagcaaggcagtgcagggtggggcggcggcctgcctggcaaagacggtggagggcgcggggcctggacctggcgtggtagggatgtttgggaagattggtccgagggtttgcaaattgcttggtggacagggagtacaggctaaaggggcacttctcaccatcatcgggagcttgtctcaggttgggattgcgcgatatttttctttatgcatgcaatatgttcgatgaattgacttgacagatgccaggtggtagaaatttgtggtagacattactaaattgattatttttcatggacatttagttttctgtctgaatatgggaaatgttatcataaattgtggccaaggggtaggaattgtttttgtgataagtgatgtttggtgctgccgctgcggtcgaatgtagttcatcatgtaatcagttttggatgttgcctatatgtcttgctgacaactatatggttggaaattgttcgtgttgtgaagaatggtgagttatcattgagacaagggtttgatattttcaatcattattacaatgtgccattttgttttgcacctctgaatttatggatggttaggacttaggagtttagtatttgatatcctaccattgggtacataagactgttgttacttttgtgtggtgtttggccccatgaacaatggatagtaccacagcattgtgatttaatgtttagataagcgaataattaaccttttgctttgcctctggtagccttttattctttttagtacttcagttgaaacattgaactgaaacatacattgatgctctaagcgaatgtgtctcctaacacatgctttgaatggtactattgggaatactgtgccaagcattactgtgcgatacatatcttataaatctctgcaatgacataacatcagattcactagctctccttgtttgaataattgttgatatatttcttgtcaggttggagcaatcagtcctcagaatatgcctcaaacattgcaaagcattcgtgactgtctcgagaacagtgattgggctactagaaaagctgcagctgatacattgtgtgtcctggccacatattcaggccgattgataggtgatggaacagctccaacaatagctgctcttgaagcttgtcgcttcgataaggtaactaaaactttaactcactcaacccaaactgaaggatctgttgctcttccatggatccttttcagatgatgacaagtcattgttacatgcattatgttgcattaagttgttcttgtcaatccttttcaggtaaaacctgtcagagatagcatggctgatgcagtgcagctatggaaaaaaatggcaggagatgattcgaacggtatcaatttgttttttagtttaaaagtgcatgatgttatttaggattttattactctatgcttattgcaacataatttcattcaacagatggtaaaaataaggaatcagctgataatgaagggaaaatggattcacctaataacaatgacaaagtgaagggcagtagcatggctgaaaaagcagcagttctcttaaagaaaagacctacattaaccgatagggaattgaaccctgaattttttcaaaagctcgagacaagaatcacagatgaattagctgttgaggtggttgtaccccgcaaaactttacaatctcatttacaaagtgaagaggaaccagaagatgcagatggcgatcctgttggtccagctaacagcaatggatcagcagatgatgaagcaaatttgactcaactgcgttctagctctaattttcaaaatattcgagatagatgggctggccagagaggaagtagaaacaaagatgcaaaggttagggcatctgatgttgaagataggaatgaatctagtgcaaaagattctgcttcagcagcaatgaatgttcctggagaagggccttccttaaataataaaacaaactggttggcgatacagaggcagttgtcccacttggatagacagcagactagtctaatgaacatgctgcaggttagtgccatgtttatttattcccgtgaagaaattgttggaatttcttttttttgtttttctgttaagaaataattcttgaggagaaatgtccaggatatcacactttttttatgtcctaattggtaacatcagttttttttcttcttctgaatatgtaactatctgctaatgagatttgtcactgcttgctatgctttctgagattatattgtcatgtgttatgtttgtcttagtgatgtgctgctaggcatcttttggtgtcagcaatttcatgttgtcttctaaaagaaagtagtgctacgatattacacagtagcccaaataaagtgagcttacattatttagaacaaaacattatgttggctttagaagggatgttagtaggtagtagctttgatgtctatgtaatgttgtacattgctaaagtctacaaaaaagtactttattgatggtttatcaccgtttcttagtttgggtttgaaacagaaaatttcctgctttgttttgttgtacatgaaccttttttccagtaattcacaaatgtgatccgttgtgatgtactgatgtatgccatctctgaggacatggtttttagttaattgggtgtctgtgggctaactacctaatatcacttctttttttaatacaattttcaggatttcatgggaggatctcatgacagtatggttactttagagaaccgagtgcgtggtcttgagagagttgttgaggaaatggccagggatatatcactatcatcaggcaggagaggtggtggccccatgctgggctttgattcatctcctggtagatcatctatgaaatacaatggttttcatgaatattctaattcaaaatttgggagggatcgtgatggacgggtgggatttgcagaaaggtacttttctggagatggtatgtcttctggtgtaagaagctctgaaccatgggactcgtatgcttattctggatcaagaagtggtatgaatgccaggagagggttggactctgtttcatctgataacagggtgcctagaaatgaacgaagcaatgatcaagcaggacctaggcgaggatgggacaaaggacagggtccatttaggtttggggagggtccttctgctcgaagtgcatggcgagcctccaaagatgaagcgacactggaagctattagggttgctggtgaagataatggaacttctagggcagctgcgagagttgctatccgtgaattggatggggaaactttgaatgatgataatcaaggggatgaaagaggaccaatttgggagtcttggactcgtgcaatggatgcgatacatgttggtgatatggattcggcttatgctgaggttctttcaactggggatgctgaattacttgtaaaattaatggagcaaactggaccagtagttgatcaaactttaaaaggaagtgcaaaccgaagtcctacatgctgttggacaatttcttgtggaagaaagcttctatgatatagctttgagctggcttcagcaggtaaagtagtatgttccattgtaggaatataaaagttctgaagagacaggtgtttactctgacaacaatatcatggaaaatgttaacctgtgttcagactaaaactggtgttgatataataaaaatgacattctgtgttaaaagagtagaatgctctaaattgcttaggaatggatttaaacatattttgacagttgcatgctattttagcactactgctctggttccccttcctggttcaaagccagccattcatgatacatatgattagcattgcatttgcaaataggattatctgtagcatgtgatggtgatcggaagttttgtaaggctgaaaacatctgatactgataccgggtgtttcttcaatttccaatttctgcttagtatactcgccagttttcagacagtgtttgtgtctatagttttacacattccttgcattatcatttggctccactcttgatttgtgagttcaatttggtttcgtcccttataattcagcaaacaaaaaagagctttgaaaggttttgagttattaaagaatgctattttctttagtaacaagaatggagaaacaaggaatggcaaccacaataaattaatttttcattagctatatgcttatccaattgaagtaactgaagcactcttaagatgtcttggtaaaaaagtccatttggatggagactagaattttgactgatttacgcttggtcctttgccctctcaaacagaatcctggcttttcatttggtctagaatgaaggcctctcacttttactggattgctacaaggttgaagaaaaaatgattgtgaagtatgtgaaggatatttgatgctatcttcaatgatcaaatggccttctgtttgttggatagttgtttatgttctttgtttgctcaacaataccaataataattaaggttctgtctggacagcaggtatgcactggcatgcttgtgaaactaaacagttgcttcaatattgaaaaccaatgcaatactgtcatggtgcaacttatgttatgtccagacatacagaataagttagtaagttgtcagatgatggttataaactatagacttttgaatataggagttatgttgctctaacaaaaagtttgaaagaacgcgtagctgtcttttttctttttttggaagttagaaagggaggtagacttcttttattgaacagaatatgatgtactctccgtgctccagttgtttgtatagagatgttaaaacctttgtttggtccatgcatttattgttttgtttttggggataggaaaggagtattactttgaagtacatacccaagtgctgaatatcttgattgttgttgcagttgactgatctggtaatggacaacggatccggttatcttggaatccccctagatgcgaagaacgacctcttactgggattacacgaagctactgccattgagttgcctgatgattgggagggggcgacgccggttcagataatgaagcagctagcttcatcatggcggattgatctgcagcagcttatcagttagggccatcggttgttgacatgagttaatttcatttgttcatttctgcctattttttctctatatatcttgctattagggctataagtattaggtttgacagaacctttgagtggaactgtgttgacatggattggtgttgtacggggaaatatgatgttgatattgtttacctcataacctgtgttggctttcctatttataatttggaggatctcaatttttacattttttactggctcaatttatagttttattatgcatcttgaactcttaagacaccggttgggctgataaacctaacgcacaatgaacagacaaaattgtaatttggacatgaatagattgtacattgcttttgttctttcacctaaaggacagaggctggcaggcagcaggagattaaagatatcctgtcgagcttaatgcaggccgacaataatttgttagggaagacaaaacttatcccagatgatggttgcagacagagatagccattgatcaatttgaagatggattgatatggaaatcttaaagcacgaggtattaatttcatgctacagtcaaaatattttccagggttaatttcctgctgcagttcaatctttttagtgttctcaaccctcaggtaatctactgctgcgcgtggtgaatctgcgctttgttatggctgattgtgatatcgactcgaaacgatgtggtcagcatggaagcgttttgctgaatctgaaaaactgatgtggatgatgttgaacagcgagcctcaagctaccgtggtccgtggttatcaaaattctcccttcttggaaattgttgatgaacagcaagtctaacaagatagagaattactactatatttatcattcaggagttgaactcgtcgcagcggagaggagcaatgtggtcgagctcgacggggagcccgttggccggcgacggcagcgggtccctgacgaaggtgttctcctcccccccgcagcagagcctccacctgaagtgcctcaccaggtagtgcatcgtcaccagcgtctccaccctcgcgagctccatcccggggcagatcctcggcccgccgccgaacgccacgaacgagtacggcggcggcgccgacgccgccgcctgggcgtcgaaccgcgacgggtcgaacttgtccgggtcgtggtagatggccgggtccatgtgcgtcacgcacggcgcccagaacacctgccaccctttcgggatgacgtagccgccgtcgagctcgacgtcctcgagggccctcctgaagctgccgaacaccgggggcaccatgcggagcgtctcctgcgcgacgcgccatgtcagcttcatcctcgccacgtcctcccatgtcagcgcctcgccgtctcgcttgctcctcgcgatctcctcgtgctctggccatggcgttgtcagagggattcgatcttggcaaatggaaatggtgatgtgatgtgtgagttacttgccttggaccatggcggcgaggatggcagggtcgtcggcgaggtggcggaccatgaaggtcaagaggatggcggaggtgtcgtggccggcggtgaggcagacgatggagttgtcgatgatctcctcctcggtgagcagcggccggccgccgccgccgtcgccgtctcggaggctgacgaggtagctgatgaggtcgtccgatggagacgactcgccctgctccaggttggccttcttctccctcaccgtcgccgcgagcagccggcgagccctcgcgctcgccctgaggctccggcggaacgcggtgaacggcaggtcgagcggcaccgcccacaggccctccagcatgtcggcgaacgcggcggcgagccgctcccggacggcgccgcgcgcgagcccgaacagcagggtggcgatgacgtcgagcgtcagcagcttcatcagcggcagcaccgcgacggtgcggcgcccggcccaccgcccggcgaggtggcgcctgacctcgccgtcgatcctgcccacgtaccgccgcagcatctccggcctcaggaactgcgccagcgcgccgcgcacgcggcggtggtcgtcgccgacgagctccagcatgttcctcctcccgatgatcgccgcgaggctccgcggctgcttgggcgccagcgcctcgctgaggaacaccgccttgttcgccgccgggccggcgaggagcaccgtcggcgcgccgaacagcgacagcttcgacacgggcccgtacctgtcgatcctgccctgcagccaccgctcggcggtgttgcgacgcatggcacgcagcagggacaggctctggccgaccagcggcaggccgagggatcccggcggcaggttgcgccgcggcggcggcttcgtcctcgtcgatcttccggccaggtagacggccagcggcgtgaggaaggcgacgaggagcgcgacgacgacgacggcgagtgccattgcagcgatggctaactgggacgatgagtgtgaaagggtttatgtgttgagacttgagagagaccgacagaatggcatccgcatacttctttcgtaacggggtgacaggaatctgatttaagccgctttcatatgtaattaacaactatgtcaaagtagaattgtttgcagtttttttatttgacattcatattttagcagctggacccaagctaataggaaccgtgttacgacgtcccattggcatggtgggagatgctagccaaaaaaaaaaaagatgcgcctaagaaatgcttgcgtaccttgatcctactggttatttgggagatctggaatggagagaacttcaaacaaaagaagacttcggcccctggccctaggttgttcaacaaaataatggaagaaacatgaacttggaccctagctggtgttaaaaagctagtgagtttcatctctgtacaactttacttttttctaaccctaggggttgtatttttctcccattttatttaatgatagcacagtctcgtgctgattccaatcaaattttaccttaaaaaagacaaaatttgctacaggacataaaaaaaatgtgtaattagctaagggacaccacaagatcgtgaaacgactgagaaacacttaaaaaaatgtgtaatttgttgttagacactttcatcattattttatcatttttgggctagatggaaagagaaacaattcaaaaggaccagattgctcttggggctagattatttgtagcgtcggtgtcgtcgtcatcgatgcgcgtcgctgcgtgtcgttgccaccacggttgatgcgcattgctgccgcagctaatgcacgccactctctgcgcgcccgatgcgtgtcgccaccgccaccaagacacgccatagcagatgtgcgccgcaggcccgcaaccataatcgatgtggtgagaggagaggagctgagaggagacgagtgtgaatgcgtgatgcggcgtaaatgttttgggatgcggcgtcgaagaggagaggaagtgggattagggtagattgcctattgggttgtgatgggctgggagacctgggctaggaaaagctatgtgtgaggctaggccacacgagtagggctgggccacgagtggttaggaaaatctaaaaaaattataagtactagtcaactaatttttttctcacgagtagggctcaggcccaagctgccctagacccagttccgccctaactccctcatcgtttcttttattaaaaatacatcatattattaaagcattttgcatcctaaatacaactatattacttagactaaccaaaacataaaagtttttattggtgaaagataaagttgtaggggtcaagtgtcaaattataagagtgcgtgcttggtctgtcacgttcacgtcacacgtgggtgtacaattcatctaatcacttctctactattataaaagatgtttttgccagtcctttggtacatcatctgtgtttgagtcagtttttaagtccattcgctttacatatccgtatttgattcggtttttttaagatcgttcgcttttagaaatacaaaaaaagttttataagaaatatctttaaacaaacttgcatgataatttgagacgatcagactcctaattgcagcttatgattttgtaaaaaaaatttctttcactcgttgcaacccacgaatatttttttttctagtaataaagattcggtcgtacgcagaaaacaagtttttaatagtgatgggttgggaagggagagccgcagatcgagtcctgtctctctcagccaacaccgatttctacttcacgtgggctgtgcccgagcttattgggagagtactttgtttaaagggacacgtttttcaaaccattaaaggatgtgtcctttaaaaaattgaaataaagtcatttctaaaattagaataactgatcatacgcaaatcaccaatctcttcctcgtttttgtctgtggtttacaaattccctctgtttcgactgaagcctaattcttgtttcatgctaaaaaaattaagagaaaattgagagaggtgaggatattgtttgtgaaaaaaaagtcaaattttgctataggacatgcaaaaaaaacgtgtaattggccataggacaccggttgtatttattatttatggatcaaaataggtgagatatttttctaaatacccggattgccccttatctttcc

SEQ ID NO: 44710 - DNA, 6143 bp, Oryza sativa
cctgtccattgccgcaccatctggctgttgtgccgtgccaccagcctggccgccccgcgctgcgccgcctggctgctgagccgtgccgccgcctggcctccctgtacggtgccgctacctggcaaccacctagccgctgtgccgcaccgtcgcctagacggcccgcactgtgcatcggcgcctccccgcctgcgcttggtacctctgcccggccgagctcctcctccgctcggcctcgccccgccgcaccagcattgccgctgtgccgttcccggcaaagtcaatggaaaggggaaaataaggaaagagaaggagaaaaagaaggaaagagaaggggcaatccgggtatttagaaaaatatctcacctatttggcctggaaataataaaataatacaacctatgtcctacggccaattatacgtttttttaagtgtccatcagccgtgtcacgtttttgcggtctcccagccaattacacttttttacgtgtcctatagcaaattttgccaaaaaaaagcatgcttgtctgttcaagaaagtggacaaaagaggaggaaaaaagaactgattgagcagctattgatggaaactgatagaaaggaaagtcagctgagaaggatgtatttgagcaagaatggaggaagagatataaattagaggataaaatggaggtctatgaacaagaggagagattttggtagagggatgtggagaacaatgtatcttgaagggcgattctaattctaataactcatttttcatggattggaaaataggggaaggaagagtcacattttctcactacaaaagggttataagctactaacagaatcccagagcatacaggacacctatgggtactatggccttatttggcaaattggcagggagaagagactgcaaatgcacttgaaagagggagtgtgggctaatggagggggtttgacagaggaggatgctaagtttactacaaacttgacaacagtagagctataagtgcagataaactaactagctaactgatttacctaatggcacacgtagacccttttttaataaaaccaaaagaaaaggaatgccttcagcatctgttcttatgatgacactataacattgtaggccattccacatttctctacacaatgatcataagtcactgcatttctgaataactttaccacaaccttcatacctgcaacactctgacacctcaattaaactggagaaaacataaactgaaacgcatggtaatatacagaaacatgtggatccttttaagcatgagcatattcaggggggcttctggtctcaagttcaattgggagtccaagaacaggtatcggaacaggatctttcctgtaaccttcttcttcgcagcacaatttccacctgaactgcctcactagttagtgcatggttaccaatatctcggtcctcgcaaactcgtttccagggcacattcttgggcctcccccaaatggcacgaagcaataaggtgggattgaagtgtggttgtcaaatctagtagggtcaaacttgaccgggtcattgaaaaaatttccatccaaatgtgtgatacgttgagcagtgaagacctagcatcgcaagatgtatgtgagagtaataaaaagaaatttaggagttgggtacattgttcagatcgaaacatcactgcgacactaacggcataattggaatggaaaagatatccaatcgaaaaataaattggttaatataaaaatacttacttgccagcctttcggaatgtgatagccatggtattcgatgtctttgacagctgttcggaagcttccaaatattgggggaacagtccgcagcgtctccaatgccaccttccatgtgtacttcatccttgagacatcatcccaggttaaaggttcattaggccctttcctcctagctatctcctcttgttctgtggttcatgataggtgcaaatgataccgtgctactcagaagattaaaacaccaaaatataggcacacgatacaatatagagtactaggtgctcaccctcggttatcttgccaaggatgtctggatcattagctaggtaccggagcaagaaggtgataagaacagccgaattcccataaccggcagtcaggagtacgattgcattgtccacaatgtcctccactgtgagcgagtgtgtgccttcagagcgcaaaacaagcatgtatgtgaagaaatcatcagctgaactggaatggccttgctgcaatgctgcttccctttcgcgagcaatttgcctgaggaccttcctgatcctccggctcgctctcaggcccttgatgaacttggtgaagggtatattcactggcagagatagcaaagcctgcacaagtgtctcaaagtcggtggcaagggcttctctgatgggacctatcccttgtccaaagacgactgagcagatgatgtcaaaggtgagcctcttcgccaagggtgcagcctataatcaccaaagtagctcacaaacatgtccatactacaaaaagttgtttttactatacataaaggtctaacaattcaaacaacagtaacacaatgttcataccttgacagttttatgaccaacccagttcaggtcaatgtgcctcctgacctcctcatccatcttacgcatatacttcgtcaccatctctagcctcagatagccctgtagagcactgcggactcgctttagctcctcacctgagagtgtcagaatggaccgcccaaggatggtgttgatcgcctttgtctgggtgaaaatgaggtcctggttgctgaatacaaagtgattggccgccgggccagccataagcactgttggtgagccaaaaagtgacatcttgaacacaggaccatacttcttgatcctgtcctggtaccactggtaatcagtattactgcggagggcacgaagaagggagatgctctggccaatcaatgggaagccaagagaacctggagggagattataggatgagtacttgcgcctgatgacaaagcggaggagggtgggtatgagcaaggcaagcagcagagcaaaaggcatggaggaatccattgatggagtatgttgttatgcactatgaaggttggctgatcagcttgtggatttgtctacatgtatgtatataggcaaaccagagttgttttctttctgcatgatagacaagggagtatgattgaacaaatttgatattttctttagaactcaataaatggcctagttggcaaagctgaatatatcactttctcaaaagtcatacaacaaacaagcaaagattacaaattgagataagggaacaacccctcattgtcaccagagtaatgagtctgattcatgataacttacaatattagtttataagtaaacaattctatcaccccacatgataggagcagcttagcacgacataggtgaattactggaaataaatggaagccagctcaaagaatcacatttatgctagccaatagaatttctggatttatgctagtcaaataattgcatttcctcctcaaatgaaagacacaaaaacgaattccctaaaaaaactaaaaagggaagtacatagacaagcaaataatgagaagaactgattcctttggatctaatattagctcgaggaaagatgctacatacaacagaattaaattttgcaaagcaagcaaagcaaaccattgaaaagatctggttacaacaatttggtcatccctaacgaaacgatccatgtcctatcctatgtaataagaaattttgaacaatattctagatttaattcttctgcataactgcaggactctcaatcgacaagtatagttttagccttggcacaggccatgtatgcaggaaacatcctttttttttggcatattattatgcagaatatctgccaagaaaaacaggtagacatttcaaaaattagaagcaaattacatacttagtggtcagaaaaggttaactccagttctatatatgtgcctgtgcacaaaatgacacatttactgtagccgcaattcttctgaaaatggcatggccctgcaatatagattacagaacagtacttaagaaataagcagatgattcctcccaaatatagcatggccgtttatttaataacgttggcaaaatcaatgcattatcaggatatacacgacaatgacctcgagggcaacttagatcctaaaaaactgggcaaaaagggaaaggaaaacgacaggtcggataacatattctgaaaatccactatggtcaacttccaagaacaaaaaaaatgtatacagacagatagacttcgaagggatagactctatccaatatagatttggagatcacatcacgaatgcagatttgatttaataatatagtttgtccaccgatcgaaatcggcaataatcaggccaggagatcattattctcctataccgactttaggcagtgatcattttacactaatccacaccaccagacctgactgaaacccacccaaattccatctgtgccatcacagattcacagctcgttcagccccccatcaacaaatcgaacaacatctcaccaatcaattgcaaagctagaaatcaagaatcccaggacacctaagagctagtgaccaaacctcttagcgcgctgcctgcttgttggggggcgtcttgcaagtaggatgcaggaggggaagcttgcccactggcgcaccgccaccggccgacggtgcgcgccgccgacggggagccccgcgcaaagctgcgcagctgacggctgccgaatgcggaagatcgagccggagaatgtgggagaccagcctaggcccatgcccggatgaccagccttccagcccaacctccttagagcaggaacaatagcaggctaatgctattagccaactataaatatattttaatgagacaatagcaggctattagctagctagaaatatattttaatgagataaaagatgtgagagaaaagcagtgagctacagatttacagatttatagctagctgtagcacggactccaatacacaatgtgtgtatgacaggtgggaccatatattaatagtatagtaagcaactattatatgagttgactattagattggttatagttgaattggagctagttgtgggctatactattaaacttgctcttagggcatccacattgtaagccacgggtaagagtggtctcatgtgggccatactacctaaggctacacataaagcaactctacccccaatggaagataatctcaaatggattcttaaaatctgagggtactgtgtaaagatactacaacccacaatgcatgccctaatccacaaatccacaggagttgttttcctcttctacccttttttatattttcttcggccacagcacagtgctactacttcctcctctttctcgtcaccactcaccccaccgacgccccctccgactccgtcccggtgtgccctcttgtacgtcgccgctggtggccgacggcgagcggagcgcggggtggccgacagcgagcgagctaccgccgctctctctccctctctctttcaatgtgcggggcaaccgacgatagcgcaagtgtcgaagggacgcggggcagccgacgacggcggcagtgtggaaggcgaggaccgcaaggagcacaagcaggaggaggacgcggcggagctcctcttcctcaagtcgtcgccgcctctctctctctccctccgcccgccgctgccggattcggtgggcagcgcgagttcctaccgcgccgccgccaccggatctggtgggaagcgcgagctcccacctcgtcgccgccaccggatctggtgggaagcgtgtcgccgtcccgccaccgccggctcctccacctctccaccgacggctggcgcctgtttcactcccttctttgtcccaggtcgtcgccgtcacgccatcgttggctcctccaccacctctccgcctccgaatcctttccaccgtcggccaagggtgaaaggggaacttttgttgcgggagccgtgtccacaagacacgacaccacccaacgcgaggcctagctcagtggctttggctgaggagcaggggggacacgtccctcggagaggagtcgtgcccctctgctgggagacggctttg

SEQ ID NO: 44711 - DNA, 12185 bp, Oryza sativa
ccaaaaaaaaacccacggtgggtgttttcctatactacccctctcttctccccccctctctctctcctcttttttctccacctcattcccctcctcttctttttttcttcgctctctccgccgggtttcactcctttcgctcggcggcgtcgctgtcctccccctccctctccctttctctcccacgagcgctggcgccaccttcctcctcgccctccccagctaccgccgccgccgctttctcctctctctttctctcgccgccgctacttgcctctctcttactgccgcgcggaggaggccaaggcagaggaggtcgcgacgacggcgaccaccaccacgacgtcgtcctcgtgctcctcggtggcgagcacgggcgcctcaagtggtggctacggcggcaccgccgcagatccgtcgtcaccgtcgcctctctcttctctctctctcgcctgcgcctctctctctctctcgccgccacctcgggttcctccccaccgccgtcggtcttttcctagcgacgaggtcgagggtagaaggggaattcacaggtgtggtagccgtatccacgagcgccccaagcccccaatgtgtcacctggcagcgactccccatgaaaagttggcgaggtgcggagagagctgcatcccctagcagagggacgcgttctatcgcgggggaacggcgcggacggaaaagcgaatggccatcgctaggggtacgacctggggataccgattgtagatggccttatggcatgtctatagttacgagacaaaacttttcacgttgtcacatcgaatgtttggcacatgcatgaaacattaaataaaaaaaactaattacacagttcaccatgaaattgcgagacgaatcttttaagtctaattgcgtcatgatttgataatgtggtgctacagtaaacatttgctaacgacagattaattaggcttaataaattcatctcacagtttcctgacggaatctgtaatttgttttgttattagaccacatttaatacttaaatgtgtatccgtatatctgatgtcatatgcagagtcaaattttttttccaactaaacatgcccttagaaggccggttttatgtccaaaactgatggaaattaactctcctcataaatatgctacagtatcaaactttttaactttgaccatggtttttaaagtaaattttataaaactccatctagtatagtctaggcacaaaaacacatgaattttggcacataacacatatcctcgcgtattatggtcataaagtttcacaaaatcacaccattaaccattttgacatattcctatatcaaaatttgactctctcaaatataacttcaatctaattcatatcctgaatcgctatgccagatatcttgatcctcaacaattaaggccagtgttatttgattccctcagcaattttggaggtttgtttacgttgacgtggcgctttacttggtctaacctgctgagtcatcctgtaggtcctacccgtcagtgacccttatatttgttctcttccttccgcctcttctccgctaccactgcgtggccaatttcaccaagctcatccatggcgcccacgattgaatgcaagagaggtaggggaagagaagagaatagaatatgactaaaagcttcttggcctgctcgagggcatagtgtggtcgaagtggaagagatcaaagatgatgttggtgtagacgtggataggacggtcggggtgctccgtctctgacagtgacagtgttggtatttcttaatgacattactagaaatataattcccagcaatggtgcagaaatacttctggtatattatggttacagagttcatccgtaagcgcacggatataccattgtagtatttcacccgagagtattccaatgatatcgtatttgtttaatctcgtgggaagattataatagagagaaccgtactaataatttatatattacttgcaacaatcaaagtctaagcaggggttaatataattcaagagtagagtgacactaagcagaaacattcatacactcattcataattatctaaattaagtggaaagaatatagaaagatctattcatatacttctagtatacaggcatattatacatacatcctagttatatcattacttagctaataccctctttctgatgccctcctggtgcttcgagaagccacccatgattgccgagttccttacgacaatccgtcatgaccatccaaccgggactaaatatggagaagtaccatccccaggaaattaacttaggactatatacacgcgcgaaagaatacccgtactgagctgtcaccatcagcgacccacctcgcttccgcaacatataatctcaaataatgatatccagtaatctaaacaccacgcttaaattacgaaatactactctaatgtcatcgtcatgacatagagtcatcgtaaatacgatcactatacccacaccattgcatctcccagataagctagcatcataataaatataacttggacatataataaagttggtattcataaactcgaaaaatagtacaataccaaagtagtaaaaagaagaatattctaaataaagtacaagtcttacaaaagaaggaaaagctactaaagccataccaccatcccctcctcaccgccgcggcggcgggggtggctctgctgcctcgggcaccgccgccctgcgcggatccggcaccaagggcggcgggggcggccgatccggtgcctgccatcccctcctcaccgccacacccccctcctcaccgcccctcctcccctcttcactgccgcggcggcgggggcggctctgctgccttgggtggccccgccctgcgcgaattcgacgccaagggcggcgggggcggccgatccggtgccgctgacgacggcgggcggcgagggcgacggatccagtgccagcgatgacggcgggtggcagggacgacggatcgcggtggcgggctagggtttgggattttttttatttttattttttgtttgctaaatttatttttgcatgcggccggtataagcaaccgcatacgaaaatgggatttttgcatgtggttgcaccggccgcatgtgaaaagcttgatttttgcagaccttctcgcccttacgtttggggcaatcgtatgcaaagatgcccttcgcccgcatgcaaaaagcctttctgtagtagtaccgggtggtctgaccaagtagcctgacggtcaaaccgacaaactctaggagggaatcagtttcgggttgttttcatggattttctagattgcttcatgcttatgacttatagatggcttctatacatatgtgatattgttttgtgtgctgatttgagtcaagttggtgcaaacttatactcggatatgaagtttctttgttgttcatgtgtaggtgttgcttgaggttatgggagtttagctggtaatggttcgggactaggcttggtagaatttgagatccagacagtcaagttgatcacacaacatgctcagactagagaacaatgcacgtggaggtgaaagttttcatatgtcatacacatggtgttacatgcttatggacggatgagtcaaatttggataagagtctaagtttggtaagtttggagtgtggagttatatgggaatgttgtttcctggtttggtaggtttcctatgtgattatgagttctagttatagttgaattcgtggttagggtcagccatgttttgggtataaataaaagaggggttgaggttagaagtatatcaactttttgggagagaaaagttagggtttgcttcgagacttcgattctagtttgttcgtgaattgagagaagagtgctttagacacatcgatgtaataaagttaatttaattttaagagtttcgttgatttatgtttcccggatcccgatggtccgactgaagtacaatgagcggttagatcggcgacggtggtggcagcaagcaaataaggagaccgacaggtggtccaaccggtggcgatctgaccaacgactagggttaggactgactcgcattgatctggcggtgtgatcgaagcaacttcatcaggttcgagggtgatcttttaattctgaaaaaagatttggttttagtgttcctctggtaaacttggttcttgtatttgatcccacatcaatatttggtagaaaacacccaaaattttatgtctagattttcaaatataatttgtatcttttcttttttcttatctgcatgtataataatggatttgtaagcagtattcgaaaatatattgttcatttctggtgtattattttcttcttttttttgctcgtataatgaatacaatagggaaacaatattccaaaaaacctttgtctgtttcaatgtcctaatattttttcccgtttccactcctaatctctttttttctattctttcgattaacgtgggattttgtaaaccgtgaaagccaacctaaagactctttttctactactttctaagttaatagatcacggcttaaaagtttatacacaagaaaagtttatatatctgatttggattcatattcaaatgtttctaataaaatgtttgtatattaaagtatttttacgaagcttgtatagtttttctcgatgtaaagtttgtacttataaacttatattaactttcatggatagcatttcgtggtgggttacatgcccggatgcacgtgcgcgaacaccccccattagacccacccgaagctattgtagtatagatttactccctcggttcttaaaaaagtcaatttaagggctcctttggatgcacggggagaaaacccctaggaaaaaaccccatacagggattttccctgtaccaagtgaatccccccccaaatctctagggaagcactttccgctaagggagatttccctgctaccatttggaagcagctcacgggactgggggatgattagggtttttaagttttgagcctactctaccaaataatggctagttggagcgcacccaacaagataaaaaatgtctaaataaacataaccgagcacaaaaatagaataattaagttaaaaatgcaagaaaaaaaaaatctgaaaatcatatgaactccaagtagagcaataaattctagctaaaatagagaacattatagatacaagcatcaacttagttcatgagatgatcaaattgaggtaccatctacagtatttagccaagtattatatgagcatccaagaaatatcactttcagcaaatacaagatgtaattcatacaattatcatttacaaatatcttggaagtgttttcctcctgcattcatgagcatcaactatctccatcgctgctccaaattgagaacaaggctgaatatacaagggcaaggcctgttgcctacatccaagaattaaaaacacaagtaagggtgcaacctgtaaggcttattcgtttaaaaggaattgcaaagaaaaagcataggaataggaatatgttctaaactaccatttgtttcataggaatgcaccataggaaaattataggaaaattttcaattcctccattttcgaaggaaaagcataggaaaaaataatccactccaacctaatgtttgcattcctttggttggcttgctcaacaacataggaaaaattcctgtgtttttcaatccatagatttgcacatgtattcctatagtattcctacgtttttcctattactacgttttgaaaatccagtgaaccgaatgagcccgtagtgttggtagaaaaaaaagcattcaaatacttcttgtatagaaaatgcagactagagtatagctctgtgtgggacaatctttgtttatgccaatccagagattcaaattgaatcatggcaagaggaagagtgcaagaggacaattatcattatggacatgacaaggaaaagaagtgcatctcatatatataccccctatgtgagtcctcattaggtaaacttttgcaacattttcagctgaactgcagtgccgttgagctgctgtttaggcgcaaactgattagacagattaaagcctcatgctactacagtttgagatgcaaattaatgcgcaatgcttcagacggaccgtggccatttccagctaactctgtctcttagttttatgcccccaagcaagcacacaaacactgtcattagtgtagatagttatggttagcacttagcaatactaattagtagtagtagtagttgttttaattaactagtcttgcacgtcgatactattgaatggagttaattttgaaagagtattcagtcttggtactaacaaaaatatgtgtattcataaatatgtgattaattttgaatggagttaattttgattgagccactgagccaaagatctaaggggaaaccctagaggagaagaagagcagaaaccctaggaggaggaggagaggaggggaaagagaagaaggcttaccatggtacggtggcagcgctggtggtgtctcgccggaggagtcccggcggtggcgcgtctcgccggaggaggaggcgcggcggtgcccaacattggtcgcgcgcgagagagaagcggcggcggatcgcgcgaggaaaaattccttccctagggtttccccgcggattgggctgggaaatccctgcctcgtgggcttccaaatggacaggaaataagcctgtggaaattttcaccgcgggcctttctcccaggggaatgggcggggatcccccgggatcccaagttgccaaaggaggcctaaaagggaatgtgacccctcctagtacaacgaatctgaataatcgagataaagaaatgtccagattcgttgtattaggagggatcacatttttttcctaggttgacttttattttttggaactgatggagtatgtgactactgactagtgtagctatagatggccatatggcccgaggcccgtggcttagcccaaggcacgtcattttggcctggcccaagcatggcacagcccgactcggggtcgtgcccgtgccagcccggcctggtagctgggccgtgcttgggccgcacacttggcacggtgggctagcccggcacggcatgaccgaataaaaaaatcgaggatgtcaaatagacttaattaacatataagacaaggcccaaagagaagagaaatacaaaatagacttattttctagccatatggacccagcccacagagttgagcaacgtaaaatagacttattatgtggaaaagaacagtgaaccatcgtgccttctggccggcccggcacggcccgagtcgtgttgggccatgcctgggccgtgtttgcggcttgtgggctggcacggcacagcccagtgtaggtcgggccgtgccgcccgtttggccatctgtaagtgtagctaccagagaggggcaatgcggtcgagctccacagggaggccgttgagcggcgtcggcagcgggtccctgacgaacgtgttctcctccccgcaggccgcagcacagctgccacctgaaatgcctcacaaggtagtgcgtcgtcaccagcgtctccaccctcgcaagctccatcccggggcataccctcggcccgccgccgaacgccacgaacgattagggcagcggcggcggtggcgccgccgacgccgcctgggcgtcgaaccgggacggcaagaacttggccgggtccatgtgcgtcacgcatggcgaccagaacgcctgccaccctttcgggatgacgtagccgtcgacctcgatgtcctcgggtgctctcctgcgcgacgcgccacgacagcttcatcctcgtgacgtcctcccgtgtcagggcctcgccttcttgcttgctcttggctatctcgtcatgctctgcatccatcaatcgtggccggctatggcggttgttagggtgttcgatctttttttggcgaaaggaaatgttagtcttggggttggattattacttgccttggaccatggcggcgagtgtggctgggtcgttggcgaggtggcggaccatgaaggtcaagaggatggcggaggtgtcgtggccggcgacgagggcgttcgagcacggagttatcgacgatctcctcctccatcggtcagcagccgccggccgccgtcgccgtctcaatcggaggctcacgaggcagctgatgggatcgtccgttggggacgacttgccctgctcctccaggttggccttcttctccctcagctcacggtcgcctcgagcagccggcgcgccgtcgcgctcgatcgccttgaggccgttgcggaacgcggtgaacggcagatgagatccaccggcaccgattgcgtgccctccagcatgccggtgtacgcgtcggcgagctgctcccggatggcgccgcgctcgagcccgaacagcagggtggcgatgatgtcgaacgtcagcgtcttcatcagcgggagcaccgtgacggtgcggcggccggcccacctgtcggcgaggtggcgcctgacctcacctcgccgtcgatctttcccacgtaccgccgcagcatctccggcttgaggaactgcatcagcgcgctgacgagctccaggatgttcttcctcccgaggatatcgtcgccaggctccgtggctgcttgggcgccagcgcctcgtggaggaacaccaccttgttcgccgccggcccggcgaggagcaccgtcggcgcgccgaacagcgacagcttcgacacggggccgtacctgtcgatcctgtcctgcagccatcgctcggcggtgttgcgcccggcatggcgcgcagcagggccaggctctgcccgatcagcggcaggccgagggatcccggcggtatagatggctaaaaggcccgcccggtacggcccggcccaggcatggctaggcacggcccaccagctgtcgggccgtgctgtgccggcccgaaggcacaggtggcccatcgggcctttttttaaaataagtctattttctttccctcctctttgggctgttacatatgtatagctaaaaaataagtctattttccatctcctctttgggctgacatatgtatagttaaaataagtatattttacgtccctcctatttgggctgacatatgaatagataataagtctattttatatccttattctttcgtccatggcatatatatgtctatttttactcccttttttttatatcgggcctggctgccggcccggtcatgccgggccggcccaacgtgccagtggaggggccaggcacggcccggtggtcaggtcgtgccatgcttgggccatctatacccggcggcaagttgcaccgccgcggcgacgccctcctcgctctccccgccaggtgcacggccagcggcgtcactcaggagggcgacgaggagcgcgacgatgacggcgatcgccatcgcagcagtaggaaggggccaagtaggtggctaggagaacgagtgcgactgtgtgtgtgtgtggctaagcttggattgacacaaacaagaaagaaatctacccaacatcattgtagccttataagaggatcattagttgttacttcgtttcatattataaattactttataacttttaaatttaattaagtttatagaaaaatatagtaacattttcaacacaaaactaacatattatcaaagctagatttaatgaaatcaatttgatattttagacgttgataaatatttttaaaaatttagttaaacttaatagagttcaacttagaaaaaaaattaaaacgacttgccacggagcgagtaagagttatagtatgtgtactttgttttcaatagttacgactttgaccaatgaaattatttacaaacatttgacaacgcatggaaccaactatatactccctcatcttttctttttaaatattttataaaaatatatcatattattaaagcattttgcatcctaaacaattatagtacttacattaaccaaaacataaaagtttttattggtgaaagataaaattataggggtcaagtgtcaaattataagggtgattgccctgaaggtaactgcgtgcttggtctgtcacgtgggtgcacaaatgatctaatcactaataaagatttggccgtacgcagaaaacaagattttaatagtgatgggttgggaagggagagccacagatcgaagtcctgtctctcagccaacaccaatttctacatcacgtgggctgcggaccggcttacttgggggagtacttcgtttactgtgacatattttccaaaccgttaaaagatatatcttttaaaaaattaaaataaaattattattttttattattttaaaattagaataacaaattatatgcaaatcatctttatcttactcgtttttgtgtgtggtttacaaattccctctaaactatgtttttctatcgaagactaattcttgtttcatgcttaaaaaaactaagagaaaattgagagaggtgaggatactgtttgtgaaaaaaaaaagcatgcttgtctgttcaagaaagtggacaaaagaagaggaaaaaagaattgattgagcagcaactgatggaaactgatagaaaggaaagtcagacgaggatgatctatttgagcaagaatggaggaagagaatataaattatattagaggataaaatggagatctatgaacaagaggagagattttggcagaggagatgaggaggatctatgaacaagaggagagattttggcagaggagatgtggaggatctatgaacaagaggagagattttggcataggagatgtggagaacaatgtatcttgaaggacgattctaattctaataactcctttttcatggattggaaaataggagaagaaagagtcacactttctcactacaaacaaagggaaaattggaattccttaggcatctgtttttatgataaacactaacattgtaggccattccacatttttctacataatgatcttaagtcactccatttctgaataactttaccacagccttcatacctgcaacactcttgacacctcaactaaactggagaaaacataaactgaaacgcatggtaatagacagaaacatgtggatcattttaagcatgagcatattcaaggggggcttctggtctcaagttccattgggagtccaagaacaggcatcggaagaggatctttcctgtaaccttcttctttgcagcacaatttccacctgaactgcctcactaggtagtgcatggttaccaatgtctcggtccttgcaaactcgtttccagggcacattcttgggcctcccccaaatggcacaaagcaataaggtgggattgaagtctggttgtcaaatctagtagggtcaaacttgaccgggtcattgaaaaaatttccgtccaaatgtgtgatactttgagcagtgaagacctagcatcgcaagatgtatgtgagagtaataaaaaggaatatagcagttgggtacattaatcagatcgaaatatcactgcgacactaatggcattattggaatggaaaagatatccaatgacaaaagaaattggatcatagaaaaatgcttactttccagccttttggaatgtgatagcctcggtattcgatgtctttgatagctgttcggaagcttccaaatattgggggaacagtccgtagtgtctccaatgccaccttccatgtgtacttcatccttgagacatcatcccaggttaaaggttcattaggtcctctgctactagctatctcctcttgttctgtggttcacgataggtgcaaatgataccgtgctactcagaagattaaaacaccaaaatacaggcacacgatacaatatagagtactaggtgctcaccctcggttatcttgccaaggatgtctggatcattagctaggtaccggagcaagaaggtgataagaacagccgaattcccataaccggcagtcaggagtacgattgcattgtccacaatgtcctccactgtgagcgagtgtgtgccttcagagcgcaaaacaagcatgtatgtgaagaaatcatcagctgaactagaatggccttgctgcaatgctgcttccctttcgcgagcaatttgcctgagtacctttctgatcctccggctcgcactcaggcccttgttgaacttggtgaagggtatattcactggtagtgatagcaaagcctgcaccaa

SEQ ID NO: 44712 - DNA, 1822 bp, Oryza sativa
caccgcggacttgctttagctcctcacctgagagtgtcagaatggaccgcccaatgatggtgttgatcgcctttgtctgggtgaaaatgaggtcctggttgctgaatacaaagtgattggccgccgggccagccataagcaccgtcggtgagccaaaaagtgacatcttgaacacagggccatacttcttgatcctgtcctggtaccactggtaatcagtattactgcggagggcacgaagaagggagatgctctggccaatcactgggaagccaagggaacctggagggagattataggatgagtacttgcgcctgatgacaaagtggaggaggatgggtatgagcaaggcaagcagcagagcaaaaggcatggatgaatccattgatggagtatgttgttatgcactatgaaggttggctgatcagtttgtggatttgtatacatgtatatatgtaggcaaaccagagttgttttctttctccatgatagacaagggtgtatggttgaacaaatttgatattttctcccgaactcagtaaaaggcctagttggtgaagctgaatatatcactttctcaaaagtcatacaacaaacaagcaaagattacaaattgagataaggggacagaaagatcattgtcaccagagtaatgagtctgattcatgataataacttaaaatattagtttataagtaaacaattctattacgccacatgataggagcagcttagcacgacatatgtgaataactggaaataaatggaagccacagctcaaagaatcacatttatgctagccaatataatttctagatttatgctagttaaagaatcgcagttcctcctcaaatgaaagacacaaaaacgaattccctaaaaaaactaagggaagaacatagacacaagcaaataaagagatgaactgaatattcctttggatctaatattagtttgaggaaagatgctacatacagcagcattaaattttgcaaagcaagcaaagcaaaccattgaaaagatctggtgacaacaatttggtcatccctaaggaaacgatccatgtcctatcctatgtaataagaaattttgaacaatattctagatttaattcttctgcataactgcaggactctcgatcaacaagtatagttttagccttagcacaggccatgtatgcaggacagccctttttttttggcatattattatgcagaatatttgccaggaaaaacaggtagacatttcaaaaattagaagcaaattacatacttagtggtcagaaaagtttagctccagttctatatatgtgcctgtgcacaaaatgacacatttaccgtagccgcagttcttctgaaaatggcatggccctgcaatatagattacagaacagtacttcacaatatatctagggtgtgttcagttcttgaaaaaagttggaagtttggaaaaaaagttaaaagtttacgtgtgtaggaaagttttggatgtgatgtgatgtgattgaaagttagaagtttggggtagttgggggtgaactaaacacaactctataagcagacgattcctcccaaatatagcatggccgtttatttaataacgtaggcaaaatcaatgcattatcaggatacaccacaatgacctcgagggccacttagatcctgaaaaactgggcaaaaaaaggaaaggaaaacgacaggtcggataacatattctgaaaatccacatagtcaacttctaagaacaaaaaatgtacacagacagatggacttcgaagggatagactctacccaatatagattcggagatcacatcatgaatg

SEQ ID NO: 44713 - DNA, 876 bp, Oryza sativa
cctaattttgcatatatgcattttactcaatatttgtgttatcttaactaatgaattcaccctagattaatattactcatattttatttttatgtaatttatttgagttttaattaaggttaattcttattccatcgtatttaaatttaattgatccaaatatggttgcgataatattttatttatttctatccccacctaatctttattttaatttgtatttattttaccaatttgtttttaagttttattcctaattaactattctttactcacgattaataatcttcgagatcaaatccagataaaatagacgaataagattggcatgatgcaattagtttaaaaagtttttttgaaaatccgtatttttagagttttgattttgtcggtcgaattttcagggtattacatcctacgatcattggtggagaagtggttttcactcccggttcgtaacccctatatagtcccggtttttcaaccgggactacgaatccgggactaaagatcgctatctttagtcctgggtgaaataaccgggagcaaaaatcgatttttagtcccggttggtaacaccaaccgggactaaagatactttatctttagtcccggttggtgttagcaactgggactaaagaggcagatccggttgcttctttattcttttcttctcttcattatttttcattatttttaatatattgatttcaccctagccctatcccgtccctaaattcccaaaacaatcatcctcaaattgccttcaaatccacaaatcgatcatctcaaatacatcacaaaatctaaaaaaaaaattacatcacaacttctacaaaattcaaatcacatatccacatctcacacaaatcaaat

SEQ ID NO: 44714 - DNA, 10586 bp, Oryza sativa
  unsure (1)..(10586): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgataacctcgcattggcagtacccgctccgtgaacttaaatcctcatgcactctaggcgtccatgtttctagcagtgagaggagttctggcgctcccgggaaagagaagtctcacacgcatattaaattatggttcaagttaagttctctctctcacacactcatggcagtcctaccaatggcgacaccgatgtagggcacgcttctcggccctacctcaacggctgtcccatcgtagcgcacctgcctcactcaggggtgaaccatctatgcagggatactgcctccgctcggctatctaatccgctaggtctatacccatacgagaagtgcggttgtacgggggttgtttcatgcttaacttcatggctcggtccttaattgaccggggacggtactagccttttccagataccacccaaatcctccgtccgccccagtcgaaaacagttatttaattttatttctcctttcacaaatcatgtcatcaacatcatggcaatgtggcgctcatgtctccacatgccgcatctcaattaccttcccaaaggtaattgcccaagcatatagcatttgataaatatgagtatgcatgattctagaatagcatttctaagcaattgtcatagttgactagggactcatacgtaaacatggttacaaagatttaagggtaaacaataatcaaggcatggcataatcacaagtaggatgttcgtcattgcatgcaattttatttgtaaacaaaacaatttcgcaattgggatcaacatgttcaaggaatagtgatgacttgccttgctcagagtcttgcgggtcttggccttcgcttggatccgcaactccctcgggctctatagttacgtgcaaaaattgatttgaattcggttagaattcaaataaaaatccaaataaatccaaatgaaagtcgaatgtgaaagtcgattcctttttattaactttactatctgcgaactacggcaaacccaatttcgacttaaactattttgcgggtataaatattttgttgtcataagtttttaatttaatctacccgagcattatatccatataataggttagagatttctatcgcgagctaaatatcggacgaaatcctagaaatattatatgatttaatttagtctatgactaaatgattaaatataatacacggctaaaatccctagtaattaaatccgaatttctaccgtgaaccgatgacttttagagattaccaaaaataatctataataatctataagaattcatctaattgtttagttattaattatatctaaattactaccaattttaatctaatctgatcaagaaatatatttttataattaactcggaatttcgaccgaaatactattacgctcaaggaattttccctctttttctctcctctctttctttttctctcttttctcttttcttttctttctctcctcccggctccttcctcctttcctctcttttctttttctctgctccctcccggcttctttctatctctctctctctcggctctttgcttccccgagcggcgacggcggtgggcgcgaggtgagaggggggggagacggctcaccggcggcggcggtggcggcgacgacggcgacggcggcgcaaggcggcgacgcacggcgcggcggctccggggcgacggcgcggcggcttcgaaggtggcggcgcagcggcgcgacaacagcggcgcatcggcgcgacgacagcggcgcgtggagaaggggaagatggagaagatgagggaatggagtggggtggagaaggggggattgggccggggtctttataggggagaggggaagaaagagaggggaaggagggggaggggtgaaacgacggcggcgcggcggcgcggggcgcgaggcggcgggctcgcggcgcgaggcgacgagacggcgcgcggcgcggcagcggcaatgggacgcgcgcggcgacgggacgtcgatggcgacggcgacagcggtggcgcgcggctcggggcgggatgcgatgggcggcgacacgacggcacggcgcgacagcgacgatgggacggcccggcagcggcacagctcgaggcggcgatggaacgcgcacgcggcgacgggatggcgacggcgacagagcggcagtggtggcgcgcggcgcgaggcgggacgcgacggcgacggcgcggccgcggcgatgagatggtgacggcgacaggcggcgatggcgacggtggcgcggcggcaggcgacgatggcgacggcgcgcggcagctggcgacgatggcgacggcgcgtggtgacggtggcgacaaagagagggggaaaggggaggagctgggttaggggaccccgtcgaacaccttaggtgcaatgaacagtgccgttttctaattaacccgattttagtgtattttccatataaatttgattccacaattcctaattttgcatatatgcattttactcaatatttgtgttatcttaactaatgaattcaccctagattaatattactcatattttatttttatgtaatttatttgagttttaattagggttaattcttattccatcgtatttaaatttaattgatccaaatatggttgcgataatattttatttatttctatccccacctaatctttattttaatttgtatttattttaccaatttgtttttaagttttattcctaattaactattctttactcacgattagtaatcttcgagatcaaatccagataaaatagacgaataagattggcatgatgcaattagtttaaaaagtttttttgaaaatccgtatttttagagttttgattttgtcggtcgaattttcagggtgttacaaacctaccccccttaaataaatctcgtcccgagatttcttaccagttttcgaatatatgcgggtactccgtcctcaagaattcttcgctttcccatgtggcttcatcctcagtgtgattgctccattgtaccttgtacatacgccacactttgctcctagtcctcttttcggcttcatccaatatccggatcgggtgttctggatatgtgagatcattgctaatgtgaatctcttccagcggagcttgctcttccggcactcgtaaacatttctttagctgagacacatggaagactgggtgcacatccgcgatattctctggtaactgtaactgatatgcaacttctcctcgcttggcgatgatctggaatggtcccacatatcttggtgccagttttcctttgaccttaaacctttttgtttccctcatcggagaaacctttagataaacgtaatctccctccttaaattccaggtttcttcttcgggtgtcggcgtaactcttttgtcgtgattgtgctacttttagacggtcacggatcaagcgaaccttttcttcggcttcttgaataatgtcaggtccaaataccgcccgttctccagtctcggaccacattagcggggtacgacattgtcgaccaaacaatgcctcattggttgacatttttaggcttgcttgaaagctgttgttgtaggagaattcggcgtagggcaaacatctctcccagtccttgctaaaatccagagcacaagccctcagcatgtcctccaggacctggttggttctctccgtctggccatctgtctggggatgataagctgtgctaactgcgaggtaacttcctagggcttcatggactttctcccagaaatgtgaggtaaactgtgtgccccgatcagatataattttcttaggtacaccatgaagacatactatcctggtcatgtataactcggctagcttagcactgctataatttgtcttaacgggaatgaatctcgccgtcnnnnnnnnnnnnnnnnnnnnnnnnnaaatagaatcatatcctgttgcggttttgggcaatccaacaataaaatccatacctatctcatcccatttccattcgggaatcctaaggggttgcagcaagcctgccggtcgctgatgctcagccttcactttttggcacacgtcacagagtgctacgtattccaccacatctctcttcatgttgggccaccagtatccttccttcagatcttggtacatcttcgtacttccggggtgcaatgaatatgccgattcgtgagcttcctttaaaattaatcccctcagtccaccctgttcgggtacgtaaattctctttttataccatagaacatctttttcgtcggttgaaaattcctttgcacgtcctgcagctaagcgttccttcacctctcggacttcctcgttgtccttctgggcttcttctatttgggttctcaaaagaggttgaatgtccagggtgtttatccgtccacgaggtactatatgtaggttcagctgagctatttcctccctaagctcagggaccatcccttccattctcagatgattgcaatggctcttacgactcagagcttcggccaccacgtttgctttgcctgggtgatagtgaacctctaaatcatagtccttgattaattctaaccatcgcctttgcctcaagttgagatctgactgggtgaagatatactttagactcttgtggtcagtgtagatatcgcaatggtttccaattagataatgtctctaaatctttagcgcatgaaccacagttgcgagttctaggtcatgggtagggtagttttcctcatgtggtcgcaattgtcgtgacgcataggccacaactttcccgtcctgcatcaatactcctcctagtccttgccttgaagcatcacaatatataacaaagtctttcctgatgtcgggaagaactaaaataggtgccgaggtcagcttttctttgagctgctcaaagctttcctgacactgttctgaccacacaaacttcttttccttcttgagtagttgtgtcattggtcgggctatcttagagaacccttcaatgaaccgtcggtagtatccagccaagcctagaaaactccgaatttcagtcacagatttgggtgctttccattccgtgacagcctctactttagcaggatccactgctactccaccggccgagattacgtggcctagaaaagcgacttcttttaaccagaactcacacttgctgaattttgcatataacttatgcttccgaagtttctcgagtaccaatcgcaagtgttccgcatgttcttcctcatctttagagtagattagaatatcatcgatgaataccaccacaaatttgtccaagtagtccatgaacactttgttcataagattcataaagtatgccggagcgttggttaaaccaaacgacattacggtgaactcatataatccatagcatgttgagaacgcggttttgggtatgtccccggttctaattttcaattggtggtatcctgaccgaaggtcaatcttagagaacaccttagctccgttgagttgatcaaaaagatcatcaatccgtggtagtggatacttgtttttaatagttacttcgttcagtgatcggtagtctacacacattctcatgctaccgtctttctttttaacaaataacactggggctccccaaggtgatgaactggggcgtacaaatcccttctcttgcaactccctgatttgctttttaagttcttctaactcattgaccggcatctgatatggtctcttggatatggaggcagttccgggtatcaggtcaataatgaactctatgtcacgatctggtggcattccaggtaaatcttctgggaacacatcaggaaatcgctgcactacgggcattccctttaggggtagcatggtaaatatacctccggcacgttcggttagcctaggatcttgatccatggttgctctcatatccgatccccagggtgtggtcagggtaacttctctatgtctacagtcaattattcctctatgctttgctaaccaatccatacccaaaatgacatcaagagtttggggtattagcaccataagattgtagagaaataccacatccctaaggcggatgggtacgtcaatgcaagctgtatccactgctatctcaaccccaggtgaatgtactaacattggttgtcttagtttaactctggttaaattgtgttgttgacttgctttcaaagatataaatgaatgcgatgctcctgaatcgaagagaactttaactggagtggagttgagtgaaaacatacccatcagtacgccttggtcttcctgggcctcttcagctcgaacgtggttcacttgcccgcgtccaaatccggtagcggtcctgttagtctgcggagtcctgaatagacctcgtccagcagcaggggtagcagtcccgtgaatagccgttgcattagctccggtgcgaatgggtgtcttgtttggatgaggacatttattggcgaaatgctcgtactctccacagttgaaacagcttcctgtccttactgatccagtggcggcctgattcggtgcaggagctcggttctgaatggtaaccgacctgtggaaattgctggaggcggcaggtcgactggttgtcaccactgttggtctccatgccgaggaggttgtccctttaggacgctggggtgcggtctgaggcgagcggttcatggcaagcctccttttacgattgtgctccacgaccttccggtcgttctccagcctaacgaccttattgattaaactctggaaactatcgtgatcttgtccaatcatgggcccgcgtaactcgtcattcaagccttcaatgaatttgtcgatcttttcctcctcgtcggcaagatctctagtcgcgtagcgcgctagctgagtgaaacggttcaggtactcttgtactgtggtattccctttccgtagtctcctgaactcattcttcttcatccgcatcaccgcggcaggcacgaagttgtcacggaaggctgtggtaaattcctcccagtttggttctccagcatcttcttctcgggcttctttgtacgtgtcccaccagtctccggctggtccttccaattggtttgccgcaaagatcactttattggcctcacgtactcgaacaagagttagcttcttctcaatgatccttaaccaatcttcagcatccataggttcttcagctgtggcgaatgtgggtggcttggtcctcataaactctccaaagcttgaccctccgcggttgccttggttgttcgcgatagcttgcagaagttgagtttgggtggccataactccggccagagtggttaagtcgggtgtctgagtttcgtcattgctggttgttgcccgacgtcggcttgccatctgtgtaggttgatggagtaagtatcctaattttctaactagctcctatggctttatcccattaagggagttgtgttgatatgaactttgttttgcaagcatggtggaataaactcatttataacacaacaacaatagatatcataaataatatcacagagtttcacaaatggtacataaatcatgatgcaatcgactgcatacatacgcagtccaaataaggttcatccaaaagatacatcaaactaatcatcaaactactcgtcaatctaggtaagggaggggggtgtctcgcatactatccaaaaatccatctgatacgagatcgaagctgcaaggagtccgtcagtctagtcctccagccatccgcaggatcctggggcaggtagagggtggtcgcttgcacacgcaaacctgagtccccacggctcagaagtagtggcctctggatctggcttgggcctcttgcccggaggtcgtgtgctcttgcgagcagtgctgagggtgcgaggacctccaaggaaggtgatgcggggaacaggggtctcatcctctgaaggatcagtgatgtctggctcgatctctggctcggtgtcggtcccctctgtctcggagtcgacctggatcggagtctccaaactggaacccagctgcggagaaggtgtagggatcagtggagtgtgcaccatctccgggacaggtggctgtgccgctgtcgggtccactaggtaaagtgctaactcggtagctagcatactagcctctcccagaagagcgtggaacgccggtgggtacggcggggtgaggaagaagtagcggtcacggcctactgctgtggaagtagaagcccctgtggtgctgatcttggctactcgaagctgctcctccagctggctgacgtgctcctgactctctctcagctgctcctcaagagtatccatcatcccgcggcgatcgttgtactggtcagataactgctggaactggtcgccgtggacctggagctgtgccttcagtgagtctatctcactgccccaagcctggtgctcctcctccaactgaagctgctgcactgagaggtcagtcaactcagtctccagctctcccatacgtctctggtggtcgtcaatctccaacagagcctcctcgtagtagtcatctactgcctcagcccatcgtgacaaccaagtcaccatcgggttgtagcagcagggcgtgtcctgaactgtgcaaactgagttgctctcctcccggaacgggtgatgagcaaactcgatactcactaactcagctcggtggatagagctgagtcggaggaaggcctcccgggctgcatcctgcatcgcggtctccggcaggtctcggtggtgacgtgtctgaaagctgtagtccaactcggaagggactcgggggtgaacctcgacccgagcctcccaaactgagccatactgtctcactcggtatgacgggaacccagagtatcgcagacgcctcaacatccgatgcagctcaatgacatacccctctgattgaggtaagctcaactcccaggtagcgggtgaatccggatctgccatctaattttaagaaaaacccaaagttagttgagagtaaaacttgttttgtaaagaaaatagttaagagtaagatgaaaattgtaccgagttttgtaaacatagcgtttttatttttgaaagtattactaaatgggaatttctcccttggccaacttagaaaaggggtggggcgccttttggtcttttcctacggttgtatggctctgataccagctctgtggacccctgtttttataacaggaatcaatcgtgtaaacagtaccatttccctggatcaagtagtctggtacacacgaattcatagctgaaataccaagtgcacatacacgagtgtctaatacgaattattacatcataaccccgcaggcgtagtctcaaattatcggaccgagcggtccggaatacatccaaaagcagaaatagataaggcagcggaattcaggcagcggcatgccattgccacaggcaacgaccgtactaagacctactgagcgccatcgtcttcatctccctcctggtagtaggcatagggatcctccgaggcttcatctcccgcttctgattaattttatatttgcaagggtgagtaccaaccgtactcagcaagccaccacagcaatgatgcacatgacagaggaattcaaaggatggctatggttcttttgcgcaaagcaagttttgtaattcttttcacaagcctaagacctagcatagactgatcaagttttaataccagtgttcatattaaacaatgacggttctgtccaccatccattgtgatcccaaggatagcttcccgccattgagtcgttatggttttctgaggacgtccacgttcccgcctctcaggaagtggctccatcagcataaaaatcatcatgcaatatcccatcccacacaagttaaagaatttagagtctagccaagtgtaatacatgtcccggtgctcaataaccgcgagcacgactatttgaatagatttggtttactcacactgcagtggatgtacactttacccgcactccgcgattgcccaacacatgagcctcgtcccaacacatgagacgcgtcacggcaaagcttttcgataacctcgcattggcagtacccgctccgtgaacttaaatcctcatgcactctaggcgtccatgtttctagcagtgagaggagttctggcgctcccgggaaagagaagtctcacacgcatattaaattatggttcaagttaagttctctctctcacacactcatggcagtcctaccaatggcgacaccgatgtagggcacgcttctcggccctacctcaacggctgtcccatcgtagcgcacctgcctcactcaggggtgaaccatctatgcagggatactgcctccgctcggctatctaatccgctaggtctatacccatacgagaagtgcggttgtacgggggttgtttcatgcttaacttcatggctcggt

SEQ ID NO: 44715 - DNA, 8407 bp, Oryza sativa
tttttgcttgcactgtttgaccactcatcttattcaaaaaaatttagaattattatttattttttgtgtgacttactttattatccaaagtactttaagcacaacttttcgttttttatatttgcacaatttttttaataagacgagtggtcaaacaataaaaaaaaactcaaaatcccttatattatgggacggagagagtatgtattttaagggcatgtttagtttccaaacaaaatttttcacgctattacatcgaatgtttgaatacatgtatggagtattaaatgtagaaaaaaataattacacagattgcgtgtaaattgcgagacgaatcttttaagcctaattgcaccatgatttgacaatgtggtgctacagtaaacatttgctaatgatgtattaattaggtttaataaattcgtctcgcagtttcatggcaaaatttgtaatttattttgttattagaatacatttaatactttaaatgtgtgtccgtatatccaatgtgatatgcatgggcaaaatttttgccaccaaaacaggccctaatcacaacagaaataggagtacatagcatttacacagctggatctcaatgcaaagtaacacggtccagattgatctagctatcctacctgtacatggtacgagtatgacgtgctatagtgccaagtaactagtgctgtaataatagtttaatatgatgtttaggctgagtttatgacccacacatataaataagataataagtgattaaaatatgattaatacaaacttaaaaactaatttatttaattttttttaaattttttttaaaaaatatcgtttaataatttaggaagcgtacgtgcttgtgcttatggtaaataagggagttaaaaaaccaaactcattttgaacgactcagccaaattaactaaccatcgtgggctactacttcagaaacagacaacgagatcaggtactcaccatttccaaacatataaattgccctgcaggtggcacgtaccacgtacgtacgtccaattccagcaggcagcactaatcagtcacaactactacaaggaccaatctcattaacaccaatctaattattattaacaaattaaagcaggtaacatgaggccatcgttgacttgcattagagagcgtatcaaaacaattaatcaacgtgcagggcaaacaccaattaacggatgggaaagtgatggtgccgtagttacggtaaactacgaattgtaaacagaacgtacgctgtctgatataatcttgcttaattagtttaagtccttgcatgtccaagcaactatcatttcaagccgatcaaaattcagaacacgcgtacggtgcactgattaaactagtactaaccagaatttttcaaaattgatttgccgatgatttgatcgtaattaatggcgcttgatttatatctttaatttgctcatgccggcttgataatgaagtagcgtgcaacatttcactgcagctccctctgggaaaaaaaaggacttgttcactttactactatttctaatcttaacaagttttggtactgttgaatttccattaggcagtttaaaaaaattccattaggtagctagtaatccaaacacatatctaaaataatactataccaaatctttttcatatagcttcacacgaaataattgctaagtaccaaatcaaacaacaaccacatatctctaccttaccatttttttggcatttcccagactttgctaaattctggttatgcatcaaactgaacatgcccttaaacttatctataaatgttgaccatttaacaaaatattgataatcaaaattttcatcaaatcttatctataaatgtcaaatatttttatcacgaaaagtcaagatgattaaaattagaacatgaaatcaatctttattttttgaataaatgagtatcaaagcaatcatgaacatctcccatttgagaggcaaaacgcaggttgcggtccacaactccatacatgtgtttgactgtcgcctttctgcgctctccacaatagctcctttctaatatatttttttaatcaaactttcttgtcttttaagcgagttctctttcttttagacctttttaagtttttcatatccatttgaataagcagtcttgctcggaaatcgaattttgggaagacaagctcagcacaattgcgcaaatacgtagagaaaaacatccatttgcaaatgacctgatatcagccgacaggctgtttaattttcctgtttggagctcgttcatgacgtgcccatctccacattaactggatgtgtcagagttttaagtgttttttcttaaaaaaaatccggttcttatgtgaagatttctcctaaattacagctgaaaaacattttttttgtgaaataggaaaattataataaattgtcctttccatgtcacaaacacataaacctattaattgatataccatacaaacaactattacactacatacacttaaggggtagtaaataaaaaaattgctgcaatatcttcattcttgaattactcaaagggcaaatattttttttaaaaaaaggacaagtattttgatacgccgcatcctaaataaaaattgatactactaagttataaaatgaagtaacatcccaagatgctactagtatttagaattggttctgcttagctgaaacagtaagcatatgccatgtttgttgttgtgatagtcaaaacacacacggacatataattagcctgaaatttcaactcaggcatgtggaaagctttaaaaaatcttttatgtcaccgaggtggaatctgtccaaaaccccaaatacctccaagtactgaattctttaattccaagaaagcccaatttgcatgtaaccccttcacaaatatactattcttttcttgaaatgccttactagaaaataccaaatggaaaaaagaataatttgttcacaacacacaaatgacatttgacactattctcttcgtcccagaaaaaagtaactttcatacatatatcaaataacttatatatataaagcacatatactaaataacttttatacatgtccagtctaaatttacacttaagagttgtttttttatggccaagtttagtttcaaacttccaatttttttatcacatcaaaacttttctacacacataaattttcaacttctccgtcacgtcattctaatttcaaccaaacttctaattttaacgtgtactaaacacctatagacagggaattcgagtcagaatgacagagaagagagcgaagagaagaagaagcagccggcaggcaataaatggggagaggtgtataagttgcacccttcaaggcacacaaacaggtcatttgaatgtgacctactctcccctcaccccttcatcaattcggctcagaggctgctcctcctcagtcctgagtctcctgtcctcatctccattttgttttctcctcctcctcctctctctctctctctctctctctctctctctctgtctctctggtggagtgcagtgcagagattcaagaagttcaagatcgaacaggcctgctggtatgaaccctgttcatgttttttgcttgctctgtgtaatctctctgggctctggccatctggtgctggagagattggagatttgctgcataatcattggttcattactaccagttgtttgttgaagctccattaattggggattcagtggttcttgttttggtatttcctcttaccatttcttagggtggttttggttgatgtattttcccacaaattcattccatgcgtggagttcttgatggctaatccatagtggtttcaggctttcagctgctattcttctttttgttttttctcctcccccaaattgtctgctgtatggaacagagagcagttcattatgttttctggatgctcttgtatgcctttttttaatcaaactgtcagcttctgttctctgtccatgcttcttctgggctttgacctgaaagattgtggtttagaacattaaatctgcaccccaaaaaccatatattgtccgacatgcagaagtggaaatgtgagctcttgtttaatgctgctcatttgttgcctcttttcaagaaaatgaaaatttgttacaattgcgtggtctagttcttgttttcttccatccctgtattagataaggagtttggtaggcactgtcacatgattttgtgccgcaattgattttattcattagattagtaacctaaggaatccaagaacattagggtacattaataaaatgcaaagaaacagggacagaagagagtaggttctttactttgcccagttggcatcccctgaagtgatgcttgatgcttccttccattttgattatctcttgctgctgttggtggtaaatcattattattagtactaccttttttatttttcggaagaagaaaaagaggaacaagccaatgtggcctacataatatgtggtctagaaagttggcatcagtagtgtgtagatgcaatttgaggaaattaaggcagaaaggaagggacaggaaaaggggctgaaaggtttgcttgagcatagtgcatctccacaccttaaaattgctggtcaaattgtccttaaaatcgtttatatcacgcagacggcatatcgttttcgacattgccttccttaactcctgtgttaattcgaccacaactttagaacagcttgttgagatttcttaatcccagtgttgtatgtcaacattgcattgattgtagtattattatgagaagattagatactgtaacccctccagagagtgacatccattgccttctgttactggatttctgccaattcttagttagatttatggataaaaagtttttaaccaagtagacttaacaggaccaaaggttgaatttgttcacctaagaaaaatgtacaatttgttgaacaaacagcacaattcttgaatgaggagatttttagtagtcaggtttgttgtttggatatcatagtttttgaatgaggagaacatattggttggatttactgcgtggacatcacaattattgaatttggagaacaaattggttagatttgttgtgtggatatcatacttcttgaattagaagaccaaactagttgtttctttgaacaaattggttagaattattttttttttaaaaaaatcatttttcccttcatgaattaggaacagacagattgatgcccatgttaccatggtggtgtctgactcattgcagtcttatctttttacactctctagttttcccaagctgcaatcatggtggccaagtgcatgccatgatgcacctctcatataccaccatctctgcatgctcaagaacatcatgattttttgttcttcttgtcaccaactttttttttgtttttccccctaacttcttttcacccttgcaacgcacttctcactcgtagctttagttttcctcttgtcagtagcatatgtttgtttagttgtgataaattatcttttttttccagatcatgccttgtgctgcggccgagctcgccaatggcgaggcggcggcagcagcagcatgcgcggtgaaggtcggcacgaccggcaccatcggctcgctgatgacgagggagctggaggccatcaaggccgcgccgccgcacgccacagccgcggcgacgacgccgcggcggctgaggcggcagagcagcccggtgtcggtgccatgcggagccagcccgaggaagatcgccgcgctgaggaagagctcgtccagcctctccaccaccagcagcggcggcggcagcgggcggcgcactgaccgcgtgagcgccgaggagtcgtcggcgtgcaagacggcggcgtgcaggaggagctctagtaccacgccggccagctccccgatgctcgcggcggacgtcgaccggagcggcggcggcggcaaggcgaagaaggcggcggcgagggggcgccgcggcgtcggcggcgtggaggtggtggacgtgaggtgcgggaacccgatgagcagccggctgaggaggctgggattctccaagctgtcggagacgttcgcgtgagcagaatcagatcgtcttcagtcctgacggcgagctgtgtcgcgaattgcaattcggaattgcattatgtttgctatagtaattatattgttgttattaaaattttcttttgctggtttctctcgtgtatgggtatgaccaaattaagttaatttatgagaagcgttttgccatcgtcgcaatgcaagttcttcgtggtgatgtgtatgatgtacccgtaattgcgtattttaacttttggagtgaatgtctcctcgtttttttatgccgtccaaatagttattttttttaaacaaggtaatatgatagattaatatatgatatattacactaaaaacatgcatgttaaaattatatctccacaaattgcaaacataaacactagctagttaacgtatactactactactcacaattaaatttgttttgccaattcaaaattatatgtttacgaagtaatatatcatatattaatttatcttattagttttttttaaaaaaattataaccatttggatgagttcaagatcgtttttccatgttttttagcctatagactggcgcgttgagcgttgctggatctcgaatcaacggtagatcttgcacaaacgattcttgaaacttttttcccgtgtcacgtcgaggtactgtagaaagacagaagtgaactacaaaattggatgcaatttttagtaattgattagctaacatggtgatttaccacttcaccgtattaggaaggaaaaaaaaaggactcattggcttataagattcagcgaaagatagaaacacacccactgtttggttttacatcatggagggtgtatgtcatcttggaaatacaaacttgatgggaaagtaggaaatcttgttgggtgtgttcgctattcctggatcccaaccggatccctccgcacggaaaacggagcggtttattagcgtgtaattaataagtattagctattttgttaaaaaaatggattaatttgattttttaaacaactttcatatagaaatttttttttttaaaaaacgcaccgtttagcagtttgaaaagcgtacgtgtggaaaataagggagatgagatgggaaaggggcatccgaagtctggaatggaagtagggatttctagactgttgattgatgtttgaaataaccaagctcaatgcatccaaaatgaggctagatttgagctgttcatgattgaatgcaatgtcagaagatctgagatcactactactcactgtactaactccctcacagttgcatatcatctgaaggagacaagagggaagatctttgattggatgctggatgatgagctagtttaatagccctacttgacaggataaccgtgtgaagtgttttgttggagcaaacaggaactttctctgtttgaaggttaagcaatcattaatcataatatatgtaaaaaaaccaatcattaatcaaataatggtgaggatattcaagacccatgccaaatgatttgggcttgggactgagatattggcagggatttattgggcttcccaaacaggacctaactgtgttcctagcttttttagaacttctaactgtttctagctggcttattattctacaagcctactggttattctaccaactggttcacaattctggaaaagtgccaagaagcaaatacccggcaagatactgtccgttcattcctgagatataataaaatagatttatttaaattttttaaagaattttttatataaaaagtttttggacgaaatacatcatttaatcgggaaaacgagcttacagagaacgagataacaactttagcccaaatgaaggtcaaaacgccgcaagctaatagtgagttcaaagcagcttaatagactggcttttccatggcacgtttaacgagaaaaaactattagcgtacaattaattaagtattaactattatattttttaaaaaataatttttaaaatttttaaaatattttttttataaaaaagtttatagaaaaaaatactgtgagcaacttagaaaacatggttatggctgtgtttgctgggggaggttgggaacaaatcttcttcgcacggaaaacggagcggtccattaacacgtgattaattagaaattagctaatttttttttaaaatgaatcaatatgattttttaagcaatttttgtatagaaactttttgcaaaaaacacattgtttaacagtttaaaaagcgtgcacgcggaaaacgatggagaggtgctgggaacccttgggtccgaacacaccctaggatcttagggaaaacaagtcctactagcggccaactcacaaaaggctgat

SEQ ID NO: 44716 - DNA, 1526 bp, Oryza sativa
ccaaaagtctcaaagctgagagcggagcacacagattcctttttccaggaatatgcaggaggcagtgtgctgttgtcccagtatggcacggatcaaatttatccatcttttttttcacctttactttttactgaaatttatacacatacccttttgaagcagagttgcatacccattttctttttttggttgctatacaacggaatctccttcagacgtgatgataccgattagttatcaagtcctaatacctaatcggtatcgggtgatacatatcaagtatcatacgattctaccacgtattaggtgatacttggttattcctattaggtatacgattcttaccacatagaaggtgatacttacgagatattaggtgatacctattaggtatcatgcgattcttatcacgtagaaggctatacttgcgagatatcaggtgatacctatgaagtatcaggcgatacctactagataataggtgatttctactgggtatcagaagctggacatacctgacgccgacgccgacgaccactaccgcccttcctccccttggctctagccaccaccgccgctccctttcctggctccggctaccaccgctgcccctccctcctctagctcttgccaccgtcaccactgcgttccttagcttcggccaccgacgcccctcgtctcttcgttgatgtatcccccgccgccggcttggccgcgacgcgccgctgcctcgacgcgacacagatggggtcctcgacaccacggcagctcaccacaaggggctcgtcgccggcggcctcgtcctcttctcgccgagcaggtcctcttccccagcccgcgccgaaggtcctcgccaataagcggcaaccacctcctcctcatggctcaggcgttcagctctcgcttctctttggataggcaaggaggacaaaggatcccgtcccaactggatcccggtgcgtagcatttccgtttctttttttcacattttttatgggtgtctatttcacatggtaattagacagctaattccaagcttaaaacctggcttaatgctactgctttttatcctaggaatctattttgatttctcaagaggatgtcttctcgtaagcttaaaaaccattcaaatggttataaaaaaaattctaaaaaaattaacaacactcatacaatttacttcctccgttcaaaaaaaaccaacggatgtgaccccctcctaatacagtaaatctaaacagcacttaatccaaatttgttatattaggagatgtcacatccttttaggttgtttttttggtgacggattttttttttacggagggatggagtatatctcacacagctctagcacgtactcctatctcacacagatttatcacaaatcatacacttttttttaatatcttctacactgcactttatgaatatctcatgtcctgtcttccacaggaaaaaaagtgaaatagtgaaaagattcagaattaggaagcatctaatcacctaacttgacagcatcagtttca

SEQ ID NO: 44717 - DNA, 2414 bp, Oryza sativa
gccaaacagtttcaagattacttacaacttatccgttccctccatatatctctctcccctcttctccacctctcgctactccaccatccaacgtgcgagaagccatggcatccatcccgtgcaccttccagctgagcgcgagggcgtcgtcggcgtcggcggcggcggcggcgaggaggtcgccgcgggcggcggcgaggctggggtggctgcggccgtcgcggctgagcgcggtggtgccggcgagcgagagcgggagggtggggccgacgtgcttcttcaagttcgggaacaaggacgccgagggcgccggcatctacggcagccagggcagggacgacttcgaccgcgacgacgtcgagcaggtgagccagcttctcgttcttcctcctccccatgttgccttaggtgttccttgattgctccagtccatggggaatgtgctgacgaatgactgagatgctaccttaccactgctatattacttggtggattggtaattctgatcctaatgtgagacatacgaagtagttgattgctatacttgctagtttggtttgaggacaaatgatgcagcatttgatttgagttgaattaaggcatgtctttttccttatgcttatacttatcaaccaacatttgaattttaaatttggagttgatttagaggttttttcattgaagtatatttttcagcatttgcttttaaatctctaagaatatacatataaaagttttatttacaaattactttttatttgcaaatattccgtttcgcttgcttcgcttattccgcgaataagcaaaacgatggctcgtatcatagccagcagtagcaaagaggaagagaagaaaagaaaaaaacaacaatcacctcgcaatttagtctttgtagtttcatggacaaaatgcaaattgcagctgcagggtatctgaaattctgaatatgctaatcaagaattcaagatagctgtagactagcacattcagattgaagaacagcacctgaacatggaaagctctagtgacaagaaagattcagaatagtaactttgattcctgagatgagattctgaatgtatctgaatctttctgtctgcgcttgtagtacttcaactacatggggatgctggcggtggagggcacctacgacaagatggaggcgctgctgaaccaggacatccacccggtggacatcctcctcatgctcgccgcctccgagggcgacaagcccaagctcgaggagctcctccgcgccggcgccaagtacgacgtcaaggacgtcgacggccggacggcgctcgaccgcgccgccgacgacaccagggagttcatcctcggcttcgccgccaccttggccgcctgatcgatcgcttcgccgacgacgacgaccttgatgcctggatatgtttcggctatactagtatactacgtatttatcttttcttatttttttctttttcaagtttctccaagtttttcttgtgtttggtagagtttagccgggaaattcacaagttgtttacagttcaagaggaagtagcttcatctgtatctttcactttcttcgctgtgtgaggctatgctttgtagaaattgttgttacaagtagtatcttccactgtttcaatatgaaagtaagaagaagctttggatgcatgatactattggaattggaagctttgatgttcacataataacatgttaagatgccaaatcctaacagcaagcaatagcatgaacttcaagcaaagcattactgcaacagcaagcaaaacttcatcctttattgtctcagattaactgctatgtccatgttgccgtcagtacatgttctatgtactagcctagaattacaaacagcatttcgccgaaagattcacttgggggaaacaaacagtctgcgaccacagcctcaacaacgaaattacgagtataaactctataaaccccctcatgaatccgccagatcatattattcttttcttcttctatattcatcttggtatatatttctataaggactgtgaatgtactcctacctacaaaacattgggtaaatggcagttgtacttcaactttggatgtgaccggagcgcttgctggagcgccgtgtccaccgtcacgccctcgcggaacagcttgtcatacaggaggcagatgaactgagccatgtactcctcatcatcgaaatctttgctgcgatcgccatttttctccatgtcgctgtcttcccagtcactcgtagggctaacaggttccgcctcagactcggaagcctcatcatcggcaatgacaaacttcccgttctcaaggctgccatttacttccatcccatggtatactatagactgggaatctggaggctccatggccgacaagatgactgcttggcaccagaatccatgaatgct

SEQ ID NO: 44718 - DNA, 2070 bp, Oryza sativa
tgtaaataacacatctttactacagcattggcagcaattagagtatgtctgacatttggttcctgactaaattttttcagtaatgtgaggcattgatcattggccagattttggtttggtcaatagctggccagattgatcattgaccaaatatgctcttttctatgatatcattttgatggctgcaccatgagaaaaatatgaaggtttgatcttaaatttatagttgactggaggaatcaactaccagtaatgtactataccagaatttagttggaaattagcatccaatttcatcagatgtcacttgcatgaatattttgtcacatgtcctttctaagcacaattaacacactacataagaatagaatttgaagagcatttcagtggaagtgctagctatccaggctggcatataccatccatcgaacatcttcaggtgtcatatgagcagcaggcactgtcctcctgaacatataggcaccaatttcttgattatcttccattacctgcgacaagatagattattatatgcataatgatttgtcttggaaacataaagaaggaaaacagttcctacttgtgtttggcgccctatatagcggtggtgaatcccaccaatttcaaacgacggccactctgcaaccaactcagacaaacatgaaatctttgacaaggaatatgcaccctttctcttacatccatgcaacatggctgacaagctagttttcacacactggagaaacctgtctgcaagttcccctggttccgcaactagggtctttttcattctgccagctgcggtagtaatttttgcatcacataatcaaaactagagaaaaaagtaaacacactgacgcttatttcagtaaaagaaatcgtgataaaaaatacctcaatattgagccagttgaatcgttttgaagtgccatatgtatcacaccaacttgaggcatattttgcaacttatcatatagtgattgaacatgtacagatggctgccatgacttaagaggtgacgttggcggcgaggactttgcagttgggttgccatccaggctaagcggcggaaccaggtcaattcggccaattctttgggtgccctctggactatatagaagtggactagatggaaaactgccagtaaataagggagaagtaattggagtcggaagtgtggtagctgcctttccaaacccagaagcactgttcattagagtaagcctgataccattctgggagcagaatgtttcaagcgagcgggcatgatttactttcttcccaaaatcaggactatatgaagcctctacaagtaaaaccacacgcctccatcctaaggtaggattactttcactaaaacctgaattagaggattgaaaaatgaatcaaccaaatgttccttcgaatcattacacaaagtgcaaacctggagaagacaaacctgaatttgatggcttgaatcttgaaaacaacattgatttggtagtttcagatgacttttcttcctcttggtatcttggaactaaaagctcacaaacattcttgaaatcttgaaagtttttctgaatgtactcatcagttgcagcttccaacttaagccagacagcaggatcagtctcatctagttccataccacaccgctcatcaactgccacagtaacaagattcccattctttcaatatcaaagtgcattggtaaatatgtactagaactcattaaacagtacactatgatcgagttgctgttctgtggatttccttggaactcaaattacctggattaaagcggaaatactgcatttctgggagcattggtatcagtgtatccaaagtttcttcaactctctctacagagcatgaactttctattaaaacttgccctgtgtccaagtagcgccacccacctctccgactctagatgcataacacatggaataaatttatatatataagcaatgtgatagatgtatagctcacaacgagatcactggaagtgtaaacttaatgtaccatagaagttaacttttcaaactaaaaacaaaaattattcatcttggatcagtcaggtgt

SEQ ID NO: 44719 - DNA, 2878 bp, Oryza sativa
  unsure (1)..(2878): unsure at all n locations
ttttttgcatttctgtctctgccactgatacttaatagttgtaatgaataatagtgttaacaaaagagtcgacaactatgatgtatattaccttagttggaactgaaccacaccctattgaaactagacatctattctcgtatcaggccacaaaagttgtgcctctcttatcgcaaagattgtgggattgttggctacaatagctccatcctgccaacgatttacgtctgaagagaaaggaagaaaaaaaaagggctataagaactgcggtggataacaaatcttgaggactcaaacaaatagaggcctactgttcttgcacaaaacaatatccacaactaagtttaggaatatctaccatcagagaaatcatccagataatatggagctgcagaagatgctcttatggcttcccatatgcgatgcttgcagctacccatgaaagcaccacgtttaataccaaccggtgcaccagaaacagcagttccaaccgtgttaattggtttaataccgaccggggcaccagaaacgggcgttccagctgagccaattgatgggctttctgtcatgactgatgatacttccacagtgccaggtgggtactggaacatgttatgaggttaacagatggcccaatattcaagaagagaaaaaaaaacttgtgaatctgcactcttcttcagtttcctgactaataagcacaagcattgacatggtcatgcacagactgtatatatggtaagaaaacaaacctggtaatttcggaatatatatggttgggcaggcatgacactgactaaagtagatacagcaaaaaccttcggaatgccttttacagcagactctataaggaggtcaccatcttcatcagcacacatttcctttagtaacctctcaaattgatctgcactgtgctgtaattaagactttggtcactaactacattgtgtcacatgaaagaccacatcaataacaagttattatgttatttacctttgatccatgtacaaccaccctaaaactctgtgatgaacttttaaaaagctgatcaatcttctccttccacgttgcagcttcatccttgggggcaggttcagcaaagacaagtttgcctggagaaaccaacagttcacttggcaacacaataagaaaaatgtggaaagtaagagccaaaagacactcaccaagttttgtgtatatttcttcacattgatccagagtcatctgcttgactccaagagccatcgcaagcatgccacctgtcgatgtaccacatatgaggtcaaacatttcatgtatgcgtttcccagtcccttgctctatctgtttaagaatttggacagtcgcaaggcctttcatgccaccaccatccattgatagaatgcgcagacccttctttgcaactggtcttcctcttattgctcgacgcaagttctcgttctcacctaaaaggattgaagagatattcacaaactaatcaacacatatagttattgaatattcaggaaaatggatcacataaattaagattcagtaccaaaacaagcatacctagaattgccaaagcacgtgcagctgccttgctgacacgcttctcttgtgaaagagttaagcgaattaaaaggtcgcgcaaactttcagagtgcatgagggtgcgacgagtctccaagcagaaagccaaattgccaactgcaaatagagatagacgttgcacctagaaaatgggaacagatacaagtgagctcaccggtgggtatcgaaacaacacatcaaccagagtctaaatccagatcatcttgcctcagagttcttgtgtgcacaaagtgttttcagtgacttcagaacgtctttcgtcaacattttttgagcaacatgatcagaaacaaaagttaaggtgactacaacttgcaatactgattctaattcttcttcattaaatgatttcagtacagcttcaataggcttcatgatatcacacttaataagtagcatagctgatgaaatatctgatcccagtgatgaaagagcaaggcatgcttgctcaacctgcaaaagtaacttctaaattaaaagaaggaactgtgttgtgcttgaaatgagcattttgtttccacagaactttgagcacaatgaattagggagattgaatatgtaccacatgacgattatcactgcttatcatgcttataagctgcctgacagcattttcttctttgctaattgcaacttggttgctacgatcttccattattttggccaaagcagaggctagcaaagggtggtgacaggaagagaaccgaaaaacaagtgaaaagaaggcactaagtttgtgcctggccgcaacgaagtaggaattattttcagtctggaattaaaaccaaaatacacacttatcaaaaggattgctagtagtgaaacaacctagctaacagaataacaatgcaggatagtttaccaacctcaatttgtacagtgacagatctaagactttccagtgcttcaattctaatatttgcaagtgtgagatgcctaaggttatgcagtggcaaaatttctgggagaaactctagaggatttccaaacaagcgcaatacacgcaacttaggcattgacctgttcggaacaaagaatgaataattagcttaatagcaccaacaggaagaaaccgtcaataaaaaaatgcctctgtaagacaattgaataacctgaaatccagtaatgggcggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 44720 - DNA, 2035 bp, Oryza sativa
tcacttgccgattgcttcagggtttcgtgcaccgttcagcaccccaccttcctcggctaggccttctgttgtgccccccacaggtacttaaaaaaacaacattacttcgacaatcaatttacatacattttatgtcttagcttacaagggtcccgttgtcgatgtgtaggtttcgcccagttcgctatgacgcaggccgcccacttctcccaggctgcagggtcagcgtctcaggcagctgtgtcgacctcgcactcagcgcagttctggcagtacaccgggacttcgtcacaggcagccggcatgtcgagtcagggtccaccactggaccatgctgggacctcgtcggactgcttgttgccttccaccttcctcttcgacatcactgacttcgacttcgcttcaggctcgacagaggacatcatcggcccctcacagctgggaggcgcaccgccggtgcagacgcaggaccaggcgcaggccactcctccgcgggacactcgtgctacccgtgctgtgccaccggatcgtttcacctactcccaggaccacgtgcgagcacaggcccggaggaccaagcgtggtcgcggcgcggggcagggccagtagagcagtcttctctttgtttacttgcttcactttccagtactgtatgcttgtgtaatgactacgttgttgttatatgtgcacgatacctttcggcgcatgcacgatacctttcggcgcatgcacgactactttctgccgcaccgatgcaacctcctttattcgcgtgtgatacgagtatttgcccgccatttggcgcatacgaccaatgtaactttcggcgccgatcatgcatgtatctttcagcgccaatcaggcgtacccaccataccccaccacgttcacatgtcaggggtatcactcgattttttgcgcctatataagtcgccttaacgagtgaggcctcacaatctttcagaactcagtcacattcagtactctcttccccacttgcttcattacaaatccgaccggctttcgtcaatggctagacgccgaggtgttgaggatccaaactggcgtagcgatccttgtgtatacctactaccaccttggtgccagcgtcctctctgcctatgcggtgatcgatgccaactaatggcttcgaggaatcctgatattcgaggaaggcgcttttttaggtgccctaactatgaccgtgaggtatcttattatctgcatatgcttattcattccgtatgggcaatcgctttattcttcgtaacactactctattcggcagacccgcactatggcttgcgcatacatcgagtgggtcgatacagaaaatcccgttctcaacctaaccacttgtttacaagaaggtcgctggtatttcgcatccgaaagtactgagcaatacttacagagaaaagcggcttatgaacgacaatgtcgtgaacaacagagcgactggcgggtgctaactacggcactccctccatgggaagcccgtccaagatgcaggtgtggtgatcgttgtcaggttcttcgttccataaatcctacaacattgggtcgaaggttctttatttgtccaaatattcttgacgacgatttcatggtaagaatattttgattacatgaatccttattttctcacaacatttactaactttgcttgctttacatctattctttcctcccaggaaccaccaaggagatgtcaatacagagaatggatagacaccagaagggttctaactccacctagccgtgttgtgcagcttgaactaccaaagcaatacagggttactaaagcgcggtttgagagaggagagggatcctcacgtaggggttagctattatcggacaacttggcatattgaaatttctactgtcatgcttccttgtcccattactacatcgtcgttgtgttcaactattgcactacctccctcctagttcgaatctaatatcatctatgtaaccgcaatgcaaatagttgtatcatgttcaaattgtactactatttcttcatgttacataa

SEQ ID NO: 44721 - DNA, 17720 bp, Oryza sativa
caagctctttatgggcggccaaaattgcaattagccccttgccgccagggcctaatcgcaattttggccgacggcggcagacggcgcggtcgacccaccgtctgccacgttagcttgccgcccaccattagggcggcaggggctatttctgcaatttttttttggtcgatagattatttctgtaaatattaaaaaaaaatctaaaaacgaaaaaaattcggtcgcccacattctccggctcgagacgacgcaatcggcggccagcgtcggcggcgcgcaccgccggccggtgcgccggcaggccgtcttctcctcctcctcctcctcctgcactaacgcctgcagcttacttgcaagccgccccagaagcagtcaggtacgggccgccgcctagtcgtagctgcggtttggtcaccaagctctctggctcctttgctgtcttggtgttcttgattaatttcgtaagtggtagtagctcgttggttggtgtcgttgtgaaatgttgttagcgagggacgtcaggtgcggattgatgtacaatggtctcactgctaaaaatcaatggcaagagagaacaatgatctccttgacctagggattgttgatttcgatccgtggataaactatatattattaaattaagtctgtattccgtgatgcgatttgtggagtctatgaattcttccaggtctatctatttggcggtgtatatatttttttgttcttggaagttggccatgatgtattttcagaatatgttatccgaactgtcgtttcctttccttttctgcccatcttttcagatctatgtgaccatcaagttcattgtagtataatgcactgattgtgccgacattgttaaaggaatggtcatgctatataaggacatgaatcatcttcagatctgcttatggataaattctaaactatttagttgggcgataaattctaaactactgttctgtattgcagggcaatgctgttctcagaagaactgcagttacagtaaatttgtctgtgtactcaggcacgtacataaaactggagctaaccttctccacttcgtatgtactaactcgcttctagttcttaaaatgcctacctatttttccttgctcatattctgcataataatataccaaggataaaggatgcatgttctgcatacatggtctgtgctgctgtgccaaggctaaaactagaccttataagatcgcatagtgggatttcctacaggaactcagggagaactcctgtaattgttgactgagtttcctgcagtcacaaaaagaactaaaaactagaatattgttgaaaatgtcttattacataggccatggattgtttccttaggaatgtccaagttgttgccaccagttcttttcaatcttttgctttgcttgctgtgcaaaatttagtgctgttgtatgtaaacattctctccaactatgagcaaatagtaacgtctttcttctacctaatattagatccaaagaaatattcagttcatctctttctttgcttctggttatgtacttccctttttgacttttatttttcgagggtagtcatttatgtcgcacttattttagggggaaatgtgattctttgactagcataaatgcagaaattctattggctagcatcattttttcttttagttttacaacttgatgatgaactagcttccatttattttcagttattcacatatctcgtgctaagctgctcctattatgtggctagggatggagttttttttacttataaactaatattttataagttatcatgaatcaaccttgctgctctggtgacaacaacgagagtttgttaaaagaatcctatactgtttctttatgccccattctctcctttgctcatttgtctgtcgtatgacttttgagtaagtaatatattccaatgggctacctacgccttctgttgagttctaaagaaaaatactaaatttgttaaatcataatcccttatatatcatgcagattgcagaaggaacaactctgtattacctctatatatgtataaaaatccacaagctgatcatccaacctgcatactgcataacaacacaccatgtcaatggattcatccatgcttctagctctgctgcttgccttgttcatacccatcctcctccaccttgtcactaggcgcaagtatgcatcctataatctcccttcaggttcccttggctttccattgattggacagactatctccctactccgtgccctccgcaaaaacactgattaccagtggtaccaagacaggatcaagaagtatggtcctgtgtccaagatgtcagtgtttggttcaccgacagtgctgttgactggcccggcagccaatcgctttgcattttgcaacccagacctcattttcacccagacaaaggcgctgaacgccctcgttggcggtccattctgatgctctcaggtgaggagctaaagcaagtccgcagtgcagtccagggctatctgaggccagagatggtgacaaagtacatttggaagatggataaggaagtcaggaggcacattgacctgcactgggttggtcaaaagactctcacggtatgaactttgtgttttttttttcatttttccgcttaatgttttcagcattgctagatccttatgtataactcaaaacaacttttcatgatatggaaatgtatatgtgtgattctttcatgattataggttgcaccattggcgaagaggctcacctttaacatcacctgctcagtcttctttggagaagaggcaggtcctatcagagaagccctggcaaccgacttcgaggcattggtgaaggctacactatcaattccagtaaatattcccttcaccaagttcaacaagggtttgagtgcgagttggaggatcaggaagttgctcagtcggattgctcgtgagagggaagcagcgttgcagcaaggccgttgcagttcaactgatgatttcttcacatacatgattgcattacgctccgaaggcacacacttacagtggaggacattgtggacaatgcaatcttactccttactgcaggttatgagacaacttctgttcttatcatcttcttgctccggtacctagccaatgagccagacatcctgggcaatataactgagggtgagcagctagtacttttgatttttcaatcttcttagtatcactgctatcattggtacttatggagttatggtgaatccgcagaacaagaggagatcgctaggaacaaaggacctaatgagcctttgacctgggatgatgtgtcaaggatgaagtacacatggaaggtggcaatggagacactccggactgttcctgcaatctttggaagcttccgaacagctatcaaagacatcgaataccagggctatcacattccaaaaggctggcaagtaagtgtttttctgtcaagtaattccgttgtgtcattgaatatctttttggtcgcccatgtgcatttgtgtatcagtaatatgcccatctgaacaatatacccaactgttaaattcctccaacacattttctgttctatgccagatcttcactgatcaaattgtcacacatttggacacaaattttttcgatgggccgaggaagtttgaccctgctagatttcataaccagtcttcaatcccaccctattgctttgtgccatttgggggaggcccaagaatgtgccctggaaacgaatttgcaaagactgggacattggtggccatgcactacctagtgaggcagttcaggtggaaattatgctgcaaagaagaaggttacaggaaagatcctactccaatgcctcttcttggactcccaattgatcttgagaccagaagcccccctggatatgctcattcttagagtaatccacatgtttctgtttactttttgcgttttaatttatgctttcgctagttggtttaagagttgcgagtgttgcagatatgaaggtttggtaaagttgttcagaaatgtagtgacttatgatcaaaggtggtacagttttgctgataaatgtgtattggtgtataaactatgatgcaataaataaacacagatgccttatgagttatttttcttttgtttttttcttaaaaagaatgtctaggttatgctattgggtaaatcagccagctggttactctgatatgcaatgaaccaaaatataaaaatggtactgcaatttacccatagaaaaggtaatgcactaaaacacaatcgcactgtactagcaaacaatagtacttgtcctttgtctcagacttgctatctgatgattgtatcggcagcaaaggtcagtccttttacattgcttatgactttttcattcacggtggaggacatcgtggataatgcaatcttccttctgattgcaggttatgagacaacatctgttcttatcaccttcattccctggcacctagacaaggagccggaaatccttggcaagtcgcccagttgcagctgcctgtggtttggtcactacacctcttgtgtcttggattcatgatttctagcttgcagttggttggtgagatattgtttgatttgttcatgggggatgagcgagctgtcatggctcagacgcaaatctgcattcctgatgcgatatcaagatctatattgtggagtctatgccttcaaagtttatctagatttgtctacataatttttttgttcttggaagttgaccatagtggattttcagattatgttattctaaacttgtcgttttcccttttttgccaggttttcaggatctatgtggccctcaaggtcgttgttgtgtatcctgataatgcactgattgtgccaacattgttaaaaaatatgtcatgctatattaagggatgaatcttctgcttatggataattctaaaagttctgtattgcagggccataccattttcagaagaattgcaggtacagtgaacttgtccttgtgtgcacaggcacatacatagaactggagctaaccttctcaaatctcaactatgtacgtaattcgcttcttgtttttaaaatatctacctattttttacatgggtcatattctacttaataatataccaaaaacaaaaggataggtgtcctgcatacatgcctgtgccaaggctaccttaagatcgcatagtggcttacctgcagggagaacttttgatcgagagccctgcaattagaagaattaaaatcttgaatattgatcaaaatttctcattacgtaggacattgatcgtttccttaggaacgacatcagatcttctcaatgttttgcttttgcttgctttgcaaaatttagtgctgttgtatgtaatcattctctccaacaatgagaaaacagtagcatctttcttctacctaatattagatccaaagaaatattcagttcatccaaagaaatttttttagggaatttgtttctatgtcttcatttgacagggaaatgtggattctttgactagcataaatacagaaattctattggctagcagcacctttttttaaaaaaatttcaagctgatgttgaagtggcttccatttattttctgtaattcaccatgtcgtgctgagctgctcctatcatgtggctagggatggaattgtttacttatgaactaatattttaagttatcatgaatcaaactcattgctctggtatgacaactaacaacagcgagggtttctttaagtaacctgtattctgtcttctcgcctcctctgaatttgatgtctttgccttggcctatgctttggtcatctgtatgttgtatgaattttgagaaagtagtataatcaggtgggccacctagccttctgttgagttctgaagataataatcaaatttgttaaatcattctttcttgtctatcattgagaaaggaacaactctggtttacctatatatatacatgtatacatatccacaagttgatcacccaaccttcatagtgcataacaacataccatatcaatggattcatccatgccttttgctctgctgcttgccttgctcatacccatcctcctccactttgtcatcaggcgcaagtactcatcctataatctccctccaggttcccttggcttcccagtgattggccagagcatctccctacttcgcgccctccgcagtaatactgattaccagtggtaccaggacaggatcaagaagtatggtccagtgtccaagatgtcagtgtttggctcaccgacggtgctgttgactggcccagcagccaatcgctttgtattcagcaaccaagacctcattatcaccgagacgaaggcagcgaacgccctcattgggcggtccatattgacactatcaggtgaggagctaaagcaagtccgcagtgcactgcagggctatctgaggacagagatggtgacaaagtgtattcggaagatggatgaggaggtcaggaggcacatcgacctgaattgggttggtcaaaagacagtcacggtatgagtgttgtgttttcttcttcttttcccacttaatgttctttgaattgctagacccttatgtgtacttaaaacaacttttcgtagtattgatatgtatatgtgtgatactttcgcgattacaggttgcaccattggcgaagaggctcacctttgacatcatctgctcagtcatcttcggacagggggcaggtcccatcagggaagcccttgctgctgacttcaagaaaatggtgcaggcaatgctatcgattccagtgaatatacccttcaccaagttcaacaagggcttgagtgcgagccggagggtgaggaaggtgctcaggcaaattgctcgtgacagggaagcagcattgcagcaaggccattctagttcagctgatgatttcttcacatacatgcttgttttgcgctccgaaggcacccactcactcacagtggaggacattgtggacaatgcaatcttactcctacttgctggttatgagacatcgtctgttcttatcaccttcttgctccggtacctagccaatgagccagatatcctgggcaagataactgaaggtgagcaactagtactctgtattgtcctcatattttgatatttgaatcttctgagtagcatcaatatcatttgtacttattgtgaccaacagaacaagaggagatcgctaggtacaaaggacctgatgaacctttgacctgggatgatgtttcaaggatgaagtacacgtggaaggtggcaatggagacactacagactgttcccccaatatttggaagcctccgaacagctattaaagacatcgaataccagggctatcacattccaaaaggctggcaagtaagttttctttttttctgtgaactgattccattttgtgacattgagtaacttttccattcccttatgacattaatgtatcagtgatatgtccatctgaacaatatacccaactgttataggcttacagctctcttaacacattttctgtgctatgccaggtcttcactgctataattatcacacatttggacgcaaatttttccgatgacccgaacaagttcaaccctgctagatttcataaccagtcttcagtcccaccctattgctttgttccgtttgggggaggtccaagaatgtgccctggaaatgaatttgcgaggaccgagacattggtagccatgcactatctggtgaggcagttcaggtggaaattgtgctgcaaagatgaaggttacaggaaagatcctgttccgatgcctcttgaactcccaattgaacttgagaccagaagctccccctggatatgcttaaaatgatccacctgtttttagtttatgctttcactagttggttgaagagttggaaatgttgcagttgtgaagatcttggtaaagttgttcagaaatgcagtgacttatgatcaaagctttggttcagttgcgcagataaatgtgtaatattccctctgttatttaatagataacggcgttgacttttgaacacatgtttgaccattcgtcttattctaaaaatttatgtaaatgtatagaatataaatcatgcttaaagtattttgagtgataaaacatctcacaacaaaataaataataattatgtttttttaataagacgaatggtcaaatgttcaacggcatcatctattaagaaacagagttagtaagacatctgcttagggggttccttttcttttgtttttctgaaaacaatgtctacgttgtgctattgttgggtaaatcagccagctgtttactttatttggatgcaatgaacaaaaaaaggataatttaaaattaccattagaaaatgcaatactctaaacacaatcgccatgtactagcaaacaaaatacttgtcatttgtctcagaatttgctatcgatgattgtatcgctagcagaggtaagtccttttcctttgcttttttttttttcattcacagtggaggacaatgtttagttgtcacagtgtattactctattccctaaatgattataaatatttgatgtttaggataagatttagtcaaagttttgaaaattcgagaaaaaagtctatagtgctagggaacaaagtctatcaaccaaagaaaaaaaagggtctatgggttattagtctcataattctctttcttataaagaatttgcacaaattttataatattgtagtgacaaagtccctgtgtgaggtatgtgggttctttctggtggtaaaatatgttttaaaaattttaaaaaactttttcagaggtattgccaagtgaaatgtcaaggatggtaaaacatgcttattttttgcatctcaggacattgatttaacttatataagatgcaagagagactttcatgcatattttctttgaatgtcactttagccaagaatgtttggtcaaggctgcttatcatgtggaacacaagcctaagctttgagcagatgttgcagtcggctatggataattgcaatgccagggtttaaactttgtggaaaaagttctatatgcttcccgaaatatttggaaaacagaggaatgacttcattttgaagataaagcaccttgccaccttttgtacatccctggagttgccttttaaaggatgatctacttttacttttctttcttttaagtcatgtataaagagatattctatcatcatggattgacttgttgtaatttcagtttggtacttttttatttcttggccctacttaatgtatcacatggctattcttagtcaacatttctattagaaaatgtcccttttgcccttacttttcgtaccatgtaaaaagagaaaaacaaagatgaataaatagaattataaatgtacttcctattatttcattatgtgcacacaaggttgagctttaattacataattattttctttttacataaattactatgcatctatagcaaaattcattatatgtgatttcaaaaaaaatcatataattattggatgtatgtttgatagaaagttgggtatttaaagctcaactttaggggatcttgtcataaagtttcactgcctcattagtaaggtatgttcttcatttttgttatatatgtgaatgaggggtataagggtaatttatcaagagatattgattatgtttagccatgtggctccttaaatgggttcaaggatgagtttgagctagaattaaaacttgaaagagtaagatgggcagattaaaatgtcaaagaccaaactaaaccttagatgaaacttagaggaccaatttagctattcacccttaaaatttttttaaaaaaatttaaccaccaataacttcttaaatgtttaattaaaaaagataatatttttacttgaaaaacactttcataatattgttagctattaggttttaaaaaacttgttctgctaaaatagtgagagtaaatttcataaaatcccacgtattatgattcaaattgcacaaaactacaggaatttcggcacgtatcacataacctctaatatgattctaaagtttcacaaaaccgtacaggtaactttgatctaccacattttaaaattctacgataacatcttaaatttataaggatttaatccatcatgtaaacgttaaatccactttttaaaattttgatataggaatatgtcaaaatggttcatggtgtgatttttgtgaaattttatgaccatacaacgcgaggatgtgtcatgttccaaaatccctatgtttttgtgtggcctagatggcagtcttataaacaatctactttaaaaaccatgatcgaagcttaaaatcctgatcaaagttaattaccatgaggggcggacataaaaccggccttccatggaggtagggctggtcatccgggcatgggcctaggcaaggcaggtcgcccacattctccggctcgagcggcggctcgtcagctgcgcggggctccccgtcggcggcgcgcaccgctcggcctgtggcggtgcgccagcgtgcaagcttcccctcctgcatattacctgcatgacgccccccaacaagcagacagcgcagtaagaggtttgagtcactagctattaggtgtcctaggattattgatttctagctttgcaattgattggtgagatgtagtattgatttgtcccacccgggcggctgaacgagtctgtgaatctgtgttggcgcagatgcagttggggtgggtttcggtcaggtctggtggtgtggattaaaaacagtgacactgcctaaaatcgatgtaggagaataatgatctcctggcctgatgattgctgatttcgatccgtggacaaattatattattaaatcaaatctgcattcgtgatgtgatctccaaatctatattggggagagtctatcccttcgaagtcttacctatctatatatctatctatctgtctttatacatattttgttcttggaagttgactatagtggattttcagaatatgttatccgacctgtcgttttccttcccttttttttgaaagtttttcaggatctacgtgatcctcaaagtcaatttcgtgcatcctgataatgcattgattatgccaacgttgttaaaagaaatggtcatgctatattaggggaggaatcatctgcttatggataaagtctaaagtattgttctgtaatctgtattgcagggccatgccattttcagaagaattgaggcaacggtaaatgtgtctttttgtgcacaggcacatatatagaactggagctaaccttttccactaagtacgtagtaatttgcttcgtttttaaaatgtctagctatttttcgtggcagatattctgcatactaatataccaaaaaaagaatagctatcctgcatacatggcttgtgccaaggctagaactatacttgttgatcgagtgctaaggctagaagtgttgatcgagagccctgcaattatgcagaagaattataatctagaatattgttcacaatttctcattacatagaacatggattgtttccttagggatgaccaaattgttgtcaccagatcttttcaatggtttgctttgcttgttttataaaatttagtacttctgtgtaaactcatctaccagcaaaacagtagtatctttcctcaagctaatattagatccaaaggaatattcagttcatctctttatttgcttctgtctatgtacttctttttatagttcttttttttttaattttagggaattcgtttttatgtctttcatttgagggcgaaatgcgattctttgactagcataaatgcagaaattctattggctagcataaatgtgattcgttgaactggcttctatttatttccagtaattcacaagatggaattgtttacttataaactaatattttaatttatcatgaatcagactcattactctggtgacaaacgatggtttgttaatgttatattgtcttcccgtccttctctcaatttgtaatctttgcttgtttgttgtatgacttttgagaaagtgatatattcagctttgccaactagtccttttgttgagatcaaaagaaaatatcaaatttgttaaaccatactcccttatatatcatggagaaaggaacaactctggtttacctatatatatacatgtatacaaatccacaagctgatcatccaacgcataacaacataccatgtcaatggattcatccattccttttgctctgctgcttgccttgctcatacccatcctcctccacgttgtcatcaggcgcaagtactcatcctataatctccctccaggttcccttggcttcccagtgattggccagaccatctccctacttcgtgctctccatagtaatactgattaccagtggtgccaggacaggatcgagaagtatggtgctgtgtccaagatgtcactttttggctcgccgacagtgctgttggctggcccaggggccaatcactttgtattcagcaaccaggacctcattttcaccgagacaaaggcgatcaacgccctcgttgggcggtccattctgacactctcaggtgaggagctaaagcaagtccgcggtgctctacatggctatctgaggccagagatggttacaaagtatatgcggaagatggatgaggaagtcaggaggcacattgacctgaattgggttggtcataagactgtcacggtatgaaagttgtaataatgttctttgaatttctagacccttttatgtatagttcaaaaaaactttttgtagtatggatatgtatgtgagctacttttgtgattataggttgcgccattggcaaggaggcttgcctttgacatcatctgctcagtcatctttggacaaggggtaggtcccatcagagaagcccttgctgccgactttgagacgatggtgaaggccatgctatcaattccagtgaatatacccttcaccaagttcaacaaaggcttgaacgctagccggaggatcaggaaggtgctgaggcaaattgctcgtgacatggaaggagcattgcagcaaggctattctagttcagctgatgatttcttcacatacatgcttgttttgcgctccaaaggcacacactcgctcacagtagaggacattgtggacaatgcaatcgttctcctggctgccggttatgaaacatcgtctgttcttatcaccttcttgatccggtgcctagccaatgagccagacatctttggcaagataactgatggtaaacaactagtactctgtatcgtgtcgtgtgcctgtaccttgatgttttaatcttctgactagaactgctaccatttgcaactatcgtgaaccacagaacaagaggagattgctaggagcaaaggacctaatgagcctttaacctgggatgatgtctcaaggatgaagtacacatggaaggtggcattggagatactacggacaatttctccaatttttggaagcttccgaacagctatcaaagacattgaatacccggggctatcacattccaaaaggctggcaagtaagtatttttctattgaccaattcccctttttgttactggatatcttttccatcccagttatgacatacgtgtcactatattttccattcccaagtgctatatttatttttttaccctcccaatcttgcgatgcaggtcttccatgctcaaagtatcacacatttggacgggaagtttttcaacgatccgatcaagtttgatcctactaggtttgacaaccagtctttgatcccaccttattgctttgtgccatttgggggaggtccaagtatgtgccctggaaacgagtttccgaggactgagacattggtagccatgcactacctagtgagacagttcaggtggaaattgtgctgcaaagaagaaggttacaggaaagatcctcttccgacgcctgttcttggactcccaattgaacttgagaccagaaccccccctgaatatgctcatgcttaaaatgatccatatgtttctgtctactaccatgaatttcagtttttggtttctccagatggtttacagagttgggagtgttgtagatgtgaaggttgtggtaaattattcagaaatgcagtgacacgttatcattgtgtagaaaaatgtggactggcgtatagtattataatctaattataaaaacagatgcctaaggggttcattttctttctgtttttatttaaaaaaagaaaggtctacggtgtgccattaggtaattaaatcagccagctagctagtttatctgcacatttagctcttctgatgtgaagttctagttaggttagtttcaagcgtttttgcagcctctcctccctgccaggccttatagtactcatagatgtgctcctgcatgtatactctatgattctgttaggttttctttgaattctggtttaaagaaaccagttcatatccagccttttttttcttaatctgtatctatctttttaacttgtgtctaataatatgggattgtgatctgatccagcttaccctatattttactctattatttgtgttcccacaatggttcatgttcattctgacttggacaaggcttcctaggtgaataacattgtaacatgacacatgagaaaccactgtgtcattactacagactgcatcttatgttgacaaacaaatgactttgttttctttgcatggaataacatattattcctatatacttgtacaattaatcctcacttaggtggttaataccattttcctgttctcttgtgaagccacatcatctaaattaggccagaccattggatgaaccatatgactttgtttaaaacgccttgatacaagagaaccatattgcaaggagccaagtagaggcatggatcacaatcccgatacaggatcaaaaactgctcgcgagcgatatcttcagaattagcgaaaaccattgataaactgacaaaaacgagaattagcgaaaaccattgataaactgacaaaaacgacaaaattcggacaaattttgtcaaaaaattaaaattcagtttgattttgtttaacttgacaaaaaaaaaatctagcggtttatgttttttatctgtcccaagaagtttggatccattggttttaaaccttgactagaggtagacacattactagatggaataagttcactttgactccctcaaaaatagctccaatctagtttatatttctgaaccggaataagttcactttgtgaccctcaaaagtgatcgaaatctaatccatgaccctaaaccacaaaaccggatatatggaccccccaactctcaaaaccggtgtaatttgactccctcggcggttttggagggcggtttcgctgacgtggcgcctacgtggcagtgttgactcggtctcctttccacgtggcattgacgtggcacttaggtggcattagaaataaaaaatatgtgtgggacccatttgacatggaaccactgacatgtggggcccacataaaatcatcctctcctcatcctccccctctttctcttccatttgctgtccgagcgctggcaggtgggccccactcgccaggagcttcttccacctctgtccgtcgtctatttcatctctcccgtgaaactcaagcactgccgcctccgttgatcttcctgccctatcgtttctcctccaaattaattgcaaaaatcgattccttgtgtagtgggcatcaatttccccaacaaatcccacttaatcccgcactaaatcgccctcaatcgatttcttaaaccggtgtcttcaatagggagctccaccgtcgccgacgttgttttccgtccgtgcggtcgacctcctcccctccggcctatataaagagagcccccgtgatctgctctttcccatctcctgcatcgctgtggagatttcataattaacaggtggttttcaccgtgctttgtggtgaatttgcaccggatggctgattttttttttggttttattggtgggtcacgacgcagaccctctcggcggcggcgcacatgacgccgtcgacgagctgcggcatggagcatttggccagggcccccgggccgcagccgacgcggagcccgacgccggccatgtagttgcagacttctgtgcgaatcatctcctgcatcgtgtagatgagatcggtgttgaacgggtatggggacggagatgttgccggcggcggcggcggcgagggcggtagcgaagggaagcaggagggggaggggaactcctggaagtggctccatgcgctgtcgtggtggaaccccgggtcctgctgccccgggagggagagggacagcgaggtgagcgtgtcatcgtcgttgagagcgcgatagactcaacacaatagattggattgatatcgggtgcggagtacatataggctcgaaacctcccttatccactcaaccgacttatagaaacagaatcgggagagacattaggagggatcggcacaaaaggaaacaaacatgcacaagatatatatctatctaacaccccccccccccccgcagtcgcaacggcgctggagcgaacattgagactagaacgaaattccgtgaagacagatgtcggcagccctttggtgaagatatcagcatattgcgatgtggttggcacatgaaggacacgaacaactccagccgcaacacgatcacgaacaaagtgaagatcgatctcaatgtgcttagtccgttgatgttgtactggatttgtagaaaggtagacagcgctgacattatcacaatagacaaccatagctttggagggtggagtatgtaactcgtgcaataactggcgaagccaacatgtttccgccacggcgttggccacggctcggtactctgcttcggcgctggaacgggagactgtgttctgtcgcttgtcgcttggaggaccaagaaatcaggttggcaccaagaaacacggcatagcccgaggtggacttcctcgtgtcgggacaaccggcccaatcagcatcagaataagcaaccaagtcaacagttcgagagcgctgaaaatgcaatccatgatcgatggtgccctgagtgtagcgaagtatacgcttgagagcggcaaggtgcggctcccgggggtcatgcatgtgaaggcagatttgctggacagcataggatatatctggcctggtgaaagtgagatattgtaatgcaccagcgaggctcctgtaatcagtcaggtcagcaactggggcaccatcgacagctgagagcttggcattagtgtcgaccggcgtagaacatggcttgcactcggacatgccagcacgagcaagaacatcaagaatgtactgttgctggctgaggaacaaaccagtggatgtgcgggtaacactgattccaaggaagtggtggagaggcctgaggtccttcatggagaattcagcttgcaaggcggaaattgtccaacgaagaagactgtcagaggaggctgtgagcacaatatcatcgacatatagcaggagatagaccacatcggaaccacgatgatagataaacaatgatgtgtccgaccgagcctcagagaagccaagtgtgagtaagaaactggcaaaccggctgtaccatgcacgaggcgcttgcttcaaccatacagggacttgttgaggcggcagatcatgtcgggtttggtaggatcaatgaaaccagcaggctgagagcagtaaacagtttcctggagagtaccatgaaggaaggc

SEQ ID NO: 44722 - DNA, 1251 bp, Oryza sativa
caatgggggtccgccaaggccgcacgataggtgcgaggcaccggcgacaagggtgcggcgtggaggttgaggcgatcgatcggtcgtcgtatgccagatttgccacgcgtgaccatggcatgttcattgtcggccggagaagcatcgaggatcggtggaggagcgcggccgccagggactcgcgcgctgcgagggcgcgtgggcgcgcctgtcggtggaggccgcagggaagacgcacctgtggtgggagctaggccggtcgacaggggcggctcgttggaggagccggtgttggagggggccgccgaatgggtggaccggggggacagcatggggtcccaagcgcccggtccagcggaggaaggcccagcctctgtgggccgagctggtgaagaggccggggacgcctgcctagccgagccggatggcgtgccgacggaggcacgcggcccagggggtgttccagccggccggctggagctgctgcctatgcgtcgaccgatgggagctggcagaggagatgaaaaatcctcaagaaagtccaaattaggagcatctgcactgttagtcatctcagcaaaaggaaacgagtgctcatcaaacaccacatgatgtgaaatatagaccctattggagacaggatcaaaacaccggtaccctttgtgattctcgggatatcctaaaaacacacacatgatggagcgaggggcaagcttatggggggtagtggcagataagtttgggtaacacttgcatccaaagactcgaaggtgtgtgtaggatgggtgagcaccatagagggcaaaaaacggggtgtggtgatgaagggttttggtgggatgacgattaatgagatgtgtggcagtatggagggcctcgacccaaaaagaaggtggtaggctagcttgaaacagcagggagcgaactatgttattgagagaacgtagcatgcgctcggccttaccattctgaggggaggtgtgggggcacgacatccgcaaggagacaccgttggtgaggaaaaaggtgcgggcggtagagttgtcaaactcacgaccgttttcacactggatgttccggatgctagctgcaaattgagtcttcacaaaggcaaaaaagcgtgataaggtggcaaaggtatcggatttaaaacgaagtgggaaggtccatacatagtgagagaaatcatctagaatgacatcgagcatagttgccggcgacgaggtctaatgtcacggggacgagagcctt

SEQ ID NO: 44723 - DNA, 1024 bp, Oryza sativa
ttgcaagaaggtgcacaagataaggcaagacctctaggagatcattctgcaactgatggccctcaggcgaataacacaagggctttcaacaaagggcacaagagaaaaacacatgatagatcatctaagttatcgaactctggtaaagggtctgcagaggatctttcggcagctggagatggtggcagtggcattatggagagtatggttgaagataaaagaaaggctcaaaggcctgcaaaaagagcacggaagccaaacaagacgtcggatggagatagacaagatgcaacaccaccaactgctgatgggaatgtaagtaatattggacttttggtttttttggcactacaaaattattgatttcgatgaagcaaagtagttgtttaacactgaccttttcttttgcagcaaactctgtcaagtaaacataatcaggcaggcaccccgacgaagaggaagaacagaaaagatagtcattcggagcaaaggagaggaaaggctccaaagacaaagaaagagccggctggggaaggaggtgtggataaatcgcttgtggagcaatatcgttccaagtttttgcagcatggtctgaacaaaaccaaaggataattaagcgtgatcgtcgtgggaagaacaacatggtgatccggactagcttgtcaaaaggctaataggtttctttgaactttacacaaacttcgcagccccaccatggtctgccaaaattttgcttccagcagtttgattgttttctcccacactcatgtcaatctttacccttaactagtgagcgtgcatgtgcaaggcacatcgatatatatactaagcgaagtatactggagaacgacacatccattgttgatgcacagcgatatatataaatacattgtagctcacatgcaccgataaaaataaaagtattgtaagcgttgctttgataattcatcaaataaacgtaaattggtattttattacattataacaaaatgcaaaatgtgtttttctaaattggaaattctac

SEQ ID NO: 44724 - DNA, 16561 bp, Oryza sativa
gagagaaagaaagggaaggccgttgcagctaattggctgcacattcttggaagtgaacagaacacgattcggcagatgttgcgtccatcaagaatccagaggaggagactctgcagttgacatacctgcaagatttttttttgccactctcttgtcctccaatttgcaaaaaagaaataggataaacacctttgatatattgatgtagttcttgctttctataaaagatggaccctctttggcttctgatcccaaaaaggatatgttagcggagttgtaggtgcatgactccatttatcaagatcaaatcataatatctacgatcattcatacatgagtgtgactcttgagcatatgttaaaggggtgtactcgcgaatggcagtccgtgtggtctgtatgcgtagacgtctttcatgtaatcgcaaaaggaaaaatgcagaaaaaaaggcatctatctccatcctagcagaaaggattgactgacatttgtgccaggagaacatattcttcttcagtgagatcagatcagtctcacaatataagaccacaagaggtatgatgaaaaatcacaaggaattgtcacctgcttgccttatctctgtaagattctccatgcatgcaaacatgcattactgttcaaatgttctatgatcgccaagttgatgtctgaatcagcataaataaaaatgtcctgaaatgaaccagcccaaaaatggaagaatgattaaaatttttcatgataatgttcaaatgttctatgatcaccaagttgatgtctgaatcagcataaataaaaatgtcctgaaatgaaccagcccaaaaatggaagaatgattaactttctcatgatataaagtcagaagcgaatgtggatcaaagttacatggagttttaaggtaggagtcttagaacaaatgtctctcatgacacaaatggtctatgcatggccaggccagcactgacaacgatgccaaagtatgctgttcccggtccaatggaaaagcagattatgctaaagcagatagcatagaactgattctataaggccagtcacaatggctagtgtcattgcacggctacccaaaatattataccatcttctctcaaatgaaatcttttatgaaacaatccccacagtggaggggtttcactttgacgtttccaagactaagcaaagcatttaattgatacaagttgctgggatcatttgtacccaaaatccggcgcggcgcgggagaatgcagaggtcgcacggcggaggcggacgcaagagatccggtgaatgaaacgaatcggcctcaacgggggtttcactctgttaccgaggacttggaaacgacgctgacgagtttcaccaggatgaaactctttccttctctctcatccccatttcatgcaaataatcattttttattcagtcttacccctattaaatgtgcatgacacaccagtgaaacccccattgtgactggcctaataatgtaaaaaacgctgaatcaaatgaactgaaatcctgatgttacaccaactaatcgaaggatgtgatacacgtgagcagggaccgcagatgcagtatacttcaagcaacaagtgagaagaaagaaacaggatcagcagaaaggcaaaatgcagtacaagtgagaatggagatatattagctgttcagttcataagttggaatggataataccaccaaaaaggcaaaaataaatgtttttagtttctagcaggaagatgctggatattacaccaacatggaaaacatcatagtatttctcagctccaacaatttagactataacaagatatataacacaagcatactgatagaaaacatgatatagatatgaaactgtagaaagtcttgcccagcaacagtctctaccaaaattttgcaactacacatggtatctaccttaaaaggaatatttctttctagcgatttaaattgtgattacaaccccaccagaattacaggccaaaaggagtcaagcgacctacataacacctagtgctgtaagatccatgggaatttccttttgcagcatcaccaaatcttcggttgcacctaggaagaacagcatcctctctttgtgttaacagcagaatcagtaacattgatggtggttccttgagtgggaggtccactgcctgctgcctcttgggcagcaagtgccttcttgctgatgatttgatgaatatctttaaggatagtctgaaatgccttctcaacattaagggcttccagagctgaggtctcgaggaatgatagaccttccttctctgctagtgcctgaccatcttcctctggaactgatctcaggtggttaaggtctgatttgttgcctaccatcataatgacaatgttggagtccgcatgatcacgaagttcacgaagccacctctggatgttttcaaacgtctgcttctttgttatgtcatagactagaagtgcccccacagctccccggtagtaagcacttgtgattgcacggtacctctcctgcccagcagtatcccatatctgagctttgatggtctgcccttctatctgtatacatgataccacactaaataagaaagaccaacatacctaatatggtgagccaaaataccaatatcatggataaatttaacttgagtatttgccatgaaagaagtcgctatagtatggtgaaattagattgttaaggtctattacaagttcactatatcagagccttatacaggcaaaacagctcccaaaattcagaagttctctgaaatgcaacaaattaatcaaaagactcatctatagaaacagtgtgtgttaaccgtcaggtacattcagaggcctacaacactaaaagaaaacaaaagagtaatggtacatacccccttccgacctccccaaaatgttacccttctcctaaaatatttctggacaggatccacttgtacaatctatgcagtgcaagttgctatcattttttaacaagcagtttgaattgagcaagtataccgaataatgataaatacactgctcagacttcagaagctctgtaaatgcatcagcaatgctccagcaacagagcaaatcaaataaaaaattcctgcagaattatagttaccacgccggtgttatgaacttaatacaagctttatgacgttacaaagataacggtatactttaacatgctattgaaataagagtaaattttacaatgggccacatattttgaccaaggtttcataatggactagggttaaatcaatgttttcactaacatcatacatctttacataagttttcagtttggacaaggggtgagcaaaacaagggaatatgagagaaattcatatgatttacatagggataattataaaaggcaaaacattttatgttttcttccttcttttcagtgtgtggtaattaactagttctattttctatttattcatttgccccaatgtatagatcattttgtgccacttttaaacatgttcacgtcattgttttagtgtgatttgctgaaaaaagttattttctgatttgctaactttttctaaagatatttatcctaatattgtggcactaaaattgatgatttaaactagcttttctctgacaacttcctttgatgtgctcaaccctagtccaaagtgccaactagtgcaaagatatatggtgttaagtgaaaaaaggttggtttggaccttgcccattgtgaaactttggtcaaaatatatggtgcaatgtgaaatatactgttcaaataatgatacgcataatccatacacccaagtcaaggtataaacaaaataatggatgacaaactgcaaagtttggatttatacgaaatcagaaggcaatgcaatataaatgcatgtttcagagatacttccaatattgaaagacagttgagtgaaatacgccaaagcagttgtagaacttccaacagaaaaagtagagatttatgcaccacatataagttagcaacataagttcaactagcacagcataaagctcaccatcttctacattgactaccaaattgactttagcaacatgtaattcaagttttttcttaatatccccttaatcaattaaataaggacatgataaatgatacttagtacctctgtagctctgtacctatggatctgatttatgttgataccagtgcagttaagaataaagttactttcttcaaatcattccaagggccccatgaagcacaacaaaatgacatactactattaaacgagtggtacatgcaaaaagagtcagagctcaacgtgtgcatcattaatcaatagtagtagatatttttccccccatttcgttcgtcagattcacagaattgaactgaacttaattcatgttcagtacacgcgaagtaatcatctcatatcaaacagaaaaaccctacatcacgacaggccaatcaaacaaaaatgcatcgaacgcaatggtgacatgcgaaatccccaacactactattctgaaccatagtcgcgagagaagaggatggatcgcgcgagggaagggggacctggagcgtgcgggtggcgaactcgacgccaatggtggacttggactcgaggcagaactcgttgcgggtgaatcgcgagaggatgttggacttgccgacgccggagtcgccgatgagcacgatcttgaagaggtagtcgtactcgttgtccacccggtgcgccatggccgaccaccaccacccctcgccgccgcccccctgcaccaccacacgcacagcccgagatccaaacccccaaacaacagcaacgtaagcagagatcccaagcaaagcaaccgcagaagaagcaagcaaccgatcgaaaccagcagaagaagaagaggagaatcgcagcgagcgagtggcgcgcacctcggattcgattcgagtcgagtcgagtcgagtagctgctgatctctcgcgggcgcggcgggatgggaggaggagagatttgggatgagaagaagaagaatgaagaaagggaaaccgaaacgggcggcgaagtgggcaatgtacagcgaggcagagaggcaatcagggagcaaaggattaattaatttcttaattgattattatattataagcagctaattattgggggattaaaaaaataaattgtaacagaggaatttcagggagccatcagggaattttgaatttaaactgtcctcctttggtagtttggttccgttgcatcagatctactattggttgctggcgaatttcacggttcaaataaagaattagtatccctcgtgtattgtcacgtttaacgtcggttgctaaatgggagtataatatttgtacttgctgtatgtgcacgaaataaagagttagaaagtgttttttttttctgttttgcatataattgcatgtgagtggttggtacttgacgaggtcgtgtacgcgactccccctgcacctgcaggctgcagctcgctgtttcgagttgaaatggtccggattttctggtaggtttgttgatccgaacgagttaaattcaaattggaaaattctactagcgcatatgaccatgctctttcacatgtggtttcacactctcacacctggcatgtcaacgatccaaaggtgtcaccggcagatgggctccactgacaatgcttttgagagttttgtctcgaacatgcatgaggcatgagaaaaaaagaagagagacgtatcattgtcaagatcagctggttggtttggacgaattcaaggtccaattggatttccatctcgtcatgggctcatggttcagtttgtagatcatctgctcagtttgaagcactctgttccacttcttttttaggtcgtctgaagaagaaaaggcaatccatataccacgagaagatcagcaagatagtgaaatcacagctgaaaggatttaactgcttacactgaagatagtaaaatcacagctgaaattacagcctcgggggaagaaaaactaggcattttcagtttgttgatttaactgttaatccgaactaatatacacccaaaaataccgagtcatttctccttcctcagatagttttacactggggtctgcaggattcagaactcaggagtataaaaacactaggagaaacaacaatctggcaatgctagaattacttacccaagaactaatcgtactacaatgctatcccaatttgatacaaaacactggcgtgcaaaatcagaaggatgggaagaacttgttgaggttgaaaggcagagagtagaactcctcgctgcgtgggtctgtcctgaacgacctgaatctgtcccagaaatggtgcccccggtccttcctggcagtgctgtcatgcctctggagggtattgtccaacaaatatgctacagcgcctccgacgaatgcttttgacgagaataccacattgatcatatcattgaactgggaaagagcaaacaggaacaaacataaccatcaattgttaggttcatgaaaggagtagtaacacttgagtatatttactgggtcttacccatcttgcgtgagtgtgtactgggccatagcctgcaacagaggtgtactcgttgaaatactgtggaaccgacaaacccataaacacggagaatcccacgatgaattttgttcggaagctgttcaggttgcaaaactgaaggaaccctactcctgccatacctgtggacagaaaccaaatatattgcaggtgttcataattcaaatatgatagaaagaaagctagatttatcatttaagattctcttcattgtacataccgacatatgcaaagagaagacagtatatagctgcaattattgggcctggaattgaagcaaataccgctccaaatttccctaggaacgcaacacagaatcagtacaaccagatgaagtacatgcttattgtcagtattgcaggagcataacaaggatgctttaaagttgtatgacaagatgataagcttaaataagcaaaagaaattatgaaagcctgagagaacatcacaagtataggtttttatgcagtaatcacgactttaactttagttaaatctgagtcagtgtcagccttgctattgtgcaatagtatttcctgtaatattcagcttctggctaactgcggctccttgagaaactattcatgaactgattttaagcttagctatttatccagctatcagtcgttggaaccattaacaaaccacctctgaacattacaggaaatacttgatcaggtcatggataacagcctggatatagaacttcaccttttccactctcacaaactcacaaatacatctttacttgacagaagagtacgatcaaaaccatctaaatacataattacatcaaagcattaggcttaccaagaatagagaagaaaatcataaatccagcagaaatctgcaccacacgtctgctgccaacacgtgtcaaacctagcaaaccagcattttcactgttccagaacggtacaaagtatctcagaccaacatcaaatgctagtattaatatgaaactgtataaaacagtaaaatataggcaacagtaatctagaatgtacttacacagatacagatgatccattagctgttccaaataagccacccagcaaaataccaaccccctaggcaacacacaaacaaataaagtaggtaagatgcctgcatgccatttgaattgtcaagaactcggacaaaatatttgcagattaaggagtctagatggtacctgccaaccaatgccgcgactcataacagaaggagggcatggtgttgcactggcgtaccgtgagacagcaatgaatgcaccagtagactgcattagacagtaaggaatattagctggttgatgcataatgccctctaacatactgcacctccccctaaaaaccatagatatatccacagtacctccacaagagcaacaaaagaagctgccatcattgcaaaagcttcaccagcatcaaacgttggtgctccccactggaatgggtaaggtacacttatcctataaaatgcagacgaaaatctatttatattagctaatcttttctttagtgccaaactgccaattgcaggatataaatgcaaacagatgtaatgtaacgcctttccgacgttaggatggcatggaaatagatgcatggtattaccatggagcaccccctacaagcccagatcgatcagttcgacagtgaaattgtgtcttcggagcagcattcttgtacgccccaccaacagtcaggaagaaggcgtaaagccagacaagggccacagacattatgatggcgaaacgctcgaacgcagtccccaacaaaggcaccagcttaggtatgtactgcacaaagatttacacaacattcataaggattcatccaccgttagaattcacacaatagccatcttgatgtatacctgggaaagagccaccagcagtatgatttgtggaaggccaatctccacacatttggcaacctgcatagtaaatttatgctgtcataccactgttgcaaatacatccagacgactgtacatgtacaattgtagtacaaaatactcacacttgggaatccaagctcatagagcccaaatccaacaagcgcaaccaatggtgctgcggacagtgggctcagcagcctgcaacattacaagaatataaacatgaattagcagaatgatagggccagttaaggtacactgatcaaacgacctggaatctgaaccctgaggatgagacatgcacacctgacgacaatccgccagagcccactgaaccccatgatgatttggagcgtggaggccactatgagtgcgccctgcgttccccgcatgatgcgcacgaatttctgcaacgccatgccgaacccagcacgccacatttgtcagtgtcaatacagcaaggagtcaaacagaagaggagcaaactttgcgtgggtgcgggggggagtgaggagggcgacctcgtggggatcggcaatgccgttgtagcggccggcgaggatgatggagatggtgggcgcgacgaaggtgtaggagcccccgatgacggcgggcaggcgcgtgccgaggaagctctggatcagcgtgttgatgccggcgacgaacagcagcgtctggatcacccgcgccttctcctcctgcatccatcggcagccaaatgagtgagtcacagaagcaagtgagcggtgcgacgccgcggcggcggcgggaggaggggacgtacattgccgccgcccatctgggggacgagcgcggtggggatgatgaccgtggtgccgagcatgacgaggtagtgctggaatccgagcaggatggcctccgctgcagaaagaaaccgaaggcgccgtcaagcagccaaccatggagatcgatcgatccactcctggaatgcagagagagaggatgagagagggaatgggcactgacgccatgggggagggctggtgaggcagtaggagatggccggcagctggtccttcaccgcgtgcggctgcagttcctcctgcttcggcgccggcgccgccattgcctaccactaccaccactgcagtgtgagtgagagtgagagtgaggcgcagcagccgagccggcctcctcgagatgcgcgagttgaagcggtcgccgcgggagtggaggaacgcaacgcactgcacgcagcggcgcggcgcacacgatgaaacactgacgactccgcgatgactcacgcacactgcactgcacacgcaccaaccaaaccccagtaaatttatagagtggggggagtcctccacttcgtctttctctcactctttctcgccgtgtgtgggtgtgtgtcaccgacgaggcgatctgagtcggcgacgagtcaaaccacgcggtggtgccgtggtggtggtagcccgcagccgtgatggcggtggtggcgtttttgccgttttctaccgcaacttttactgccgcgctgcgtacgcgcggcgtggtggttgcgcttgcgccgtggttcagctgcggcagcctaggcggggggccgcgtcggcgtccggttattacgaggaaaaaggggaggagggatggggggtttccgaaatgatttcacgcccgtttggtttgccggcggtttgttgccgcgacgcacggcagggatatctcgtttttttcctgcatatatataatcatatcaaacgccctcctttcgtggaggctgccaccaatctcgcggttttctcagtcaaaccacactgttaaattattactactactactacaaatctaagcaatgtgactattattaggattattagcaaggagtaataaatttacagtggttaaaagaggagtttggatggtaatgagtgaggagtaaatgagtccgttggggcccacaaggagacctgaacttgatactgggggccacatggatccctccatgtgggtagattaaggagaaaagaaaggccaaaggtgcaagtaaaggatctagagggaacctcctcttctttattcagttcctaacatgcagtagtagtaatgaggatttcggccgcaaggtatcaatcaatcaaccgaccaccgaatcatgtaatgtaatcaagtttaaagtaatggttgcaagtactgattaggttttgggataattctgccaagtgccagcaaatcagtaatcacacgctaatataatgcgtggagtgcttgcagggtttggcaggcagtgaccagggaataaagacgttggcacctgcgaacaccaaatcactgttttttttttggtactgttctttactccagtcagcatggagtgatcagcgatgctcactttgatcaagacatttcatcaacgtctgtctctaacgtctgtctctaatcaagacatttcatcaatccaatagaatagtgcgaaaaacaatgcaaactgttaagagtgaaaggggaactaatgttgcaggaacattgttcttgccaacatcatataactagctgatgataaccgcaattgagctggagacctagagaagggtacctacatccaaccggatatatacaacatttttaaattagaaactcaacctatcaaacaagtaacttaaccctcaaataacccaatctgatactatttgatttcaggaccttgaagtgctactcaggtgagctagagaacatggtttagtcgacaccatccacaaatgtttacggattaaattcacaaaacttcatccgattatttacaggcaatgctgaatgctcttgctaaaaacaaaaatgttggatgtagctcgtaaaccagcaaagcgtaccagctctgtgcccaaaaagattacgagactgccaagctcatagtcatatgtacatgatttcccttttccccacttatatactactccctcctttcctaaatgtttgacaccgttgacttttttaaacatgtttgaccgttcgttttattcaaaaacttttgtgatatgtgtaaaactatatgtatatataaatgtatatttaacaataaatcaaatgatagaaaaagaattaacaattacttaaattttttgaataagacgaaaggtcaaatatttttaaaaaagtcaacggcgtcaaacattttgggatttttaaaaaagtcaacagcgtcaaacattttgagatggagatagtatatatttcacagtttaactaaacaaccacagtccacagggataaacaagtaggaaaaccgtcatttcccaggtttcgttcttttcagagcaacaatcctattggtgtagaatatccaccctagaacataagacaatgtcctccattctctacacccggccttgggcttagatatcgttgcaacgaagcctttcagtgcagctcaaggtctttgtgtgtcaaaggatacagatggatctgcacaacgatagtaatcttcactgaatgagggatgactggcgcaatcatcataaaccaaattagagaactttatccattgtctgtgatactacgggtggtccatggccaccaagtgggggtaaatcgggctgatattgattttcattgctttctgcagttcccagttgacaaggatccaatgtcagctgatggtatgcttgactggctcaaaccaaaaccatcagtagaaacctgtgttgggaattggttatattcatttgcgagcaatgatggagatctcacatcgaggagctgtgaatgatttgatggaagtgctgtttcattgttataggtgaatatacattcttccaattttcatacgcttgcttcacagctgcatgtgcttcagcctagaaagaacaaaagtcagggttaaaaaaatggtccagattttaactggtggagggaaataccaagaatcttctctaagtactaggttgagagagaaaatgtgaataccttatccttttccataagatcatcagcacaaacgaacttctcagatattagccctctcacttctccaacaacattgaacacgacagctgttttgattaggctgtgtggatagtacaaatgcaccttgtcagtgagaatacaagtttttgaatgctcaactgtgacctcccacatctttgttgacataccactgcccaatatctgcatggtttgagaataagagggccaatatatccatatattttgctgaatagcactatcatctgcaaaagcatgctacaacacaattaaacaatgacaaattcagacatatggatagaaatgtgacatctgcttgctgaggaaaaaacttttgagctcagattaccatgaccatccacagaaaaacaatttattcattcaaatctaagaaatatattgtttcatggttttatatttctcaacataacaaaataatgcttttaaccacacttacggctgcatgtccaactggaattatgtgtgaatgatagttcccccattgtactgatgccgttagtaaggccaacaaaaatgtccccagaagcaaggttcatttgccttcccttgctctaataatgttattgttaaactcctgagctgtccagtcatcgccttctccaccttcaaaatccccctctaaaactactatttcaactttcatcagggactcatcgcctgatgctacaacttctctggtaacagtgtcaactagagcaatagttatgcttaaggagctctctccttcaatcttggagctagtgaaaattggaagtgaaagcttagtcatgaactgtagctggaaatttttcgatgtaggtggaacaacgtccatgacagttctaatgggaaaataagaaatcaagttgttaaacttaaagaaagctgcattagcttaatgaatctatacagtggctgatacttgtcaaatagtagtttaagacagtgttacaatgtcgtaccttgccatcataatggcatgatttgcaaacgctgactcgatttcttctttcacctagaaattacaatcggataaaacatcaaggcctgaaggccatcattggacagccaaataacacatggctgaagaaaatcctgcctaggataaactttcaatggctttgggtgaaaatactatcttctaaatagaaacaaatgaaaccaaaaaatggaggtcaggaattaacagtcttccagggattaaatacttgttaggtttcaatttacggatacacagggttccttacattacgtcgaacactacaagtagggtttgcgtaattcagaaccacaaaacagatctaatattgccagctgcaccagatacagatgaaactttcgatcaaactatgaatgaacaatataaaagccacgttagcagcaaacataaccctaagcccaacagaacaaaaggggatacagataaaacatgcacatcatataccaaaaagtcatatcttcctataaattcatgacacatgggtgagaaatggaaaataagaaagtaggttccataggctgcctcaccattcttcggatgaggggctcaatagccatgaacaacttttcaatgctgcttttctgcatcacctccgtgatcatcctgcacgaaggcaagccacacaccggcaccaaatcagacaaccaaccacacaaacacaaccatgggggttccaatcgagttctcaaagataacggaggggatatactcgcggagggcagggaccatctgatgcttgggctccccgtagcggtggggcggcgacgagctcccagccccagatttggctgggccaggggcccccatgcctccgctctgctaccgctgctctcctccagctgccgcttctgcgacatctccggccaccgctgtgcacctcgcctccgccctcatcttcgctggccccgacctaaatgattgtttttttttccataaaaatgacctgaaattgcgtgggcgaaccagcccactaggccacacaaaatacaaagactagcctagtctaaggcaagtcggcctaaaaaaactttttacatctattattgttcgattcgattcagttattttcaccttttttataaagattcaaccaccaaccctgaccatataaagacctgactttgtaggcaggaatgcagaagtgacatggcttcataaagtttattctctaaaaaggcttgatcaagtttattcaccacttgcatgaacggaattgaaatgctatcctttttatctggacaggataaaaccaagagtagaatttggtgaaaaggggccaaatggagcagaaatgaaaagctgcagtgtcagttcaagaaaaaagaaaagaaaagctgcagtgcacttgaacttgaaccagatggtggaacagagataacattcacattgctttcattgttatctgaaaatgagagttcaaccaatggagatgacacattccttcttggataagcatgtggcaaagcaaaggacttcaaggtcaagagaggataattaacaaaagaccatatgtcttgctgatacatacaattggctattagaaatgggaaaggcaacattcccatgattactagaacacttatcttccacaagtcaagcaaagcacacagcgttccatgaaccacaccttccttgaggaaacaggccagtcacaacatcacaaatacattctaaagaaagattttacatctcccttaagattgtcaatacctttctcccagcaatcaaatctcgagtctgctctaccttaaaatcaagcacatcggttccactcggtcttcagtaactgcttaagcgtacaggtaacagttaactcacggcaactataccaagaaaaaacagtttgcaatgaaatccagtttaagtctagctgaacctgataagaagccactaacaaagcttgaaaccacaagaacattatatatttctatcatgcttgataagtgaaaccaaaggtagcattgaaatgttgccaaaaactaaggtagcgtagtgttgaaatgactgtaaaaaaattgctactgctggcagtgatcacagtgggatgtaatctgagatttaaagcactgcaataagtctggtcaggctaagggaaaacgagtgttaggaaccatttgcaacttgtctcaagttagtattaaggttgttagtttcaaagtatcatagcagttgaaaggcttctattcaattttttttttactctgagcaatgcacagtataaacatcaaaagcctataattatcggactataaacagagatctcagttgaatccaacgttactacttggtacatcagcaaagccaacccacatacattgctggtgcctggtggggagcataggctgtgttttcagtgcctcgtttggtcaaaagacatgaccaaaccccacataacctacagttctcaagcatgacctttttatctaggaaaactattgaaggataatgaactaacttgatgggtatataaccactttaacccagggcgacaaagaaaacataggtaggatcaaaatgcaaccaacctacataactgatgaaattataagttgttgacaaatggctataccataattgtaactgacaaagaacaactagctaacaggagttctctagaacaatgcaacatcaagatggcaattcatgaggccgttccatgtcagtggaagttgaattcaaaattatcaagtgcccaaacaaatatgagttctcagtcttaatgccacaagtgtctccgcaatcaaatattcatgtcataccgatatccccatatctctgaacggatccatgtcacgatctcctaaaattaaggagttctgatagaaaaattgtgcataatctcttgaggatacaagccaggaaggtgttgcggctaaaacgaatctacagagcagaacgatccgctagtttacattctaagacaacgtaatgtaggatcaagtgatagtgtgatctcgtctgagagaagggggcacgaaccctagggtttgcgaagaccggaggggaaaagcgacgcggcttttgcggacggcgccgcggtggcgttggacgcggggctgggtgcggcggcggcggtggtcggaggagccgcggaggaaagctcgcggacaagggcggcgagggcctcggggttggcgccgcggtcgcagagcgccatgagcatcgacagcgtgtggcggtcgaggc

SEQ ID NO: 44725 - DNA, 2096 bp, Oryza sativa
tccgatactccggttggtgggggtagctctggttcagagttactgtgcacggtagcggccgcgatcacgcgatgcaggtgatttggtgaaaaccaggatccagcgagaaatcaagagctgtggcctgcatttgcaaaagccatacggttacgcacttatcacggatatcacgtgcagtatgataaatctcacggtagcagtacggttttttacggtaatgtgtaattatcgggataaccgtcttattatggggtggtggtaaactcacccaaaatagtttagtaaaccctgattctgacttggtaacatgaaactttggcaaatttcaattaaatttctgtcggattttattgatttatgtatgacctcttaaaaatcatttgaaatttcgctcgaaatctacttttatcccgtgcgaggcttgaaaatttacctcgcttgaaaatttacggtttttagtcaaaaagttaaacttgctattgctagcacacatgtatatctactcatgatccaattacataactagagaacatggattttttttaccttttgattattttttaaaaaacttattttataaatagacccatgaaataacttattacaggaatagactatttttatggcgccaacatcattagcgtcatgatctaacatgattatgtcaacgacgttggcattgtccctatcacccgcaaaagtaaaagttaagtaactaatataaagggggtcggtcattggcaccaattactatttgtaaaaaatattacgaatgacatatttgcaattaaaaaatatatatttacaaataggttttcgatgccgatgacacatcgagggtctaaatgtaaatatatttattataaatagatcattttttaaaaaaatcacaaatatgtcctcgacgtcgatatactttatactaggggattccccgcgctttgcttcggaaattactaagtaaattttaatattatttttcgttataattcagctaggagtaaaaagaaaaaaaaatcaaatctttgggcttatcaatatttaccatgaaacaaataaaatttacactttaatgtagaacatgttgataagtatatatattaaataatataaaaatgataaagatatttgtaaaactattagggaaatgatgtgagagatggtgattgaatatgcttgcatgttaatttgtagaattaaatagattgtagatgctctttcatgcttgcatgaggttgaatatgtaattattgttggtgggtgatgatgtggcatggttgcatgttaagctttggaattagttggttataattttatataaagtatagattagacttagctttcactagtggggttaggaggcaaggggggaggtgtcaatgacattaatgccgtcatgttagaccacgacgccaatgatgttgtcgctacgaaaaaaatacatcctaaaataagtttttttaaaaagactataaggtaaaaaaaaaacaggctggagtactatttttcgactcacttagctggaggcctggagaacttgattatatcattacagtttactacaaataactcgctcgcacaggcttgattacatactcttctctgatcatatattcatacgaattatataaaatataactacataaaagtattttcttgacacgtctattaatgtcattgcaccaattaaaccttcatatttgttacttatataagctttcaagatcttacaccacgaattcaaaaacaaacaccagcatggcagcatcatacacaagaatatttttagaaggcagcttgcattaaaaagatcgggcacactgatacatcatgtaggaactggaaccatacggtgatacaaactcccgatattatttccatcagaaacgtatcgatgactgatgtgttccactgactcatcagcatgttttacttgcatcgagtgaatccatatattccagacagggttcgttcttgccgaatggggcaggcacgaaatgtcatatagaacatagtgagcaactaacaacaacatgcatactctgattcttcctactaagtgctacatcctgaaacacaactggaagtccagcatt

SEQ ID NO: 44726 - DNA, 12275 bp, Oryza sativa
tgggaacaaaaccagaaattgcagcaccattggaagaatctatggctgcctggagctttttcaactgggacttcaaacatatgattcgtcccttgttccattttggataatggaaggatgatgatagtgtatcattcagaaaagagtacacaacttttgcaatcggcaatccccttgtaactgtgcttttctccatttgtcccctcctggcaatcagagaactgtcagtcaattagagcaaacggaaaaatgtataagtagctacgtattgcatttctttatgcaagtgaaaagacaagaaataatcatgggaatcacgaactcgattccagaacagtgctagaacatatcatgatataactatagaacatggtaaatcttaagctaaaagcttacaatacaacaactgaggctaactgaggaagatcttcatcgccttttagtctatcataaagtttattgagccacactgacacagccactaatgatccacctactgacatcctgcaaatgcaaacaaccttaagcaccgcttgacgaataaaaaaactggatcactcacagaaccagatgagagtgataaataatattacctatgcacatctgcagaccagaccagcttggtatcacgaaataactcagggaagagcccatattttaatgcttgatccaaaacccttgcagctcgacccttctggccaaaccaccaaaggacatcaaggagtgcattaaagaatcgtaaactgtagtcacagccttccaagttactgttgtcaagaacatattcgaccatttgccaattggagtcatcgtcatactcccctttgatcatggaagcaatcacttgatgtgtactactagcacggtttgttttcatttcttccaacagatcataagcatctgtccacctgaaattgtacatcggttatgttgtagtttcattacattttaaggattctagaaattttgatgtccacatcatttatagtaccttgtgttgttctaatattaagtgcttttagatcaaagtattcaagttttggccttgtgcctatcaatgctacctgaatgatgctggtcaaaactctaaatgatttaagcaggataaataacaggaagagagaacaaaggaaaaaaggaaagatatcacagcccagatctttctcaaattttaaggtacaaatatgaattcaaacccctcaagaaccataaagaaacaagtggtctctagaaatatgaatcggtagagtaataaagttctgcagcgtatgaaatgagagtaaaattgcaagattggagcaacaagtgtgttacagacttacagcattacatgccgcatatggcatatcaagttaactggaccaacaaagggggtagaattcctaatctatcaaaccgccattcaaattttatggaatttcacaaaacagacatgcgattgcccctagacctagccccatgttacttagaggaagtttttttatggtcatatataaaatttatatttcaaattccatatagtgattaatcaaatctaaatatatttttatggtcatttatgtgattaatcaaatctttactcctttaaacattccttgtggctgacatttgggccccacatagctagtccaaatatatttttctacagccccaaaaccagccagtttagttgattaaagttattccctatttatcactctcaatgctttacatttacaatcagaaccacataagttttaattaaaacagcatgaaggtttctttgatagttacctgtcattcctggcatagagtgacaacatcatgcaataagcaataatgctaggaacagtcaccatggactgaagttcttcaaactgctctttgctctcatctataacacctgctatgcagtaggcattgagtaccccctcaagggagcgttcatctggattaaacctggacttccgcatctccatgtatgccttaactgcatcatctaactgtgcaccctggcaatacgcttcaatgagagcatcgaatgaatccttgtctttctgaatagcagcattgttggtcattcgagaaaagatggcctcagcctcctggaaaaggccaccctttgcaaatgcatttgcaagagcattgtaggtctctatagttggcaagcttccaatttcagtcatcatgttgaatgcaacataagcctcctggaatcaaatataacatcatgaaacattttatcacaaaaggggtatcttaagagtcaattcatcaatatatgatacaacatctgacctcatacatagctgcatggccaagcgcttcaactaggccagtgtaggcctttgcagtaggcaccattccttctgttgtgatatagtcaagaacttcccttgcatcctcatggagtccaccacgaccacacgcaaccatgacgttttcacatgtatcaatatcaggctctacttcagagtgaagcatatcttggaagagctccaccacctccttgaagaagccaccgtccccaaaaacgcggaacaggacattgtatgtggctgtgtctggaggtacagttgttctcatctcgcggaagagctcgcgcacgccatcaaacctcccctgtctgccatacagatcaagcaagacacggtatgtcgcagctgtcggcggacagccatcagcctgcatctgccgcagcacagctaccgcttcagcagtggcaccaaccagcgtgtgagcttccatcagcccaagatacgcagatgggtctggagtgtgccccgttgctgacatctcggcaaacagctcggccacacgggagaggttaccagcaccagcgaaggcatcaacaatgtggcggtaagatgcggtgtccggcaagacaccggcctcgagcatggtgcgcagcagcatctcggactggtcggagagagcgcgtacagcggcagcggcgaggagggtgttgtaggtggtgaggtcgggacgaacggagggggaagggtcatggcgcatttcagcgaagaggccgagcagcatgtcgaacgggaccggcggatcggtggcgcgagcgcaggcggcgagcacggtgttgtacgtggcggcggtgggcgcgacgccggaggccttcatctggtcgagcagctcgcgggcctcctcgtgcagcgcgttgcgcgcgtaggcggcgatgagggaggtgtaggagagcgcggtgcgcgactcggaggggaggtcatggaatacctcgaggcacttgtcgagcagggcggggccctggcgcccgagcacgccgatgacgatggcgtggatgtgctcgtcggggcggcaccacgactggcgctgcatgtacttgaacagccggagcgaccgctgccagtcgccgcggcgggagaactcgcggtacaccgcggcgaagtcctgcagcgtgagccggtggcgcgccgtctcgaggcaccgcgcgatggacccccgcggcggcaggttgctcagccggtcgatcagcgactccacctcgtaagagtgccccccattctccaccaccaccgccgccgccgccgcctccctcggcgccctcgcggccaccaccgcgacccgccccccgcccccgccgcgtctcctcgccctgcaacaccacctcctcgcgggcgggaacagcaggtcgcagtagtggtaggacggcgacgcgactgtggcggtggtggagacgagcgccatgggagcatccaccatccgccgccgccgacgacgacgaggaggaggaagaggaggggtttaggattccactcccttcgcgtagtagattttggggagagatttttcgtcgcgggagtggatagagtcggactccgagaggcgcgggtgcgacgcgagcgagtcggactcgagttggctaagcctgaccagcttggcccttccacttctctctctatctctctctcttctctttttccccaataggcaactgcacgcgccgccgcagcctctctctctctctccgccgctccggctttctcctcctcttgctgctccgattgctccatggcgggcggcgacagcgcggcggtgtcggcggtggaggggaggctgtcggagctctccaccaacagcgacgagaaggggctccccaggaggggcaaggtgagctctccttttcagtccctcccctcccccgtgtcagttctcctctttgggatcgggcgatgagtgtaagcgacattgaatctccatatgagcaatctcccttggcgaagcttagcttggatttggttttggaatctgaatccttggccaatcttctgtaggcagttaatcataatttgtaacgatcgaatttggattcttgtgaaagatgggatgggaaaaagaacaagatcgctgaaatacggcactgccgcctttagattctgttggcttcaattaggcaataagcttttcagaggatatggggatgaacgcttatcagctaagccggcacagtcgtatgggaagaaagactgtgaaggcaaaagattcttctttttgttcgatgaacctggttatgatgcctagccctgtgcccctgtctgaagtctgaaccattttcttttcattctgatatatctgattgctagctttacgtcaacactaattgcttgattcctggccctattggaaacttgtgctttaccacaacgtttaaatgagctgtccacagttcagtttagctacctacaaatttctttgtatgtattgatgagcatacatgtttcttctgtattttttcccctcctgatcaatccaagcatagcaatggagcttgtctagtacatgcaacattattgtcctgaacagaaaactaatatccaagaaaaacacagtcggaggaatcatgaggtctaggtgacatttgtacaatgagcaattgctcttgttgctttataaaaaaaagtattttgtattgtcctccgtcatagcaagttgtccgatttgtttccttgtcgtttactgttttaagatacaagcaccttcagcccaagttatctcagtaaaattacatgttttcagtaaggaataatttatttgagtaatgtatgttgcttttaatatccgcatggtgacactttctattgcagtctttatcaggaaggacattaaacaccgcacagattcaactcgttgcaagccatccagaggtgtatgaaccatgtgatgattcctttgcacttgtcgatgcgcttctttctgacaaagcacaacttttgacgctaaagccaagattatgcatggagataggatgtggcagtggctatgttatcacatctctagcaatcatgctcaggcagttaggctcaggaacccagtacctcgctactgatatcaatcaacatgctgtggagacaactcaagcaacccttgaagcccatggcgtccatgcagacgtgattgctactgatattgtgtcaggtcttgagaaacgcctgcatggtttggttgacgttgttgttgtgaaccctccttatgtaccaacacctgaggaagaaatcgagtccaatggcatcgcttcatcttgggctggaggtataaacgggcgccaagtgattgatcggatccttcctgctgtgcgtgagctgctatctgaaagagggtggctgtatatgattgctcttgaagataacgatcctctggatatctgtcatttgatgaatgagaagggctatgcatcacgcgttctcttgaagagatgcactgaagaagaaagcctttatgttctaaagttttggcaggacgcttccactggcacaaacgcttctcatgccgctagatcaccacgctctgaatcctcatggctttctcagctgcctttcagatccctttggcataagaatgcatagtagctgttagccttgtcgatttatctccagttccaaaagatagcaacaagtactttgcaaccttcagatggcagaagtatctgtaaacatgtctgaaatgagatgctgctgttggtctctgactcccttcaaaagagtaaaagaatcagaaatcagactgacttggtggacttagctatgaatggtcctatgagcaattagcaataaagttccaacccttttattttgggtgttcttctattttggtgtgtatatgtgctagtctggattccttatcttactgcacttgtaatatgggtcctgttattatcgaatggattagtaaaccatatcagcgaaaagaatgtacgagcaagtttctggaactataactacatcaaagtagttactacaagaatatcatgatgtctgatgtgtctgttgaatcgaatgaaacgtaatgttgggaaattccatgagaataagcctctcatcgtttgctcaatggttgataagcggttagaaaaacaaacaaatcaaccaaaagaatttataggcaaaacttttacagctgtgtattagcgatttagaagccaatactgattttttttaaaaaaaaaaatctcaaaatcaacgtttcaaaattcacatttttgttgtggctgataaggaaacaatgagacttgaccatgtaccagccacaaacaagctgagttcgtctgcttgatccgatgcactattcgaatactcccttcggttctataataataataattgacgctttagacgagattgatgtcaaacttttataactttgaccatcaataactttaaaaatatttagtttaaagaaactagaacaacatatataaatttgtctttgaaaacactacaataaaagtaaacatgcatttatttattatatatattataatagaaaaataaggtcaaagatatattttatagacagtgtcgttgtccaaaacgtcaattaaaatgaaaccggagggagtagcttttagcagtcacaatttttcctataacatatactccatccgtttcatatcataagactttctagcattgtccacatttttttcatatcataagactttctagcattgcccacatttatatagatgttaatgatgtgtatagatttattataacatctatgtgaatataggcatgctagaaattcttacaatatgaaacggagggagtagcttcaaaatttttcctagatttttaagatctacaataatagaatccaaaaaactaactaaaagtgattagaaaccgggttttccagttttacattcttgcatgttagttctcagaatctcgaactcccctgtagggctgtatttgtcatgggcttccaacgcaaacacgtccgtgggctggaagcggcccacagaacggcccgacacatccatcctggaccttccagttccggtgcgaatcaacgcaccgcaacgtactgacgtagaggcttcacgcacgccggccgccttgctcgtcgtcgccggcgggagctgcggcgagcgcgcttcatcctcgtccccagctaagctagtggcctcaccgcctcaccgagcttctgatcgcgagagcgaggtgcggagagatctggagctagctgggtggcggcggtccagcccatctagtcatcattaaaccctagcccacaaaagccctcgtcgagttactggagagcttcacacgcctcctcctcccccgcgacaccggcgagcggcgatgggtaagcggaagcagcgcggcggcgggggagcagccacggaaggcgacgcggccgccggcggaggccacagcccctccaccgtgttcgtctccaacctgccgtacaccttcaagtccgccgatgtaagcgtgtgcccccctagccttttctcctctgcgaagcttaaaaggggttaggattgtgctatttcggggggatcagtgttgtggtacgcggtatgatgtgatgtattgctgttatgtagctcgaggcggtgttcagcgaggtcgggccggtgaggcgctgcttcatggtcgcgccgaaaggtaagagaattcaggaattccatggctgtttagccagagttgtttggtgtttggtggtgcttattattaagggcttcgcttatgcgataatgtttgtttctaatgcagggtcggagacgagccgaggctttggattcgtacagttgtaagtatcagtggttgcttttgtaggtgttttcaatgaaaatgcgtttccctttaccatatttccagaattccacaactgcttttgatcgtgagtgtactggtctagtgagcaaatttctcaatgctaagcgtaaattcattgttcagtgtctctagtggtggtgtgtctgtgttactgtgtagtatcagactatcaggtccctaacagaagataaaccaaaccaatagttagttcttattagaaggagtactgcacaaagttttcgccgtatattatatactgcactaatgaacaagcgaaaccataagagtttggttgatatagctcgattcttttttctcaaatacagatgtgtcatgtgtgatcattcatgaaggaatatctttctgctgaaaatgatctaggcacaaggcatacaaaactggcctgtaacctgttttatatatatatatatatatatatatatatatatatatatatatatatatatatatatatatatatttgacttgtttacattaatacagtgcaactgttaaagatgctgagcgatctattcagcaaaaggatggattttctgttgctggtagaaaaattagagttaagctagcaacacatcgtgctccactgaaggagcgtttacagaagaaggaaaacggtaaatctctattcctggtagttgcttctgaatttcaattgattgagattctgatcgcctggctgcttttgcatgtaagccatgcaagccaaggatgccgatgtaacaaatgaagccaaggatgccgattcaacaaatgaagcccaggatgctgatgcaacaaatgaagaagatgatacttctactgcaaaacataaggagacctctcataaaaaagatgcaggtttgaaaggaaaattacccagattccagcactgtttccattcttaaattttctcgacgctttaattttctgatgcatcatgttttactgaaccagaaccactacagttgttgaaaaaggatattacagtatcaaaggaagttagtattttcaatactgataaggtgaaaagctcagaaaagcaaaggtgtggactcaaatattctataccatcaaggcattatagcattacctaaaaaaaattgaagtaattatgctgaaattttgccatcctgttctagtttgcttttcatgacctcaccattcttagttttttcaaggatatatgctgtaattgtttatttttatccagtttaacccagtgcgacaatataacatatgcaattgattatgatgaaggattgaaaaactgtgatattcggtggtctccgagactttgctatggcaagtgaagtttttcgtctagctggagagattggcacagttgtatctgtcaactattcacttcctaaagaggaaatggagctccatggtatgacttcctaatctactcctttttcagttctttttttaattgtataccatgtcactaggtcgaaattgctctggtggaagttctttgagtcaaattattttgttgacatgaaagttaaggctgattgtagtagtcttgaattatatctcatattttctgttttccagttcatgctgtacttttgcaggacacgtctttaccttagtttctgtatcgtttgcttttccaagctccaagtacacaattattttcctttaataccactagcatgttcttgaattggtgtaaattatagaatatgaccatcattctcaacagggcttgaacgagatggatgcacaacagatgcagcagctgtactttttgctagtgtgacatcagcctgggattcagttgttcacttgcaccgtaaggaggtcaagggagcagttgtttgggctcgtcaacttggtggggaggtatcttcttgcattatatttaccttgatatgctgccattacttcattattttagcttgattgtcttgtttctattctgtgattaaacaaatttcaaatacttatgtttttctttcacctttgtttaccagtgcagtagtgtgcgtgctcacatttagttgctcctcaaagctgtatgcttgtatgtaattgtccttatgttctaacctaaggtggttatcatgtcttagtacgataattcaaaacggatgggtatgtgctaattaaaaatgggttggaagttggaacttcaagttctggagtctcaaattaacagtaacctcctgcagctgtgcctcctggaaatgtcttgaataccacatacattacaggtctcctgactacagtttcaaatatatttagttacattgtctcataagtacacatggtgcctgttcattgcattggatctaaactaaatgtaatataagttttaaactagaaaaaaaaacagtatccccaacctacatagttcattcacattagattcgatgactacatgcatatacacataagtagatgacggaatgatttgattgtttacaaaaggcactactatatttttcatcttaaaatactaccgtaactaccactaacttctcttttatatctgtaaaagatgtacaagcctctagagatttagtcacctgtgctttctataaaagcagggccttctggacttctacctaaagaactttccgtttgaaagatcctaatattattctgtgaatggaacaatagatatactggagctttagctctgcttataatgcaccactatcttgcatggctagttgagctgttgtgctaataggtgggtaggagatagaatgagattacttaaaatctttacttttggttgatgagtgtctgtcttctgcacaagggttgcatggtgtttaacagtactttgtcgaaccactatcattttctctgtttggccatttccccatttacctgcagctgtttgaaacttgcttattgctatgcagggctcgaagatcagaaaatggagagtgatagtccggaatctgccattcaaggtgcttcatgaaatgcaaaacttcacctgttccaaactttgttatctaaaacagataacagaggttatatgcgtttgtttcattattgcagattacagtaaaggagatcatggatatgttcagtttagcaggatttgtatgggatgtgtccattccacagaagtctgataacgggtatgttttgcattgaatcctttacttcttctgtagtttaaacaaattacaagaaattatgactatttcattcattcttctacaggacatcaaaaggctttgcttttgtatctttcacacgtaagcaggatgcagaaaatgtatggtcagtaccctgttcagtaagagtaaaaaatctttggaagtcctaatattgcttttttttctcttaaataggctataaaaaatgttaacggaaaagtagttgcaaagagaactgtggctgttgattgggctgttccaaagaaagtatacactgttgctgctgcaaaatccagcgctaaggatgatggtaaatacaaccttttgtatctattattttagttctggccttcgtttgttctgtgacctgcaatatctttatttacttcaatgatacgcttcagctattctaacatggacctttggcttttgacaaaggtacctgccatttctttggtatggtaggcgaacagtggttcatgttgtttaagatgatcaactggcttatttgtttcataattaaaaatgttttaatactctgtgtctcatctgctaatcctggcaattctttgtgctttctgagctattattttggaagatgcaatatcatgaatttgctgtccctacagagctggtaaatgtgtctgacaaaggcagtgatgaggagtctgaagataatcttgttggagaagatgatagctatgaacttgatcaggaagcttccaatcgtcctgctgatgatgattttgaaactgaaattgatatttcaagaaaggttcttgaaaatttgatcaagtcatctgagaaggctgaaccatctggcaatgagggttctgatgttgatacagatacagaaacagaacaagatacatcagaaaagaaacagaagcagacacatttacctgcatctgtacctgcagctgataagttagaaaattctaaacgtgtggcagaggaggaaaacacccttcctgcctcaaaattcaagaaacaacacgctgggctggataggacaatattcatatgcaaccttccttttgatctaagtaacgaggaggtaagggctgcaggaattcga

SEQ ID NO: 44727 - DNA, 1230 bp, Oryza sativa
atttttcctatctcatgattcattttcgtggcaggaaggtgaaatacttgctgggacaccagctgcagaaggtgtgtccgatgctgacatgaataaacgtagttggtaagagtttatctttttccttctttcagccagcgtcttcctttttccgagaaatatagttgcattctacatttccgagaataaacgtagttggtaagattttattatatttgtaaaatgtccattctacatgttgtgttcatgttactctgggaacaaacgacaacacatgcactttttgagaattcattgccagcatttggtgtcttgttggcttttctataatgaaaaggtgtctctgtactgcagctgtaactattgaatcatagtcttttcccattaattttattttgtcaaatatttttcaaatctcattcttctataatttgtatttagtttttctttagctgattgaacgttcagtactcttcttaagatggagtttgattatgctctcaatcatggtcaaaggatctcatgaataatgtttaaggaatcattgatcttgtcgtgcaggctagctagaagaaaagcagaaatgctccagtctccaaaatttcatgtgtccagaacaaggcttatcatctacaacctgccaaagactatgaccattaacgacgtaaagaagctttgtagagaagcagttatttctcgtgctcacaagcaaaatcccatcattcgaaaggtttcttgggttttctttattcaacctctgttttattctatttctaggtattcttttataatgcttatgcgtgtgcacttgtcttgaacaggtaaatatcctgaaaaatgaaaagaagagcaacagtactgcacagaaacattcccgtggtgtagccttcgttgattttcaagaacatgagcacgctcttgtggctctaagagtcctaaacaataaccctggtactgcctctataccaaatgcttctaaatattggtttgtaactgcctcggttgcaactttataatgtggaacatgtctttctccaagaagatttaatgtgttatattgcattgtgctgcatccctacattgcatggaatcaccgtatcacatgttcgtggcttcatgctacctatctgtattgtttcttgtcctgtcatgagcctgatgtgtcgtagtgctgctattagctgtaattttactttttttcctctatatttgcagattactacgatgtaa

SEQ ID NO: 44728 - DNA, 9741 bp, Oryza sativa
cttcactggtgcattcagttttatttgggctatgcttttcataccctctgatttgccattgtcatatgatgacagcgccctactgttggtgatgttaatggagatggtcgcactgaagttgtggtcccaaccgtgtcaggaaacatatatgttcttagtggaaaggatggctcaaaaattcagcctttcccatatagaacgcatggaaggatcatgagtcctgttctattgcttgacatgagcaaacatgatgaaaagtctaaaggcctcacccttgctactacatcctttgatggttacttgtatttgattgagggctcaagtggctgtgcagatgttgttgacattggagagacctcgtatgacatttcttgtctgctttgcaattctgtactctgtacaatttctggattcaacaaagtggctcacttctttgcatattgacaggtacagtatggttttggctgataatgttgatggtggagatgacctcgatcttattgttactaccatgaatggcaatgtcttctgcttctccactccctctccgcaccatccacttaaggtacatagcatgtttttttatgtcaataatttagagtaaattacacaaaaccataggtattgtgtccaagttacacaaaaccacaggagttttggcacgtggcatagaacccctattgttatgttaccaatgtttcagaaaaccacacaattgccaaatttttcttaaatttgacatgtgggatgaaacttttatatgctcatagaaccacggtggatgaaagaactcataatcccacgtcagatttgggtcaaatcatgttcagatttgggtcaaattggtcaattgcatggttttgtgaaacactaacaccataatacccatggttacgtgccacgtgtcaaaactcacgtgattttgtgcatactcataatttaactcaagtcagtagatttttttgtgaatcctccgtaacttatgtttaatctggtttggctgagagttgcatatttcctttaaaccttatattttttatggatgttgaaacaagatagtggaagtactgctgacaataggataacaaaatcacgtgattttgtgcaatttactcataatttaactcaagtcagtagattttttggtgaatcctccgtaacttatgtttaatctggtttggctgagagttgcatatttcctttaaaccttctatttattcatggatgtttaaacaagatagtggaagtactgctgacagtaggataacaatataattccttccaatttaatggtaggaatggagatcatcaaaccagggaagaaacaatgctgcatatcgttacaaccgtgaaggtatttatgttaaacacggttccagaacattccgtgacgaagagggcaagcatttctgggtagagtttgagattgtggacaagtacagggttccttatgggaaccaagctccttataacgtgacggtacattttgtcaacccaatggcttgtctgatggatattccaaatatttttatttaacttccaactaccctcgcttaccattggatttcaggttactctacttgtccctgggaattatcaaggagaaaggcgcattgtggttaatgcagcttataatgaaccaggcaagcagcggatgaagcttcccacagttcctgtgagaaccacaggaactgtgcttgtggaaatggttgacaaaaacgggttctacttctctgacgagttctcgctcaccttccacatgcattattacaagcttctgaaatggctcgtgcttcttccaatgcttgggatgtttagcgttcttgtcatcctgcggccacaagaaggcgctccgttgccatcattttcaaggaatattgattagtgatttgcacagtgaaacgtcaggtcctcatagaagcagataagcagaacaagatattagcaggatatccaatcacccatgaaggagcttgtccacatcatactgcatcggggagctcaatctgcacagaaaaaacccctcacgatgctgcatcccatcagttagctagttcgggaagtacagcttttagtcatgcaaaaagaattttgtcacacttgagattgttttctaacttatgatatttacacaaggaactggcagctgtctgatcctggtttaacatcttgagaattttagccccagatatgctatcaatctttcttgcaccatcatcctgactcctggaagatgctatgctctactgctatgtactactcccttcattccattttaagtgcagttatgggtttctttgttcaacgattgaccgtctatcttttttgatttttttatgattaatacttgtactattgttagatgataaaatatgaatagtactttatgcatgacttatttttttaattattttataaattttttaaattagatgaacggttaaacgttacatacggaaacccacgactgcacttaaaatgggacggagggataaacgttacatacggaaacccacaactgcacttaaaatgggacggagggagtaattggcagtgatcagcttgctatgattgtgattgaactcaacctgagatcattgaacataggtacataacatgatagatgcaagccttccaagaactgagaattttcaagttaactttacaaattacaaatgttcttacataatataatcaacctatagtacagaacaatctttctaactttcataagaaagattgttagacccaacccctcatattttgtattcacaaagcatggcggcatggtagcttaaagatgataaattaattaccaacaataattaattcatctcaaaatctcaacctaagtaggaacttaggatcacatcgttgcatgctaaactaccttaacccaatcggagctcctgtcttgagtcggcgccgcggcgacggcggcggcggcggcgggcgcgtcctgccggcggtggtattccctcctgaccgaccacagcgcctccgtgcaccgccgcatcgacggccgctccttcctcgccggcgcgacgcactgctcggcgagctccatcaccttctccaccgtcgccaccgacgccgggctcctcctgatcctggggtccatggccaccaccacctcccctcccctgaacctctgcaacgcctgcaatctcatcgcatcgctgtgagttttccatctcttgcggtgtgttcgtgcttgcgcgtgcgattggattggattggtttggcttggtttcttacccatttcgtggtggggcggggatcgaggtcgcggcggcgctcgatgggcgggcggccggtgacgagctcgacgaggaggacgccgaaggagtagacgtcgctcttgtcggtgagctcgtacgtgctcaggtactccgggtccacgtacccggcggcgctcttcccctgcgtgtcctccgactccgagctctcgccgccggccatccgcgccagcccgacgccggccagcttcgccgtcagcgtgtccgtcaggagcacgttcgatgaccggacgttccggtggatgatccgctgctctgcaaacggcgagtttcagtttagaattcagacttccacttctcatatcatcttcatatctctgaaatttcagagaatatatgtcacttacctttgaattcgtgcaggtatgtgatagcatgagctacgtcgatcgcgatgttgagccgttgcgcaagttctaaaccatttccacaggattctgcagtgtgttgcatttgcacaaatcctgatcaattcctcctactaggtactagaattatttcgaatagatagtaacagtggtactattacagactagaatcttcttggcattgtagtttactgcaactgaatgaatcgatcaggggcaaaacgtaccatctaagtgttcccttaaggaaccattgctgacatactcaacgacggtcaggctctcatcttcgcgctcaaagaatcctaggaacctcactagattcttatgatcaattttctgaagaatttcaagctctctccgaagctcagctgatgcatactgactgtttaactgttgcaacagaagacatggttactacttattaccaagtaccaatctccaacctacatacctcatgaaaaattgctgaatatgcgtattccctttgtttccatacctttctggcacatttgatggcaatttcagacccatccctgagcttccctctgtagatgctgctataacttccctgctttattatgttcttgtcactgaagtttgaggttgccttaaatatctctgcaactgtgagctctgtgctttcttggggataccctgtccctgctgcacttaaatttgtcatttctccattctgattttcacacggtgggggatattcatgtttatctagtgctaaaataaaagtaaattgcagtttttcacactaattgtttgctgcttgatatttccccttttaacaggtgacctaagtacagttaatctgcaattaaatttactctacttaaccagcaaaacaaccaagaactgaagaattggaaggcaccagaaggcagaattgctgggcaaattcctcgatagaggaatagttcttacctggatcaatcgagacttggtaacctgtacttctgctcccttgagaaatcgtcgtccgagaaatctcaagttcatcctcatttctggacttcctgggcacaaagcaactgaaaactccggcgagactctgcgccgccgccctgaacgagccgctgctgcgaaccgagctcctgctgatctctgaagatggaacgctgtaagaggaagcctgacgacggtagacctcaggagggcatgattggtatctctggtaagtaggcttgcaagaactgatccctgaaacttctttgccctggctggtggtgctgaactgcctcttggctgcaggcaattccatggcaagaagatcgagaggaaaaatttcttggtctgattattgcttcatcgtttttcctttggatgcataaatatggggacgatgacttggtgccgttcaatggcacaagcctttgctgagcgtgatgttgctgtcctggagctaggtcaacggtgtgctccgacgacctgcaggtcgctactatgtcgcttcccaattctttaattgttgatctggttggacggtatatatagtgataactgttttccattatctaaaaagtgatataattgttttctgtatagttgtgtaatcgtatgaattatgacgataaagtatattggttccagaattgtaactttttaattgaactattgaagttaggttgctgttcctggaagggttcacatctggtccgtggcatcacaagttcatacaggaagacgggaagaagtggaggactttctgtgatgtcatggtgtgattggtaaagatttaggtgccagaattggtcagattattagcggtctactcgctccgtcccaaaaaaagacaaaccctgggtttccgtgtccaactttgattgtccgtcttatatgaattttttttataattcgtattttcattgttgttagatgataaaacatgattaatattttatgcgtgacttgtctttttaattttttttcataattttttcaaataagacggacggtcaaacgttggacacggaaaccagagtttgtcttttttttggacggagggagcatgcagatgaaattgaatattgttatctaggatcaatcagtttaggataggaatgtatgacttggatttcgtgatgcaaggaaaaataaatagtactacctccgttttttaatagatgacgccattaactttttctcacatgtttgaccattcgtcttattcaaaatttttatgcaaatgtataagatataaatcacacttaaagtactatgagtgataaaataactcataacaaaataaattataattatgtaaattttttgaataagacgaatggtcaaacatatgagaaaaagtcaacggcgttatctattaaaaaacggagggagtacaatattgtacctacgtgtcgttgacaacaactcagcagaactccaaatgataccttgtactactgttataggagtaccataataaaagatcaaaatttggtagctgaaacaagaacaaagccttgtttagattccaacttttttcttcaaacttataactttttcgtcacatcgaactttcctacacatacaaactttcaacttttccgttacatcgttctaatttcttcaaacttctaattttgacgtaaactttcaattttggcgtggaactaaacactagccaagttcgttctgctagctaccgacaactttttacatagtaacaagaggtcttgtgataaaagaagtttttgttcattcgtctgctgaaatttcaatttaaaaattaattttccttattttctactacagttttcatattcaaacggttaggaatagagacgtaaaagtatttatcaaaagacatttctgattgcttcgattatttttgtagcgctcatccattgttttcctatatccagtcgatcaaacaaggacgctttgcatgagcctgaagaggtattagtacagtactacttgacgtttccttgtctttgaaatttcttcagaaacctgcatccgtctgcttccatggctgatctgctgcttatataggcacacccgcgcatgcatgtcatgcgtgaggacgcgctcctcttgaggccgccatagctttctttaatttgggtttggttcattgattggattgaattatccataaccaggaattactcgaagaacaacgtttctttactctttgcatacaacatcaccagagatacaagttattgacatatgccaaattgccaacggtttatgatgagataaccctcaatccagcaatgataaataccgcaaagtaccatcaccaggacaaaatttcataaatcagtttggaacaacatgcaggtagcaatccctgcaagaatgataccgagccaaattgaaaattccccaggacacttatgcttcagcaatatttgaatttaagatataagtgctatgtcaaaatgattccaaaatgatgaccaatacatctggccagttctgtaccaatttcccacatctttcattctctttcgtattatgcacttctctctcaaaagcgaagcaaaactcatgaatacatcacgcaactacacaaggtctctgtcatttacttcagtagactaattcatctcggcttgtattttttcctcgggtggtggtgaaacctacatccaggatcactggagaaccgtgactgtatctagtcagatatgtaatctgcaatagccgactactactgagtactgaaaagaaaagaaccacgtcgaattagacatcaaactcttctctgaattttctacttcctctgctacaaaaaatgacccaccatccaaattcttttgatacttctacttcctggacctgtcaaagaaaacagtggtaaaatataattatcacactagcaataataaaaagatcaacaaggattaaaattgcagcggaaaaagaacaattctgaactttcacaatgaactactgtttctatttaaaagaactttctgacaagaagtacatatgttaacaattaacgtgcacacgcatccagcattgtgcaaaaatgtgacagtcattttccaagaagttcaaaagtactggtacagcaatagctacagtgaccatccaccaatggaccctttgatatatttttttaaggaaactatgaactcttggattaattaaaagcaatagccagtgcccaacattattggtttcctaaaattccattgctgttacaagggagccaagaatccctctgttgacaggtcacagaaaccacaagtagaacaatattcagaatgtattttctttttctaaccttttcaaagatcccgagctcttcttcttctagggcttctgctgtttatagtaagtgaattagatgcaagctcgagtaacttttttcttacagatatgtcaaaggagaaaataaagtactagactaagataaaaaaaaaaagcatgtggaagccatatcccaaaacaagcagtaaaaacaacagatattcttatcgatactcgtcaatccactctagttcaaccaaataaactaaaatacataggatgcattagaaaaacattgcattttagttaatcttgttgaattagactagatcgacggctatccataaagtgactcgcgtccatccctactccatagagttcatctctacacaaccataagaaagctagacagaaaataaataatgaaaataagcacaataggaacaatgccttgtccacgtgagcataagctccactattacataactaatgaagaccgaccacagcaagaccgtcaaaacaaaaccacattcaacatcctaaattatggcggactccgttctgcgcagtcatcatatgaaaatggcagcaaaactgtaaaactaaacaacgcagcattctagaatactaattacaatcagctcgttactttatacacgtgacactatcataagtgttgaccctgaaaattgtgaaaaagtacagatataacaatgcagtaaaaacagaagatgcaagcaacaatttaacatactgatcagtggaattccagttgataacctttcataaacaacaatatgtcctaagaaaatcatgacacaacggaaggtgatattggaagctaaaaactgcatatctcactcaatcgtcacaaacatcgtacccaagaagtcacagactaaagtacgaaaagctgtcgaaactaacaaaagagacaccgatttctacagctacaaaaatcttagcccatgaaacaaagacaggtcgtcctagcatgcaagacatgagcagcaaactaatgaataggaaggaatcccacatgaagaaacatataagcaactgcaattccctaacagggcaaacccatgcaaaggtggcgagtacgagacaccaatatgttgcctcaattctacgttagattcatccaagattaacataggcaaaaggtccgatcaagaccaccaagaaactgcgtaatcaacaacagcatcccaagaactcaaatgtgccgaaccagaactggacgcgtgccgaaaagctcacctccaggtacggcgaggcggggtcatgggccggcgcctgcaggaccgcttcccgcatcgtcttcgcgctccggggtgtaccacagcgcccctgcacccgcgctccgcacccaactcagcgtggtagccgcggccaccctcggctcgttgtacggcgaggcggggtcatcggcggcgaggacggtgcgctctcggcgcgcacccaggatcacttcccgcatcggctgcacgtgggcgcgcgcgcgcccccgggtgttccacagcccccctgcgcccgcgctccgcgcccaactcagcgccatggccgcggccaccctcggctagttgtgcggcgaggtgaggtcatccggcgcgacgacggagagctctcggcgcacgtacaggaccgcctcccgcatcgcctcctgctccgcagcgtccccgcgccccgaggtggtggtcccgcgccccgaggtggtggtccgccgctgcccctcggccgccttcctcaccgacaccgacacggcagtagtcctgaccggcgcggttgtgggcgacagcgacgacggccttgcttccgcggggtcagccgaaggggctgcaggaatt

SEQ ID NO: 44729 - DNA, 7197 bp, Oryza sativa
tccgaaggcgcaccagcgaggcgattgctccgcatcgcggttgtcggcgacgacgaggtcggcggtgctgccacagccgcggggggatccggaggcgcaccagcgaggcgattgctccgccttgcggctgtcggcgacgacgaggtcggcgctgccgccgcagccccgggggtagcaggaggcgcaccagcgaggcgactgctccgcctcgcgttcgtcgacgatggccctgcttccgcggggtgatccggaggcgcaccagcgaggcgcttactccgcctcgcggttgtcggcgtcgacgacgaggtagccggaggcgcctcagcgccgcgcttgcccttcctgttccccggcgggccgcccggtggcttctggccggagccgccgggcgggaggtcggaacccttcatctcgggggcgctccgccggcgaggtgtttgcgggaatgcgcgggcgcggcaaggcgaggagaggagagggttttggcgctcggggttgggtatttccttgctccgccgaaatgttggtttgtttggtgggatgctttgcttcgtcggggtgtggggctcgttttgtgggggccacgtttagggagggggaacggcgtgacgtgactttctttcttgctttcacattttcttgtgtaggtcgtggatgccgctgacatgtgggcccaactgtcctcttatgtcagggtggcggtttacgggagaggatcacgttactcttgcgtctatgtatacgtagtagtaggagtaatatgctgtttttagatccaaagtttgtatccaaacttcagttcttttccatcacatcaacctgtcatacacacaacttttcagtcacatcatctttaatttcaaccaaaatctaaactttacgctgaactaaacacagtcatagttgcttgaaattagttgaaacattttaaggtggggttcttgatttggggggcttttaactattttccacttttagatttggcaaataactatttgccacccctatctcaatgacacgtgggtccacatgtgtctatgacatgtgggtccagtgtcaaaaagttaattgccacatctaaatgtggcaaatggttaaatatctcttaatttgggacatgagattctaaaataattagaggataccgcgctgctgcggaatatttgtattaaaataaaatttaaaaattcaagtacactttgtgtgataaaaaaaagtaagaaaagaagggaaatagaggctaaaattctggatgatattgtagcaacttttgcaaggaatataataatagcaatgcttcactttgagtacattgagagtttgagatctcatataaaacaccaccatagtgcttgacagaaaataggatcatatttaagcacggtgaacaaaataggataaggttaatggcaaagagcaagcttgttatctgttgcagaggtaagagttgagggcccctttaaatcgtaggattgagaaaacgtatgaataggaaaaacgtaggattttgataggaatgtaagtgtaaaacagaggattgcaaaacgcaagaaaaacacaggaatgaccgtttgattgaaccacaggagaaacacaggaattggatgagagatatagactcaaaggaaagttagcaagaggttgaagctcttgctaaatttcctccaaaatctctataggattgtccattccatagtaatttcaaaggattaaatatgattcaatcctttgtttcaaagggctttataagaaattttcctataggattaaaatcctctaaaggcccatttgaatcgtaggaatgaaaaaaacacaggaataggaaaaacacaggattctaacaggaatacaattgtaaaacagaggattacaaacacacaggaaaaacacaggaatagccgtttgattggaccataggaaaaacgcaggaatcggatgagagagatagactcaaaggaaatgttccaacaggttagacctcttgctaactttcctccaaaatgtgcataggattacacattccataggaattttaaaagattggatagtattcaatcctttatttcaaaggtcttcattggattttttttccataggattgaaatcctccaaaaatcctacattttcctacaaatcaaaggggccctaaaattctatgttttttctccaaatcaaaggggccctaaatggttttttatgtattttttctcaactactgtagcttgctattccgaaactcagtttattattgatcaaaagctaacttccaaatctatggggcaaggagaagaacaataagagctaacttccaaatccagagcctgaagaatcacacaaaaagaactctgaatgagagcaccgtgttgcatatatgataaaaaaaatctccatctaggtcattgcttcattgaatcatacagttgcctgtgtattctcatagagttgaccaaggatcaccatactttttgatatattgggaattatctgcaattattttttatcttactccctccgttttataatgtaagtcattctagtattcctacattaatattgatgttaatgaatctagacatatatatctatcttgattcattaacatcactatgaatgtgggaaatgttagaatgacttatattgtgaaacggaggaagtatcatttagtatctcaagtccgcaagataaatcatgtttacaaaatgagctgtatataaaatcattgattcactaaatgttgcttagtgataaaaattatttgtagtcatgtagtgcaaatactgttgtacagggaaaataaaaagggactgatttgggatactgaattcggttgaaaattgatatataattgaatcgaagaaattagtgtgactactcaattagcatcaatcaagatgtattataaaaagatttagctgaatggggaaagaacttacgctggaacatctgagatcagcaagcagtggaagtggaacaacccctttgttggccgagcagatcaatccagggatctgtgtatggaggagaagcttcttgctggtcgagcagatcgatccagcttgttggctgagaagatcgatccagctgctgtgtatatcatcatacataaataagatgggaaagaaaggccggagtaatgcaagcgaccgtttgaaaacatgaagaattgaagatgaatagacgggactaatttcttcgggcagtttaattcagtttcttgccctgtgcggccactgatgcttccgtttcttcatgcacacgcctaggaggcgaagaggttgggaggcgggtgcttgggggcgcgggaaggcagctgcggcacaggggtgcgacatcgcggggagaaggggaagtggcgactacagcgccggagccacgggaggcgatgcggccgtgaggcggggtccacctgtggcgttggtcgctccgagggcgctacggagatgcaatgaggatcctcgagatgtaatcgaacggctgagaactaaataatgacgtggcttaaccacagctcaggaaattgcacttagtggggatgacttgtacagatatataggattccatttctacaatctatgttacatccttaaataacttcatttatatcatactccctttatcctaatttaatcattatatttacaaacgacgctaagaccaagacaagaaaacattgttccttttaaaattaaacatcattgatcaaagtgttattctatacatgaatatgaggcatgcaatgatgccatttatcactgcacagataagcgaacaaacatacagcaatatcatttactcctacatacaaaacgaatagacatgaaacaatagtattttatttctacacatacaaacttatagacacaagttatataatgatcaatttggtaacacccaaaaaaatcttagaggatgatcaaattgggatgaaaagagtatctccttatccatcctcgagctatatttgcaagtgcaacttaaaggtatgtttggggcgggcttaagattttgagaagcagttgattgataaccagcttctgagaatctagaaaaactggattttccagcttctgacttttagtttattttctggattgtacaactataggttctcagaatctaaatcaaaagttatactatttatgggaacttctgattctaggtgaagctgtagcagttagaagctcccccaaacaagcccttagttgggttagtaaggccctctttgtttaggcttaggcttattggcttagacttttaagtcagcttattggcttatatgatttataagccagtgaatttaatatcctaagtttagtggtggagtcatacatctatctcatataagccaaaaaaaacttctccaacctagcttttggcttaatagtgtaagagtggcttatggcttcaaaaaagccaaacgaaaaagctgcttgtttgtttaggcttagacattttggcttataagttggcttataagcctaaacaaagaggacctaagtagcacggaaaatatagtggaatttatgtatagcaacttttagttatgaatctaaataatattttggaacggggagtattaattattataaacttaaagaacgaattatttattaaaaaaacttatgtatagtttttttttcataaaatgcacgtaccgtttaaccctttttatttgagaaatcgattttgaaatttaaaatttgattctcaaagaatgatttggtttttttttgtttctcttttgaaaagagaggcgaacaacgaatatgactgaaaaaaagccttaaaatcaatattaattgaacttctataattcattatcacccaaccaagtaggcactagataaatattttctttttaaaatagttaaaatgttttcatccctaacctctgccataaggcacatggccgataaaaaattaatgagatgtttgtatcgtcaatggtatcaaaatatttatttgtgatcgcagatttcgtatcgaacataaattacaagcattcatatgatgttggtttcctttaaaatgtgctgcacatttgccttaagattttcaaaaacaatttgaaaccccgataacaagcaaaggtatcctagagaatcacatttctacacatgttatggtgttgtgcatacatcttcggccttcaaagagttatgaaatgttatactgagcctctatcatggaccagaaaaaaggcaacatatgtgcacttgaaacgctgttacagacaccacccaatgtggttcaagtttcttcaggcaaaatcctggctcgtcattgcactcgactactgttactagtattgatgaataacacgaagtacaaactaatttgattaattttcctcatgaagcaacaaatcctgagaggaattccagtatgacatcatccaagagatcaccatgtaacatcctggctatatgccatcccaccatgttgatgccctcaccgaattccagccattctggatcaagaatcttgtcatcaggatgtgctacagcaagctcttcctgctgcctgaccattgtttgccatacaacctcaacaggtccttcagggccccaaacagggcagcaatttctactcaactttgcccacggatgcgtgtcgatgcatggtgcgaggatctcagaaagaacagaattcgcaagatcaaacagaagcctcctttgtggtcttggccatgtagcaaccttgctgtacttcccctcaagcttgtcgaagacatgaggaccaacaaggtaaccagaagattgccatgacttgaacaagagctgtgagtccgcgactatcacaccggagcttataagtatgtcaagtagataagagaattccttttcctcctcaacttcaaatgcttcaagagactggtcagaagaatcattgtcattgtcgctggacaaggatacttcttgctcatatcggagctcacagccatatatttgtttatcgatgcctgaggccaacataaaagattcaacaatcaatttagtgctctgaaagttcattgatcagaggcaatgaacatttcataactagtaaaacattcaactgggtagaaaattcctttttaagagtatgttaattacaaactaaattagttaaactaaaatccttttcagtgtatgctaattacaaactagttaaattaaagggctgaactttgaactttccaacttttaactcagtgatactacaaaagaaatttatcattagttagttaactagtcatatttactagatagcaaatgcctttctagagtatgttaatcacgaatgatgctccagtcatgtgctatagactacagaaatggtttagcttaatttcataaatatttgtatcaacttcaacattgttaggatagctgataaacgcagtacagacttctcctttgaagcaataaaattcttttatgaagaagggaatgtttctttgttccaaatggtgctggtctgtctcacttactaggcatgacttgcgagtcattttttaagtatccagaacaacaactgtcttcatcagttggaggctcaagaatagacactgggcttggtcggtcaacctctttcaagcttctacgagactttgccgcacaagtatgatcagaaatagttatggcttcatatacaccgcaatggaaaggcgatgctgaaacctgaaagggggagcactgggtgagtggtaaccacaaatttatgcatatagtatgacaacaccagacgttttaaggctccaaagatgtcaacaaatgaaaattggttaactcccagttcatcattatattggacaaaatgaaggctaagtaaggtattgcagtatgtacacaaaccaagtacttagtaccatactagaatagcacatgtccgcactcaagaaaaacttaaacaaagaagccatactattgataaagaagaaaaattaagaaaagagcaatgtctatgtttctgggttcacagtagagtgtactttcttaagtgcttactgctttgaaaaacataagaaagaagcgatctaatgttaaacaaaaaaaaggaaataagaaatgatacaggaacagcaattgaaccctttttaaaattaaaattagagtaaaaataaatgtttaagtttattaataacttcatagtagagcattcttgtcatttcagaaaattcatgatccttgaaataagaaaaataccatgaaagta

SEQ ID NO: 44730 - DNA, 985 bp, Oryza sativa
  unsure (1)..(985): unsure at all n locations
atttgctgccgtgttgttttatgggataaagaatcaaactgaaactgaccactgttgtgactaattgatgtatttgagaaaaaaatatcgtgaggggacctttcacaggaagaattcttgtccaacaaactgtgaggaggcaatcgaggtgcatgctttggcaacactataaagcatccttccttgtcattgttgttgccccggttaagtttattgtcttgaatctgcacatgtgagtctgaatccctcttcaacctctctgaatcagataaagcaaacatctctgcaagagtttttgaaccaatggcaccttcctcatacttgcggcggattttccagggtgagctatttgatgatgacctgttgctttttctggagttaacttcactgctaacacacttctgagatgatccagtgttatccgtatccactgtgttatattgatcaagtgatgaatcttgtcgctttaacagtgaatctacagcattgctagtcaagtgtctttctccttttattctaggcacattaatatctttagtgcctaaaagattttgcgaacccctgttcgtagtagaaaactcagcctgcttcatctttctcctgaaattcttattgacatcagagggttctggtgtagaaaaggcattacctgaatgttggacttcccctaagcctagctccagaacaacaatttctttaagtgaagagttacctaaaccaacagggtacttcctgaaagtacttgaagtactatctttctcatatcgataatttggggaacaattcacatcataggggtgcttctcaaacaaaggattatttatctctagcgagttcaagcgatcaaaaccatcttggttcactacattgttatcaaatgtttcatcgccgtagggagactttgatggcataagctttcttagctttaatgcacttcgcttnnnnnnnnnnnnnnnnnnnnnnnnnnnnnnnnnnnnnnnnnnnn

SEQ ID NO: 44731 - DNA, 20751 bp, Oryza sativa
gcagaaatagccaaaacgaaacagaaggtacactcactggggtggacaagatgtgagcatctatgctcacataatcttctgccttttcatgttgttgttctttccagtcctcgtctccccacatggtttcatcaacgtagtcatcataatcgtaattgtactcatcaggcagatcttctacatcccgaaacaaattaaatgatgcatcagcatcagcctctagaggctcgctattttcaacagtagctgcttttgctgttccggtatcacttgcatcagtttctgagcttcctgcttgattacttttctcatctgtttgaagcaaccttctctgaacatgtgatgcattctctgttgtagtacttaaactagagttgttcccagcatctgtgctgtttagattgtttaacacatccatattctcctgtcctcgggtagaattaggtttactttcaactggctcttccttagacgcatgtttcatggaatcaactcctcgtgttgttgagtcatttgtgctccctacagtgataaacaaataaaactataatgcatctcttgtaaatgatcttatagactacacacggagtgtggattctctgttactaaaatcagagtactggagtagcataatcgttactacgtgcatgcaccactctctttagagcattttccatcctctggttggtaacatcacataatctagttataatatccaggctccactgtattatctatatatctaaggacagcctacaaatatgttcaacaaacatcaatattgaactaatgatcctaaagtaccatttaacctaaacagcgcgcagagccacagactttcaaggtagagcatgtaaaatactagtgactagagaataagcattgcagccaaactactaaagcaacagatgaaaagaagggattcttatgattgaccagtgaatagtgtgattatagcttataagataacttacgtgactgggattccttagaagattcattcacaactggcttgtcctgaatatttgggtgagattcttcagaagcagctttctttgcaattgagctgtcatgaacatctggatgggagcggtcaacgggatctgtattcagcccaacataccagtctttgtgtaccttcctacgaggtacttctagcttgtccatcatcatataacctgataccctacataacaaacaaataaattaccatgtcaaacaaactcaacaaataattttacatgttcagtgaaaacataagaagatatgcaccaagttccttacctgaagaaattcactacaccattgtaagttgccaaaactatttcccgtgtcccgtccttgtcaatatcatatagaagtggacttgaatgaacatttgactggtgaaatgcaggccatcctggaatcaatttcacaacaatatatattaataaataaacaacattaaaccaattcttttgttaattatagcacaaactttcaggacctttaaaatgtggtagaacatcttagacctattcattcaattgatggttttccagaatttatagcaaagagctaatgatgaccactataacatgctaatcggtaatgtgaaaccacacacctggcaatttgtccccatcagagccttcaagaacttccaggtaatgaacaaatgatggcaccactacttccaactttccatcgctaatacaccaaaagattatcattaaagtgtgcccagagcagactaaagaagaaattaagacaataactagaaaaaagtcatccacgtttaaaaatccaaagcaaacatgcatatgatatttcacagtgtccatagtttgaagcacaaaatcatacagaggaaaaaaaattcagtttatggcaatgatgtacttatttgattttgaacataatctatagtaactaacagaaggtttattcagaagtggatgctgttccagagcatagaacaatagatttatctttatacaagcaaataatgatggaaacatgaagtcaaatagaagaagataatgagaaggatatctgacaaagattaacatgtcctaaagccaaaaaaaagccaaatcatttcccaggatattttacctgttgatatcagcgatcaacggagttgcataaatgctggaactaacttcagtctgccatctcagctctacatgttttggacacttggtcttcaataaagcatcttcatcactgcggagaatatatagttattacatcgatgaatgcatctatccgtacagatgatcaacattatttgtctaggtaactttcaaagatgtagtgtccacaatagtaaaatctttcatatgtccccctgaacaaattgaaaacacggggatcatggtagctaactgaattaataaacttgctccataagttgtggcattttgcaggtgctcagttgaaattagtggtatggataaatgcattatgctttaggctgtgatttttctctgagaaactacaatactacagtataacaatttgatgatccacatgttgtaacagccaatcttactcttaatctcttaatcctttttgcagatgaaaacatcaataagaatttatatttaacaggaatgcttttttgccccctgtatggctgactaatatatcatatatatttgtgcagatattttaagaattagcacgccaatgaaattcaggttgacagtgaaatggtatcaaagattcaagtaatgattgatcatatacctgcttttagattgaaattgaggatttacccttcagtctacatgtcagtgaccttagatgaccctatatgtcagtggcacaggaggtttaatactctttttttttatctaaagagaggatatatgatcaaatctatttcaaaggacactaagattaactctgaagggaacacatctgaagagctgtttgcgcttttacagcactcgcaaaaacaacagaactacaataactgatctagaaacctcaagcgatgtacagattttacatccatttttacctacagaaccaattataaatgtagattttattgtatgtgggtggtggaggggatcagtgagtactaattcttttaagatacaagagaatataataataatttcacactacaaagaatcaactgaatgaacaaatctgccaggcatagtatggttggtcacaaatacgctaatcccaataaggcctattacttaatgcagggtatcaatcaccacatgtatcatatgtgcccattaaatggaacaaaaattaagcgatccaagttttttaaaaagaagagtaaatcttcacactctagaaattgcatatattcttcttttttgtgacattagcctgcatgacagttgaaacaaatccagattatgaaacacaagcctgcataacagttgaaacaaatccagattatgaaacactagattgggtgacctaaatgaaaagaaggacgaaatcaccatttccatattcaaattaactattccataaaatgagttaattgctttgtgtaatccctgatacatcaatgctcgaatgaagtagaagtattttccaatgcaaaaaaaaaagtgtagaggttttaacagattctgcacatcgtgtcattctgagcataaattgaacactcctacagaaataataaggtgattaaggtcgttaactactaagaaattacgaggagccacagaaaacaaccaaccatctaagatcgcttccagtcccaaggatctagcagcagttcagttccaaatcgaaagcgacaggagaacccatgtgaaggagagaggcaagcggtgactcacaggtgggggtatccaagcatgtcgtcggtggcctcgcgctgccggaacttgttcgccttctcctcctccgcggccgccggcgctgcggcagccacgagaagggcgcataccgccgcgaaggcgaggaggggacgcatctgagtacaaaaccctagaccccgagggcctcgccgcgccgcggcggtcgccggcggtggagagggaaggagatctcggcgtggaggcgccggtgtgggaagtggtcggagactcgtcgggtggggaatccgaaatggcgaaagagacgaggggttttctgtgaaactgcgggtcagatcgtctcagcgctcgctgacgagtgggttcaggatgggatggatggcgtgcttgcttacatgtggggcccgcatgtcggatcgaacgccagcggggcaggcagacgagggtgacgtggactctctgtagcatcaatgggactcatcttttcgtctagacgtttatgtttatcaactaaatttaaatttttaactttagatttgaagttgattttgaggtttttttttcagagtttattttttagtgttttcttttagatcattaaaaacacgtatataaaaattttatttataaattatttttcacttgcaaatatgccgtttcgcacggtggctccgaaaatcatcaacgatttagatagctcgttgtgattttcaaacttgtatttttcagattaaaacaactgcaaagatctcataatatggaacaacaaatcgttgcagcagtaatgccagatttttcttttctttctggaatcagggtagttcgggacccgggatcgtgcacagtctcggcatcgcgtgggtgttgtgccgggcaacgccgcgatagtctgattccaaaaacaaaagatcggtacgtgtcctatctacttgtcctcttttcttctactccaagttgaattcgaaaaatcgaaaactatatttgtgctcaatatataaattctgcctcaccgaaggacgagtgccgtctcaacctcgatcctcgctcttgctctgccaactcgtccctcaggagccttcgtctacgcctcccagtgatctaccgtatccaggattttacgtacgtatacgtatcttgattcctaatttctttttccggattatgatgtttttcccgtacagaggttgatatataattaatcaatctaagaaagacatatataatcaatcaaccaagctgagtttattcaattctaatttttgtcgttctactaatcaggttggtctagctatagctgttgcacatatataactgatgcctcgagtaggggatcagcacgcatactctggagatagagtcggaaccgagctggtatatctttcctgcgtcatcggaggatgctatcttcatcgagtgagacgatcatgggggcttcttacttatggagcggcgattggacagtacgcaatagtgttctattgttatcagattagcttttatcaattagtacttgatacaatcaattcgcctaatgcacggcctgaccggagggatcctgataggatccccctagaatttttatttaaaatacccgtgcgttgcaacgggtgaagttattttaatcctattattgttatatggtttagttatggtgaaattcactgtcttaaattcgcttggatatataccttgttagaaaatcatgagatgtaattaggagtccgatcatctcaaattaacatgcgagttttttttaaagagatttcttatacgactccttctgtatttgcaaaagcaaacgaacttaaaaaccgactcaaacactgatctatattttcaaaagcaaatgaacttaaaaaccgacttaaatatggaggacgtaccaaaataccggtaaaaacatctttaatttttataatagtagagatggtaaatatcaaatactattgtttctctccgattctttttgttgttgttcgtggctctcatcttcttattattctattggatctactactcgttggtgctgccatctgattggcatggatgacgatccagagatgtgctgtttgtgacgctccaatcgcaagaggcgagaccgcgagagcaacaagtacaccatgcgccggcgctcttctcttctcatcctgtgttactccagcccagatgtgagcatgtggcccgtgcagaaaaagaaaaacagatgaaaggccacgctagggccgtgccggtgaaggaaaggagagatgggctgagccagctggttcgctagggccgaaaaaggagagaggaaaagcgggccgtcgaagaaagagatgattcagcacatcatttgtattttctactagtgtgctttttttttttggaaaatatctgaacgtatttggatttgaattcaaaaaattagttggaactaaggaaagattttaacgaaaatatcaggaaatctatttttgtactttaacccctctctccatctatttcttctcctcctatggcgttaggtgttgctactcgccattgtctcatcacgctccgccttatctatggggccttcctcgctggtacggtgctctatctgccggtgcccatcatcaccatactgggtgaaaacctacattcattcgcatctggctggtctgcatgtttcgcagagcaaatggtctcgattagtacattacaacaagtgcttttcacggttggaaaggtcaaaagaggttaagctatccacttgcccagaccaagcaggcgtctggtagatgaatgcattgatcacatgctcagccgcataatccgggctaccataacactaaagaaaagaaagtcataccacattatcacagctcgtaacataaaacttcggttgactcgcactttgatcatggagacatatgatcaaacttacagtgtagcctacatatttactgcagtagtttgcatcaaggaaaccgaagcaatgccccttgctaacacactattccattcgtcccataaaaaatcaacctagtaaagtggcacattctagtacaacaaaaagacatacgtctgtttagatttgttatactggaatatgtcacatctagtcctagattctttttttttaagaacggagggagtacactactactcctatgctgatgtgtgttggtactagaatgctggttttaaagtggagattagtggctcattagcatcgtttgaatggtggttgtttagccgagggaattggtggtgaggttaaatagtattgagcctgagcttcccagctcactgccttgtctgcatctggctgacctccatgtttgcgcagagcatctgtctcccattttgttcgggtgtttggcttggcctcccctcctcttaaattcacacacgccccacctcgtcactcgtctcgtctcgcacagtcgcagctgctgcggctgtttgcccatcaatcaagaaatggcgaacaaggctgtcaccattggcgatctgatccaccgcgtcgccacctcctgcctctccaaccgcctccccggcagctacgcggtcagcgactccggcgacaccgacttcgacgacgacgacgacgacgaccccttcgctgacgccatctcgggggccggtggcgagcggcggcgcactccctcttcttccgaggaggcggaggcggaggcggaggctgatgatgagggggaggatggtggtgagggtggggaggaggaggatgaggagaatctgaagatctgggaggagaagaggaaggtgaaggcggcggcggcggtggcggcgagtggggctgagcgggcgagggaggcggagacgctcatggcggaggtgttcgacgcggtctccggcgtgcgccgcgcgtactctgacctccagggggcacactgcccctgggaccccgacaagatgcggagcgccgacgccgccgtcgtcgccaagctccgccacctcgcgcggctccgcgaccgcttccgccgctccgtcgccacgggggggcacatccccggccccatccccaccgcgccgccgctccgcgaggccgtcgcgccgtacgaggccgcgctcgacgacctccgccgccagctccaagccaagcaggccgaggtcgatggcctcaaggagaagctcgccgtcgcgagcaaccgccgcaactcacgccaccacccctccaagcacaatgcctccggcggcggcggcggcgccccgaccgcggagctgttcgccgcctgcgccgagcaggcccgcgccgcgatccgggcgttcgcggggcacctcctccagctgatgcgcgcggcggggcttgacctcgcggcggcgacccggtccctcaccaagatcccggtgtcctcgccgcagctggccaagcacgcgctcgaggcgcacgtcacccgcgtcctcctcgtcggcttcgagcacgaatccttctacctcgacggctccctctcctcgctgctcgaccccgccgcgttccggcgggagcggtacacgcagttccgcgacatgcggggcatggagcccgccgagctcctgggcctcctcccgacctgccccttcggccgctacgccgcgagcaagttcgcggcgctcctcccgccgcgcgtggagcaggccgtcctcggcgacggcgagcaccggagggcggtggagggcggcgcgcacccgcggacgccattctacggggagttcctgcgcgccgcgaaggcggtgtggatgctgcacctgctggcgttcgcgctcgagacgccgcccagccacttcgaggccggccgcggcgccgagttccacccggattacatggagagcgtcgccggcgggcgcggcggcggcgccgccggcatggtcgtcgggttcgccgtggcgcccggcttccggctgggcaatggcgccgtggtgcgagcccgggtctacctcgtgccgcgcggtggccgaccgtgacaggatacgcaatgcacggatcgcctcttccttagctggagtagttgattggtggaagcaagtgttgtagtagtagctgcttaattacatgtgtaatagacttggattactccagaaatgaaggatgaaccatttagtctacttactgttctatttagcattttagcaacctcttatctgaagtaatccatgggtaagagaattgggtgtatgatcatgttgtactattactattatttagtcaaagtaggggttggtactggagtattagctgggtcatgtgtactatcagtatgatcatcgcaagatgtgggcttgagtatgatggataattaagaaggcactctatcattcagaagatgtggtagtagttgtcacatgacatcaaagaagtactatccttaattggcatttatgatgtgttgctattagtctgttaattgaagaagttgaaggctactagatcattcttgctgggcagaggacaggctagatctgtttagatagattttctgcaatttaaaaacattaggcatggtacacaaggaaagaacagtatgttgctcaatgtatattcatcaaaagaatgaatttgtatcttgttcagatcaaggtattgtgccttttaaaagcatgaaaacatgttgcatgatagagctgttcaggtgaagaaatgcacagtttgtctttcgcaaacagatctccagaaactacagtaaaagaaaaggggaagaagcagatccctttgttctcagaagcttttgcctaaacaatttaataaaagatgaattgggtctttctccaaagtgatctcgtagctaaggaatcaacaaagaaagaagcaaagtggaacacgaagatagcctaatacacatggtgaagtgacactggggatctaaatgctcataagaacaaaacccttgtgcaaagaattgttcttcttttattgaatttattgataaatgtaggtacgaaccaaaattttgaaatgaatagcctatgcatctaaaaataccaacctaaaaagtttgaaccttgttttctacatgactttccttgtccgacaaatctagccctcatgtggtcatgtaactcctgtaaaacattataaatattctttcatcagaaatggaaacgtcaaaacccggtcgcctagtatgaaatactatacttgttagtgaaaagaaaacttacaggtcagttcttgaggtagcccgtatgctaacagttttgtcacggtagttactcaaagttaaatggattcaatcttagctatttcctccaggccccagctgtattgatcaaagctaatgatccgcaagacttctgctcagacaagaaacacaaacttatggaaggaggatataaacccataaaatcagaaacaacctctcctgcggctatagtgtgggggagctaaacagttatcaaaatattctttttgaatggctgttaagaaaaaaggcaaaatattatgccaagaagcaatgtcctatatgatggaaattggagatgtcctaacattttctagagcagtaaatttatgtattgttagtatcgtaactaaacttgatttacttagattgggttgcatgaataattgcagcacaataatagaacataagttctatcctataacctggggactctggagtctgtcacagaaatgataaaatcacatactgtgcatgtaaatcatttctttctcagcccattcgtacatgaaacatatgaaaatctaacttgtatgctaacttcctgcttgctatagaagtactactagtacttcctaagttattgctttcctgaccacctgatgcaaccagaatggcagacgcttaggcatgctcattactcaggagccatgattcttggaaagtattagttcataatgctattgctaggaaaaccagaattcattgggtcagtgatcatactttttttcaccatcaagtatcaactgcctcaatttgatcaaaatctagatccacaaagctctccttcccaaaaagtgtcaactgaagagtggcctgtgggaggtacatatataacatgttcttagataatcaagcaatattggaagaataggtaatggaaaattaccatacaattaattcactgatttttgcgatgttcttagatggaattatcatcagcctaaccttcttatttttgcgattcacttccaggagtgaaccagtgaagccttcaaaaggcccagatagaacatgaacactagcaccaggcgtaaaagcattgtggttgctgccaccttttgagattggtttcttaaactgtctcttgatcttattcattagcatgagttcagaatcttcaacgggtttgttgaaagactcgacaattcctccattttccatttcttcaaactctctgtcaactctctcttgctcctccttttcttccctaataatcgattcaacttcttcaactggaataggtttaggctttttaatctgccttttgctgcattacaaaaatatagcgtgaaggtaggcacaaatgaaaagatgatattagaaagaaggaaatggataatgtactttgctatattctgatcttagactttccatcttctataatttgcacttttacaactacagtcagttattgcctttgaacgaagattgctactttcactctgatgaaatccagataataactaaccaagtagcttatggttttgaggaaacatggtgtgatgcatgtcagtcaccttgtggggttaaaggatgactctcaacttatagatggcaagtaatatttgctttgacatatctgcaacctaaaatttcaactttcaagttaacctaaagaaatccaggatgagatattgaggtagtttttccaaaaaaaaaaaaaacagccataaaatcaaagctaatttcaacaagaataggaacatctaaaaaaatataaatgctaattcagaagctatcaaatgaagaatacccacatagagccaactgtagctccaataaaaccataacaaccttcagtgtccctaatgaagtcatgaacttccttgttcaaggtgcaatacagaaagaccaacccgggatgcaaaggctttgatttggtactgattgaaccatttttcagtctcttcttgacttggatggatggattataaatctgcaaatattttgtcagacatatagtactgaaagcaaggcatgcaaataaatccattcagtagcacaacactgcacattgggggtactaagttaccgaactaaccacagctacagttttacattaacaggaaccggaaaaggttaaatggatataacaaacgactaattttcactaccaacagattaagtttatcatatgcatttcagcaggcatcttatgaccaatcacctacaacacatgatagtgtaacgataagatttttcatgttaaatctaacatttctaacaatgccagtaatttgcgtcctaatgttgctcataatctaatataattggcacatctgacatctaacaacatattgcacagaccaacaagcagatataattcgaatgtacaatgttcagcggaatgcttccgctgcacagaagcaaataatttgttaacttctgagaggagaagaggatagacgagagaccttgaacgagagctccgggtaccgtcgtgagatcgccttggtgaggaggtcgacgtagtcggtgccgggcgccatggagacgcgcacgagccaccactgcgggccgtgctcggcgaggaagtcgaggttgaggttctccctccacgtcctcttgggtggcttcttccgccgccgcgccggctcgtggatgagccgctcctgcacctcctccttccagtcccgcgcccgcagctcccgcctctccccccgctgcttccgcctctccctccccgtcagctccccctcacccccatccacggacatagacaccgatatagtaggcccaggcgacgccctcggcggcgccggcaccgccgccgccgccagcgagcagcggcatgggaggcggaggagcggataagccaagctcatggcctcctccgcgacgagacgagagagaagagtttggattttttttttttttttgacacgagaagagtttggatttctgaaaaaaacttaaaaaacattacccggtgctcacaggtgggcccaagttgtcggtgagtatcattcgggccgtgaggcccatgaggatgcggcccataaaaacgtggctgttttggttcctccgcttgagaacaaaaccctagaattgggggaagggttcatcaggtcttcttctcttctggaggcgcgctgctcttcgcggcactcaattcccaccgccgcatcgcgagatctccggccttttctccttccgggtaagcttccctccctctctctccttcctcgagcggttcgtttgcctgcaatttgggggtatgggttccttaggtttcctgctttgcagttgaggagcaaagagcagcaattatggcggcgaaacccgagccgacccagttggagaaggagcaggtgtgtgtgcgtccatctttcctctgcattttgtttttcttttttttttgtcgatataaagttcgtggtgcgattgaagtcgtggttctgtggctgggcagatgttcgggatgatggagaaggagatggagtaccgggtcgatcttttcaaccggtgagtgatacactccttgtatgctttgctaattgctactatctgggacttctgatatcacgaatctttcaagaagtaaagcattaaacaaacttagtttctgtcaatctaattacagtgagagtgagatatctttattttttttaagaactagagtgagatattattatctggccaacgatgttaacactgggctattagttttcatccttgtactggcagcgtaatatagaacttccgtggtttatatatcgcatatctgtagttactggcaagttgtacttcctatactatctgttagcacccaatattttcggtgataaatagaagtgatcaattaggttggcattagcaatgttaagtttctgcgggcaggtagttaatatatttttaggcccaggtatattttagcaacgttctcccttgtttgtactgagatgctttgtgcgattctagtatttaagtatcttattgagtggtaattttgattggcccagtagcccacatcactcctggtcatctttttggcactaatttgacgcctttgtgtccttttcctttatgcagacttacacagacttgttttgacaagtgcattgagaaaaggtacatatcgtctggttaagtttcacatagctgagttatccgtttcatgctgttattttctcatccttctgtttggtttcaattagcattctcatacatggttgtgggatgatagactaaaatattgctggtaaagaatatatctatatcaatatatttcaactaaggtgaccaatattgggcatttctattcatcatgtgtcttgttctctagtaactatcatctgttgaattaactgtgcattttcccctgggatttgttctatttcaacaggtataaagaagctgagctcaatatgggtgagaacagttgcattgatcgatgtgtttcgaagtactggcaggcaagttaactgataattatatatttgctgtcatgcttgatgctgattcagatgtctggagtttttatagcaatagttagcttggtggtaacatgctgaatatgtatcatgactgtctttcctactttgtgttgtgaagaaagtcatctttttagtgcatctgatctccatccagagaatttagatcatcttactaaatcatagggttcatccttgaacaaatgtcattgaatatgagttccatagatcttcacgccttgtatagttggacatataggcagtggttgaaatccatgcagagcacatgtttttctatttcgagttttcccctcgtctgaacactgaatactattttcccgattcatttgaaatgactgttgggttaattttgctctatttgtatcaatttatttctatttgtatcaatttatttccatttgtaccaaattaccaacgccactaagtctaactttgggttaaaatctttttcaggtaactaatatggtaggtcagatgctcggtaaccggcctcagatgtgaggcgagaagcagtagaagcattaggccagaccattgtcgctatgtttctccacattggttttagaatgttaccgattgccagaagtacacagcacgagtgagtgtgaccgactaatggattgcccgaaaagaaattgcaatgttcctttccaatggtgtaccttctccctgaatcatgaacaggccacatgcctataataatttggtacagctagacgacgatttttgctgcgaaatgatgctctcttttgttatacttgcctgtctgaatatctgtccgttgagacaatttattctggactgttctaaccttttgctttgtttaagtcatgtttaaagcgaactggaggacccagtgttagtctttgcaatccaaatgcagccatgtgtggttttctggaaaaatcgcaagaaaattttcttacaaacagataaataatcctatatatactaagtgtagttaatgttaattcactctacttatgaagccacatcatcttaattgtttttagcctttgaatgattcatctagaatgtaaattgcatctctttctccaaaagacactatacagcctaatcattaacctttgggtaattgataacagtataaaaatatataaacacatgaaaaaaatagtaattgataaaggtataaaaatatattaacacatggaaaaaatagtatagtaggtaagaaagaaaattgtagaacttgtatctactatctactatactataacataattcttctgtatcaacgcctgggtaaccatctagtttaatactgtttgaactcctgttttaaagaaaattggtaccatatatgactcccctacttttctcagccattaattggctaaaataatgatagcattaagccatagaatgattatttaccggtgctatagcatcaagaatacgttatacgtgttctactaatcagaaaaagaacatcgggtatttgcacagttgcactggaacacgcatgaaaaatggctgattactcacaacagtctttaactcttgacgcctcagaaaagtctgcaagttgtgtatatacatgaattgtgacgaaataacattaaagctttacaatctcacatccacggtttgctatttgaatgctagttgcccattttttgtacttatgaatatattggaggtgtcataacagccaacctaggagttgtaaaaccactggaaataccaatacaagttagggaagaccaaaaaacagccctattggtggcaaagcactggaggacacccaaaatgcaggcgatctaggtacagaagagaggaggcatcacatcatgtttgagggctatacagttcatctctatctagcattcctttcagcttccaaagcggcgccttgcttgagttcttcatgcccttcaggctccattcccatggcgagatatgccatcccttgaaggtagtgtgcagtaggccactcaggagatatgtctgctgctttctttgcatccgcaaggccttcttgcagcttgccgagcaccatgtatacgaaacttcgtcgtgccagcatagtcggagacaccattacaccagtgtcaatgaactgcaaaatgtttaaaaacacagcttagcaacctgaaaatcaatcaggaacacagtttttttaaccataatcttaatttgaggaaaagtaattgttaatgtacaagcagcgaggctatcgaaaacagagtatagatacaggaaagtgaattagattcatggacaacatttgatactctaatacatacccttgagtagcactcaactgcagtcgcaaaatccttggattgaaaagcactgtctccatgtttcttgacaagaatactatcagatacttgttggccagtccaggaatggaaagatacctgttatatacaccaaatttttaaggtatgggtcagatatgaacgggagcagtgcgaaaacatggaaaaccttcacgttaaaaaaacttggaccagccaacatggtgagaagttaagttttgtatgggatatattacaggtcaactgatggatgtataatatatcttcaaaagatacataaatgttctattgtactttcagacctatagagcaataaaaataagcatggtcaaactagttaaaagtttagcctcgagctcaaaagaatggcacttaaaacatgagctaaccattaggtttcattggtcgaagagcatgggcatcaacatagaccatctactttcttcctatcctatgccacaaaatgtgtgggctttcaacatattttgtttcatctacacaattgaaatattccaagatgacaataatgtagtaataagttccggcagtttattcctttttagggaaatggcagcaatgagttagggaaggatctatggtaccaacaagaatatttcattatgataagcttaactgacaaaaagttaatacctcgaatgttgctctttcatcctcacaatatccatcattctccagcatctcatgaacctcatcaaggtctgctctggcataaactttcgctatagcagataacgaaattcgctctgtattttccttatcatgttgtatgcctagtaaagcatgtgaaggagcctgcacagacaattaaacatcgagtaagaaatattaagctggcaggcgcgacacattaataaggagaaagatgagttggcgcatacttcaaaaaaccatttatgctaacataatatcaaatgaaaagcaaaggtagcacgttgacagaagacaaaatagttatcaaacgattgtgtggagtttttttcctgcagctttttcaatattacacaatactgttactagtctagaaagtagcaagaaaaagaaacattacagaagcatctttctggaggtttccaagagcagacaccaccgatttcaggtttggccggtcacgaccttcatactgcaagcaacgggatgctaatcgtatcaactcagttccatcagagctggagacatggccttctaagcaagagtccatcaacaccaggtaattttttcctcttataaggtcaagcgcctacagcaaaaccaagcaaagtgaatacttatcttgggtaagcagaaaagcaggaaggatagataacttacatggcttggtgggatatgttttccacttaggagatcaagcaagatagtaccaaaactgtacaccacactctctggaattactctgcctgcagaaaatgtagtggttagtaaagaaatagagactgtgtctttgatggacaaagtcataagaaaacgaggtagattttgcaacacagaattctgttgcttcactatgagagaggtcgaatgctaaatactatcccttcatgaaaaacaagtccgtgcagcttacgttgttgcctaatgtctgtggttcataaccatggtaccatagctaaaaataaacaaggtgtgaatagctaaaaataaacaatggaaacccagcaataacatttgcatagaatgatttaccccactggggaaaataactagcaaagaacatggacatactcaacaagtgtctaagagttagctcatattacgctcatattacaagtccttacttcatgatcaaacattaacaaataaaattcatgaaatgcataactcacagaaaaaaacttgcttgtatgcacaacacataccagtcttaaggtactcaggaggcgtgaaagccaaattggtactatagctcttcccatccctgctgttcttcatcagaccgaagcacgacagtctggggttaccatcctatgatttatcatcaaaacattacatgccttattactggaagcccaagctaagaagttactaagtagcacaggtactgactcaccacatcaaagagaaccctgtatgcatgcagatcatggtagagagctctccctttgctactgcagtactccaatgcctgagccacatagaatgcagctcgtaccctcattgcccagctcaatggctttgtctcccctgccaaggataaccaccatgagcgcaaaatgtagataatccaaatgcaaagtgtctactcctactgaaaacgttaaatgcaacaggaggcaaaagctctccaatttaccataacccatactaagaaccttagatgcaattgagttggatatatattctagaaaggcaataaataatgaaaacatcttgatgccaactactagtgtagtactccaaacagaacactaataacaagcatttatagaagaataaatgcattaatttctagttaacccagaagaacaaatgtaggaccagacaaaagaaacagcaaaaagagtttgttgaaggaattacttcaaccgtctccaactgaaagcaacaattcaacattagattcaggtgacaaaaacacatccatccttaaataaggggcccaatcttatcatctttgatgcctacatttgtactaccaaatcggaaacaacatttgccaaagcccaatatgtagctgcagctagtatagaacaagaagaaaaaaaaggtgagcaccaaacacatacagtggaagagatgctttgccaaggtctcgtgcggcatgaactccgcgacgagcagccgctcgccattctcgcagcagcagccgatcaggttggccagccggacactccgcagctgcccgacagccctcgcctcctcctgcacacacacacacgcaagaacggagccattcaatcgaagcggcgaaggcaaggcaagcactgatgcagatggagcaaagctgcacgaaccaagaactggcgggagtcgggccaggcagagcggccgaagcgcttgatggccacggtgcggccggtgctgaagagggtgccgcggtagacgacgttgggcgccttctcgccgtgctccgacacgatgcgctcgggagagaacccgtcggtcgccacccgtagctcgtcgaggctgtactcggcgaacaccggcacgccgctgccgtcgtccgcggcggcgccattctctgcacgtcaacaaaaccacacagatagctcggatcagcaccaaaaaagcacgacgcgcgcgtcggaatcaaccacggattctcgcgaagaggtcgcaatgctctcgacgccaagagattaccccactgaatcaaacgcaaccaactccaaacactcgcaagagcaaccgaattcgtcaacccaaccgacaaaaaaaaacaaacaaaaaaaaacatcaaatcagcaacaggttgctagagcgagagagagagtgaaaaaaaaaatgggatcgttgatgagcgttcacacaaaaaccacccactggatcagacccatttcacagcgaattccagcaggatcaacagctccacgaccgcaaaccaaagcaggagaattagagacgcaaaccgagttccccccccccccaaaaaaaaaaaaaagatccccagaaaaaacgcagcaaaaccaggcccaaatgcagggcgccaccgcaacaaccccactccatcatcaacacgcgcacatccgaaaccagcaaccaaatccctcccccccccccccaaacccaacccaatgcgagagcgagagcaccataccaagcagcggcgacttgaagtgcggcggccaccagcacacggagagcttggagcagcgagctcccatggacgcctccctcctagatctcgccctcacctcacagcagcagcaacggctctctctccccggcgtactactactaccaccaccaccacctcctccaccgccaccgtctcggctgcttagctagctactggtaggactcgaatagactaatactactactactactacgcgaggaggggtgggagagaggaggagggggaggggggtggagtggcgtgtgtggggtggggggtgggggt

SEQ ID NO: 44732 - DNA, 22403 bp, Oryza sativa
gtgggggtgtttgggttgtggatccaaggaaggtggtgggctttccgctccctgctttctgctgttcttcctcctctccctttctccacctcctcccctttatatattgctcctgttttttaaatccttcctcttgatctaatagcctttagctgtgggttttttcttctccttttattaatgcttttgaatttgacttaaacatggtaaaatgataaaaaaagtctgtaagaaatcatataaaatgcatgtcttgtaaaccagtataatggtgggtccggtatattagagttaaactatgaatgtgcacggtatgttttagtttgaaaccgtttttgttatatgtgcatcatatttttttttagtagagtatttatagttcatttatagctctagaactgctacggtgctacccgtgtttcaatttttatctacacacgactgtttacgttgtcacactttgattgtgtttttttaaccgtgcgtaatgcttttgaataacgtggtttctagttactggtttgccataaccatacaatggtttctcaaattttgctttacatgtgtagaagacgaccaagtaatatgataatcaaattgctgaggataatccctagcccaaatttagatacaaaagtaatactagcttataatatattatcttgacagacgataattctgattaaaaacaactagtatttgtttaggataaatgaggatgattcttggcccaatgtataaattgtttgctttacatagcagaggtaactgcaacttatctatttgaaaaaaaaaaagcagtccaatgatatctgtatatcaatgattactccaaaacaaaacaaacagttagttaggtaactaaattattgataggataacaaatactccagctcatagtcacttcagtcactactcactaaccttttccagtttttcagctagtaacgctaattttctgtttcagatagagtactttcagaaagaattcagaatagctcgtatctgctgaagcaacggcaggatgctacgtagcccaagcgtgataaccttgtataccactgacatgtggccccgctcgtttgacgtggccccacgtgcctttggtgtcaagatgcttcagctcatgttggttgtttttgcagaaaatatttgcgttattagttttgccaggtaattaatttactaataatttataatagtcattgacagtgggaccacctaacttacaattgtcactggttcgtgggaccaccagcagtttggagccagtcttgaacgggaccaccatttactaatatcaaatttaacactaattaaattggttagttgttcatactactaactaaatttcataattgttttaaaaaaaatcgaattggttgtcaaaaattgtccttgttgcaagcggtcatatcatcaaagtggagatagctgaataggctccatctttccccatcacaatttggacatgttcatgtcaacagtttatatacactgttctgtgagtattatgtgagcaggtaatctatccactgtttttgtagtagtagtttttttttttgggtaaggtgagaaacggcggcgagttgggcacatgctgcacagataaagatgcattacgaggaaggtcgctgttaaacaaaagttctcgtccttaattaacagataaacatcacatgctgccctgttaagcaacgatcgatttgaccaggagtaccaagcaaagactttagggaccaacgactcttgcattcacagcgcacagaagaaaatggttccagttttttcaaatgcatgtgttactgaacaacggagtacataaaaacatcatgaacagtgaatattagagaatgtgttattctatggcattatcgccctaggctacaaattattttttaaggaaattaggctacaaaggttaccttaggtagtggacggacaggcttaaagcaggaaagtagatgcataaatgttgactaaacaaacaatgattaaagctcttccaaagggaatccatcctccatcgatctaattgtgatcatataagaaaatatagtaaatattaaacagactgaaaatagtatttattactacctccgttccaaaatgtaagctaaaaatgcttacattttggaacggaggtaataagttacaagcatgtgcttacattttgggacggagataataagttacaagcatgtgcttatattttgggacggaggtaataggttacaagcatgcacctactagttaattcaaatgtaaagccggtaaagagaaagttcctctgaaacgcatggttttaaaaacacataaatagaaaaaatgaactatataggatgtctcaccttgtgaattcatacgggaatgtcgcaaaatagtcatttaattgaatgaaatgcgctcgtagcgcagtggcagggtcgctggcacgcaccccattggcccgggttcgatccttgtcgagcgcccttaccaggggaaatatttacctcttcgttcttaaaaccattgacaccaagtcctttcttggtgtccaacctttttcttttgtcatttaattgaataatgtgcatgaaaaaaataagcataaaaaatcatgaggtaaagacctcggatttgttttcctaccaactccctttagaatggcccattttataagattttcaaaggaaatataaagcattaatctttcgttcctaatctccataggaattttttcgtaaggattcagggtcattttggttgatgccgaaatatgccatactaaattactgtcactttaagtagtacattggctagcatttggtttgctagcaaaggataccaataacacataaattgaaaaaaaaaacattggtgctaccaaaagttaagttttgacattattaaaattttagcacggtaacaaaccaaacaagcccacaaatcctcctaacatcctctttttttttaagggagccatgtccagggtttacgattccgagatggccttccatttcgggctttggcggaatgacggctttcgtgaaatctggtgaaaagccggtagattccgaacaaattttataaaccaaaatttgaatacaaattctctgagtttaccgataagtttgcgaaaaccggtcggttttgacaaaattccgagtgaaatcatcgaaatttcaatcggtaactagaaaaagaggtaattaaattgaaagtgtttttctttttttttcattcgttattcttttcttttctactgtaaatttcagtaaatacacggaatacatcttttttttcgaaattttatgtcctaataggttctatgaatatcatattgtttataagattttattttatttttttgttttttatcaattcaaatttgatcatcgaaatctcaaacggcttctagtttcgagccttgtcaaaacctcgaaaattcgcagaattcgaccgatttccattggaattgtgaacctggccctgtcacagcttggccctagttgggagaaaaccgggcatttagcttgcttgcctgtagaggggtaaatagcatgagtaaatatataggccaatttaactacatgatatgtatggtagatatctaaaaagctatcacgactgaaagacactataaaagcctgataatttgttggatgccactttcggctcaattggagagaaattttaaaaagacgagaatgcttatagggtcaaaagctttttagctgaagctacaatgaagatgaaaacatgctgtatactaacgatgtatttaggctgatgataaatttagagttgtatgatttctaaatctattatattattaaagtaatagaaaaaggagcctccacgttcgctctcatggcctagaaattctcacattaatcggagaaaaagaaaaggcagagtccatatagaaatacaatttagaaatagccgaaattcggaattaaaaaataaggaatattagaagaggatactagagtccatatagaaatacaattagaaaataactgaaattcagaattaaaaataaggaatattagaagtatagtatagagtccatatagaaatacaattaggaaataatagaaatttagaattaaaaataaggaatattagaagtagagtccatatagaaatacaattaagaaaaaaatagaaattcggaattaaaaaataaggaatattagaagtagagtatagagtccatataggaatttaaaactaactaaaatttggaataaacataataaaattaaaagtagattttttagagtccgtataaaaatacaatttacaaataactaaaattcgaaattaagaaaaacatggaaataagaatttaaagtcaatataggaatacaatttagaagtaactgaaattcgaaattaaaaattaaagaatattgaaagatgagtttagagtccacatagaaatacaattagaaataataaaaattcagaataaaaataaataatattggaagaagagcatagagtctatatagaaatacaatttacagaaaattcggaattaaaaaaaagaaatattaaaagacgagtctagagtccatatatgaatatatataatttacaaataactaaaatttgatattaaaaataattaataactaacacgtatataaaatacaatatgaatattacacattagtagttttgtaaagttattgcaaaatttaaaattatgatgtcattgtaatatatttaaataatataatgagaaaacatatatgctattatatgagagaaaatataatgatgctagccgcgcaatctgcgcgggcaccatgctagtttttataataatattatgtttgaagcatgtggtataaagggcgttctcgttttttttaagaatttatcgttctaattgagacaaaaatatccttcaacaaatcaccaattttttaactatcttttggttgtaacactttctcacgatgtctcaaattgtatagattttgggtgacccgcaacaaaatttgtcaaatataggagtatattgtgaagagcttcgtcttgcttgcacttgcagagagtttcaggcgtacgtacagtctgcaggtctgcattgcctccggcagcaacagaagccgaggaagcgaaagcagccatgggctgtcgcgtcgaggagccctacaaacaaaccgtgcgcccgcggcggcaggcggcggcagcggcagaggcccggccaacacgagcacgggccaccagccacagcaccagtacgtactactagtacaccaccaccaccctacccacccctgcacgaacggcgacacgcaccgcacggccgcacgcacgcaccgcgcgcggcggacaagcaaagcacaagcggcagcacagggccggccagcctcgtgagccctagccagtactagtactcctccagtagccagtagtagtatcatgtccgcccatgcacctccgcatctctgatcacctcgatctcaccatttgctcgagtgagccaggcagcagcgtcgcaccgcacactggacgtcggcacgctctgcaccacaagcagcaccagcagacagatcacacagatgggaaggccgacgtgcagattgtgttgtgtgagagagagctctttcttctccgtgcatgtgcctgaggagaaatcttttgcttgtcactgctgctgtgccacggccacgggagacgggaccgacgcgtatccggcttcaattccatcacgcactggtacgtgtggatggagtcgtcaatcaatatcaaatcaatcagttcgtgcgtgcgtgcttccatacatctcgtccgtcctgcctcacaggacaaacacactgcaatacggagtattcagctcacgaaaaaactgtggtttgctgctgtatgaagaacaaaattaaatacgcccacgtgtgtgtgaaatccgccgctgcagtagtgcagtactcccggccgcaccgcgtacagtacgtactacaggtacgctgcgtgtgtaagtatccatgaatatccgccattggatcctggcgctcgtacccaacgtaccagatgacacgtccctgtgctgctgcgaacatgtgattatgaagcaattccatttccacagtgattatgaaaataatcccattagaaacggaggagaagtccacatggcactgtggatttacgtctacggagtacttcagctagaggtgaggtgaggcggaaaaggagattcaccgaacgaaatgaatcaaccgaggaataacccggcttacgtgcgagcgttccttgcatgcgtgcactggattcggggattcggccgatccgcgagcacggcacgacttgtttcgtcgcgcgcgaggctggcggattcgcgggtcgattcgccggcgcgcacaggagtggagtggagagtaatgtgtcgatcgagtggcctcggaagttggggctacagatagaagagaggggtagcttgcagaaaaccaggacggatttatgcatgcagagcctccgtcacgtcgtcgatcggcaatgcaccattgatgcgaggtgaaggtcgggttggtggcaatcatggccctgtagcaatgggcgccgcagagatcagatggtcggagttgagtgacagatattctttctccgtcgatctctatccatgctgctgctgctgcctgcacgcatgcatacagtgttcgttcctactctcagctctcgtctcctcctgctcatgcatgatgcgcggctatatggctggagtagagtacctaggtatagcacggtgcacagctctagctttagctagcgacatgttggatcgaatctggcctgtttggtttgcagggacttactctctaagtctctttcatatcgaatgtttagaaactaatttaaagtattaaacatacactaattataaaacctatttcataaccttggactaatccgcgagatgaatcttttgagtctaattatgctatgattttgacaatgggatgctacattaaacttttgataattatagattaattaggcttaaaaaattcgtcttgcggattaactctcatttatggaattagtttttttattagtatatatttaatacttcaaattagcatccaaacatctgatgtgacatgggctaaaaagttttagccccatctaaacaccctagctcagctctgacatggaagatcttcccaacagttatcaacgccaacaacagatcgtattctgcgttgcgttgcgtgtgcatgctactcgatgggagtactatatactcctatattaaggctgtgttcagaggcaacatatcctatacacaccggccctcacgtgtacacacgtgcacatcaactaaaaaatgtcaccaaaaaatctagaaaaaatcatacacatactttcaattgtattacacctagggttaaaatcttaacgtcaaattcattatattttagccgtaacaaaaaaacaaaaaatctgacagttttaaggttgcaattttgtcagaattttatcttttttgttattctctatgtagaatgaatttgaagatgcgactttgcacgtagatgtaatactattgaaagtacatgtatgaattttcttagaattttttgtaataatttttagttggtgtacacgacgcgagggcctgtgtgcataggatacgctcccgtgtttagattagaggtgtaaagttttaatgtgttatagcagatatacgaacgcatatttgaaatattaaatatagactaataacaaaacaaattacagaatccgtctgtaaactgcgagatgaatttattaagcctagttaatccgtcattagcaaatatttactgtatcaccacattatcatatcatggagcaattaggcttaaaagattcggctcgcaatttacatgcagtctgtataattaattattatttttatttatatttaatactctatacatatgtctaaacattcgatgcgacagtgtaaaaattttaccaggagatctacacagggcctaaccccagctactgatctgatcagctaaacgaagttgatctccaggctgcttagattagactgttttgtgtttgtatccctctaaagtgcggaggaagtgattccattccgtggatagctaggccttgcgcgcaagcgacgcgaagccgcgaacgaactgaagccaacctggattaagttgagggcagctagaaagcgtcaaggcctgcagcccatcggagaggccagcatacagatgcttatcagattacgccgcctttgtttatgttatgcagatgtgctaatcaattgctccccaaaacaacgaaagcgaaagggagcgagcgagatgagatgctgcatgctcatgcttaattatatactcctactcctaacaagagagggaccatgtaggtacgtacgtacagctgacagttgtttgtacctgctggttgctggattcctttgaggcttaatcaaccagcagggggtgattaaaaataatctgaagtgtccaaagagaaaggaaagaaacaaacatcagtagctgcatagtagcatgtatagcaaggggtagtagaaaggaggagagggagaggcagaaaggagagggaggcaggggaaagcgcggtgtccccgtggcgtcgcgggcgcggggggcacggcggcagcagaacgtgtgcagcgtcgtccccacggccacatgctgtcgtgtcgtgtcgcctcgcatatcgccttcggtcgttcgttcgtcccccacacctccacttttcgatcgacctgcggctggcgcaggatgcagtacgaagcagtccagtccttcctatcctacctcggcgttctactagtgtcgatcaagcatcgaaatggtatactaatactactgcacatgcccatgggccatggcttgatggctagatgatgacatttttatctgcgttgctctcatccacctcagttttttggcgtttttggtgatataataagggcgaaaagcaccttggtatgtataatcggtaatcccagacacctgtgtgtttctttgaactcgacttgtcaattactatgtatctggctcacacctagtggattaacaggtgatgagtgagtggtacatcaaatgatactgcgagacatgtgctgatctagaaaaatcgaaaaaaacggaaggaagaaattaagaagcgagctagacatgacggctcggtgatgatcagggccaaatagcgagcaagaaagtgaaccggaggcataatgggccggcgggcacttagcctgctcggttgcaggccagtagtaacgggcccccgcggtacacgagaagaggcccaataaccatggtttgaccgtcatgggttgccttgcagagtaagttggtgatgaactgttgatcgccgctctctctctctatctcaaagaaaaggagaaagggttggtagaatggtagtggtcgctgatcgagtagttcgtactgtgcactgcatcggcatcgcctgctaccatttttgtcgtcgcgtgactggaaatagaagctggagggcaaaggctgcgcaaccgcgccgcgcggtgagaaagaacacctgtttggcaactgcgcggtgaaaaagaagaaaaagaagaagaagaagcccacatgtttctgttttgttttcttttacgtttgaacgacgctgcgtgtatgtgactggtgtgtgggctccaccacgtacgagctgttgctcgtcagtgggatgaccagccaatgcaacgcaaaagtagagagaggggtttgcgctgctacgacgtcgatctcgtgtatatcatgcaacgctcccctcctcttcttcgtgcaaggacgcaatagctagagccacttctccagagaacgagagagagagagagaaggcttaggttagaatggctcccgttctcctggtggtggtcggctcgtcggcggcggcgtgggccgacgtgcccgccggcagccgggtgcaggtcgtgcaggtagcctgcggcgcgaggcgtccggcgacgacgtcgatggcggtccgctgcgtcggccgcggtggcggcaagacgggtccggtccttggcaagccttccgacgacgacgacgacgacgtacgtgcatgtatggatctcctcctttcccctcctccttctttacaggttttcgcctgcacaaagacggtctatgaagtagtcgaagcgtgttcttttcgtgtcttttcttgtgttctgcttgtgctgttgtgcatgtcggctgtcgcgcgtttcctgcgtcagatcgaaccaagtatttgtttcttgggttcaggcgttaagcaggtgcgtttcttggggttctttcttgtttctccctgtgcatgacgcgttcctgagccagatcgaaccaagtatgtgtttcttgggttcaggcgttgagcaggtgcgtttcttggggttctttcttgtttctccctgtgcatgatgcgtttgctgcgtcagatcggaccaagtgtgtgtttcttgggctcaggcgttaagcaggtgcgattcttggggttctttctcgtttctgcttgtgcgtgttgcgttcttgcatcagaacgtacatcagacgtaccgtgcgcatgacattgttttgtttgcccctgtttgcgttcttgcacgagatcgtgctttgctatgctcttgtttctcgtttctgcttgctcgtgttgcgttcttgcaccaaatcgtgcatgtacgacgtacgcacgttgtttgcttcgctcctctattcctcttctcttgcctatcacgcaggaatctttgatcagttgatttcttgcacgtacacgtacttaccaccggtcagactcagatctgctcgtttaattttgacctgtttatcgacgatccatcacctccgtccttatttttccttgcaagttttgcctgtgcaaagtcggtctgaaaagcagaagcaggtgtgttcttttggagtatttctattttcagctttgctcgtccgcgtagcgtccctgcacgcaccagattcaaggaggtgtgtttcttggggatctttctttttgtttctgcaagtgtatggttcttgcaccaagtcgtgcatgtatgttgttttctttgctcctgttcatcgatatttgggcctttcgtttgctgcgaagcttgcagatttccttctctttttaccgaagctgtggttccttttttttttcagagaagaaattagaaatacaacggattccagttgttcttgtgagatattttttaggattttgtttgtgacgtcctattcgatcttctgatgcaccaaatctcttattaatttccaagctactgcttttgttactgttgaagcttcagtttttttccctttctgaaacggaagcttcagttttctggttgctttgaaactagtaataatagttttgatggctaatttggtctctgtttgcggcaaattgcagacgaagctggtcaagatcgccttcaggatggccgtggtgacggccgttttcttgaggagagttcaggcgaattccaactgcgccgacatgtctctgcaggtgtcgagcctgcaagaggagtgcgcccgtttcctggattcgttcgtggccggggaggagatcgcgggccacgacgcggtccgcatgctcgtcggctgccatgacaagctgaccgtggttctctccgcctacggcggcgccggccgggacgacgtcgacgagggacaggcgccgccggtcgtcgtcccgcccggaggacagatcgacacccacctcctcgacttgttcctcattgggacctccgagctaccaaccaactggtctgacagagtaaggacactgatcgatgatcgatctgttgtagtagtagcttttgttgttggttgagcattactacattacatgtatggattaacttactgaccgactgtctgtgtgcattgatcgatcgcttttgcttgtgaattgtgatagaccctcgttgcccagctgacgtgctctctgtaccgggcaattgaagcagtcaccaagttcatcgccaccacggagaagggggttcctctcgagcaagcagatgcagaggggaggtctcctccacctcctgaagaggaaggagggaaagcgtagatgttactcagtcagcagaaaggaggaaggagtactttttgggaggtcattagaactcagtcagcagtagtaatcatcctaagtacggagaagtagcatttagttcttctgatgttttggaaccttaccatgctgtttagtattcctaattaagtcctactgctactatcatgtagtaacgtgctatccgccgatggttatcaaataacatcatgtgaactttgcaacagctgcttctttttagtaagtaatagttcattcccttttgttaaatcttgatcttctttctctgtggctttgcttaaatttgctcgatttcgtttagaagaaatcagcccaactgattcttttcctaaatacgagagacagatgatcttatctctaagctattttcctggagacgaatcgaagcgaatcctagatcccacgatgatagttagggcacggcaacgatggtatttatagatagggcacgcacgaaacggaggagaccaaaccaaaccaaaccaaaccaaaccaaaccgaggtgaaattgaaccggcgctccctcgtcttccgtcgccatcgccgtcgcgtcgcacccaaggtatctgcttcaattcagccctgcttgctagctaccgcttcacgatctacacagatcgaactgaaacttgatgagatttgttcaatgttcatggctgacaggtgacgggtaatgggggcgtgctactactaccaacccctccggccgccgccgtgcccttccgttccttgcggccaaaaggcacagcggcaacctctctttcgcagcagccatcagagtctgcatgttgcatctaaggcggccgggctgaccagcagcagcagtagatcaaaagatgtgaagttgagggctatcttacatgaggacagtgttactggtgttagaccatggtttagcctgttcggaatgtccttttctgatctttatgatcacttccctgaatctgtctgggacatctgtgaggattcccctgccgaagcttttgagaagaaggtaatagaatttgttttctcctttacaaacttaagtgttcttaaccatcttcttgattcttgagtgcaaatttcattttcattatattgttactgtcagttttcttgtcaataactcaatactcatgtttcaagctaaagcaaagacttcccttttttttttaaaaaaaaagattaattgatcatgattgacaacaacacgggagatctctactgtatacaggtttaatttgtttttggccatatatagggtaattagggtacatttttctacttgcgcatctttactaattctaattctgaggatcaggagcataaggggtggatgcaatttcggagtgaaatgaacagcagatacaacaaagccgtggacataagttttgacgataggtttgctgattccattgtgtttgacaaaacactctacaagtatgcaattttgggttgcaaggtcaatgcggatgggattatgaatcaggtattctcagcatgtgcaatcactcatacttctcccttccgaaaatatactgtttagtcacccattaaatttatttacaccagatgccactgtcttcatgcctaatgatttagtattgaccaacgatttatgataatttgccaaaattgcttcctggatgtgctagtttagggcccgttgctataaatttctctcaagagcaaacaaaacacaagtttcttcgttaagaagaagagaaatgacataccatggtggtgaacaaaccaagcacttaaataacgatgttttttttttgaaaccctaaataacgatgttttgacaaccgcgtagataaaataatgcccctcaaccatggaagatcaatatattagtatacctctatatagtctcgtcaataggccttttatatatgagatatcttacgaaaacatctgttgttgtagggtgttatatctgccagtgaaagaaataaaattatccatgctcttgaaaggatagaaggtgacattgagattggaaagttcaagtggagagatggcgctgatattcatacaagcattgtggaagcacttgctgatatgattggggacaaagcgaaggatcttgcagtggaaagtaaatatgatagttgcctcatgatactggaaacatggtccaaaaactccattgatcatattatgactcaattgaaacaacttcaggtttgttttcttttatctttttagtttcatggtatactctaaaacgttgtttgggaagatatatatgcacttgattgtttaattatgaccctttttcctttgttcactcgctatattagattcatgttagttttagcatacattcgtagtatgtggttcaattaaagctgtatgatgattttctgttgcaggttgctctagttctgttagcaataaaaaatgatggggttatccttggtgagagagagattgagggcaccacatgcctggagagtcttcttctgcgcattgtcaaagtggtaattttccaacatggactcaagtatccttggcagcatagaaccttttcttttctcaaacacgcaagagaattgcgtatcatttcatcaaagaagcttaaaactgtctggtacgtagatgaacataataacaatacttacttatttgggagtcttgggactgcaccaaaaccatagagatgggaatgtgcaaccgaatgtacttcttaacataacaggccatatcacaatgaatctgtgtttgctgctcacataaatatttcattacctatttattgcccatttcgccttgtattgtatctaaaccagttttctgcccttttcattatatagctagactatgatgcttccaaacttcgttcctatcatggaagcatttcttgctcaaatgatggtgtcatgcttctgaggaccaggtttttgctgctactagtttatcatttttacgcccccaatttacatctccagctctcccaccctcttcaatattttgttcacttgcttctattaattatttatgtgaacaggggcatagttctgtatttttaatatgtacttctatactcttttgattgagccaattttatcttccatatatgtgtctctaaacaaagaaatgatatcataggcttgattaattattgcactttttgatgggagattaatctatctattaatttactaaagtaatagaaaaataagcctccacgttagctctcgcgacctagaaattctcatattaatcggagaaaaagaaaaacgtaatacatatacaaatactcctacaatttaaaatagctaaaaattcaaaactaaaaatataaggaatattggaagaggagactagagtcaataccaacatacagtttggaactaatgaaaattagaaattaaaaataagaaaaattaaaagtacaggttagagtatataggagtacaatttagaaataactaaaatccgatattaaaaataattaataactatcatgtatatacgaaatatgaatactacatattggtagtttggtaaagttagtacaaaatttaaaattatgttgtcattttaatatattttaattaaaaaatatatactattttatgatagaaaatatatggatgcttgccacgcaatctgcatgcaggctaccatgctagttattattatactaatggtagtaatcgtccttttttttggtgttgcgttctccacttttaatccgatgttacttcataggaactttgactattctaggggtttttgaaacgcaactatttctaggtgttataaatatttaactatgttgtgcttgttatgcttcataaacttgcccgccaagtgcaatctaagaagttacgcacttctaaattttaatatatagcaagtcatcatgactaatttctaaaaagagggaaaatgtcacattgtttggttcgtaatgtttgctttaaaatttttaaaaaggaaaacctatttttttaaatacttctaataccccatgagccctataatttttttgctcatcttttaccatctaaactatgcagctatccagaaaatcagatgttttccaagctttcttccatggcctcgtttgcagaatcaatcaacaattgcatccccaaccatctaaggcaactgcttgagaaggttttgtccaggaggaatatactgttactcacaccaaatggtgaaacaacgatatatgacacagtcctatccaagtttggttccattgaacagacaaggcatcatggagatgttgctatctcaaaatgtctaaatattggatttcgaaatgtacgtgaatcacctcagacatgtgaaatcgaggtaaaaatgatcttaaatttttgccgggtaaaaatgatcttaaattagcatattcgtaaagcgtgtcatcctacatcatggtatagattggttctaacaaagtgtgttttcttgggataggacgctaagcactatttattttctagcactaaatctgtggtcgaaattctcgatctatccatacaacttgttctaaggatcttgtttggcatggaaaaggcccaaaattccctcccaagaggatatcatgatgttatgaggtttacacatttcctgacaacgaaggtgagagttttgcttttttttttataggtaactccggtatttcattttatttttgccgtatgccttaattagctcgagttcatttgaatcaggcttatcattctttctcacaaaagaaagctaaacatgagtactccattatgatttggaggaataataacgtattagtctcagcctttccatgctctagcaaatggttaatatgttaatggtatttgcaatgagcagggaatcgatttgggcacagcttatgccttggtccatctgtgcttggataaaaagctccaaccttcggagctcattctagacaaacacgagctaaagcagatcgattttcactgtgagcgtgctcattacctcctggaatacaaagggagcatctttggtgattccaccgatctggatgcctgcaagaagatgctgaaatggtgttgcaaacttcgcattgatcctgctgcgaccatctcttcttgattcccacgattcaatgcactcaatagagaattagggatattgtgctatctcgaactcatgtttaattagcaacgaatttggtagtcatcacgtttaattagcaaatgtattctcatatatcaagattgagttagggtcctattatagtctaatggacttgaaagtgcatgaacctgtattcgttgttatggcattagattatgaatgtgcaagttgccagtcacatgataatcttgatccctgtgaagatcatccaatacagcaataattaagtgcacaaaagtaacttaaaatctctgcgccccatcatttcgcttattcgtggaatttaaaaataatctgtgaaaaacttttatatacatattcttagcgatctaaaagcaaaggctaaaaaataaacttcgatgaaaaaaaacccaaaatcaactacaaatttaaggttgaaaaattcaaattttagctgataagcataaacaaaaagatgaggttgctacaacatgtactatttttaaaaagctgaaacacaaccaaatcacctcgtgaaacatttttctataacgtatgaaacaacagttttaaaaaaaaatgggcgtcatttcaccctatataaaaacaatgtttcaacaaatagtgaacgaatgttttaattcactgcaacatttgatccatacatagtaaaacatcacgagtatactttactaaaacattgttggtggaacaaaaaaaataaaacggatttccttaatagaaatgttttcgcaatatacgggtgctttgttgcaacgacgcgtgtggtggggcgcgtggaaggggggggggggacaacgtgggaggcggcgggcacccgacttttttgccgctgattgggcacccgatcgcttgcattttccaaataatatagcttgatcagtttttagagagataacagagaaaatagctacaaattgcaaaaattgaaattaactataaaatcacagcttgattaaaaacctataaaggcagaggttacaacgggcggcacggcccaggcccggccgtgcctgggccgagggtagtcgggccggcacagcccgacctacacaccgggccgtgccgtgccagcccacgggccatacacacggcccaggcacggcccaagatggctcgggccgtgccgggccggcccaaaggcacgacggcccatcgtgcttttccacagaataaatctaatttttctccctcctcttgggctgtgacatatatatagctaaaaaaaagtctattcccccctcttctttgagctgacatataaattgctgaataagtctatttttaggccctatattttggaccgtgacattaatatgtctatttttagtccctatactttgtgtaccgggcctggcctgccggcccatcgtgccgagtcagcccagcgtaccggtggggaggtccaggcacgggcccaacccaagtcgggccgtaccgtgcttgggccgggccgtggtccgggcctcgggccttatggccatccatacctccgtgaaacaaattgaagaggaagctcatcaagatagtaatcaggcttagatgacggcccgtctgctggagagagttcatgcgaggccgctcgggtgcaccgacagcgacaagctggagatgtctctgcagctgacgagcgtgcgcgagcagtgcgcccgtctcctggaggcggtggaggcaggggagatcgccggccacgccgccgcggcccgcctcttcggcagctaccactccaagctgcgcgtgcttctcgccgtccacggcggcggccacctcgacgccgccgccgctcgccgtcccgccgcccggtggacagatcgatcgccgcctcctcgccaagttcggcatctacgccttcgagctgccaaccaactgggttgacaaggtgatgatccattaattaacttttgcttggtggtggagcaaattttctttatgaattctttttttttgaaacgaacttttttctttatgaattcactaattaccttactaacaagtgcgcaaatttgctttgattgtgatgatagtccctcattgcgtccatgatgcgcaccctggagtacgcgatggatgaagcaaaggatttcatgagcgtcacagatgagcaggatgaggcagaggaaggggacgatggtgatgatggaaaggcgtagctgtcagcaagttcttaaccaactggaaggcaattagggctcagtcaagagtagtactagttcttttaagtgtttttggcgcgcattacacctaatctagcttaagatgcttctgctgctgctactactactactatgttatctatctagtactagtactacctgctactactaccatgtaacgcctatgggctatcttgtgaactttgcagcagctatcttgtcttaactatggcttgatctttttcacctgtcttgcttattaaacctgctcaatttcgtctagaaatcagccggttgattttgttcctaaataagttatgatctccccctgtctcgcgtaaattcgctcaaatttgtttagaaatcagcccgactgattttgttcccaagtaaacgagagacggatatatatgatcatgatcttatctaccccttgctattttcctggagatgaatcgatgcgaatcctaggttggttggtcacggcagtatttatagatactgcacgaaacggaggagaccaccaaccaaaccgaaccgaaatagaagcggtttaggtgaattggaagcggccgcgccggcgatctctcgtcttccgccgccgccgccgcggcgtggtaccaaaggtagtatcttctttaattccgccatgcttgctagtagctactagatctacatacatactgagattgaagtgaaacctgagattgttcttgaattgcaactcgagattgttcaattttgatgacctgtttgttgacagttcgaccgtaatgagggcgtgctgctactatcaacctctccggccaccgtgcccttccattcctcttggccataagccccagcagcatcatctctttctcagcagcagatcaaaagatgtcaagttgaggtctatcttagatgaggacaggcttactggtgctagaccatggtatagcctgttcggaatgttcttgagtacggattaattatcttgtcattatattgctaatcatgtttcaaggtacagtaatgacttcttctttgattgatcttgactgacaacagtacggtagatctgtcctgtatataggtttagggcttgttcactttaatgttattttcaaccttaccaagttttggtgaagttgccaaaaaattggctacatttagtttgttgccaaattttagtaactatataagaaattctgctaaaattttggcaagttatcaaaattttggcaactatgtcaaaatttaatttggtaaggtttattttggcatcaaagtgaacatgcccttaattgtttttgcccatataaagggaaattaggatacttttttctagttatatatatgcactaataattctagctctaaagatcaggagcataaggggtggatgcaacttcggaacgcaatgaacaacagatacatcagagccttggacacaaattttgacgagagctttgttgattccattgtgtttgacaaaacactatacaagtatgcaattttgggttgcaaggtcaatgcagatggaattatgaacgaggtattctcaccatgttcaatcactcatacttcctttcgagaatatcctgttcagtcaaccattacatatcttaacaccagttgcctttgaatccagcatcttcataccttatccttcaagctaatattttagtattcatcaaggatttatgacaatttgccaaaactgcgtcctgtatgttctagtttagggttatttactacattttctctaaagagcaaacaaaagcacttccgttaagaagagagaaatactataacatggcggcgaacaaaccaggaacctagataaaaacatctcgacatcccctcagataaaactaaatgaaatcaactgcaactaatgccgttatatgaaatttttctatatgaaaccagacttctagataaaaaaatctctatatgaaatttcttataaaaaacatccaatggtgtagggtattatatcttccagtgaaagaaataaaattatccatgctcttgaaaggatagaagatgacattgagattggaaagttcaagtggagagatggtgcagatgttcatacaagtattgtggaagcacttgctgatatgattggggaccaagcaaagggtcttgccgtagaaagcaaatgtgacagttgcctcatgatactggaaacatggtccaagaactccattgatcatattatgactcaattgaaacaacttcaggttccttttctgctttttttttgtaagttctcaagatatattcttactattcagcattttttatagttttgatggtatattgtgttgttcgggaagatatatactcaagcatttcattgtttaattatgacccttttcctttgttcactctttaacatcggattattgttaattctagcatacattaattcgtagtatgtggttcagttaaagttgcatgaaaattctctgttgcaggctgctctcgttttgttagcaataaaaaatgatgggtttgttcttcctggtgagaaagaaattgagggcaccagtcttcttatgcgcattgtcaaagcggtaattttctatattctaccactgaaccaaaacatacttatgaacatagccagccatatcacaataaatctgtatttgcttaatggtttactatccatataatattacattacccattgccttgtgctgtatctaataccagttttctgtccttttaattatacagctagacagtgatgcttcaaaacttcgtaactgtcttggaggcatttgctctaccgatggtgtcatatttatgaggctcaggtttttgctgatacttgtccactatttttagtttttttttcaccctcaatctcctgatcatctagccctccatgtctccaccctcttctgtatttttctcttggcttattgactatttgtgtaaaacggaatgtgtttttgtattttgaatatgtacttgtatacgcttttgattgagccaattttatcttgcataatattgtgtgtataaacaaagaaatgatacccaagctttgtttaattgttatactagctagtcaca

SEQ ID NO: 44733 - DNA, 11883 bp, Oryza sativa
acataattcacataatgtttcaatgtatatcttcatgcaaagatgccacatcatcatccactaattaacaagataccacatcatcatccactaacaatcatcacatttaaacatcatgcaaacatgctatatctttatagtttttataatttaagagcttttcaaacataaacatgttaaattatcatccaacataattcacataatgtttcaatgtatatcttcatactaaattcccgcagcaatgggcggggtttcacctagtttaacaaatagcaagtcatcatgactatttttcagaaagtggcagaatggtccatttttcggttagcagttttgctttaaaatttttgggaaggataacctgaaatacttcaatatatcttgccccgtaagtctgataaatgctaagtttttttccccatctaaatgatgcagttctcctgaagattacacactttccaagctttcttacattgcctggtttgcaaattcaatcaattatcgtattcccaaccttctaaggcaactgcttgagaaggttttgtccctgagaaacgctgaaacagccatatatgagacaaccctaggaaagttgagttctatcgaacagatgaggcgtcatggagatgttgctatctcaaaatgtctaaatcttagatttggaaaagcatgcggatcagtgcagacttgtgaaatcgaggtaaaaatggtcctatattctttcttacagtgcgtcatggtatagtttttggttctaacaaagtgcgttttccttgataggatgctaagcaccatttattttctagcactaaatcagtggttgaaattctcgacctatctatacaacttgttaaaagcatctcgtttgatatggaaaaggcccaaaattgcctccccagaggctatgatgatattatgaggtttgcgcatttcctgacaacaaaggtgagtaactcctgtatttcgttaaatcaggttttgtcgttctttcccctcttgaaaaagaaaaatcttttctcaatgaaagaaagatcacgctcttatcattcaaaaagaaaattcttttctcaatgaaagaaagatcacgctcttatcagtcaacaagtataggataaaaaggtgtttatatgatcactccagaatgatttggataatctcagctttttcatgctttggcaaatggttaatatgttaatggtatttgcaataagcagggaatcgattcggtaacagcttatgccttggtccatctgtgcttggataaacagctccaaccttcggagctcactctagaaaaacgcgagctaaagcagatcgattttcactgtgagcgtgctcattatctcctggaatacaaagggggcatctttggtgattccactgatctggatgcctgcaagcagatgctgaaatggtgtagcaaacttcggattgatcctgctgcaaccatctgttcttgattcccatgattcaatgcactcatagagaattagggatattgtgctatcttgaactgccaaaacaactactacgtaggaatttggtagtcatgtttacattagcaacttggtagtcatgtttaaattagcaactaggaattctcttatgacttgaagtgcatcagcctgtgtattctttgttatggcgttagattctgtaacatgcaatttgccagtcacatgatagccttgaacttaatttctagttgtacggtttgttctggcgatcaagcagcccacagtatgtcaagcatccaagcacatgataacctttgatcccttcgtaagttatcgtctgctgcagcaataattaagcaaatgaaagcaacttgtagcttaatttcctctgtttcacaatgtaagactttctagcattgtccatatttatttagatgttaataaatctagatatatgtatgtgtttagattcattaacaactatatgtatgtggacgatgctagaaagtcttgcattgtgaaatgtatgtggacaatgctagaaagttttgcattgtgaaattgagggagtactactctaaattacagggacagcatgtgagtgaccattttgacgatggccgtctccgacgagccggccttgccggtgcactccgccgccgccttcttcagctcgcgcgcccgcgccctcatctcgccgccgtcgctctccgccatgagccgccggatggcctcctccaccgcccccctctcgagctcgccgccgaccacctcgaacccggccttccacacgtgctccacgtacctcgcgttccccatctggtcgccgaagcttggccggcacagcatcggcaccccctcggcgaggctctccgtcgtcgagttccacccgttgtgagtccagaacccgcccacggcgcggtggcgcagcacctcctcctgcggcgcccacgccaccaccaccccgcgccgccgcgtcgccgcctcgaacccctccggcagcagccgcgttggctcgcccggcgccgcgcgccggccgcggacgaggcctggccggaccacccagaggaatggcacgccgctgccggcgatcccccacgccgtctcgacgagctcccgcgcgcccatgctcgccaggctaccgaagctcacgtacagcaccgactccgccgtctgcgcgtccagccacgcgaggcagctccggtcctgatgcagcaagctgccatcggcggcgggggagaacctgtggagcggcccgatgtcgaacaccggcacggcgaggtctcgccggagcttggccagctcgtgcgcctcgagcgcgtcgaacgtgttgagtatgagccccgacgagagcttcaccgccgccacggcgcgggccagcagctcgcacatcagctcgtggccgtcccttccgatgtgcatcaggtcgcgcacgcggtacggcggcagctcgctcaccggcatgtcgagctgcgactctgcaaccaaaccatgtcggattaatcgatcgatgagaagcaaatcagttgatagatcgattggattatggcatgccttgcaccgggaggtagcctctgtcgcagaggagtgggtaggcgaggaagctggcaaagcaggcggcgctgccggtgcggagcacgagggtgggcacggcgagccgcctggccacctcgaccatgcgcaggaggtgcgcgtcggcgacgaggcacgcgacagcgtccctggaatactcggccaggacggcggcgaggcggtcccggaacgcggcctcgcacgcggcgttgagcgcgcggatgtgcttgacgacgtcgccgacggagacgggcggcgggcggccggacatgccgtcggggacggcgacgaagcggtgctccgggtggcgcgcggcgtccggggcgttgaagtgggtgtggaagacggtgacggcgaagccgcgggcgcggaggacgccggcgagccggagcatggggttgatgtggccctggtacgggagcgggaacaggaggacgtggcgccggcgtccgccatggccggccgcggccgcgccgccctccactgctggcgaaggtggtggcgtcatggtttggctgggtgcaacttgcaagcaaatgcaaggacgtttcagtgatctaagggacctctgtgccgttgtgcgtatggacgtgccgggttttgtacccatctcttctttgctagtactaattacttctatttttttggctttttctttcatagatgatatcatatatcaatagaaagacatcgagattatgccaacaagttctgaaattcacttcagtcacctacaacaacactaaaccaacagccgttaaatatgcaaatgaggtcattttaggtctatgagtattcgatgaaaagctcttatagttatctttccaaattttctgacctcatatccatatttcatccgagtcaacggaaatcgtacaaataaggtgccacatcgtctagaatggtttttcaggcttgtaactaggtggagcacaaccctagacatccttaggctgtcctcccacctccgtaaatagctaggtatatattctttcagagatttgggggttttgttagatcgaaagttagctaatgctacttcgattgtaattccatgtattggctagaccgcctaattacttgtcttcaaaaccccacctttgtgactaattcatattgtttgtttatatttttgttagttatctgttgcttacgggaacaaatgccttatggttggtcgcacttcgtcaggattatgactcacgagcaaccttgaaattagtgtaacgattgctgaggcacatcgtccctggacagttatagtcgggtggccaacttcttccccatgcatgcaattgacttatcccctcttattgaaagatcgaaatacctgagaacacatcaaatcgtttcacctatagttgattatgggacgcaacatttattagcaactaaaaataatttatgagtaaaactgttacatgtgttaaggaaaacattgaatcgtttgacctatagctgattaagggacgcaacatttattagtaactaaaaacattttagttatggatagattcttttatgtattcttaacaactttagtcaatgctgaaaaataaactaaagaaaacccatcaaaatctattcattaaatttaattcttagttttgagggttataggacggatcgcaggctcgcagcacctggtacacctctaacatgcaaccgttgtttttggatatttttgagtttcatttatggattttgccttgtactgggatatcttggagaatggaaacttattttttttaattaatagctgcccatttaattgatgccttgaaaagatatcttcttcaacagtttccctttagaaaatgttggtatattcccagattgttgtagaaagatttaaaataatttaaattttaatttggtaagcattggtgaaggctacaagaatcaagttgcctctagccctctacacgtgaagaaataataatcaaaaattaaatttaagacaaaaataaaaaataattatttacattcatttttttaaaaaataaagtagtataaaaaagcaccgggtccttgatgaacaggggaattaccgaattagggaggggtgataagacgaagcaaatgatcatgggcccatttgtcatgggccgagccgctggttggcccaccaagcaagcggcgctgctgcctctctcttccatcagaagcccacctcccatggagcccgtggcttcccgtctcatcagagaagactactcgtctgctccggcatcccggcgacgagagagagagagaggggagaaggctgcgcggcggagatggcggtggcggacgtggcgttcaaggcgctgacggcggggctcggggtggcgacgctctacctcgccggaaccttctccgtcaacgtctaccgcggcctctcgtggcactcggagcaatccgtaagcaaaaccctcgcccgcctcgaccaccaaacccttgacttctccccgccgctcgctggggagccgctgattcggggtccttctccgacgatctggtgctactcgctgcatctcccatgtcgaatctccccccttcctttgggcctaggacgagggtttgggtggatatccttcgacctttgttctgttgttttttttttgcatcgacccatgcctgccaaattggaacatgtttggccctttgacttgatgcgagcacatatatttttgcgtgatgctgctgtactgtgcaggagctatcggtgatttcgtgttgctatctaactgctgctgcttatttcactttgattaagttatcattggctaattagctttgtagacgccaagctagtgttgatgtgaattatagtagtgtaatgcagccacttcttgttttgttgtgttgtgcttggaaaggtagtcatggttttaggttacaaacctgttggatgctcaaatacaacaaaacgagtgatatagcattttcgtggtagttctgaattttgacatgtttaaatagaaatggttcataaaactattcatcggcttcaatgtggctgatgaggtactgcgtgcaaaaatgatggtaaaggttaatcattccatcagttttgtgaaaggattgttggcttttggtgaatctaagtcaaacgaaaaatggatcctacaacttttggcatgaatattgcatcccagaacaaccaaatcagttttcctcatcaagaaacttagtgcataagtccatttttatttcagtaaatcatccagtcaactgttgtctgataggaaatcgttgtgatgttaaacccaatggatgctagacttaatctgctgatgttaattcagataacatggaatctggttaatgatttcagataacgaggtaagcatggaatctgggtaatgattttgtggtttatatcactgcttcaattaatcatggtgtgtggttgaaatatgttttgaaatgaactatatggtatcagcttcttgttatctacagtttgaggcggtttccctctttatcttgcaatacgttgttgtggagcttctgagtcgcatgctgacatgttcatttgtgattttcagaagttagaaaaggagaaacgtgaagactgaaaagcatcagaagctagtctagaatgtcagacacaacaaaagaaaacctaaagataaacactcaccttgtgagatgagttgtctttagactagttatgtttcctgggattgtttttgcagacctttcaagatctccagaatgctattttgatttgatgtaagatgcaaagatctcatgattattattcctctttatgcttacgaaaatatttcgaccaacatatgggtgtcattgatgccattttatatgccacagtttccatttaaggttgtgtaggaaattttgtcattgttccttttctctcttgtttgtgtctcgccgttttatttaccgatctgatgaactccagcaggaatgatcatccgcccaaatcaactttccaggggtaacacgtccaaacaaatgcctgatatcctggtgatctcactgaaatcaaataaatcttgcttagttcgtgtacgagtcagaccatgagagtctcgttcatcaaaccatactcattcagatattaaactgggccaagtctcttcttcttcaatgaaaacagttgctcccagtcctctttgaggtttacctaaaaaaagtgtagaacacaagcaaccgtacccaaagctttctctgcagttcatatatagatggtacaattgtgttcttgcccttgctcatgaaagtgtacttacacaccaaatacactgtacgagaacccactggcaagtcagaaaatcagtaattcacgcaactcaaaactgtagatataacaaattgaagttcctctatcacgagttgtgtctgatacagttaagcgcctagcggttttttccctatgtagtgagcagcagataaacaaggcctttcagatactcaactatctcagatccaccaagttttgaagttccaaaaaccctatcgacaaaagttattggaacctgaaaaatataaatcacaattttcagcattcaaagaagcagcatgccaacaatactaccatatagccaggtacaaaaaaaaaacaatacaatcatacaaagagaaatgggaatacataatctacctcttcaatgtgataacctttcctggtagccctaacaatcatttccatttggaaaacatatcccttgctgacacacgaggagattaaatcttctaggacattccgtttatatagcctaggaaatcaggtcgcaatgttgcatcaatttaatagtagttatgtggagcttactctattgtaggaaaaggagacacacctgaatgatccagtcaaatcagaagctccaggctgtagtaatgtttgtgctagaacatttgctcccctgctagtcaacttgcgcatgagattccaaccatggacaccaccgttctgaacataacgggtgccagttacaacatcagcaccagtttccttttgcttcctggtgatgcaaagaggacaattaacccaaagggcaaaggttcttctaagttacttcttatcagtgtagtagccttggtaagagtccaactgtaatggactttgctctaaagtttcagatatttctaacatctgacacaaacaatctttcagcaacactaaagtatttaatacctatacggctataccaattccatttagagttgacaaaagcatattgatgaggaaaatgagctatagcagactatttttgcaaagaaaattctggattgaatacatcttcaaagataagatgcttacctaatgaagcttggcaagtacttcggctgttcagagtaggaaaaaaggcgtcaaccaaaaaggaagaaaacaccagcttaagcatgccaaatatcagatagaagaaaaactgaggaattacatacatggtgagataggtcagcatccatgataacaacgaagtccccagaggcatgctttagtccatgtaaatatgcagtacctgcaccatttccagttgttagttaactcaaatgtgaagactaaattcaccttagacttgaatggaggataggagctcaccaagtcctagcttcctcggtctagctcgcagcagctggtctcatgtcagatcaaacacatatcaggaagccatgataccaagacaaatcatatatatataaagacctagacaaaagggagcactatacaaaaatacttacaacacggttttcaccatatatttgctgcaactgctttacaatgtcttgagttccatcagggcttccatcatccacaactatgatttcaaagttgacatccctgatgaggaaatctaaagtttgagatactataactcgaaagagttcacaaaataaataaaactgccttgtcataaagagacacagggacagggctgcagaacacacgggcataatgagttgaatactgatggaacgctagcagtataaatcgatgatgaaatatatactgtagactgaacataagcatgctgtctggtggcattcttaaataatcactcaattcaaagagttggatggatttctatctgcccatttgacacaagcaacatgcaaagtaacattcttcgcagcattctattagcacaattgagcaagttagctgcactcaggagcaccgatgaagggtgtctaggagagcatagctaaaatctgaaagtgatcaaatcatcacatcgtctcaattgcactggatcaataagtaatcgtcttctatactttccatatgttcttgtgaaatcacaagaggcgcgaattgaatctaaaagaatggctaatccggatctgacaacaaccttctccgatccactgaagagcaacagatcaacagtagatggggggatagagatgggagagatggggggagttacggcaggtgcttgaagatgaggtagacgatgagggcgacgttgaggcgctcgttgtaggtgggcacgatgatgctgtactcgcgcctgccgcgcccgcgtcgtccgccatcgccggcgccccgactcgacctcgcaccagatctctccgccccccgctctctcccgcacgcgatccgacgcgggcgctcggtgacggtgaggccacttagctggggatgaggatgacgcgcgcgcgccgcagatgccgccggcgacgacgagcagggcggccggcgtgaagtctcgtcgaggagttgcttcgccaccgcaaggtccattgagatgtatagggccgcagcgtgggccgtatccagaccatggacgtgtttccatgggccgtgtctagcccatgacaagcaaacgctttgtatgcgcctgtagaagagaaacggtatggtttggcaaagaccaaccatgcaatccaatggagaatggacaggccaatcacaggaagcaccgcatttcgtgccaactccagtctagaccgtttcagtttacataagcaagcattcccattcaaacggtcatcatcgtcatctatatctatactaatataaaaagcacgagttcatcaaatacctatctttactgacctttaaatatattcatccaacgatttatatcaaaagttagatcaacctctgcaattagccatccccacgttcgattagcagcggttatagcgatatagcgatcgatcacgagaaagaagcagaaaagaaaaaaaaaacttctctcccgtgcgctagcccgtcgccgcctcccggagccgctcgctgcctccttgcacgcgcccgccggaccgccgggcgccgccgccaactccgagcgcgcacccgccgcagccgcgccccctaccccgccacctcctcgcgcgtgcccgacgctcgccctaccccgccgctgccgcctcctcgcggccgccggtgagtcaggttcgccgtcggctggcgccttctccaccaccgccgccgcctcctcgcgcgtggcctctggagttttgggatcgccgtcggccggctcctcctcgcgtgcgcccgccggggagctgtggtgggttacggcactacgcagtacagactccaggttaaggtgatgtcctctcttcctaaatcctcaaacaataaagattttgtgcttttattattttggggtcataaaattgtttacctagggtttgggcagggttgcttatgatacggggccccaaatgtttagtcagttggttctctcgtctcgctatgttatttgctcttgtttaggagataattttacttgctatgaattctgcttgctaagcatctcacaagtatcatatcagtcatgcttcctcaggaaatgtctaaaaacatggtggactgccgatcacacaaattaattctacaaagcaattatcagttaattacctaaggacttggctgactgccgattaccgattatagtgtaaacggtaagcatcagttgtggcagtgcacataattgaataaacaaaatgcccaatacccctaattaatctgaaagcaatccatcaatttaataaattaagttgtgggatgcagattgcaattagtgtttggccgtcaggcatctggcattaattagcattcggccatcaggcgtcttgcattctggttgcttgctttgcctatttgattgggttggatcaggtgtccaatgtgatttggtccgggggtcccacactaaaattatacatagcctataggttccacaatgttgttaaccaaagcactcgcccttcccatattcaagtggatccccattgatctaggttggcaaatcttactacactatttcgttacctcgtaagtattaagttcttttatggaacatatttttagatttaattccaatgataggcttgaagatattttgcacttttttacttattggagttgatgtgatggagctaacatcagctggaagtcaccttgaaaatggcacattttgtgtcttgcccattaactgtcaagtatggcacaattattagtgtgttttcccctttctgcggtgcagggagacgcatattacatatgtatccctcttctctggatcaaagagtgcagaggtccttcaattgcattctaaggggatagggttcataattgaattgtttagtgatgtttgcaatctcacaaactcaaatgtcgttagcctctcttgaagacaagaaccattagtctcataaattatcaggtttggattttagcagttttaggttagattataattccagattaaagtgaaaatgatgaaagttatacattaaagattttgagtgaaaacattaccagattttttttctccaatggaatgttaattgttaagtgcaatatatattcttaattaaagttgtgtgcatagatgacctgccaacaatactatcccgtattgttcagtctattgat

SEQ ID NO: 44734 - DNA, 10893 bp, Oryza sativa
tgtttaatgttgatgtagtgtggtagtttctaatttcataataatcatagttgttgcacgaagaaaattatgtaatacagagtgtgaattaatgaaaaatgccatagcatgtgaaagtgatatatgaggcctagtacatcaattctaggatgatagaggtggtgtttgaatctagaacaagtgtttcacgcaaaacgaggtggttgtaacgtgtgattaattgagttttaattattacaaacttgaaaaatggatttatctgacattttagagaaactttcatatagaaagtttttgcatgaaacgtaccgaagaatccaaactttcatatagcagtttgaaaagcgtgccacgagaatccaaaattttatcctactcttaccgaagaaacgaacagggccagagggtggtatttttcccattttacaatcatcacataaagaaaaatgatacaattaatcatcacagaaagaaaaatgttgctaaaccaaatatacagcttagaaatcaggtagttgatgaacctatttgtcagtgactgtttcgattacaaggtgaggtaactgtgaagtacatgtagctagcctgcatggaattccaaagttgaaagtgtgcatcgttagtgaccctccactaatcacaaaatgttgcggctatctccgtatgagctagctgtctcaaattttatgctccatttcttacatgtgctaattttggttagttggaggcagactaaagcaaaaaattaaagtgggagagcaaagttgtggagtccatccgtccatccgtccatccgtccatccatccatccatcgccgattgcatccaacttgattttgtcggcaatgcaatctaatgcatgcttgcatggttatcgtctctactgacatctcctaatccagcaaaatattcagtgaatatgactgtgcagagacagtgtcgcgtgcagtgcatgcatccatggaattattgttacttaaaaaaaattcagccagatgtattaaatgcgttggtgtttttggttcattgacaaaaccaaccatataaaagaattggtggtaatacttgcatatccatttgggggtctgttgccaaaaaaaaaatgaaggggctaaacacaagcttcggaagtaacattgccaatttttttggcttgacaaaattttagtaaggctaagaatagctataataatccaaacaaacctattatggctaggcactagaatttgaattgttagcaccctgcaaaaatatttgggaatagcaccctgcaaaaatatttgggaatggtgccatatttgtcaataaaaataaaattttaacacgtatttacatgtaataatcaaatattacaatatttaaatctatatatttcgaatgtaaatttcagaacttacaatataaatagtatcaaatgtttacagtgtattttttttctaatactcaatgtatataagatttgagactaggaattattggttaccggtgctgatcaacaaatgacgtaaaaggggaaaataaaaattggaagagagagaagcggagggatatatagtctgttcgccaagccaagatttggggacatatgttgcccacgacggcatgaacatctatcgcacggtccaaatccgattgaaatcaatcacaaattgctggcgatagatttttagcaataccggaatactcctacttttacatcagaattgtacatggaagttatgtgtgcatcgatctgtaaactagtactggtaaattgttgcacaaagcttttgtgcgtttaatttgcggaaacaaaataaaagaacttaggtattatcagtgtcaaaaaaagcagcggaggtgacggactcatggcacatcagtttatgttgtatgtcatcctagaaatgcttgtgctagctgactagctccaccactccagtcctctgatcctctactgctcctgtatacttcttttcactgaattttcagtgaattggttgttgcttgttagtactccctctgtcccagattataaaaggttttaaatggatttaacacatcataatactacgaatctatacaagctttctgtctaaatttgtaatattatgatatgtcaaatccacttaaaattccttataatctggacgacaggtgctatattggcatgaggaagagcaattcatcatttacgattcaagacaagaaccatcaaaaatgtattaaacctgcttagattaggtcatatatacaatagatttttttgaactagaacaaattatttcattgttcttcagacaaaagaaagaaccggacaaattaatcatggccattagtacacactttatgtaattattttcctttaaaaattatcttggtctgatcaacgtcatccacagaatactatgcaggttggtagtgcttgttgtaaaacagtgtgtaacagtgaaaccgacattttttgcccctgatatgggctacacatgggagagctagacttttattttaagaacaagtaaatttcacaaaactactggtattttggttaaattatcaaaatattatagatttaatatgatgtatcacaaaacgatatatttaacactaaatttatcacagaactacagatttaaagtagaatatcgcaaaactatatatttagtagcaaagttatcacaaactaaaagtttaatatcaatttaatcacaaaacttagacatatataactcaaacatagcattggtgctaaggatttaaaccctacaatctgtagctttatgacaattttattagtaaatttgtagttttgcgatacttggcctttatgataattttattattaaatctctatttttgtgatatatcactttaaatttatagttttgggatgatttagccaaagtatcatcacattacatttactgtaagagaaatgatccccacaagagagagagaaacgaaagtgcaaaccattcctagaataacattacatttgctggaaattaaaattcatccatctttgattgcacattatgtagtataaggtggcatcacatttttagtcatagtaatcaaacatggtaaattgacaaacttcagacctttgggttggagaatttgaaatatttttgacaggtttgaatcaatttccatgagaatttaacaaccagacggcatgtgcccaaaaggttctaaaatacttccccacttcggttcagatgtgaaatttgttcaaaatttatatgaggctcctattagaaatttgatgagggctagagacttacacatgatcccatctcttaaaagtgggttgaagggtgccaatcaatcacggttgtgcgtgtggtgtgagtgtctagtggtatgtgtgcaccctgcatgatggaacaatcccaaatttaaggaaccaccacgcacctaaccctgagcatattgatgttcaaactagtcattaatttttacatagacacgataatctcaagatatatcggtctagttttccagatatgctcatagagatagatgtgagcatttataagggtgagtgtgcgtgtgttgtgatcgtccgcagttatacctgtttctcgaaagaaaaaaaaagatgatcaaaatatttcaattgacaattagtaaatcatcgagttacacattgtgaacattttagtcactaaaacatatgaaagaaatatgaaacatgtaaataccatttgaaatatttctctattttcttagaaaaagtgttcctttcttatatgaaatatcaaattttaacggttaagacatactccgtataatttcttacgcataaaatattttaagggaaaaaaattaaagcttgctaaggagctttattctttgtatgaaacatgcagccatcaatactaggtatctagagagaggagggaaaatgagcatgcagagcgtcctatgagcaccctcgaggcatatcttatattgataaaatcactataggtgtcttgctttctatgagtgctgtcagggttatagataccgcatacccaatagtaatcgactaagctcggcgggcccactacataccaagtcttatacggaatcataccttgtatatagaaggggttccagataagtaaggacaagtaaagttctatatgaaaacgacaaggactagattgtatccatattggtcttcctagtcttatttggacaaggaaacatctatgggtataaatacaagcccctaggaggagaggggacacgccacaaagccacaagatcaacacacaatacacaagccaacacacgccaagacatgccgtcgggtatcaacatcagagattagcctagacaaaccccgtccggtttctacggaggccggcaatagggatctagcagcatatctgatctcggcgagtgcggattcgaggaggaagactaccctgtcgtagtcggttatctagccgccaagtcaacgacaacaagataagttatcccaaatattatacttgtgtaattcaaatgaataaaggagcaacaccggcttcagccaacaggatgtaggggtattacctgtcagataaggggcccgaacctatataaaaatccttgtctctgtctcttttactccaatctcgcatataccctagtaccaatgatccccataccatctaaataccgtagtcgcgatctcaaacgtcgacaagtgcgttgcctaccactaaaaaaataattaaccttaaatacaattgcttatgtgaagtgtaggacttggacctgaatgggccaattccagctaaaggaatctattgagctactctcactttgattgaactctaatttcacgaagagatgtcctctcgtttattatatgttatctaaataattataaacaaactgataagatagattaaataattccttgaggcaagataaaaatatttttgccttctgaaacagatgttgagtgatatatcatgtataaaactatcttttttttataaatgtttagatggtatatatgaaaatagtttcccaaaagaagcctgtgggcgtaaattaggactcggatcctctacattaaaggaaaaaaaatgcaaagaatctacagtacacttgcattaggcatggtttttaccgttggatcttcatcaaacggctagaaacggatgttacactgaactcgaatagtagaaggggaataataatattttgtcaaccggtcaaacccacactgtgcaagcagtttttgctacagtactactatactgttctaacagtggcccttgcattacaggagaggatccacgtcccgtaaattatttcgtcctttttggatatcactgaattatttgcttcatgttttctaaaatatactccctccgtctccaaatatttgacatcgttgacttttttaaatatatttgatcgttcgtcttattaaaaaacttttatgaaatatgtaaaactatatgtatacgtaaaagtatatttaacaataaatcaaatgataggaaaagaattaataattacttaaattttttaaataagacgaacggtcaaacatgtttaaaaaagttaacaacgtcaaatatttagagacggatggagtatttgcttagaaaaaactttccagtagtactcattgcttttttttttttttgaacattgtactcattgcttgaaaacttatttcaaactattgactccatgaaaagtatatgtcatcgagttgcaacttgcgacgtcgtacaactccatttgggaattttgcaggagcgtttacacatggcgaagaacacgacgagcggttggcagttagccgctgactgaaacgcatgcagagacaagcatttcctgcgaaaaatcaacgccgattccggtgggcgatcgatcgatcgacggctgcatctgcgcatccaacttgcttagcttgtatcttcgtaaaacggccacgcgtgagtgagcccgtcaccctgcgagagatgtaaggagggcatgtacaaaagatagttcgacacgacacgatctcttagttaatacttctgcaatagttaaaaaaatataacctcttaactattactacatcaaaataaatttttattacccttattttcttttcttctctccatctccatgtaacaatatttcagttaataaatgctaccaagagttgaaatctaaaccgttgtcatacgtagcaacgctgtttttttttctttttttttcttttcacgtcactaaatttatatgcatatcaatcgaaaatcaaaagagtacgttaataaatatcattgtacatgtctaagaaaaacggacgtgaaaacgtgcacgctttaatttactggccctgcatctcggctagtttccatgcagaacagcggcgctagagacggcgtatgcatgatagatgtatgtatctcttggattgatgacgtttgctggaaatttgggagtcaatgcaaatttttatgttttcaatgtattatatctttgtgatgcatacaatatcttctcagtggactatttaatctccaggatttgatacttcatagatttcactcaaattaatgagtgctggagctattgtgtatgcatggcaaacattaattagaagatcaaggaaaaaaaatatagtgtgaggtattagctatgtgttcaatactccaccactaaataagggagacagattttgactccaaatttgaacgttgtggatagctatgatcccaccaccacatatgtgatgcttcccttcttttcggaggatatgcaacatgataatctatactccctccgtccaaaaataagtgtagttttgcactattcacattcaaggcaaattttcaaatttttcacaattttttcaaggcaaattttgctacaggacatcgcaattgtgtggttttaactcagggacaccgcgaaagtgaagttttgggggaagacatcccataatcgtggatattagccgatggacaccgtgccatttaaattagctcagggacaccgtgaaagtgaagttttgggggaagacatcccataatcgtgaatattagccgatggacaccgtgccgtctaaaggaatcttgccatgctgacgtgacggacggatgcccttttttgacgcggttggacctaaatgcccctgcgccttatctccttaatgtttggccccacatgtcatcctccatgtctggccccacatgtcatcctcaatctctctctctctcatctacaaggagaagactagagcaaggcaggcgacgaccagagctgggcaggcggctgacggcggccggagctggccgcgaagctgagcagagcagtagctcagcggggagcaaagcagagcagcagcacgcacgccctggatcccccgaagcaggaggtggtcaagccgtcgccgccgggccgcatccgcaacagcacgccctcctcccccaacctcctcgtctcgagcgccgacgccgatgccaagaacatgtgctgctactccgcgctgccgagcgcctgcccctcttcccctctctttccaatcctctccagcggctcccacgcgcgtgcgctcctgagcaagatacggcaggcgcgcgacggcacgggccgaggcgacggcggcggcctaaagggagcctggcggcgttgagtggatggggataaaaggctggctcagcgaggaggtgccagggcagcgccgagcagaggaggcggaggtggaggcgctgggtgatcgcggaggcggcgcccgtgtgggccggcttggccgtgcgcgggggcggtgctcgcagcgtggtggtggccccgagcaagacgaagacagcgggtggtggcgaagcagcagtggcgcgcgggtggtgctcgcacgggagatgtggccgcgcgcagtggcagcggccgagcgtggcgacgacttggtgcggcggcggagaggggagagaggtagctagcggcggtggggaatggcctgacgggaaggcctttttttgctgacgtggtgcaggggtatttacgtccgatcgcgtcaaaaaacggcctcccatccgccacgtcagcacggcaagattcctttagacgacacgatgtccatcggcaaatatccacgattatgggatgtcttcccctaaaacttcactttcgcggtgtccctgagctaaaaccacacaattacaatgtcctgtagcaaaatttgtcttttttcaaatgagacggacggtcaaacgttgggcacggatatccacggctgcacttattttgggacggaggtaatattttctttctttcttatataaaaaaacaaaccacataaaggaagtcgtgggcttaaaaatccacatcagtaacacactacataccttgtccacgaatacaaaaaatgattggaggtgtgaggtgagaaaattaaataaagagcggtggctaggagaaatagtttttgtgaatacttatatttgtatggcaaataaatattaaatgctaaaattctttatatatagtctatgaatctttatatgtgtaaataaattccaattattaggtatccttatatatacatatgatgtatttcaacttttttaaatgggaggtgtatttctactttgaacatgatgaattgagaaagttgcaataggggtcaaatctcttagatatttgtcatcccttaattattttccaaggatagtagttggcgatatttggtccaacgtttgtttgtagtaaaaagtaacggcaggagtacaaaaattaattaagtatggttggtaaaagctcattgaattgcatgcggctgatgaaaaaaacgtcaattttgtcacagatattttcacaccttaattactactagtattttacttaagcaagtcatctctaaagcagtgaaagactgaaagtagtgagcactagccactagcttgaagataaacacgccaagttaggccacagattatttttttttaaaaaaaaacacgccaataattagtgtagcaaaaaaaatccttgaattcccattaatgcgtcgccttcaaagattttttttggttagctagactaattatttccattttttcacaagattagactaattcaactaattcttttcatcgattcgcctttcacccaaaatcgatcgagctctcctttccctgattcgattcgttataggcccatcgatcttactaataaaatgattacaaatctaatcaacagcgaccactgactgaagccgcagtaatccggtcagtctgcgagtgagctcacacctcgatcctcgtcctcttcttcgattcctcctctgttctcgctggccgtacgtgtcaagcgtatccagcacacacggctatataaaggctgcacctcgagccccttttcctcccaaccaaccaacctcaaatcaaatcaagaacagctcgtgcttagatcgctctctcgcttgctgttcttccaatccactcctcttgtttgtggcaaagatctgggttctttttttttctttttttgccgggtttttttggagaggttttgtgagcatggagggtttaaggggcggcggccatggcgaggcggcggtggacggcggcgacgagaggtgggtggaggactcgtcggtggattaccaagggcggcctcctctccgcgccgccaccggatcatggaaggccgcaatgttcatcatctgtaagccactttaatttctcgatgaatctttgtccgtacgtgttcatgtgatttcttactgatcgactgagtgacgtgttcgtcgtcttcctcctcgatctcggcgtgaattcgatcgattggttaaatgaagtgattgagttcagcgagaggctgagctacttcgggctagcgacgagcttgatgatctacctgaccaaggttctccaggaggagatgaagttcgccgccaagaatgtcaactactggaccagcgtcaccaccctcatgcccctcgtcggcggcttcctcgccgacggctacctcggccgcttctccactgtcctcttctccactctcatctacctctcggtcagctctctcactagctctaatggcgttcctcgccggcagcgagcgatctctgatgatgatttttgttttgttttctgtcattgcaggggttgattctgctggcgatatcgcagctgtcgccgaggctgaaacccgagcgcaacctgcacctccacgagacgctcttcttcgtggcgatctacctggtgtcggtcggcaccggcgggcacaagccggcgctggagagcttcggcgccgaccagttcgacgacggccacgcggcggagcgggtgcagaagatgtcctacttcaactggtggaactgcgcgctctgcgccggcgtcctgctcggcgtcaccgtcatcgtctacctccaggagaaggtcggctggggcgccgccgccgtcgtgctcgccgccgtcatggccgcctccctcgccgtcttcctcgccggctggcgccactaccggtacagggtccccgagggcagcccgctcacgccgctcgtccgcgtcctcgtcgccgccgcgaggaagaggcacctccacctccccgccgacgccaacgagctctacgaggtgaagccgcagaatatcaagaggcggctgctctgccataccgatcaacttaggtgaccacttcatttcaactcacgttactttccttgccccttcttttctcgcaaaaagacactaatcattgacgcacgtacactgcaccacggctcaaccaccagtcgacccaaaaacttaagctgacgagagaaaaaaattatcgatagtgaaaatgataacaatatttgatcacgttgtaaagttatacataaggacttaccttgtttatccaaaagcttaaactgacgaggaaaaatgcaattgtgattgtaatcatggaatgtgtggatgacatggcatggcaggtttcttgaca

SEQ ID NO: 44735 - DNA, 787 bp, Oryza sativa
aggagacgaagctggtgctggcgatggtgcccatctgggtggcgacgctgccgttccggatcacggcggcgcaggtgtccaccttcttcatcaagcagggcagcgcgatggaccgccgcatgggcccgcacttcacgctgccgccggcgtccaccttcgccatggccgccatcggcatgatcgtcgccgtggccgtgtacgacaaggtcctggagccgtacctgcgccgcctgaccggcggcgagcgcgggctcagcatcctgaagcgcatcggcgtcggcatcgcgttcaccatcgtggccatggcggtggcggcgacagtggagaggcagcgcctccgcagcgcctcgccggcgtccatgtcggtgttctggctggtgccgcagttcttgctgatgggcatcggcgacgggttcgcgctggtcggtctccaagaatacttctacgaccaggtgccggacagcatgcgcagcctcggcatcggcctctacctcagcgtcatcggcgccggcagcttcctgagcagccagctgatcacggcggtggaccgcgtcacctcgcacggcggcgccgccgccggctggttcggcaaggacctgaacagcagcaggctggacctcttctactggcttctcgcctgcatcggcgtcgccaacctcgtcttctacgtggtcatcgccaccaggtactcgtacaagaccgtcatggccggcggcaaggtcgtcgacgacaaggccggcgacatcgagtgcgccgccgccgcagctgctgctgcctactgatcaat

SEQ ID NO: 44736 - DNA, 1219 bp, Oryza sativa
ccgttttttcaagtttaaagatggaaaaggatgtctggcaaataaaatttgttttttctactgtaactcataaatctgagtgggcctttttccaagtgatgttccactgttaacctccaaaacagtcagggatacgctgattaataagcgttgtgttaggttgaaatgtcgacttcaactggccaacagtattggaagcagggacctgcagttctgtagtacaaaatttcttttcagaaagctagcattccatcttgcggtggtctctactgtattccactatcaacactataatttaacaattacaaacagtaaagaaaattctactgtcaataattaagaatggtagtataaacaaatatggtactccatcgtagtaaccgttgcaaaacaccttatacaggaaactatggtacaaaacatacatcgtcagaacagccatcctgaagcgttcctgatgatttcgacaggttacagttgcaagatgtgccaacgaacaactatacctaaggagaaggatgcaagctatatacaaactagaaaagaacaaaattgtcttgaataaatgaagagatcgatctagacaaagagatgaagcgaatcaagagcgttcgggggagtcggagtgcgtcgctgtcgccgccgctgccaagacgcgtcttccggtgcgagctcgccggccgccggcggcggcggcgaagcgcctccgcgtcctggccgttgaggctggccagctgctcggagtgctcgccgatgatgctcgcggcgcggctgtcctcggcgagtatgatctcgtacccgtccctgaggtcgtccatgccggcgacgacgtcgtcgtcgaggagcagctgccagaacgcgccgccgacgagcgggccgccgcgcgacgccgaggcgtagatggcgtcgagcaccacgtcgaggaagtagttcctctgcgtcttgttggcgccgccgcccttccagaggaacttgccgtactcggtgacgagcagcggcttgccgaggaacgccgccgtgtcgtggacgtgggagcgcgtccagttgcggaagaaggcggcctgctcgtcggcggtggagccccatagccagacgtccgggtagaggtggatggtggcgaagtccacgccggcggcgcggtgcgtggccacgtagttggtgccgtaatagatgccccacgggttgagcttcttgctctcgtgctcgccgtcgccgtaga

SEQ ID NO: 44737 - DNA, 12315 bp, Oryza sativa
aggatttgacgacggagctggtgaagaagtcgtcgccggcggtgaggttgtggccggcgtcggccgcccaccggacgtactgacgcttgccgccgaaatcgtcgaagttgttggtgaggcagaggagaaggtatatgccatgtcgtctcgcctcggcgatcacaaagtccagcccctgcaagcaaaaaagaaaaccagagaaaatcaaacaaaaactgtgagtttttgttcaccattccacgtgacaaatggtcattgatatacgacgaatggtggtgacctggaacatggcctcgtcgtagacgcccggcgacgactgcagcggctggtcgccgccgtcgctgaaggcccaggtccgggcgaggttgaggccgcgcgatgacgcctgggcgaacgcggcgacgacggcggcgcggcgcgccgggtcggacgccatcatcatcagccagtacgcgttgaacccgctgaagtagatcgtcctgccgccctccaccacgaactgcgtcccgtccacgcccaccatgccgccgcccgccgccgccgcggcggcgccgaagacggcggcgatgatgatcgcggcggcggccggccgtggcctcaccgtcatcgccgccatgtgtgttgcacagcttgcgccctgcacttctactacacttgtgacttgttcatgcaaatatgcaacgcgatcgaattcgtgtgcgttttttatatatataggcgcatgagcagagcctagaagatgcacgttaattagatggaagtagtacgtggacaacggtggtgatcgtcgccggcagctagcgtccatgacgtgacggctgtgtgtgttttgaatatctgaaacattccatgcgttctgccatgctagaatgcatatacaggacggcgcagatcgatcatatcgagctagaatgcatcgtgttgttttgtacaatttcgtcttgccgttttctttctttctttcttgcgaggagtcctgccgctttcgtctccatgaacactacgcgattactttcgcaggagaatggccacgtcgtcgtacaaaattagttattaatgtttttcaaactaaattaattaagtgttttttgggtgattttggtgccagaaacgtcagcatggactacacaagggacacggaagtacgtgttgcaatgatatgatcgtccttacaaagtgttcgatgctgcacaggtggtggtgccgtcggactcgatcggtcggtcggtttggatggcggagccaaaattagccacgttaacggagtacgtggaactgcatatactcataataatccacagtcatatggttcaaaacaaaataaaattcaagatgcactactacgtgcttaagatgcagtggtcacatttcttctaattaatttttaatcatacttctacttcttttctttctttttccttttaacacgaaaagaaaaaaaacttcctccagtttgttctgaaattccgatcgccaaagaggcagctaggtaggcagattttttttagacgtaacgaatacaattaatctagtaatgctgctgcaagtacatctaatcacatcaacgtactttatggcgaattaattactgtattaatgtactatctgtccagagcataatgtttcgttaagattaaactaaaccgtatagacatggggaggtacgtacagtcgtacagcatcagtcggcaaaaaaaaaaaaaagaggttgctaggcagtaacatcgataggtaactgtaacaacaaccgctgcaagtgcagagttaacttcttaatgttggcacttacccatcttgcctaattaatccttccttccttgccgactttcccaaaggagaactagatacttacgctagctccattggtaggtgatataagtttaaagggtcaaagtaaagctttgttgttctctgaacgaattccacagataaaaaaaaaaagtctaaagccggctgtggccggctgaaagttctcacttctcaggtcgtaaatcccatcgctgctttcggcatgcttcgcaccttccatctgcaaatatatttgtccaaaaaaaagctcggatcaataacacctgtaataatatagttattaatcagcagtagttaataattaataataatgtacttaataattacttcatctattttttaaatattatatgacacaattgattttttttctcaaaatttaaccaataatatttatccaattacttacttaagtggagtgaaaagagtaccattatgcctggtgtgattgtttatttaaacacatattttttgaaaagacaaatactaataaaaaatcaattgtgttgtgttatatattaaaaaatcggagataaaaattaagtagccagaattgcccaataatttaaagcactaccatcagttaagatttgagaagtaatccaacttgtgaaagctacaggtgtggagtgacgctgcaagatcatatcgatgtgaggcgagcagtacactactattacttccatgttataagactttctagcattactcacgttcatataaataatttattaatataagtaatgctaaaaagtcctataatataaaacggaggaagtagcttacaatataactccatagttgtacacttgcagcattattgtttatctaggtcacaagcgaatgacgtgtgaagtttcttcaggcttgctctaacagatgctattacatttcttcagagatgctataattaaagagagaaaatggttgtcttcagagctgtactacaaaggggtttcttcagatatgctctaattaaagagaaaaaacgggtttcttcagagctgtagtactgaaaggtttcttcagagttgctcaaaataaagataaaaaagaagcaatgtctcctcaatcttgtgcacgtcacttgtgcaaggttgtgcaaatctttattggattctataagttcgttctagataccggcagatgcagcatcgcagcaatatccactgtgtgcgtttctagttgaaagccattcagtgaactgcaatttcttcttttttttaaaaaaaaagaaaaggaagaagaagaagaagaagaagaagaagaagaagaagaagaagaagaagaagaagaagaagaagaaagaatctttgcaatgataagtcaaagcatatattggatcaattcaaggtaaggatcgtgtcaagcttgtagaaaagtttggcacatatatgcaagaacgaacctacgagtgtcgtgccgtggcgcggcagcagtttgcaagtgtcgagcgtacgtacgttgcgtggtttaccagcacgcatctgcaatgatctcttggagacttcgactcgtgcaatgtacttcttgtttggacatctctcgttggattttggccgtttatattctttgtggatatagggttaatgaaaaatctatcatctaaaaaataatcttttgttggactactcggaaatcggatcagatgcatgcttatcgccactcgagacccgtctctctctactgctattttttcttttcaatttttaccattcacagcacaaatcttttactatctgaattatcgatgaactgtcagcatcgattttttttcttgaacggtcatcaatctccatcctttagcagatatttaggagccctttgaaacacgcatgacaaaaaaaaagcatgaatcgatgtcctcccacggaaaaaaaaagggaatagtgtatatttttaatcccacataaattcaaaacacataaattgggaagagtagtcatttgattgcatcacaataaaaaaaactgaaagtgttccaacatcttggttattttcctatggtattggccattgcaatgcagttctatataacaaaaaaattctaccctctccctatgaatcaaaggactctattaaaaaatcctttaaaaaaattaaatccttcaaaaactttatcattcatttcaaaggggccttaacagataaattagaccatgactctggttattgaactctccagagtccggattgtcagtctccggagtctccgaattgtaagtcggataaatgagagaatgcctcatgaaagaaccatacacctcgccctccacaaattactaaatccacccaaaatattggattttgcaacactagtacttgaatttactaaattttttccatgtattgggaaaaacaggcaatgtaataacataacatttttctcgagaaacaacataacctttttttttagatttagaaaaaaaaaggaaataacgtcatttctaagacttcacaattcacaagcaatgcaaagtgctatgcatcatgcgcacgtaatgacgtttgtcgtgtaatatatatatctccaagagtacctgagcggtttgtcgtgtcccttttcgagatttaacatatttattttatttatagatagctcttgctcttggtcactgaacaacaaaagaagaagaaaaatctgcatccactgcatttgaatacctaactcgccgcatgactatagacatgattgctggagtatatctgtgatagattctagctaacaactactgtagcttgaaaacatgttgacgattgagatctagttaatgaaagttgctgtgttccaatccaagagagaaccaaatgaccataaaaaatgcaaactgaataagacaccgcgagcaattaaattaacagaaaatcacataatggacttgatgtgtaagctctccctttccatctgattgccttattttgcagaacattttataaataatcacgtggaacgttatgtaaataaaataacgctaatctttggttgaacaccttggagcttcattatagccgatgaaaaagagaagattgtcaaaagtgtaaattttgtttgcaaacatttgaatcgcttaagctttccaaagcaaatcacaactaatactgagattatgcaattcccaaatgctcccagcttttcctgttgatctaatagcaagggcaagacacaccttcgatttttggcacattgaaatttgtttctttcgaaagtgagagaaatgtaagcttagtaaatggcgttcattttcgcttcagtaatcactaatcagccattactctgaaagactcatggaagagatgtttagaaaataaatgttacctactgatagataattcgatcagagatgatggaaaataaatgaaaaggaaaaggacagtagtatgcatcagtgcaattagcacgttttttatttttgtaatctgaataacgcgctccagactccagagcacctgacagcttcgacaagagtacgaggcctggcacaaaatgttggccaggaagcccacattagccatttcaggcctgggcttttgcaggccagaactctagtagcaggttgtaggagtgctccattttgcacgaacagagttcaaaacaacacatgtaggataggatggcaacagattgatctattaaactgaaaatatgcccgttaaaagaaacttcatgaagcagacaaactcaataactggtgagctgatagtggggtgatatacaattaaagagtagccaagcctgcagagcaaatcaaattactacaaagaaaaactctgttcgacaggtgggcgaaaaagaaagtaacaagtgattctggagatatgaacaaacatttggaggtttcagaaatcaagcccattctctctagcagcatcagccagagctttaatgcgaccatggtagaggaaaccaccccggtcaaaaacaactttggtaattcctttctccaagcaagacttggcaatcacttcaccaatcttttgtgccacttcctggaaaccaaccagaacaacagagaactttcatcagaaacagagctgtgactttcggcaagaaacaactgcagaaatatattcgatatattttttttcacactaaactttaagatacgtgttcaacactgttaatcctatactatctgacctgtggaacatttaatttgtaagtagagctcagaaccatgtactaaaatggaaatgccacatgcataaaaccataaaaaacaaccgcgacaacttcaaacagctttcattttttgtgcattcctctgggttttcttcagagctacatcagcaaaggatcgtcagatatttcaatggtaagtttttctagaacctattgatttcgcaatcaatgtctccaagagacgacactaggttaaggatttgaacaagtgagattgaattgagcatgattgtctgatcagacaaatatggatgcacaatcatcttttcacataagtgcacctacaaaatgttaatagcatcacctacggtattattgtggtactgcactgctcaatttattattttcagagagaaaaagaagcaaagaaattagacatgggtaagtcaaaatcaacttacaactgttggccctgccgagtattccaagtcctttgaaagagacttgtgcattgtggaagctgaaaccagagtgcatgactttgtatcgtcaatcacttgagcatataaatgtttgtttgagcggaaaacactgagtcttggcctctccgtggtgccactaacctgaaataaattatgtaaggtttacacaaaggcatgcttttattcacagaaacatgcattctgattctggcaaagcctacaaactgagtcacccaccatagtatgcacaaagccacaaactgtttgtttgcgacctcacggccaactgacattctaacaagtaggactaatcaagacatacataaacaagatattactcgtttgaactggacgtcactgaggatgacactagcgaatcctactctccttagtgtaccgccgccacaaaggcatttcatcaaatacgtcaacggcatgacattgctctcaccccacaagcctcacacctaccaactaaccgcaaaaaggagcgcgcaatcatcgcattgcaagagattggaaacaacgttggctaattcccctcgtgcaggcgctattactaccttcttgcggaggcggacatggcgggcgatgcggtcggcctggggagtggacaccttgacctttgcaacgacgacgagagaggcccgccgccgcgcctgcgagggcgagggcgcggagatggccggaatggggatgccgaggctcccggacacggtcgccgcgaaggcgcgcgcgccggcgagcgccggcgaggcgagcatggctaagtgcggcgactacgctgctctctacttgtctctccgacgagcccaatggctttgccttatcctatccaccctttgcattttaagctgatttggcaaacttacaacaagaccccgcgttaaaaaataatttatacacagcccccgagtacgtgatgggccaggcctatgtccacgaggagatgccgcgggtagggcccataatggaggggatgccgcgtggttgggcctaccaccacgagccaacttcccaatttggcccatttagatttagcgcacaatgatacagccatcgacacagcgatatcaaaccagattttgcccaaacgccagaacaaatcactctgatgaatactcgcaaaagatacaaaaagagaatcactctgaatctctctgatgaagatgaatttcgttagttcacttcacagaagggcattattacatcagactttacagaaagaatcgattcaactcttctcattagttattacagatcgatcgatcgagatgatcaatcgagcaatgcatatcttcatgcatctcagttgatcaaacaaacacctaactaattgattgatacgtagtacatagtacatgtctaactaaacctgttctctgacgaaaaacactgcactacttagtgctacagccgctcactacacctcaatcaaaaacttgtttcatttaattagggttcgagccaagaatgtcgtcgagggtttctccggaagccagccgctggatgatctcctcttcgcccatgcaaggtccgttcgtcgtctcgatgaattcgtctccgccgccggcaacctccatcgtcggagcccacggcaatggctcgtcgttcatcagatacctcatgtactgctccgtcgtggccgtgtcgaattccactcccaaactgtcgtccatcggcgccgacagcaacgcatccaggtccaactccggcaggatcgccggctgctcgctcccggcctcctcttgccgcggccgcgcgctgggcggcgcctccgggtgatccgcgccgtcgtccgccttcctcttcgagccggagcatggcgaatcggccgacttcgccgccgccgccgtgcgcgcctccgcgcagaccgcgcgcggcgagcggtagaccttgcagagcacctgcttgtctgctccgtcgatggcgtcgtcgtcgaggccgtactccgtcatgcaccaccctagcctcgtgaacgtgcgcgccgaccccgacgacgacgactcgtagacgccataggagaacttctggaggtacccgacgcggcggccatcggcgccgatcacggccttcttgccgccctccgacttccacacgctctcgccgccgccgccgccgccgaccgcgcgctgccgcctcccggaggtcttgcgcttgctggtgaagcgcggggagcagaagaagtaccagacgctgctgctcccatgggtgcccggcgccggtctgtgctcgccgacgagctcggccggattggcggagtagacgtcggcgtggttgatgaggcggtcctcgaaggggatcttggcgatgctggggcggaggaagagggtgatgaggccgtcgtcggaagggtggaagacgtagcctggctcaagagcgatctcgtcgtcgtcggccatgtcggcggcgctagctctcgcgttgccctagcttcacctcgatcaggggagaatctgaattgatcgaggagagctagagctagcagatggtagccgatcgagggtatttatcgtggacgtggcgcacgtacgcgcgatcaaatcgcagtacagacaatgcaatcgatcgagagttcgagaccgactcggactcaggcgaaccaaatggttttttttttttttttggcgggaatgcggtatttgtacgcgtaatatgattgtttgttgcgaaatgctaatcgattagtccatccaaattatggtttcttgatgggctaggcccggctgggagaggcccaattcggtgactggtgaggcccgtcatcgaagcaacgtcatgtggtcaggcccactagcacagccatcctgcgttacttggcccatttagaatcggaccgcaacaattctattcgtgacaggccgtgccggctccttctctaatggcctcctttcacttaacttttgggtttttctcattgagtattgaggaggatcctctagtacacagctggagcaattttatgactatctgatcccattaagcagtatttgattattatcttttttgcgttaagcaatcttcattcctcaagatcatctcttttttttcttaaaaaaaagagagaaaccttcaacttgtgataattttgcacacttttcattgaggtttatatctatttgcttacatattcatctgcagacaaaatgtttttttatgtcctctaatactctataccgaattggaagcaagaagaattcttggtctctagtattgcacgtgtctcagaaaataaaagttattttgaattgctgaggatttgggatggtttatttctcctttttcccccctctatacgcagttccacagaatcttttttgatactttcaagaaccatgttgatactgcaaggatctatcagtgttatatttaatgagcctcaatatccttgtttttcttgattatatatgttcagttgtatcagaaaataccaaagataacaaggaaaaatataccagttttctatttcttaaagttaacattattctgttttggacttccattgagcatcatcaaatcgcagagtacttctatatgacagtgaaatcccttcttttttttaatatatatattctaaattgctaaatagtacagatgcacctctttgttttccttgcagcaatcaatttccttcattatcaattgcaatatttgtctactaatattttagcgcagtttgtttaccatggaacaattattattaactaatactgtattttatatagtagtattttttttaagactgcatcctgctagtgctagttcatactgccatgctggaatgttctggaatgccaaaatctggcaggaaataacttcgtaggatttgcggcacatatcagcttatctctcacaaaaatcgttaaaaatttcgcacgttccagacgaagcctagcggatttagaatttggattagaaaaaaaaaaagaggcaaaaattgcgaatagtaatcaatctcctggtccatgaaacccgtggatgaaggagcgctagcagtatatcatgttgaagggcattcatctctatctctgttattgctgctgtcgctgctgcatcataaatgagagccatgtgaagcgcccaaactatacatgtttatcttcaatttaacttacatataggagtacttaagacaggtcatggtggtactgtgtctgcacgaacgggtgcattacattcatgtatcattattcattaggtaggattagtaaatgaaacgagaatggagaaatgatttggcaaaatttgctccattgcaagcagtggcagagccagaattttatacctggggggtcaattactaatgatttatatttaagtgggttatttctctaatttttttgaatttatacatgaaatcgagatttatatggtgtttttcaaaaagccgtggggtcagccgatcccacagaaatggcctaaatccgccactaattggaaacccaaaagatgagaaacaaagttagggaggaagagatgaacggacagctcgtacattttttctgtctactacaaaaatggtaggggaaccccggttgtagtcgagcaaaagcgtagggttaccgagaaaaaccctaaggttttaaaaactgagatggttaccacgaaaaactgagatggttaccacggtaatcgtgaggtaatagcgtagtattataaaccctgactaccactgttagctcttcctttttttcatatttcaggtgtacatcctaccatggcagctccctgagaagattagcagcactgacatctttacaacttctaaagcagatagcagctaaccttaaaagtacacagtagtggactttgtcaatctgcactcacaaagtgagctattgtcctcatcatgaattcaaactgggctgtttatttcccagcttttggattcaaattttgtctctgttaggttccccaaacctgactgcaatggcaacgaggtagctgttcgtttccaaagctgttgctaccagtactgaagtacagtatgaatgtatgattacctgaatttcctctcacacactgaaagtctgaaacatcacaatccatccgatccttctgatcagaaaaagaagaaaacgtccatgtcgaattgctcaatcatgcttttgaaaagacaatggcaccacattccagaatcaaaccatcatattgttcatgaactacgttaaacagaatgcagagagaggagtcaagaaaagatcacgcagacaatagctagctagcacatgcatctgggaccatcatctcatgtagatagtacaagtaccctactcgtcgtaagatggaggagtcctactactacctcctctctcaatccgtccccaaatataaggattcagatttgtcctaagttagaatcttttagctaatcaagtttttatcgaaaagagtaggatgaaaataaaatatattcaaaaaataaactaccgcatcaaaaaataaactatgaaaatatatttcaaaacaatgctcatatgatactatcaatatattctgttcgtaaatattattattcttttcataaatttaagatagtatccttatatatattttgagacagaggctttaagataatagctaactgacttgattaatcaggcatttagatttgtagcgtggcatatgggccaggataataatgatggatttcttagtgataatgactgagtccactgacccggcctggactcgtggagaaggtgtagtaacatacacggctaaattaaagctagtactccattgattttggtggagtgcatgctacagtgcatcaattgatcggtcagttttaaccagggatgaattacttcctgccagtacagtgtttcaattaaggggtattgacacggtggtgccagccaaagcctttcaggatatgtgatgaacaaaatcctttattgt

SEQ ID NO: 44738 - DNA, 7661 bp, Oryza sativa
gtaaatgacagtgaattcagccaatccaagatcaaatcttgtgcacatcagagagaagaggagttcccaatctctcacggaattcattgaaaaggaggcaggaatcaaagatgccattttcaatttggcatcgtcttccttgcattgcatgtagcaagtagcaaccatttgcttatctcttcttcttcagttgttcttctccttgcactgctgccttttgaccgcgacacgcacttgaaataaagctgaaacacgaaccgtggctcacctcacctacttccaaacaaactctgaatatttttttagaattagacctcagactttgggcttcttttctttctttcttggtccctgcaactcagaagattcaccggccaggcatctttccattatcctgctccaattctcttctcatcttgtttgcatgattgatactagattgccacagtggcctcaaagatttcacatttttctgaagaaaaaaaaaactgattttgtctgaaactgcatatgcacgtgcatgcatagtatatgtacacaaccctgattttatttacatgtcaatttttaagaaagaaagaagcgaacatagaggtcaaatcaagcgacctgaagaacagaggagcaggtagaaatgcagaaaaaaaaagttgagcaaaatacacagctcgttcatccattggggcagaccggcagagtagtagagtgtagattcaccattaaaagtaaaagaaagaaaagaacgaaaaaacactgaacataaacaatccccttaggtaataaacacccagtttatcctctctagtgaagcagtaataaagaactgactccatggaattacactacaagttactaacattttaccggctaatttttacttttttatccaagcagcaatgagcttagattgccttcttgtttgagacgccaattaacccaacctagctttgcctttcttgcttgatcgatgctttgcagcttcgagctcctaccagaagcacacggacgacgacgcggcgggcgccggggcgtgggcggcgccgccggagaggcggccgtagcggccgaagcgggcgccgcggcggtggatgttccggcggcgggagacccaggcgaagcagaggcggaggcgcgcgcgcagccgccggagccccgtggccgcggcgcggcggagcctgcggagcccgacccagacgacgcgccgcgcccgcgcccgcggcgagagctcgacgtcgcgcgagaagtggtagctccgcaggaacagctgcctccgctccacctgccgctcccaccgcgccatgtactccacgtacggccacgccgccgccgccgcaggcgccttcgccgccacccgcacgccggacatggcccagccacaggttcttggcctgctctgctctcttcttctttcccaaggcgcgcgcgcgagcgagcgagcgagcgagcttacgttgtggctgcggcgaggaatggagaattgataggaggaggaggaggaggttgcggcggcgaggcctcgccgtcgtcggcgatgggtgcggaggaggagagggaggaggagagaaggggagatggatggagtggaggggaagaggtgggtggcttttattctttcttcattggacttcctctctctctctctctgcttgcattctgatttatgggcggattaattataattaattgattaattgatttttttaattgattgatttgattaatggttttgcttgctttggattggatttgttcagctaagcaaggtttacatggacaattatgcactttatgaaatacctggtagtttgtagcttgagttttctactgctagggggggggggaaatccttgttgcgtatggagggaatagtgccggtttgtgatgtacaagtaactgcatatcataaaccatacatgccggtgctgtcaatgaaaaggatgcacgcttaagggtatttttctttttttagttaatcaagggtaattttattagataggaaaaatattgacattttttgtcgcaactctaatacaatcaaaattttgcaagttacaaaaggagtactaggttagtatattgtgggggagaattacatgaccaacccagtgtgtaattaggtctttgatgcgtttgtttatgtaaaccgtacggaggtgggcttccgttggatggatgggagcagagagtcgttgacctgaatgacatgaatgtcccttctgtactcttctgctcctctccacccaaaatgtccttttggattcttcgcactgcagcatcatggatatagggctgtgtttagttcagtacaaagtttagattttacttgaaattagagatgatgtgactgaaaagttacgtgtgtatgacaggttgatatgatggaaaaggactaaagtttggatctaaactttggatctaaacacagccatagcatgcctcaaaggcaaatgaaaagtccacataaatttaattcaatagtttgtgtggtttgtgatggaaatggaatgcttcttacatgaacttttgatggatcaaatgaaacaccattggtatgtgagggcctcagtatgtctttgttttccaagactgtctaatgttcaggttagcggaacttcactatggttctgtcaaatgcttcgttcgtttctgactcaacttattctggcatgggtaacgagttctttctctgggttgataatatttgttattttggacaagagcacgatctcaaaaaaacaactttgaccattattttcattataatatgtataaaagtgttaacaaatatatgattttattaaagtactttttaagactaatctatacatgtagtcaccatatttgaaagataaatattttaaaaatgatccataattaaagattttaaagattgacctcacacttatttaaaacgacaagtattatcagtccggaaggagtataaccattaatcatgtaagtattaactattatatattaaaaaatatttttgtttcattttaataattttttatatattttttacacaaaatatatcgtgtattagttcgaaaaacgtgctctctgtaaacgattgagtaacctagtctctaagctcattaagaacgcagccaagtcttggccatcatttttttaggaaatgtgtactgatttctagaacatatattctagttttaatttcaataaggagagatttcatgtggctgaaaactgcaatataaaaaggtgaaacggaatctggctgtatcacaagtgaagaccaaagcatgaaacagtgtatccttgaatccttcagtagctgtcgatctgatcgtgattatacgaaggttcttgcgtgccacaggtggatacaagatgaattcttgaggaaagctactcacaagtgggcgtttctctcagacatgtcacctcggaagttcgttatatttctggctggtcgttgcagcaaccagctgaaaatgaaactgcaggtcagttgtttctgcatggtattcctgggttcaggaatttgatatatgagtatttaaatatcaacttggagttaaaagatgagcagtctgtgtcatcattttcatttataaattaattaattaagctcgatccatcaacagatgggtgtgtgccgttaattcgatgcgtgctctgaactttctgaagagacgatatatacattgaccagttggcttacagtacgtaagtcagtgaaggattattagctagcagattaatcacagtaaatagacgtatgttgagggtaatataaaaaagtcgattgttggtaaagaatcaattactagctagcattccatggtagcactccactactgcttaactacgatgaacatatggatagatctttttgtgacgtccacatcacaagcaagaaagatgattacttatgttaattacccgaggtagaagaaattaagagcgagttggttattaaatcagggagctggctggcatatactatcattagtttattactattactatgcgatggagtagaagggagtaggtgatggtagttcacgctaactagctactagtacagtaatctctaatctcggctggtcacagcgtacactgcatctgcatgagcgccggctttacttaattaagtattcaattgcttagttaatctcatagaatatctatcattaattaactaacccccgtgcgtgtgtgtatcaatcgtacagggttggcatgcacagatgatggcgtcttgtcatatttgcagtgcagatgcttcaaattttagttgtctgaactaatgatgagcttgcgtgtacactgtagctagagtgaggagagagctagcggcgagcctgccctgatctatcgcttgcaaatggcgtccaagctaattcgtgtctgcatgataccagcaatcaattcctcgtcaaatacgtaaagatacttcatcctgaatggactgctctaatgattacttgctactaataatctcgtactattatcactcagtgatgataccatgcatgatgactcaaatatatatggattcaaaattaaaatgaaaatgtattatactactatggaaatataaggaacaaccacccttaacccaaagaccaataaataattattattacctcgtagtttggattacctaataaatagaatatatgcacccaataaaattagatatcttgatggtggaggatttaaataataatatttgagtgaaaaaaatgtactacttaataacatgcatgcatgcctgtcttagggcacccacaatggttatctataagctctctacaagagatccatgtcagcatattttcctacttggaagagattaaatgaagagagagagcaaagctatctactaacatggagatagtctatagagaaaaacgaggcaatggattagagagctatagatacccatgtagacataccattgaagtggtttactattaatctagtctattgttgaggtgtacatgttttatagatagcaccttactttaccattgcgggtgctcttatactgaattataaaacaactttaaaaaatagttgtgccttatattatggaacaaatggagtaagatacagtaaaaagtaaaatggtcagttatataggagtaaagtaggagatcgagtagtagtaaccgttggaaaagttgagcgatgacaccacgcgtggaccatgctgcgaatcgtaaatggcatccttgtggccgcagccagcatcgcagccgcagggaaagcatctaatcgcccatgataaagacatgactgatgacaacttaattgattaatcctttctgtccagcctgatctgttggaacttgcacgtaattcctcacaaaaagaaaacaagatacggagtactgtagtactagtactcctgatgtagcttgtcagaactcagaacgggaaagaattaatcgcgtatcaagtggcaaatcgtgatactagaactattaatcactctaatggttcgcagatgtaaggatggtgcagtgctcctactgggcttcagataaattcagagttctgaatttctgatatcatgtctgccagcatttgatgttctagttaattactgtaggacacggatggtgatatgagataataaccatagttagctcagatttgaggtaaatactcgctccatgtacttgacagccatcaaagatactacttctacgtagcagtgcaaagctactcttaatctagtcgagtactaccatgcagctagcaaccgatttgcaggccagtacactctactggtactaatggttgtagtaaattattggtactatgaatgatctggtattcagtaggagtacgtgtgtaacgtcaagtaggtctcgtccccaaaaattcgatctgattccacttgtcttgcaaacaaaggcagctgcagatccaagtcaaccaattttagttctgcaactcttctcgagtagtagtatggctgtgggaacctgatagtaataagatactgggcagcagtaatcactactatagtattagcaatagctttcttctcactctttgcttacctgtaacagagtgagtgttggggtttgaaaaacacatcatgcatctccatcaagaacagttactgctcaaggatttgttattctgaaaacggtgcgtgcttgtccaagaagactgtatcctcataatttattcaatttgttcacttcagttctctacacgccatccctctgcctaatctgctcatggcatgtgcatgatcgtcatcgacccagataaccacatcatatatattaaatctttagtttacctttcacattagcgtgtaactctcttctggcgttactgcagaaaataaaaactgtaaaacaggtagtagtgatggtaacgtgagtttgttaaatagctaggcagatggttaatttctagtggaacttcatttcatttcaccacttggcaagttctctaagatataaaaaaaaaggaattaggtaatggcatgatgatatcagctatcttaagctgttaccaagatacttcctccgggtttttttaatagataacgctatacatttgacaatttatttatttcaaagtttttatataaatatgcaaaaaaaatataaatcatgtttaaaacaatgctaaaccaaatcacatgaaaataaaaggtagttacataatttttcagtatgataaatggttaaacatgtattcaaaagttaatcggctattataaaccggatgtactacctctgtcctaaaataagtgtaactgtgagtatccgtgtccaatatttgaccgtccgtcttatttaaaaaatttataaaaaaaataaaaaaaaagtcatacatttttatcatctaataacaataaaaatagtaatcataagtttttttaatagaataagacgaacggtcaaacgttggatatgaacggtgcaaaacttactacctctacggagaaataatgtgtgtgtgtgtgttggggggtggggagtgttgtactggtggtaaggtacagcagggcagggacggcacgaacagcgtgtgtggtgttttgtcatgcaatgcaatggtcacgactcacgagccacggcatgaagccgtcattccggccaatgcttggcgacaggacgagtcctgttcctccgtgtgcaaaatgtacgtacagattcagtaatgggaaacatgcgtgcaatgcagctactcctactaggcagcagtactgggcagcccaatggtttggttcagagatcatccaccggcacgagcacaacccgtggggaaattaaattacggtctacacagtctccagcaaaaagattacggcctaaactaagcaaatccatagttaattaatggtcttctttcgttgtcaggcacatgtttttatcgtgttaggatcaacaaaccaactccgtccttttacatgggcacagcctcgaactttgacctgatagatatgtctcccatttcacgcatttcgctgtgccgtttaatcgatatcgtcatatcgtcagccaccaaatcgacctaccacttctgaattctgacaccggaagaacaccacgcccccctgcctttggtgccaaactgcgactgggtctatgtatacgtaagcagcacacacatgacacgtcgacacacacagatcgcgtttgctcaaatgtaagaaa

SEQ ID NO: 44739 - DNA, 13288 bp, Oryza sativa
ataaatgaacagaaggctctcctttggtggtcagcgtgccaaaatcttcacgacggaatgacgacacagagctgtactaaccagtgcaaaatcttcgtcaggcaatagtgttgggcatgtatggatcagatgaagggggactgggctttggtgttccttggcatgtgttgaatagtccagccgcttgttggaacatgatcaagcccagaaggagcaactcccgagcggcagggaagagtgttgtttctaccatctacttgtttgggcagtctgatgctcggtgcccgctttcgccacagttgaagcaagcaccactgaagctcctgctgctgtaaatgaggaacagctcattagcttaagaaagcagcatgagttaactagtagcatgtttaagtaattgttctggtactgagaaggtacaagtaatcactggccatgattcagggaggcaagattatgctgtagcaagagctagctaggaaacccgtcattaatttcacagcaaagctttaattacaacacatgagttggtcatatgacaagacttaacttcataagagtagctagtactaacaaacatgagtggctaaggaaaagactaaacattctaaagttaccaggtaagcaaattttgtctaactcataatgtatttcattttctctggtggcatctcctagaagaaagatacagcatggatgaaaaaagaatagacattatgttatttctgcgatgttgtgaaactcacctgtccctagacccaaaagatgatgagcggccaccaaaggatgacgagctacgactgccgtaagatgacccgcggccaccaaaggatgacgaacggttcgatcttctcccgccaccaaagtcatcatctgaccaactatcattgtcagatctgaagctcctgccaccacggcgaaatctgtcttcaccatcagagtcccaaccaccccgcccgcctcttgagccaccacccctggaccgtctgttcctgaaaccccggtccgagtttgagaatcggccataactatcagtagcaggaccatcatcctgtaatgcaggtagctgcaagcagagaacaaaaggaaaacagtcatcacattagctcacaaagaaccaattccgcatccaaaacaagaccagggattgctattgcattctatactgtgtgtagtgcaagaataatggtagaatattccctattttacttgccatttaaagtcaatttaaatgccttggttggaaataaatggaaatgccaccacgccagacaaatacttgtgtatcatcacacagattacgtatagcaattgcactataaattccaatagcaataattgaaaaataccaagctgcaaaggttacctttgtcactttggttatggtgtttcctgggggcagttccatactaagcaaatccctcgcaatctcctcaggtaaatcgaaaactgcaccttgaacctgacacaaccaacaatgcgccaatgcatgagcatcacagtgaaagtcatacacataaatgcaggagttttgaagatatgcatgaaaaagtagtgatatgtgtcatcgatttctgcaatgcatactattgcacgtaatgcacattaattaaagaagatatatatgctgcaaaactagtatcagccaacagcttcaaaactgcatgctcaattgctcatagacccaatgcactcatgcacagaaattaatgatcgacatgctcaagcaagagctcaccttctcatctgctgtaaggaaaattttgccaacttcatcagcagcagctgaagaaacatcagacagaaagccagtaacagatctaggagaaaagaacccccttccatatcctggatctctagttagttgcaaagtcacccatccctgtgttttaatagagggtaagaaatcatatgagtgcttctagctttaaaaagaaaatataaacggtaaacgcacaacaaaactttgagcaactcaaaaaaaaaagtggagcttttctatacaattatttgattgcccattataaatttataaaagatgcaatttcagtaatcagtactagtagcccattgtattcatataacattaggtggatataaatcctcaaatgtagaaggcataaatcaggacagctggatgaagttgatgggtagctataactaaggtagggaaaaaggaagtgttcgatacaatggtagaaatagtaaaatatcagttaatgatggatacatgtaatttcctcgggtcacttattaattcttacctgctcatgactgataagagaacgtgaagagggtggctgagaaaatccactcagatgtgccaatgcagaagcaagagcattaggtcctaattcttcttgcagtctttcagctgctggaatgaagtactgaatcgactccgtgtgcacacctcttaaagtagctatgacatgttcagcagaggactccagcacatcctcaattgctggaggacttatgaagtcaaatctgcatccaacatcacgctcaagtgatctaactgtccttctctggctgtttgtgaacatcaagattgcagttcctgctttcccagctcggccagtgcgtccagaacgatgaacaaaagtctctggatcattgggcaattcataatggataatctgcattaaaatgaaatcctctcgttaattgatccatacacacctacagttcatcccagatagcataatgctcgaatgcagttaatttgttaactagtcgtaagattaacccaagatatcagattgagatgctataaaacacatcaaagctagatgatatttcaatacaaaaacctaagttcggggggaaaaatggacagtttgatgatctaattttagcactgtaaataataatggagtttaaaactcagaagcttcactgataatcgctttatggaaaggaaagagttaagatctgtgaggaagggtgatttacagaattacaatatctaagaatcaaatgaagtgaagaggatatgtgaacccaccaaatcaacattcggtatatcaagaccacgggcagcaacatcggttgctacgagaacagtaaatttcccttgacgaaaaccatttagtgtcctctcacgctgatgctgtgaaatatcaccatgcagtgcctccgaagcaatactgtttgtcagtgctaatgatacctcgtctgcatcccttttcgtcttggtgaacacaatggttttcccaccctttgcatacacctgataacaagatatttttagataattgagtggccaacgctcagcaaaacagactagttataaagtcagtaaaaagttcgatagacatggaagatgtatgaatgaattatgttctgaaatcttaattggattgaagtaaaaaaaaaaaacttatcgggcatctactggcatgatgatacaccaacatagctgtataaactgtaactggtttcatgatcttattagtttctgaatctcaggaggctgagccgaaaagagaggaggggaaaaggcagctaaaaaatccatgaactgcaataacataccgtaatgagatcactaagaacagtgcgcttcgatgtagatgtgagcgggatagcataaagtttgattccttcagcaagtttttcatcttgatcgccgacctgagtatacacatgacaataaaagatgactaatccagacaaaaaaaataaaagtaaaccttcacagaacatgtgcacaattatatcttgcaagaaacaacaggtattcaagtgtaagtgcaattagcatactcaagaccagtgctaatatctcttaatcctcttacatgtgtgctggacagaatttgtatttactatttttacagcatataacatgatcataacaactgacacatctgatcttggaaaatcaaaatgatatctgtgattaaatgtaagaatgctcttatactagatgaaactgattcctggaatgtttttgtttgagggcataaccaaataaaaataacaagagtgacatgtttcacaccaataaaaatggaaatggaaggaaatacgaagttcataccaagtcaattgtcaaaggattgttcaagtatcgcctagataatttcttcacccaaccaggcatggtggcagagaagagcatgctttgcctctcagctggtagctgttgtaatatcgtttccacatcctcctcaaacccaactgcaagcatttggtcagcctcatcaaggaccaagtacttaacttctcccaactgaagacttccgccatttatcaaatcaataatgcgaccaggtgttcctacaacaacatcaacaccacgggagagtgcgttctgctggacattatatgagacacctccataaacacagactgtactgagcttgggtgctgattcttttatttccttctcaacttgcttggctaactccctagtaggtgctagaaccaaaacacgaggaatacgacctcgcctaccaaaagggaaaaaaaagggttaatgcacttgttaagtatcaactgattgtcatgcaatacaatgtgaagctgcataggaagatgaatggatacctcacactccgtccatcatcctcctccattaattgcttgatcatgggaatgccgaaggctagcgtcttcccggttcctgtctttgctctagcaatcaggtcacggccgtcaagagctggaatcaatacagccctctggaacagcgaaaataaatcagaaaagggtcaagcaaataagcaccatcaaggtgagcatgtgaaagctgaaattcaaagggaaataaacttatttggctatttgtatcgacatttcataatatgcaccatgccatttggtatgacatggatatcgttttattcttttagaagcaaggataaacgtaaaactggatattgttttattcttttagaagcaaggataaacgtacaactgtcctgattcaacaaataacaaatatgtaatttaatgatagttagcagtatctgtaggaataggacgaatttgatatgcagcaaatctatgaagttctacgcatcaacggaacagcaatcagcactctagtttgatattagagtaaattccacaaaactacatgttttgtagtccaagttgcaacaaaccacacaccctttgacacctggcacttaactacatatgttttagtactgaagtttcacaaaactaacgaatgaatccatcggcgagatggcgtggatgcattctctgatagtgtagttttatgaaacttcaataccaaaatatatgcagttaagtgccaagtgttaaaatatttgtggttttctgcgacttgaaccacaaactatgtagttatgtgaaatttaatcttgatattatggagcgcaaaaataattatggaaccagctatcacttgctccatagtttcgcagttcaattctcaagtgatatatcctaggagcaacttagcgtagactactctcactttccccactaaacgagtcatgccgcacttatcccgccactgttttttttttaaatcaaaacaagccccatcatgaattgctcaatacaggcttattcaccacgaactcatccccccaacaaatcctacactaacaccaattccctcgctgtctccgcctaataccgaaacctgcaatttgacatcaagcacagttaagctatccaaaactcgaaacggagcgcaaattggcatcacctggatggggaacaggtgggtaatcccgcgcttctcgagcgtggatacgagctgctcgggcaggccgagcctggcaatggcgagctcgtcctcgtccccctccccgccacccaccgcctcgaccccctcctcgtcactcccgtaggccccctcctcctcctcctcctcctcgtcgctgagctgcagccgcttgaacgcgtgctcgctgagcaccgagttgggcgacgcgatggcccccgcggccgcccaccggccgccgcccgcgcgccgcagcgcccagcagcggaaggcggcgcggaggcgcagagacggcgccgctccggctcccgcggcggcggcggaggcgctagggttggagagggagagggaggggagcgtgaggagggaagccattggagaggagaggtgggagaaaggaggaggggggagagagagagagaggggggaagtgataagaaatgaaacgagcggctggtcttgaggtggtaggaaggcgagggtttatatggcggggtgggggtagcattggatagggggacggggaagggtttgggggagaagggtttttgcgggtcgacgaggaggcctctcgttcacaagaaccactagcacagagagcctatctgtctctgccttgtactcttctgctgctatcataccagggtccagggctctcttttgaaatatctcaggcttagtgtcatactcctatcttcttggataatattaagtctgcaaattattcatggtctgcaagtatatggtatgtctacagtctgcttttgagtggtttaatatcttattagtgataaaaaaaatgagctatatctataattgttggtgtgttagttcgatcatttaaggttttttttcttgaacatgctataaaaaaccgcacacatgaataacattgtcatacgctacaaaaagtttacgggaggtttgaaatgtaagaattagagatggtaattttggatagctcacaggaaataacacacaaaaatttatttgtggaagaaataaatagttgagagaggaaaaacagtgtgcaatggacttcaaggagaagcatgaaatccaaacaaaggatttcaagtacattggaattttagtattgtttggctgcaatttatcgtcgctgcattgcaacctggcttggctatgatgtagcatagccgaacaagcattttcttatgaaatgatgtttaggtatccaatccattagattttgtactatcttattcttttgtttcaaatgacttgataataaaatttctaagtaataaaatcctttaaaattcttatgaaatttattcaatccaaaggagcccttgtaagaactctaccatcatcgctacctttaattcttaaatatattctagcaccaaacacattagaatattgtaaattttaaatgattgcgaacatatttttactgatttcctcactgtaaattaaattaaggttatttgaaaacaagagaatcggtttggttgggaggtcatagtttgctaacatccctaaggttttgttcagataggtctaaatatagaccattctacgtgtacgggcctaaaatttgtactaggctgcccgcctacacataaggacggaccgaaatggaccgtattcggtatagaactccggaatcctagaactccacaagcagaaaaggaaattgggcttcagaaaaaggccaatatacgtagcgggcctgattcctccaatggcccaatacttctgctccacccgtgaaaatttatctttttacgatttctcaacaaactttgcacctcaccgttattttattcaactttgtctaaactatttgttaactttatatcctacgatatttaattgatcctcaatgagctaatcagattttcagctcattggcgactgtccagctcacaacttcacagatgtttatatctgaagataaattgtttagtatttccccttcaatccacttcctgcctttgttgttatcttgctaatcctacattttctgaatctttccaatgttacagaagaattatgcactagtttgattacatttgggatcattcttcttaaccaaaaccaaatccaaagctggtccctggagcagtcattggttaagcatcatgataatataataatataagacggaatcagcaatcggcgctgcagactagctggcattcaaccaacaagtacctacctgactgtcattgcataatctgaagttctggaccatttggatcgtgtctctgtagtttttttttaaaaaaaaggaataatattcaaatcaggcagattattgttcaggcaatcaagccagtgggtagcaagctcgggcttagctgtatcagactatcaagcagagccagcagagatactgtttgttatgtcaagctaccgcttatattaataaagtcgcccaaactgttagttatgacacaaaagatacgatgatgattaatataacaacaattataattataattatgataccattttttttgctggtattaatagccagatatacaagatgctaatagcagttgctgcatcggatttcaggctgtaatattcagacgttgacgtaactgtcggctgcagcaggtgcccattttggccaagctaattaactaatcatacttaacttgcacattagtacaagtggtggatttcctacgttatctcagctgttaattgcaagtcaacttacccagaatccgcgtcaaaacaatgtcacgacaaatgtaaatggacaaacgtacattacagttctctccctgattccatattaattgatgctttagataaagttgatatcaaacttttataattttaaccatcaataactttaaaaaaatattaagtttaaaagaactaaaacaatatatacagatttttctttaaaagcactataataaaaatagatatatatatatttattatatattataatagaaaaataaggtcaaaaatataagatatattttgtagactgtgtcattgttcaaaacgttaattaaaataaaaccggaaggagtacaagataaatccccgtataattgattctcacacaaataattacatggataaaccaaaatccctgaaaatttcgtacgtttttttttaataaagatcacgcggtttcatgcatcaaagctctccgtaatgttggaaacttcgattatggtttgaaaacaaattcagagacagcagactcgcacacgcttcgagagaagacgaaggaaagaaatctgaatctttccttctcgaagaccggtccccttcaaatccccatagaaaaaaaaaattcaaatcgagccattaaattaaactaatgaaaaatcaaacgaaaattaatcaaatccaaccaacgtaatcagaagcagatgcaaattaaacacctcctcctcgcacagttaacccctttctcctcctcctcctcctcctccttccccaaccactcgcaaccaaaggcgcaccaaaccggagccaatccgagcgctccggcggcggaggcggcggcggccggacctactcgctgccgtgggtgggggctgggagggagcgggctggtggctcgtcccgtccgcgatggactgggcggcggcggggtacacggcggcggcgctggtgtgcgccgcggcggccaccgtcatcgcgctcgtgcacatctaccgccacctcctccactacgcggagcccatctaccagcgattcatcgtccgcctcatcttcatggtcccggtaatgcaacgcagctcgtccccgtagctccccccctcgcgccagatctgtcgatgccttcgcggtttttagcgtttttttttgtggggggtgaattcgtggggggggggggggggtggttttacggtcgcgaactggcctggaatgcgagcccgtttggatggcttggattacgcgtcgttccgagttcccgcctctgattcatggagcctaagcacctgcaggaggctgcaattaacttgcacatgattttttttctttttctttttgtgtgcgtggatctacgagtagatttgttggtcctgttaggtttgatcggtgtccagatgttgtgttgaagaaaatttgatagcacggcaactccgtggctgcaatcgctgtgctgattgatgaatttgctcgagctagctgatcctgatgatcttttaatggttgcaatcatttgtattatcatgtttcatctggtgtacatttacatttagcccttatattgaattgattttgtttgcagcacttcagcatattaactctgatgatgtttatttgttgcaggtctatgccgtgatgtcgttcctttcccttatcttaccagataattcaatatattttaattctattcgagagatgtaagtcaatcttataatcttgccccttaatgtgaactaactgttcttttggattgtggttcctgttttctgctcacttgttgggagctgaacatgtaatcttgtatctccaatgatcttaaagttatgttgtagacactagacaagcagcaaatataagaactgccataaaaactttcttttggcattctctaattgccaatgggcacaacttttcttttgttgccacacgttagtatgatttgacatctgtgccagcattgttgatattgctggtgcaccatgtcacattctagctctgatgcacttcttttgctatcacctgatttatactccctccgtttcacaatgtaagtcattctagcatttcccacattcatattgatgttaatgagacatatatatctatctagattcattaacatcaatatgaatgtggaaaatgttagaatgacttacattgcgaaacggaggaagtatatactagcaatatcatcatgacaacattggtacactgcccatgtcttcatatgtgttgtgtttacgtttagctactgtgttgataagcctcagcaatcactagtgtagagaagatctattatgccatttgcgccacatcacatgcattcatatttctagatgtcgttttaatccatcagcccatgaaccatgatttcagatgttaaatacacttgatatatgaagactattgtcactgttaatcttgagtgtcttactaagaccaacaacacacatgaagaaaacaagggggagaaagcgcattgaatgatcaccacttctatataactacaaaatcatcataatctgacacagtatgctaataagttattgtaatggaaatgctaataagttattgtaatggacatggccttcattcttacagaactgctggtttataaattctatgaataatttgatgccatgaccaaggatatgattctattgctgttttcttgtctgtgcttgttaagggcgtaaggcacatagcctcctatcaatgttttatgcgatcgtcgatactttttttttccacgttttgaattttttttactgcacttgtgttttaggatctgaaccaataaatgcatatccgactaatgttaaaatctctctgattgtttttcagttatgatgcttgggtcatctacaatttcttttcactttgcttggcatgggttggaggtcctggtgctgtggtggtaagtttgaatgggcgaaccctgaagccatcgtggtttctgatgacttgctgttttccagctattcctctagatgggtgcgtacatatcttttgcacatattaagtgcttattgtaacaatctaatgcttcaacatgcagttgcacagtaacattcagagagtatgtcatatctatgcaagtgctgattaaaattatgttattggacaggcgttttattcggagatgcaaacaaggctgtttgcagtttgtgattcttaagcctattttggtggttattaccttcatactttatgcgaaaggaaaatacgcagatggaaactttagtgtcaagcaatcctatctatacattactatcatatatacagtctcatactcaatggcactatatgctcttgcggtgttctatgcggcatgcagagatctgcttcggccatataatcctgtcccaaaattcatcatgatcaaatcagtagtgtttctcacatattggcaggtaaatatacaacagtcaaaattttttcacatccaagtacgattgctatctcaagttccaatatgtcttatcagactgtttacagtaaagatgtttcctagccaaggaattgttatgtcttgggtcatgctatattttaaagttctcctttgcagggtgtcctggttttccttgctgcaaaatctcggtttatcaaaaatgctgaaaaagctgctgatctccagaacttcgtattgtgtgttgaaatgctcatagcagctattggccacctatttgcatttccttacaacgagtatgctggtcccaatggtcgaccttctggtgatttcaagggaagccttctgcatgctctgaagttcaatgatttctaccatgatactgttcatcaggtaaccaggatattgcatataccccttgcatctgggggctttgtttttccacacacatcaccataatatgccaatgtctttgtataatctgctccattctcatgcagtttgcacctacctataacgaatatgtgctgtacaatcacaatgagggagacagcactcaaaggaagtatccttcagtgagtaccgtgccatccgggcgggatgtagaattgtctggcatctctgtgatgcctgcgaacagtgcggtgacatcaagcgtatcgtcaaaccaggcagatcaggaagaaacaatgagcaccccaatcaaggacagagttgataatgtagggctttacgacctgacagacttgcttgatgtggatttgtctaactacccagccaaggttcctgcaatctctgatgtaagaaaacaatgacattgtgatggcctttggcgggtggcaatcggggaaatcgtgttttccgtttgatcatagataacgctgtaaaaatgtgtgtattacttcccattgaagggagctattcatgtcagcacctgtcttacggcctctctgactcgctcttttcgctaactgtaaaatgttgtgagcttaaagtgaattgaaagtgagtaataccatatctgcatttactgatggcaatttctgtgcattcacggtacattagtatcatcctttttctgaaaatgaactttaagcagcctatgcgttgtgtgcacttataggtgtcaacattataaacttttcaagttcttactaaaaatggtttcatagtatatgatccatatgttaaactatatacatatttttacaaactaacggtcaacatgtttaatttaggacaaaccaacaaacgatgatttatttgaaacggaggaattctaacaaatgcttttacttgacgcctttgttacactttatccacagttcagtgtttaggaacaaagaatcactgtttcatgacgctgtaatttgttcagacaatacagcgtttatggatgtacactgcagaattgggagctttgtggctttctttgtacaaagaatatgtcaaaatgcgactgggggtttgcataaagttcacccaagtcagctaataactcacatttg

SEQ ID NO: 44740 - DNA, 1583 bp, Oryza sativa
catcacgtggctggccttctgcagcattttgagccgtattctgctcccttgattgcacctctttatcatcatcttcagcatcttcaatctgggaatcagaataggaatcactttcagaggtgatggctccagagcaggcttcaccgtcctctccatggaagaacctggcgagcgacaagggattgtaagtagagctggctttgcggaggccctgaatcgccttcattgccgcgagtgtgcttcggtacacgtccgaggtttcaacatcgacagatgacgctgggtcatggctagccgcatcatcattctgaggttgcaacttagcagaggagctagcagactcaagtacttctgcttcgataggaaacaggagctcaagattagcctcacattctcgaacaagccttgttaaaggttccgttgtgaaaaatggttggtgtcgagcacgttgagtgaaaggtaggctgagcaaaccacctgttctcttgtcatattttttcagtatcttcacaagtcctgaatgcacacaatatcaaggcattgcatgagaagtatactactgataacatacttcaaactagccaacttggtttgatgagctcaccggcaaaatttagggagctataggtttgcagaagaatcatctccccatggatgatgacaaaagctttgcgtatctctaacatctcttcagtgaattcgctcttagatgtaaaagccccattcttcttagctttgacacgttcaattctttctttgagcaccttcatcagcaagtgttagaacatttccagctcaaggaatatacaaagataaataaatcaaccgatgattcagaaaaaagaacatgaagcaaattgatacaaactcactaaatggttccttaaaattacccaagcaatcaagaaacaaaatgccaaaatctaaagaatgtctaaagtatgtaggaactaggaagatttagattttatcttcagctgctgattgaaaggtggtaattcatgctatttgtacaaccttccctttaaggcgtcaaatgtttcttaagactgtttatctccaaaaacctttctacttctttgccattaatgtgtccaagaccataataccatctgccatttaacgatgggccctcatgatagaataatgatgcagatgctttcgaatgatcagaacttgatgaattgaagcacaaaaagaggctgttcaggtactaaacacttggtatacacaagttcacaagtttggagggtagaagtacatcctagtatgttaaacaatctaattgctcaatcaattgtgcttggatgatccacaaaaatgaaaaggtaaatctagctcatcatggcaggatatgattattttgcaaagccaagtgtacttgttgtttgcataacacatatcatcgtttgagtgtcatggtgttaataccacactaacacagcagtatcacaaagacacaaaccacatatatctgcatttcctgatgtcaagtttcgtgcattcgctacagtttctaatccttttcttccctgcatacctcaatcatgacttcaactaaagtcatttctgtaggagaaaaa

SEQ ID NO: 44741 - DNA, 876 bp, Oryza sativa
actcctaggcggttaggtgtcgttcctgagccaccaatctacttgtggttggccgggagaagtttgtgaaggttggatctcacctccgaaagggaagagatacctttagtggaaggaggattgcttagtgcaccctctttaggaaaggggtagctaagacccggctcttagagagctcctcaacggagagtagaatcccctcaaggattcgaactttgagaagaacttcttgagcttcatctttggtgactttacttcctccctctccactagctttgcttgtttgagccgctataggtctagtggctgtttgtgctagcatattcttgttgtaggctcatccaacatggtcctcgccatctcaatgagagtcctattcttcctctcggctactccatttgttgagatgaatatggagccgagaactcgtgcttgatgccttcttcatcaaggaaactctcgatgcacgtgttcttgaactccttgccattgtcgtttcgaatgttcttgatcttgaggtcgaactcgttttgtgctcttcttgcaaacttcttgaagatagtttgtgtctcactcttgtcatgcaaaaagaacacccacgtgaagcgtgaaaagtcatcaacaataacaagaccatatttgttacctccaatgcttagataagcaattggtccgaagaggtccatgtggagaagctccaatggtcttgtagttgtcatcacattcttgtcgggcgatgtgctctaatttgtttgccggcttgacatgcactacacaccctatctttctcaaattgaacatttgttagtccaaggatgtgatcgtgctttagaagcttgtgaagattcctcataccaacatgggctagccttcgat

SEQ ID NO: 44742 - DNA, 3870 bp, Oryza sativa
attgtagtttagagattttaccaagagagcgttggcaatggaaagatcattagagattgcaatcttacccaatcccataacatttccctttccatcgtccctaaagactatgttatcttgtgaagtgccatttggatcaagagttgaaaatattgattcttctccggtcatgtgattggtgcatccactatcaatcacccaacttcttccaccggagacatattcctacaagagatcaatttctagttttaggtacccatacttgcttgagtcctctcatgttagtaacaagtgccttaggcacccaaagtactctcttgatagaaatattcttgccccttagactaacatacttagcaacaacacgaccactagcattcttcctaagaacataagatgcatcaaaagaacaatgtgaagcataatcattaggaaggatacttttggccttaacaaaattgctaagaccttggggcctcttgatcatcacactcttgtccacctttccttttggtggaggaacatacctaagaccctcatggttgaagttgtccctttgatagcctaggtactcctttagggtcttactacccatatgccacttaagtaggccattgtgaaggagtcccataagcttctcattttgcttttgcaaagcactcaaagaaatagagttagtagcataagcttcaatatcaatatctttgcatctcacacatggttcattgcttgggacaattttggaacaagatggctcgctagggagagagacactattctttaaggtttcgaacttctcttcaagagtgaggtatgctttgtccaagccatccactctctcttgaagttgagtgttcgccacctcaagattagcatgagactctttggtttgcttgtaaagccgtaccaatgcctcatttttttctctctctccttagcaagctcactcttgagttcatgggaccgctctttctcacgaatgagcaaagcctcttgcctctcaagagttgcatattggtcttcaattctcccaagcaactcactcaagtgtggtagggattccttagttatggacttgaacaattcatcatccataacctcatcctcctcatcactaacaagatcaacattaaatgacttgagaggagaaggtaccttaggctcctttgccatgaggtaaacgggagcatcctcatcacttgagtagtcgaagagtctcggtggtgatgaaggcttgacggcgaacgtggcgactccttcttcatcacttgagcttgactcggagtcagagccgtagatcatcccaaagtgagctgggccataatgtaccctcttgctatgcttgtgcttctccttcttctcatccttcttctcactcttcttcttatcttccttgatgtgggaaccatccttgaggtgagggcaatccgcaatgaagtgcccgagctctttgcacacgtagcacactcttgcggagtgtcttccacttgacttgttggagtagtgcttggaagatcctcccttgaagaagccgcttcgcctcatgaacttgccgaacttcttgatggctctcttcatcatcggtctccaccttgctcttacacttgcggttctcttcttcttcttccattgccttcaaagccaagtcatccttcttgatgcttgcagttgagctttggttgatgtattggatgacatccttggactcttgcacgagcatgtcatgggcaaggatgcgtccgagcaaatcatgaggtgtgagagtcttgtagtccggacgctcacgaatgatggtcaccaaggtagagtttcttggagtgattgctcgaaccatcttcttgaccacaacctcatcggtcatgtccttggagccaagtccttgatctcattgacgatcttgctcaaccggtcgtacatgtcgcttgggctctcaccatccaacatcacaaatctctcaaattgcccctttaggatctccaccttggactcacgaacactatccgtgccttcatgcaagttccgaagcgtgtcccaaatcactttgtcactctcaatgccatccacacggttgaactcacttccactcaatgcgctaagtattgcattagcggcttgagcgttcttgtgctcgttctcgtcgtcctccttggtgggatcttcgggattctgcaaaacatagcatttttcgactattctccaaatagatgagttaatagacttcaaatgcatcttcatcttatgcttccaagcggcatagtccgtaccattgaagtacggagctttgccactataggtactcacataagatgtagatgtagggggatagtcataagggatcttagctcccttatcactatcgatcccctcccccgcttggcccgacatgatctctctaagcggttaagcctaattaggagattaggctctgataccaattgaaagtgtcaattaggcctagaggggggtgaataggctaattcaaaaattcaattaaaagcggaagcagtaattttcggatatttccgaaattttcggatatatccgaaaattttcggagtcagcacaaatagcaaagtaaatcctagatctagttgcctacaacaagaatatgctagcacaaacaacaactagacctatagcggctcaaacaagcaaagctagtggagagagaggaagtaagtcaccaaagatgaagctcacgaagttgttcccgaagttcgaatccttgaggggattctactctccgttgaggagctcactaagagccgggtcttagctaaccctttcctcaagaggttgcactaagcactcctccttccactaagggtatctcttccctttcggaggtgagatccgaccttcacaaacttctcccagccaaccacaagtagatcggtggctcgggagtgacacctagccgcctaggagtccttaacctccaagagtaacaaatgtagcaaagaactcccggagatgatgcaagtgctcacaaatcttcacgaagtcaacaacaagcactcacacaaactcgaatccacaactctcacacacacacaccaaatccaaatcgaacacgggtgagaggggaaacaagaaagcaaggctcaaaagtgctagagagagagcaagccaagggcacaaatgattggaatggaaccagcagccctcacaagtgagggggggggctatttatagccacagcccaaattctgcccgttatgcacaataattgagattttcggatattccgaaagattttcggacttgtccgaaaattccagctcagcaccaacagcaaagtcaacgaaagatttttcggacattccgaaaattttttggataagtccaaaaatttccaccaccaaaacatggttctggatgttttcggaaaagtccgaaaatcactttcggacaagtccgaaaatacacagaagcgatttctgcctttgctgaagtttttcggaaactctgaaaatcaatttcggaaaagtacgaaaataaacagaaccacatttgccttcacagtcattttcggaaagtccgaaaatgtctttcggacatatccgaaaatttccagaagcaaaaattggttctgtgcattttcggaaagtccgaaaatgactttcggaaaactccaaaaatttccagaacatatcaaactgaggggaaacacttttaaaaaaagattttgagcactttgatcactcctcatatgtcaatgcatcatccctcttaatagtgcggcattcctattgactcaaatgaaaagaaaagttacaatataccatttgctcatctgccgcatcgcatcacatcaacgtatttggcgggatatgcattatggtaactcattgaggacataacaaactt

SEQ ID NO: 44743 - DNA, 3303 bp, Oryza sativa
tttgaactgtatgatatgaccagacaggtcatatggtctactttcagttttccgacagacacattgttggcaggtcaaaacttgcgtccaggcaaatttcttctttcaggtgtctctcagagtaatcatgccagtggcaagtataggcttgaaaccaacagatggcaatcttgtgatgtacccaacggcaccattgactctggtagtgcgtactggtctacctggactttcaacatgggcctcctcctcacgctttccttagatcctaatggtaccatatggatgttcgacaggaaaaactcctatacaaagatactgttccatgccaaccagccttccaatgcctcccctgatatggaaatttactatcgtctgacatttgatcccgacggcatcctacgactctactcacatgttttctttaagcttggcagggcacctacaacagaggttgagtggcttgagcctggcagtgatcgctgccttgtgaaaggtgtttgtggtccgaatagcttctgccatctcaccgtgactggagagacaagctgctcttgccttcctggttttgaattcttgagcactaaccagagcacacttggttgttggagagcattgccaaccggtggctgcgtgaggaacagctctaacgatgagacgagagtgacaaccacgatggtcgaagtgaagaacactacttggttagagaacccgtatgctgttctaccagccacaactagtattgaagcctgcaaactactttgcctctccgattgtgcttgcgatatcgccatgtttagtgattcctactgctcaaaacagatgcttcccattagatatggcaggatgcctggtaacaccacactctttgtgaagatctacacttaccagaccatatccggtactcgccaaagggctatgagtatccatgcaaattctgcattgatatcaggggtttccttggccatcttttctctgtttgtgctattagtggcatctctattacttatctgcaggcatcggcgatcattggcgcacatgacgatgacggcaccacggcaagaggactccaggattgatgggaacattgttggcctcagatcctattctttccaggaactagatttggcaacaaatggtttcggcgaagagcttggcaagggggcatacgggacagtattcaaaggtgtcgtggccgacaccaaccaggacatcgctgtgaagaggctcgaaaagatggctgaggatgggcagcgtgaatttaacagggaagtgcgtgtgattgcaagaacacaccaccggaacctgctgcgattgcttggtttctgcaatgagggcattcatcacctgcttgtgtatgagtacatgccaaatggatccctggcaaacctcctctttcactcagatgcctcccctgcctggagcaagagggttgcaattgcactagatgttgccagagggttgcaatacctgcattcagagatagagggcccaataatccactgcgatatcaagccagagaacatactcattgacagtttggggatagctaagattgctgactttgggctagcaaagctactgattgggaaccaaacaaagacattcaccggcatccgaggaacccggggctatctagcaccggagtggagcaagaacagagcaatcaccgtgaaggcagacgtgtacagctacgggatcatgcttctggaggtcataagctgtaagaaaagcatggatctgaagcgggctggggaggagtacaacatttccgagtgggcatatgagtgtgtgatgtttggtgatgctggcaaggtggcagatggtgtcgacgaagctgagctggtgagaatggtgaacgtcggcatttggtgcacacagagtgaacctgtgatgcgaccagcgatgaagagtgttgctcttatgattgaaggtgccatcgaagttcaccagcccccaccccctgcatcatattcgcagtcactaacatgagctgcaagcataattctgagtaagtaaaaggcaaaaaaaaaagaggtctacctgtaacatttttttttaaaaaaaaaactgttgataagcagagtgcaatctgaatctactgaatagatccagagtatatgagaagtggcacttagcaaaaggtgtgatcagaagaaacctcattgattgtgtaaagggaaaaaaacatttgatagcagatacccattacagaacaactctttgtcaacaggcacaaaagaacctagctaattttttgtaattttaacaattataatatttcagactttttttagttgaaatgtcaggtcgtttgctgatagaaatccttgtttaatttgcagaaaaatgatgaagtttgcttgaagcgctgcaaagtacagcaagggtcgtccgtctatcaccagttcaaatacatgagcttgcatcatggaacaccctgaaaattgacaaccaagtcttttacattatgcagctataagttttacattttgatcggtagaatgctatggatggcataagtacaggaacggtcctagcagatgctgttatgctagaagtctaatagatcatttcagtgcaggaaaatatatgatgaatcatgtactctgtttctgatatggaataaagtttatgagttctaaaaaaaaagtacaggaacggaaatccattttcgtctgcgatggagccttgatttttagttaactgccgtgttcgcttttctgatcgcgcaatgcatgttggattgttctctgaatcgttgtaaatacattgctgcattctatcgtatcaaatgatttgaaactatgtactacctccatggctctgtcctagaatatatatgaacttttaactatagatttgaatatgtacttgttcagatttatagtcaaaattattatattttgttacggaggtagtttgaagtaaatgattttgatgtcaagcaaatcaactatttgaagtaaatgatttggcaacaaaatgaaacgatgagaagtcccggcccaccaatggttactggatctcaggctctcagctactattcgtgactcgagttcgtgatgggccgagaccatgatcgctaccaatggtagagtgatcggcacagcaccatcgaaccaaattgcccaaacgccagaacgaatcactctgatgaatagtcgacaaaaaaaaagtatcactccgaaatccgaatccacgatgaagatgaatttcattagtccacaaaagtatcactccgaagtccgaatctacgatgaagatgaatttcattagcccacaaaaggcattacatcagacttt

SEQ ID NO: 44744 - DNA, 4668 bp, Oryza sativa
gggagaatctgaattgatcgagaaagctagagctagcagatggtagccgatcgagggtatttatcgtggacgtggcgcacgtacgcgcgatcaaatcgcagtacagacaatgcaatcgatcgagagttcgagaccgactcggactcaggcgaaccaaatggttttttttttttttttggcgggaatgcggtatttgtacgcgtaagacgagtatgatttactagtttgttgcaaaatggtaattagcccatcgaatttatgctttttctgatgggctaggcctgggacccaattccgtgacgggtgaggcccatcactgaaacgtcgtgatgcggctaggcccaaatttggacagcgtggccggggtcgtgacatcatcaggttcaaagggggttcggagtttccatcctccgaacccctttgacctctttttctctccaccacatgaatgcctttgtttctctggttccttctctgaatttctctgctaatgaagctcaatcaagttatcatgcaccaccattgaactactaatcttctaacacgcgtttattatcgatcttgccaaaaccatgttcatgcatgctctggccattcagcgtctgctactgattgatcatgcagtacaactttggtcccttctctgaaatgttaccatttttcttctgatgaagcgtacataccatgcgttgcatgaggcaaacattcattttctgcagccggagctggagagtagctcaagtcgtgacgccgccaggttcggagattaaagctccgacccctattttgacctcttttttccggccccaacatggatgcaaaatgtctccttcaattcagccgcccatggctctcttgtccttatcatgcatgtatggccacacatggtgaagaaatcgatcgatagaatcaaattcacgagacattcagacatgttggaattaatagatgggctaaggccaattcaaagattaattctttagaaaatcacaaaagcccatctcataagatggtatgtatgtgagtttaataccactttgcttattataggagagggaacctccttaaaagggaggatgccctcctagccacttgaagcatgtgtggtggagagaagaggggggaaatacacgcgctcgccctgtctcgcagggcagggttgttttgctgcgggaaattcggatttgttttgttttggaaacattccaaaaaatctggtgcgtgaaaacggcatggagttgcgcgacttatccggtttgctgcgggaaattcggatttgttttgttttggaaacattccgctgcggaaaattcggatttgttttgttttggaaacattctgaaaaatccgttgcgtgaaaacggcatggagtccgaataagttatgcgcgacttatccggtttgctgcgggaaattcggatttgttttgttttggaaacattacgaaaaatccggtgtgtgaaaacggcgtggagtccgaataagttacgcgcgacttatccggttcggttacgcggagtgaagatcatgcgggcgccctgatcaagcgacctatctctatataaaccgagtcgctgccttcacgcaacacacacgaaatcaatctagggtttgcctcctctgtactgcgccgtcgctcgtagactactacatcccgctcgccggcgtgcaccggcgatcgggagagcaggtctccggaacctctgccttcgacgtcttgcaccgggagaaggcggcaataagatttttgggaagcgcttcgcgcgactgctccctgttcgtccgtgacggctcgccttcctctccgctcacgtgctgcacgtcttcatcgacgcccgcaaccacgagtagttcctgccgagcaaccggtctttccgccacctcgatacgtgttcgacatgttgcgcatatttgatctgttcatgttttactacttagtttacatgtgtagatctaatgatgcgttcaatctagtttgcatctgaaatgtaataaattaaatcattatgtgcttataatttcaacaagacattcacaacattaacagtttagctgttagatggaatcggcagcataatatttacatgggtattactaccgctgcgtattttgccacaggtagacaaatcaagtgtgcttggcgacaagagatttgctattattgcagagagcttagagctccatcaacatggacaaaaatacagcaccggtatagttcatgaaaggtctgtttgctataaacagatccgggataacaatgtgggggtaaagtacggtctggatttcccaagaacagatccaggattttcttgatacaaatgctctcgaagctctacatgaaaagcatcacaagtgatccataagcatatattagacaggcatatgctaaaagaatatctactttttcatgcactatgtcatatgggaagcctatgtttacaatgtacattagtttcagtacgggcaagccaagaatattgtgcaagtacactccggtttcatgaaattaatggaccaaaatattttttttagttgcgccaataaataaatgcatgcaaccttaatatcttgttttattgcgcaaatcaagatgagcataacaatatactgatatgtccacacaacagattgcatagtattaatctcttgcctatcacatcaagtagaaaatgaccgcttgcgcttctgaacatcaaactcaacatcaatgaggccggttataccagctttgatcttctgtcctggtcgtactgggcctacaccctcaggagtacctgcagaggaattcattaataacccccacaatcacaactctaatgcacaacaaactgttctccaaaaatgtgatttaccggtcagtataacatcaccctccattaatgtcatgatggaactgatataacttattagagatggtatcttgaatatcatatcacttgtagatcccttctgcctaagttcatcatcaacctggacaagatttctctatgcttgttaataatttgttgtactttctacttcttagggggcaaatgaatagattcactacatgcctacatatttgtatagttacctttagccagagctctagatcatcaggattagctacatctgattttggaatctgttcaatagagcaagaatcatcaaggaaagtcaaatgcattggatgcagcaatggaattatgtagttcatattcagtagaatgacatcggcagcattcagagaatacgatccacgaccaacaaaaggagatgccaatctgtaactagtatcctgtggttcttttcatatgatattgactcaccttttccagcattctatgatttatttctatccattaataatcataaagattactggtgtatattccgtctcttcagttatccactactttgaatatggtacttggaactatttattacaagcaaatacatggaaatgaaaaataacgtgtcgagtcaccacctgaaccagtttctttaagcaagagaacacattgcttaccactgcactaattggagtgaaggtgtcctgtgctttacccaaagtccaaggaagacctgcagactacagagtacattggtttctaagtataaaacatagtacaagactgaaaagttatcttacattaagaaactatgtgattgattcatacaagtaccaaggatacaactgccaattagttaccatgattttgcacaaaaatagttataaaaaacattgtgtgtatatgatcaaacaagatagtggtaaccaaattcaaaagaaacaaatagttcttgttctagtagcttatacaattattagttgatatgattgcatgaacataataaagaagcagctactgagattatagtgtgcagcttgttgctgaatttcttttatcaatttgaatgttatgctcttatctatcctctgaaactaccaaggatgatagatggcaataaggtgacaagaccaaagaaaactagggcagctagtgcacaccttagccgcagactgaagttctcttgctgtcatgtccaaagcaagtgcataacctgggaaatccaaagatataccattagttataattgtactttgtcactgaaaggggaaaactgaaaaccagtatagctttttgttgactcgtagaacccacattaacaaatactagcataaaagaaagagtaatagtgaacaatctgctacttactgtagcataatttggtattgaaccaaacaataagatcaatttcactaccatgattatttagagaacatgaagcaaccaacgataaaagaaaatgtgactatgttaacgaatactcctcactaatgagactttcatgagcctggtcatggcaaaacaggcattgaacaagcagatggctaagagcttaaaattccatgtctgaatttttctaccaagcctgtcaaatgtatatggacaaagtttaccggaattgctgaaagagtgaaatttatatgtcctatagttgtccactttcagtctaagtctctaaggcctgctcaaatagttctgaatggcaattccaaggttctagtacgtagttttcacagaacaaagcatatcggcatctcctattccgatttttcggtggaaatcatattttgatttatttaccaaacttgtgatttcttccatgatcagggatatagaa

SEQ ID NO: 44745 - DNA, 1299 bp, Oryza sativa
tgaaaattttactatatttttatataaatttgattaaacctaaaaaaattgacttaaaaaaagaaaaagaaaatcaaaagtggtagtataaaacggagggagcataggaattagtttataggcatcctagaagctcttttaaattcattcagacccttgaaatttcattgtttgccagatagccaaacttggcattacaaaagctctgcagcattagccaaacacagcatgacaaaagaaccacaccatcagcctaaagcattacatcctttattctcttgaaattattctttacagcagtaaattatctcacaacctcgatgattttggagaagaaacacccgtattgaacttcttgatgtagttatagatgtgatcactgatttcctgtgctctctcctgctggatgaagtgcccagcacctttgattaccactacttcctcaagcataggaacatctttcttcaacctacccttgtgtatgtagcttttgactcctgggagatggtaagccaggtcaccatccccgacaataaactttgttggcactagaacttttgcacctgtccatggtgccatcagctcccaattcctgtgcatgcaggtcagaggttatgagttcctgctacataggattatatgatcatatcatgcaacccacaactgcgtatgttgatgcagttctcaagtccatgggagtgcatgcttgtgatcatgactggtgacaaaatattcaatatggaaattactgaataaataatctgtgtagttcagaacagatttctatatttaccataagtgttttttttcttgaatacgcaggagaattgcgaatcatcattatattaagaagaaggaaaaggaaaaggtcccgacaaactacaagactgagaaaccaaaaagacgcacagcacacggcacacccagtcacccacccatacatatccaccctcacaaagtgttatgcaaacaagaatttcatctctccgagatctgttaactgcagttcatataggttgtgagctcctggttaaaaacacacaacagatgctatgatatctcatagtagtatagaggtattgaattggacaacagttaattccaagcaacaccattatctaaaaaaaaaagttaattccaagcaacgtatgcagtaagacaaacaggatacacagcaatcagtgacaacaggtaaatctaaaggaaaaaatgtgatattgtgcttcatgtttctctctctagtaacctgtcagggagttcaaaaactgtattgcaacgttaaacaggttgtatgtgtgt

SEQ ID NO: 44746 - DNA, 16079 bp, Oryza sativa
cggtagtaattaataccaccagcgaagccagtttttgcatacacacttgctacataactgatatctttctcaaaaagccaatgaggcaatgttacttccctgttgtttgcccgcatttttttaatggacatagcagaagatcctgttgtttgaacaatcaaggccaatttgaagaatctcttcaagtcaagactggccaattctttttcaactccaggttcctggcagccaagatgacacttgtgaaggcaaattataaaaattacatgactgagagtccgaacatggttcagaaacagttgtgaagcactgacttcatgaggacaaaacttgttcagaaatgaaattattccacatagttgtgcaaaattgttgttgtttttctaagcattatttagtatttactcattagcccatgccaatccatttagcaaactatgtatgattgatatttcatttcaatgtgtacgcaaactacaattggagctgctcacaaagaggaaaaagggcttgcggcacgactatattacattccccaaagatcaattgacaggaaaatttaacaccccagcctagcacatgcacaaaaatgaaatttcctgagtatgtctatgttatgtgttcatctatatgactagtgtgttaagatgaagagcagatgtgagcaccataccactggtaagatactaaaagacttctttttgaaaataagtattcatagacacaactcacttatccattgcaatgaagtgaactattcactaataaacaaaataagcacaatcattctcaaattagttgataattagtggatgatagacatttgggacggggatttagctttaattcttcgattattaaacagatagcagtcgattggccatttctgtggcctacgggaacaaattgcgcacctggaatcggcagacatagtaatcatcgccatacgcgccgcggaagtagtcgaggggcttctcggcggggcgcctcggcatgaacgcgacgctgaggttgacaagcgcgcgcacccggtcaggccgcagcaggcacaggttccacgacacgatggcgccccagtcatgccccaccacgaacaccttcaccgcaacaacgcgcgacgcgtcatctcagcgatttgggggcggaaaggggagagggggcgcgtgctttttttttacctgggggagctcgagggcgtcgaggagggcgacgaggtccccgacgaggtggaagatggtgtaggaggtgtgctccggcggcgcggtggtgccgccgtagccgcggaggtcgggcgcgacgcagcggtatccgcgcgcggccaggtgccccatctggtggcgccacgagtaccacagctccgggaacccgtgcacgaacagcaccgcgggagcagtgccgctgcccggccccgcctccgcgacgtgcatcgagatcccgttcgcctccaccgtccggtgccttaccgccgccgccgccgccatggtctcctctccactccgtcgcgcgacgcggcgacgacgtgcggtgctctgctactggctgtgaacctgctgattacccgaggtagttggagatagttgactgacatgtgggtccagtttcctggatgggccgatgtgatactgggcctagttcctttagtttccaaatgcaaagtggcccaggacggatagagcatttgcatcgcaaagcatggtcaattataccaaatcaatgcatcatccaaacattgggaagaaaattacacaggaattcagtcttttacttatcagtaggactttgcttctttgcgtgacagctgtataatacgaatctcaaagcaacatgtcttcatccctgatttccccagagacttgacttgacgagtaaacgcgttctcctgccgccgccgcacgccagtatccttggcggtgccccctcgcttcggcccttccttgcgtccttgtgggctgtggccctccgcgcctctcgtcgtggcggccagcggtgctagcggcagctaagtggtttgcacgtgttgaccagccgactctttgttagactaactttgcaggtagtggggattatcacttagttctcgccagcacttacgttgtcaattgaaaagaagttcaacagctaaaagacaatggactaggcatgcctataagacttcaccatggtcttggtgatgtgcttctatgatctcgtgatggcttttctctggcagacaatgggtaggcatgccttcaggagttaggtccttgccatggaccctgttggaattaatagatgggctaaggcacattcaaagattaattctttggaaaatcataaaagcccacctcatgagatggcatgcatgtggagtttagtaccaccttgcttattctaggagagggggacctccttaaaagcgaggatgccctcctagccacttgaagcatgtgtggtagagagaagaggggaaacacgcgcgcgctcgctcgcctggcagggcaagcggcgcgcgtgcacgacgttactacgcgtcgaatggttcgaaaaattggctcctcacccttgcggataggttacgcgcgacttatccgaatttgttttgttttggaaacattccggacggttcgaaaaattggctcctcacccttgtgcagatgtagcctccttgtgaaaacggcatggagtccggataggttacgcgcgacttatccggatttgttttgttttggaaacatttcggacttatccggatttgttttgttttggaaacattccgaaaaatccggtgcgtgaaaacggcatggagtccggataggttacgcgcgacttatccggttcggtttacgcgggcgccctgatcaggcgatctatctctatataaaccgagccgccgccttcacgcaacacatgcgaaatcaatctagggtttgcctcctactctgtactgcgccgtcgcttgtagattactccatcccgctcgccggcgtgcaccggcgatcgggagagcaggtctccggaacctctgccttcgacgtcctacaccgggagaaggcggcaataaggtttttgggaagcgcttcgcgcgactgctccctgttagtccgcgacggctcgccttcctctccgctcgcgtgcttcgcgcctttgtcgacgctcgcaaccgcgagtagttcctgtcgagcaaccggtctttccgtcacctcggtacatgttcgacatgttgcgcatatttgatctgttcatgttttactgcttagtttacatgtgtagatctaatgatgcattcaatctagtttatatctgcaatgtcatgatttatttatggaataaattaaattattatgtgcttataatttcaatagacccatggtcggataagatgttggtctcctgcagaaggaggaagagaactcatgaagaaaagacaatgaggaattggagaagaggaggaatcatgctttgagatttggactggacaggtgtcaaacaaataaacaaagtcctaccgatgagtaaaagactgaagtcttatgaaattttcttcccaaacattgaaatttcataggaatacggtccaaattacaacaacatttggtcacatatacgttgacactgattggcacacacgcttgtttgaagagtttttttttttgttttttttttacggcgatgaattgcatctgacagttgagttgagttgagcgcttcagttgggttggggtatgaacttggtgatgaagttgtagataaggtcgctgacctcctcagccctctcctgctggatgaagtggccggcgccggggatgacgacgacgtcctcgagcagcggcacctcggccttgagcccgcccttgtgcaggtagtcctggatgccggcgtagtggtacgtcaggtcgccgtccccgacgatgaacttggtcggcacctgcaccttggcgtccgcccatggcgccgccatctcccagttcctgtccatgttgcggtagtagttgatgccgccggtgaagcccgtcctctcgaacgcggcggcgaagtagtcgatgtcctcctccgttagccaggccggcagcggcagcggcggcggcggcggcgactcctcgctctccggcttgccggccttgtggacggtgaagcggttgcacagtgtccgccttatgatgtgcctcgcgtgcgccggcgcgaactcctcctccgcaacgccaggctcctgcaaacagcaacaattagcggccggtattgggccagattatcctgtgcaattgggcctcataaatgggccgccggcccagagaggatgaaaggtaagtggtctcatgtatggcagtggctgaaccgaccagaggtgatcacgtacaagaatgtagtagtaaaagattacctagagaatcgatatctttcgatgagaaacggaatggccaagtaacctcagggcaagtaattagggcttaatctctcaattccctatttcggcttgatttgctccctccctgcacctctataaaatggcacgcacgtagtgctcagttgatcaatcgatcagaagcagatagagctttctgttgcgtcaatggcggagatcatcctgaacaaccactgcgagggctgcgcgatcgacatccgcaaggccgtcgagaaaatgttcggtaagaagctagatgatgtgtgcagtgccagtgcatttttgtcatggcgatcgatttgacattttgggctgcgtgcgtgcgtgcgtgcgtgggggtgcaggggtaaagagggtttgggtggacatgtatgggcggcgggtggtgatcgccggccgaaaggtcgacgcgacgaagctcagagagcgactcaggcggaagaccggcaagtcagtcaccatcgtcagcgacggcacgccgccgccgccgcccgacgacgtcccctttgtcgggatgatgcacctggcgccgtcgccgccctactacccattgcccgcgccgcctccgccgccgccgccggggagctacctgtacggcggcaactacccctgccagaacccgtaccaccagtacgttcaaggaggcatgccggcgcgcttcgtcggcgacgacacctacgacgacggatgctgctccatgcagtgaccgatcgtgctactaccagtcgtagacgaataacggaataagccaacacgtagtatttcatctactgttccatcggagacaccaacagtagtagcagtatgcattttttttttcttgtactgcgaccacgcactgtaccggtcaggctatcgagtccgtgcaggagaaaatttcgctactccggctggaccgctggttctgatccgtttgggactttgaacaatatttacgatagtattattctactactagtagcatatataaaaaaggttcgtttgcgtctatctgctcacgagttctacctaattttctcccatgctgcatgttgtagtagcttcaaagtagaagaaatatatatgcatatcattcgttacttattataagtcgtttaatttttttcttagtcaaacttcttaaaatttaattaaaatataaaaaaatatagcaatatttttaatacaaaacaaacatattatcaaactatattaaatttaataaaattaatttggtgttataaatattaccgttttttctataaatttgattaaatctaacgaactttaattaaaaaaataaacagtcgaatagcttataagtatataatatgaaacggaggaaacgataagtacgtagaggaaatggcagaggatgaggttctgtgtattgaacctggaagcggcagatgtagtaggtggggccgtaggccttgtggaagtgatcggtggtcttgatggcgtcggcgccggagcggatgaagacgtggcgcatgaaggcgacgctggtgttgacgagcgccgtcacgcgatccggccggaacaggcacatgtaccacgcgattatcgcgccccagtcgtgccccaccacgaacacctgcttcaatccaaaaccagatcagatcagatcagcctctaagttttatttgcaacagctagtagaaaatcttgtaaataaaaaaaaattcactagtagtgacgaattggcatttaattattagtagtactctagttctgcttgatttgattaataagttccaagattttcagtactgatctgcttaagtacatagcattgacagattagtcgtggagtcgttggatgatgccaatcaaattgacaggcaagccacggcgtcacgttgggttgggatatgcccatatttttttttcattccgtctacccattgttgatgccgccttcagtttgaactttgaaccgtatcgaagcactatcgaacaaaacagtcaacttctttgcgctcacatcacaaagccaaatcaaccaaaagcaattttaaaaatggcagccttttcattcgctatccatgttcgacgcttctagggatcacgtattttattttatttagataatgatcacatattcgcatattttaattaatagcggaatcaaacaatttaagcgcatgtgattaatcaattaacagtaaatcaaagcgtggtttgcatctgctaagctcgtacgtaccttggcgaggccgagggcgtcgaggagcgcgacgaggtcgccgacgacgtggaaggcggagtaggactcgatctcgggcggcgcgtcggtgtcgccgtacccgcggaggtcgggggcgaggcagcggaatccccggccggcgaggtgctccatctggtgccgccacgagtaccagagctccgggaatccgtgcaggaacagcaccgccgcgccatcgccgccctcgccgccggcctccgcgacgtggatcgagatgccgttcgcctccaccgtccggtgcctaatgaccgccgccgccgccgccgcgccctccatgctctctagctccttcgctttcttctctcctctcctcaccggcgagctgatcgatcagcgtgtgtttgcacacttcgcgtgcgaggtgtgagctcgtatttatcgtacgtgtggtgccccctgtcgtgttgacaatgaagaaggtattgtttagtttcaacttttttctttaaactttctactcacttttctacacatataaacttttaatttttttatcgtatcatttcaatttcaaccaaacttttaattttgctgtgaactaaacacatccgaactctcgtgtgaaagtggataaaccgagagagagagagagggtcacgtttgaaaaaaaagaaacggtggcgaagtgtggctgtgcaagcgtgtgacgtggacgctaacgcacgtggcgcgtgggaactggcccccaggaaaacggcgaccggaagagtgtgatcatagcggctgaactattttctcaaattaattttataaaatttaatatacttcgatcaagctatttctttaaggtggcatatcatgtaactatacagatttaaggtgaatttcttattaaactgtagatttaaaataaggtgtaagataaataaatatcaagtagcaaaatctcataactataagtttgttagtgtcaatttaatcataaaattaccacgtttataactccaacgtaatggtaattctagggaatttaagctttagaatttatagttctatgataactccaaatttattttgagagcgataacttcaattttaaatatgtagttttgtaatactttattataaatctatagttttgttataaaaaaatagttaaatttgtaagtgtataacatgataaatctataattttgtgataattcgtttaatatattatagtttttgaaatttagtcctttacttttggatgaaataggaaggttatattgacttggtcatggcctgcatcaatttcagtagcagtagagtaggtgcatccacgatgtgcttgaaaaaagcgataccccatcaacatgttcaataatacatttatataagtgctataaatcatattgttgaggagagatcctcaatagcggggaattgtgagaccccccatttgtgatttcggccgggggcggaggctcatctcttgaaaatcactcgctcgtccctaggattaccggcaagcttgcacgcagtcggattatacaggttcgggccgctatggagcgtaacaccctactcctgtgtttgggattatggatgagttttacaaagatttcttcactctagaaagcgcactcgcttcctctcttctggagttcaggttttctaggcgtcctcctctgtctcagtgggcagggtcctccttttatagctcaaggggataccatatgcgccgcctctacctaccctctatcggagggggatcccactccacttttcctgggctttaaaccgtgccttctcccggaagctaagcaacaaccggttctcgagtggaaccaggcgccgcccccgcctgacacgggggacagccctgtcattccctcataaatgaacgatgacctgtgacagcccttcctcgagtgacgcttggacgtgacgggtcatacccacccccactccgccgggtacaagggcgacgtgaggacatggttgccctatccatcggatgtgacggtgtcaggccggtcacatccgttggacagaggttagctaggcgcgccgcacgtctgcccttaccgcattaaatgcggtgagggacagttggggcgtcgcacttttatggctgttcagcctgtgctctcgctctctccctgtcacgcccggaaattcactagtgaatttccgggcgtgacaagttggtatcagagccatctcgactgtaggataagccaaatggtcaaaccttaaggactaattttccgaaaacatgatttgtgaaaatttctcctttcttccttatctagaattctttgcaaattgtttcattgtctactcccctctctctttcaacttgagtagttctaagacattgaaacttgaagacatttatgtggtcaacttatggaggtcagtcaagtggatcgaggaaggaccgaagtgccaagtggtcaagatggaatgaagtttggatcctaccttagaacctatgccgccaaagtgtccttgaagaatagttagtagggtagaacgcttgttgtttgctttgtgtgtaggtatggttgcattcccatcattggagtagttcattgatgagtgtgtaactatactaggttgcttgcttaatcaacttgaacaatataatggtctacacacatcagatcagtgttaacctggttaaggtcttgtctttagtgtaacccctctccttctatcttctctaatatgcaacagatggtgaacactcgcgccagtggaagtggaaacaataacaatgaagggaacccaattcttgctcaagttctggctcaacagactcagttaatgaacatgatgatacagcagatgcagaaccagctcaaccaagggaacaacaatgctccaccgccgcagaacaagttagctgattttcttcgtgtgaggccacctaccttttctagcactactaacccagtggaagcaggtgattggttgcacactattgagaagaagttggaactgctccagtgcacggatcaggagaaagttgttttcgcttcacatcagttgcaaggacctgcatcagaatggtgggatcattttcggatgaacagagcagaaggacaaccaatcacttgggtggagttcacggaagcattcaagaagacacacatacctgtaggagttgtttctttgaagaagcgtgagttcaggacattgaagcaaaaggatcataccgtggcagagtatcttcatgagttcaatcgtctggcacgttatgctccagaagatgtgcgtactgacgaagaaaggcaggagaagttcctggaaggcctgaaggatgaactgtcagttacattgatctcccatgactatgttgattttcagcagctggttgacaaagcaattcgacttgaagacaagaagaacaggatggataaccgtaaacggagaatgactgtattccaggaggcacaaggtagtagccagaggcagcatatcaggccactccaaattggtgaatcttcttccgctggtcaaggacagtcgcaacaattgaacatcgctggtgagatcaaatcagagactaatgaaagcaatgatgttaacatcgagcaagctaatcagccggtgccagttcagcaggaccagtctcaggagaataacactagtggaagggagcagcaggtatgtttcaactgttacaagccaggccactttgcaagagagtgtccgaagccgaagcgtcagcagccgcaaggtcaggtcaacaacattgtcgtcacaggagccaatgcagtgccagttgcgtcttcaagagttgcgtcttcaagtgttacagctcagccactagtttcaaagcagcagtagttttctttaaagccttagaataattatctgagttatggaataataagatagactacagtttacctatgcccttttctttctagccgttccgaatctcgggacgagattctttgtaaggggggtagatttatcacatcctgatttttgtttcaggatttataaattatttaataaattaataatagaatttatgttaaatgatctttaatttacaagtgaagttaaatgtgggaaataaaatttccttaatataaagcatggatggatttaatttttattaaattctccatgattaagtcaactctctgaaattttctcggatttttcggagctcaattcctaaatgatacaaagaacagttcagtaattatttgattttaatgatctaattatatttgttaagagcttttcttgtttaaaatccttaaattataaattgttgtttaaaaggaattattagaaatgattttaaaagcctagaagagaagatctaattttaatctgttaaatctcaatataaaattgggctagataaaattttgttaaatactttgcttaattctataattcctagatttttctgggatttatttgagctaaggaagtatttttaataaatggaattgcatttcatgaataatttaaattgaaaaaggtttttaaaagtctcttttggctttgggccgaaagccggcccaaaacctcctctctctctctctccccggcccagtcggcccagctcgagccgctgctctcttctctctctcggtgccgctgacaggtggggcccacctgtcaggcctgtcttcctcctcgcgccggccgccgctcgaaccctagcgccgcgccgccgtcgtctccttccaaatccggtcgatcctttcccgatccggtgaaatcaatagaggggaaatgatcttctcgatctcctcttccttttctcttatggaatcatcgcctaattcggtttggaaactcgtggattcgaggtcgaatcggatcggtctctttccttcaaaccccgatctttccttcccgtcgccggccgccgtgggccttcgtcgtcgcctcctagcccctttaaaaggttccccgagctcttctctacccgccgccacctttgccttcgcctctcgtcgtccgtagtgccctagcgccgtgtagcttcgagccgccgtcgtcgccgccgctccagccgtgcgccgccgtcgtttcagccgtcgtcgtctctcgggaaggtcgccgtcgtgatcgtcaagtcaccgccgtcctcgtctgcctctttatcgccgccggagaccgccggagcaccgccgtcaccgtcgacccgaaaaccgccgccgtttcttcctcgtcgccggcgccatccgttgctcctccgctgttgctttggtcaccggtgagttcgccgcgtcgcgctctacccgttggtgccctccgtttgcgtcctcgcgccgtcgttcgccggcgagcttgcgctcccgagccgtcgccggtggtgacgtcatcgccgacgtcatcgtcgcccttccccgtgagccggtcgtggaccgttcgatctcggccgtccgttttggataggttctatctcgaccgtccgttcccgtgaaccgctgccgtgcacccggttcaccgcaaaccttagccgctgacgcaataatcctcttttccttttcaaaaataattcattattgcgtcataattcaattaaaatccatataagtgttttaatccgatttaatctttgaaaattcataactaattcatttcattgtaactcagtttaatgtggttcaagttgcaaaaattatataaaataaagatctacatattaaaattgtccataaattgaattaaatttatttaattctttttaaatgggctttaattagatttaatcttgtaaaattcatattaaattcatattaagtcagaatgaggccgttcaagtctcataattcatctaaaattatgatctacatgtttgtttactttttatgtattgtttatttggtttttattagtctttttcctcgttttgcgtgttagcttgtgaaggttcgcgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcaccgggtggtgtgaacctattcctttgttatggcctgtttgcattgattactctattccttgataccttgggatattataacttgactagttgagctttatatattggttcagctagatattagatatgattgcttagccatgcttagaaacattagcacactattgggataacttatgacttaatattatttaatgatggcttaatgatagttcacgatggtcaatcgtgattggttaattaattacttgccaactaaaacttgataatggtgggttgtgagcacatggttttgagagtcgtgctcatggcaattaaggaccggttcgcgagctactgttgtgaaacattaaccgtgccaaccacaagccagcgtgggcaacggctttaccttttgtataacatggttcattgcggatcaccagactgagaagtggcggagataagcccacgggggtcgctggggagtccatgccttgttttataagggggtgattatgatccaggaatggtgcactgtggtgagttgtgttgtgcagagggtattgtcacagcctctattcgggtacttttcagtatcgcgacgcatggtagacatgatgttgaggctgtgtcttgtgggtacagtggtacacctctggccagagtaaaactattcgaatagccgtgcccgcggttatgggcgggttgagcaatgtttttcgtgattagtctcacacctctcacaataattatggatgttatacctggtaataatttgcttagctcctggtttggagttagatctgtacagccgggtatggttgttcagaatggttgggcctgtgcagcatgggtgtgttgttcagtgttgattaaaatttctgattaattactccactgttttacatctcttaaatgttttgctaagtgctgcttttgcaaatgagcctatattatgccatcctttggtatccttgtgcacttgcatatttgctttgtggcttgctgagtatgtcatatgctcattcttgcaataatcaatcaacctcagttgaagaaaaagaatccagaaggagaagacgtttggcttataccccagttgagctgcctgtgggagtggagccggagcttcggtagattttattttccgctgcagttttcttcatggtgaggactaagtgcctcttaagtaagtacttatcgttttagttaatttgatgaatctgtatattaaattgtcagtttgtgtacctcggctgattcctggacgaggattttatgcacaaataagtttggaaattactagtgaatttccgggcgtgacactccctcctccgcatggcagccgggtgagggcctcggggcgaacccgcgggatagcccgagggggtgacgccatgccccgagccccccccggccgcttccacgactcgcgtgacgcgcgaatggggctaacttgcaaagtcacgtcgccggagggaaagtaaccctctacttcacataccccgggtccatatctccgacagtagcccccgacgctatatcaggtatcgatttcctgagatcgttctgacatggtgcctcacgactcctcgagctggggttgtgggcccggcagggaatccaaaaggatatcgccgcgtggccaggttggcgtgccaaccataatagcggtttgaccgccactgaccgcgctcatgatgaagatgcttgaggcgcgataacccggggggtcagtcagaccacgcctcgattctcccgctcgctactcctgcggcggtagtggtgacggtttgctcaacttgcgctcatagccgttgtgcactccacctcgagtgtgccactgacagacgcactaaaggcgggagcggatacaacgggcgacgtgatgagtgggcgcaggatgcgaagagacaaatgcgggcgcgaggatcgtgggggcaagtatgggagcgcgaaacgaggaggcaagtgcggatgaagcgaggataaaagggggcggaggcagagactctgcccccttcctttcaccaaccgcccactcgtcctttcgcttctcaaaccctaacattctcgccacctcatactgtctcacgctccacgctctccgccggttgccatggcccaagacaccggcgacgcagtgctcccttcctcccgcatcacagcagacaggcaccttagccttccccgcaagatcatgccggacggtgccgtcgtgcgggcgggagagtcgcggcacggccacgatatccggagcgatccatgcacctcttgtccttcgccatgacgggcttgattccgccgttctccagattcttccatgaggttctggatttctacgaaattcatgccttgcatctcgcacccaatgccgtgatgacgctggccatcttcgtgcatttgtgtgagatgttcattggggtgcgaccgacgatgcggttgttccaggccttcttcattccgtagcttctgcaaggcgcggtggtggggggatgctacttccagccccggccaggcacagcgggtcagtacatcgagagcaatctccgcaagaaatgggaggactggaataaggactggttctacaccgcgttgccggaccatccgcgacttcgagttcccgctggccctcctgaaaggtctgccgcatggctggcgacttcggagctgggcgaggaatacgacgcggtgtgggatcgccttaggggcctgcggagcctgggcctcacgggggcgatggtctttggcgattacttccgccgctgcatcgcacctcttcaggaacgatcccgtggagcgtgggaatacactggtcccaacgaccccatgcggacgcatgtgggcgagcgctgggactagggtgaggaggacgcgaagagggtgattcggcgggtgctgggcctagactccgctgagccaacactaatcccagatgggattcttcccctctgctgctaccgtgaccgggagagcattctggccgtgatgtcagccatcgtgtcacgcccggaatttctatccaaaattccaaacgcttacatgtgtgtgaaccctcgtccaggaatcagccgaggcacacaataacaaattgataatagagtacaattattactctaattaataggcgaataaaatgtcattacagaggtagatagttcctctcaatcaataaagatctaagcagcggaaaataaaataaacggcgcagacggctccactccacaagcagcttgaccaaggctacacctaatcctccacaccatcagcatcattgtagaactcttcctctgatgaatgattgcaaggtgagtatatgacatactcagcaagccacgcagcaaatatgcaagtgcacaggataacaaaggatggcatagtagggtttcatctttttgcaaaagcagcattcagcaaacatttgagaatttaataaaacagttaagtattaaacaatattaacccaacgctatacaacataccctgtgcataggcccaacc

SEQ ID NO: 44747 - DNA, 12257 bp, Oryza sativa
gaatagttttactctgatcagaagtgtaccactgtacccacaagacacaaccccacatcatgtcaccatgtgcctcaataccaccacggtacctcggaaaggagttgtgacaataccccttgcataacacaatccactacagcgcacctttcctggatcataatcacccccttataaacaaggcatggactccccagcgacccccgtgggcttatctccgccacttctcagtctggtgctccgcaatgaaccatgctatacaaaagataaagccgttgcccacgctggcttgtggttggcacggttaatgtttcacaaccgaaactcgtgaaccggtccttaattgtcatgagcacgaccatcaaaaccatgtgctcacaacccaccattatcaggttttagttggcaagtaattaattaaccagtcacgattgaccatcatgaacaatcattaagccatcattaaaataatagtgagtcataagttatcccaatagtgtgctaatgtttctaagcatggataagcaatcacatctaatatctagctgaaccaatatataaagctcaactagtcaagttataataacccaaggtatcaaggaataaagtaaccaagaacaaaagggctataacaaagaataggttaattccacccaatgacattcgaaaataaatgcaatagttgaatagaaacaatagctttaaacgggatcaacatgctcaaagggttgtttgggatctgtgtgacttgccttgctggccttggaactcttcaaactcttctcctgcgaaaacggactctccggaaacgacggaatctaaacagaaaagagcaaaatcaccaaaacagcacataaacaagcatgaacagtacatgtggatatttttaacatgtagatctcaattttagaaaaatttagagacttgaaccaactaaatcggagctaagatgaattagttatgaatttttgaagattaaatcggattaaaacacttgtattgattttaattgaattatgacgcaataatgaattatttttgaaaaggaaaaagagatttattgcgtcagcgggctagggtttcggtggaccgggcgcacggcggcggttcacacgaacggacggccgagatcgacttgatccaaaacggatggccgagattgaacggtccacgaccggctcacggggaagggcgacgatgacgtcggcgatgatgtcaccaccggcgacggcggctcggcggctcgggcgcgcatgctcgccggcgaacggctgcactacggcacgaacggagggcaccaacgggtagagggcgacgcggcgaactcaccggcgaccaaaaaggcggcggaagagcaacggacggcgacggcgacgaggttgaaacggcggcggagatcgggtcgacggtgacggcggtgctccggcggtcttcggcggcggcgaagcggcggacgaggacggcggcgacttgacgatcacgacggcgaccttcccgagcaacggcgacggctgaaacgacggcggcgcacggctggagcggcggcgacgacggcggctcgaagctacacggcgctagggcactacggacgacgagaggcgaaggcgaaggtggcgacgggtagaggagagctcggggaaccttttaaaggggctaggaggcgacggcgaaggcccacggcggctggcgacgggaaggaaagatcggggtttgaaggaaagagaccgatccgaatcgaacttgattccacgaacttccaaaacgaattagccgacgtttccaaaggggaaaaggtagaggagatcccaaagattgtttcccctcaatcaatttcaccggaaacggaaaggagcggccggattttggaaggaaacggcggcggcgcgaaactagggtttcgggcggcggcggccggaggttgacgacgaccctgacaggtgggccccacctgtcagcgggcggacgcgcgcgcgcggcggcggactgggccggactgggccgaggagagagagaagggttttgggccgactttcggcccaaagccaaaagaagactttttaaaacctttttcaatttaaattatttatgaaatgcaattccatttattaaaaatactttcttagctcaaataaatcccagaaaaatctaggaattatagaattaagcaaagtatttaatgaaattttatctggccccattttatattggaatttattaattaaaattagatcgtctcttctaggcttttaaaataaattctaaaaattccaattaaacaacaatttatatattttgaatttttagggtgtgacacatcggcgccggtaggagccggtccagtcgatgcggcgccagcggtagcgccgtcggcacgggtggcggtggtgcgaccgcgggcgggagccgggccggcggtccaggcggcggtggctcaagggcgcctggatcgagccgcggacctggagatgattccgccggtgacccaaaggggaaacggaaggtggcctattcccggccgccctctcccccacatggaggaggtgccgagcgtgcaacggatcgttcgccaatgggccacaagcgacctgccgggcccgaggctggtcggaaaaagaagcggctccggaagatagcacaaacggagccatgccggggggggggggggtttcatcgagcccccaaagtggaccttcaaccgccctccccgtaggtacgattattggcgctcactttggtgctcttacccaacccattttcttgttccttctttttcttttgttaacatgatctaggttctcttgtagcgagattccttctcagggaatctcagggtcagaccccccgcaagggacgaaatctgaacggttggggcagtccgagcccggccaaaccaaggccggggttttcgcagcctcgtggcgggacccagaggacacgcactgggcccgatcccgagcgaccctcaggcgggacccgtcctactgtgggtggcaggggtggcgacgctcctcccgggggcggctccgggaccagggtccacgcggagcaccaccaaggatcgggggatgagggaggtcgcggcctgggagccgaagccggaggtggtcccgagcttgaggttgaggctgggggcggtcccgaggctgaggccgaggctgaggccgggggcggtcccgagcccgagcccgaggccgaggctgaatccacccgaggacccgaagcggggggtgagagggacagccgttcccccttgcgcttggggcgccctcgaggctggtctcgcagaaggggggccgagagcagcccccagtctcgcgggggatccagcagtaccccgtcgtcccgggggcggaccgcggccttttcctccccaactccggcgagtatggagccacttctgcaggtgctcgccgccgccgactacactgtacgagaggggttgaacacccaagttcaagccctagcggaagagcgggcggccctggatgcagagtgggaacagctcgccgcggaccgcgcgcgagtcgacgaggggcgtcgcgccgtggacgacatggtaagggtgggggcgcaaaatgcatcaaacccaactagccaaaatccaggcgcgcgaggaggcactggactccgtcatgcgggaggcggaggaggagcggcaggcggcgctgatcgcctcgagcgtcctggatgaagcgcggggcgatatccgccttcagtacgaggctcacgccgaggacttggcgaagaggattagggacgcgcgcggcatcctcgacgcagccgctgcccacgagcggcgggcatcggaggccgacgcctcgctgcgggcgcggacgatggcactcgaggctgaacgcagggccttggatgatcgtgcccgctctgcacaggagtttgaagccacaatccgtcggcggatcgaggtcctcgatcgaaaccagcgtgagcaaaacgcgtgcggtgaagaacaggcacggcgggcccgggagctggaggagtgagcacgcctgctagatcagctggagtctaccttggccgcccatgaaagaacggcggcagaggtggaggcttcccttcgcctccgtgaagaagccgcggccgagcgtgaccggatcaccctcgccgcgaaagcttccgcggaccgccgcgcggaagagctacggctgcgggaagaggcatgccgggaacgggatgccgcactcgccgagcgcgaagccgaggtgaatcgccgcgaggtagccttgcgccggctaggcgagcaactcgcgaaacgagaggaggccgttgccgggcgcgaggctcgtcatctggagagcgcccgcgctgagcgtgcggcaatatcagcgaaggtctccgagctggaggcccgggagaaggacttggtagcaggcgggccgcccggcggcgcgggtttggcgagccagctcgccatggctcagagtaccctcgccgacttggaacgcctggtgcaggatcaggctggggaaattgcggccctccgcctcaccaacgagctcgggcccgggcaactctccgacaccgtcgactggctggagcacgcggggcgccgagtcggcatctctgtgcgtcgggacagcaaactcccgcccacacagccagcactcgcgcttcggctggacgggctggcggtggacctggaaaggctggaggaggaggtcggcgagaccataaagtcttcgtcagtttctttggcacgggctgcggtggagctggtcctcgcgagccaccaagcgcgcgaccccgaattcatgccgtggcatgcgctcgaggattttcccccgggtaccgaggcaagggcccgggagcaagtccgggaggcggctaacgcgattgtctcaagcttcgaggggtcggccccccggttcacctccgggcttaccgcggacgaggaaaacggaagcgggggtgacgacggcgatgacgactaggacgacatcgtcagtggcgctggcctcggggggccgggcactccgtgaccactcgcgcctttaattcctttttgctgtgtgcccgtagcaggcacttcttgtatttaggccattgtgccatcctatcttgttctgcaactgaaacttctttaacccctcttactcttttgctttttccattggatgcctgtgatataaagagaagaaaaaaccaggacaaaaggggattattagactgcctgcgattgatatgtcgttttgaccccccctctcgggcttgttctagcgagaagataaatccgcgctcggtccatggaatctaagtggtgaaaggcaagaccatcgccccgagggagccgcccagcaggactggccagaccgaggctgcgacgaccgggggtcggggacgaccgtgtgtaggcccttccgatcccccggggttcggcacaacccggggcgcggcccgcgctcgtgctccctttcggcggttttcaggccgtcttacggcacttagggtttagagtaaacgcggattatcccttgaaccgggacaagccagagaaaggggagaaaacggtctccacgaaaaccaaggggttgtgcgggggctggcccgtgctccaggaaagcaaaaaatctcgatgtcatggatagaaacgacaaaggtgctcgatattccaggggttgggcagctctgtgccgtcctccatggttaaccgaacggagcctagccagggcacttcgatcactttgtatggcccttcccacattggcgagagcttcctcagccccaggcgcgactgaacgcggcgtaggacgaggtcgctagcttgtagtgatcgggcccggacgtggcgctgatggtagcgtcgcaggctttgttgatagcgcgcggcacgcaaggccgctcgccttctccgttcttcaagataatcgagatcttcgcggcgaagggcatcttggttggcctcgttgtacaacgcgacacgaggcgacccgagggaaagctcgaagggtaggaccgcttcggcgccgtacaccaagaaaaatggtgtttcccctgtggcgcggcttggagtggtccgatttgcccacaacacggcgggcaactcctcgagccatgaatccccgtgcttcttcaggacgttgtacgtcttggtcttgagtcctttaaggatttcggcgttggctcgctcgacttggctgttgctcttggggtgggcgggtgaggcaaagcacaatttgatacccatgtcgtcacagtaatcgccaaacagctcactggggaactgggtgccgttgtctgtaatgatacggttgggcactccgaatcgagacgtgatgcccctgatgaacttaagagcagaatgcttgtcgattttgacaactgggtaggcctcgggccacttggtgaatttgtcgatggcgacgtacaagtgctgatacccgcctcgagccgccttgaatggcccaaggatgtccagcccccaaactgcgaaaggccaagatagtgggatgatctgtaaggcttgggccggctggtgggtccacttggcgtggaaccggcatgccttgcaccgctggacccattcttgggcatcttgtaatgcagtcggccaataaaaaccttgccggaaggcttttccgaccaaagttcgtaaggtcgaatgggctcggaactcaccctgatgggcgtcggctatgagctcgatgccctgctctcgagaaatacacttcaagagtatctcgttggcggtacgccggtatagggtcccttctacaaggacgtaccgtttggagatgcgcgcgagcttttcagcttctgcgcgatcctcaggatgagtattgccttcgagatatgcccggatgtcggtcatccacacgacctgacgaggggggtcagggttgaccccctcgggccccgaggggcacaggtcgcccggagtcgggtcggagggcgtgtcattggggtccctcaaagggctcggtcgtgccgatggttgcgcgagcctttcctcgaaggtccctgggggagtggggctcgtgccgacgcaacatgcgacaactcgtcagcaattgtgttgtcgcgtcggggcacgtgctggagcttaagtccgtcgaagtggcgttccatgcgccgtacctcgcggacgtacgcttccatttgcgggtcgttgcactgatactctttggatacttgatttacgatcagctgggagtcacccaagaccaggagacggtggatgcccattccggctgccgccctcaatcccgcgaggagcccttcatattctgccatgttgttcgtggctcggaagtcgagacgaacgacgtatttgaggacatccccgtttggcgaggtcagcgtgactccggcacttgcaccttgaaggttgagggagccgtcaaaatgcataacccagtgcccgtcgcgaatgtcggcgtttggatcctcttcttctccagggaggggaaaggggacattagacgaaacaggttcgtccaccggggttcattccgcgatgaagtcagccaggatttgacttttgatcgcgtgccgcggttcgaagtgcagattgaactcagccagctcgatggcccattttaccactcgtccagtaccctctcggttgtgcaaaatttggccaagagggtatgtcgtcactacggaaacccgatgcgcttggaagtaatgacgcaacttccttgaggccattaagacgtcataaagcattttctgggcctgcggataccgggttttcgcatctcgaagtgcctcgctaacaaagtagacgggccgctgcacctttcgacggggccagttcgtgttgtcaggggctgatgactcggagcgcgcctgttcggaggtcccggggggatcccagactgcctcgggatcataaggctcggggccacctgccaaagcctccgctcctcccttgggggcctcggggtcctcccgggggctggaagctttgggcgctaggccttcgggggacgaggggccatcgcaagccgaaggggcctcccgttcgccttcctcacgctcaactactagggcggcactcaccacatggggggtcgcggccaagtagagtagcaatggttcctccggtcccggggccaccaagacgggagggaagttaggtaagctttcagctgattgagagcttgctcagcttcctccgtccatacaaatggcccggagcgcttgaggagcttgaataggggcagcgccctctcacccagcctcgatataaatcgactcagggcggccatgcatccagtgacgcactgcacatccctaagcttgctaggggggcgcatcctctctatcgcgcatattttctcaggatttgcttctatgcctcgggaagagactagaaaaccgagaagtttgcccgccggcacgccgaacacacacttatcggggttcagctttacgcgcgtggacctaagactatcgaaagtttcggccaggtcctgtagcaacgtgtcttggtggtgcgtctttaccaccagatcatcgacatacgcctctacattgtgccctatctgattacttaaggtaatacgagtcatgcgctgaaaagtagggcctgcattcttcaatccaaaaggcatagttgtataacaaaaggtgcccacaggagtaataaaggcggttttttcctcatctttcctagccatacgaatttgatggtatccagagtatgcatctagaaaacacaaaaggtcgcaccccgcagtggagtcgactatttgatctatgtgtggtagagggaagggatctttggggcatgccttgttgaggtcggtgtagtcgatgcacatccgtagcttgccattggccttcgggacgaccaccgggtttgccagccactccggatggatcacctcgcgaatgaaatcagcctccaggagccgcgccacttcctccctgatgaaggcctgccgctccggggcttgacgccgcactttctgccggacaggtcgcgcatccggccgcacggcaaggcggtgctcgatcacctccctgaggaccccgggcatatctgacggcttccatgcgaaaacgtcagaattcgccagcaggaaggagacgagcgcgccttcttatttggcgtccaaggttctgccaatcttggcggtcttagatggatcgtcgccaagggggatttccttgacgggcacctcgtcagccgaggggaggcgcttcttggaagcgtgggacgcagaggcttctggggcctgcggctccgtggccaccgccaggttgtctgcgcgctgctccgcgcaggcgagggcgaccttgacatcaccaaggacggtgatgggaccagcaggacccggcatcttcatctagaggtaggcgtagtgggtggcgaccatgaacttcaccaacgcgggtctacccaaaaccgcattgtagggcagattgaggtccgccacattgactggcccccccatccaccagcacatgcttcatcttgacgttgtggatggtcggggagaccaccagggccaactttccccccccccccccgagcgagcaccgtcggatggtcgctctggtcgaatgtgagcttcacctccgaccagcgcaccttccggaccacctcatgcgtgggaacaatggccagaagctcccacttcatagccttgaagcttcggcgagaggtgtgagcgcaagccccccccccccggtcgagcgtggcgacggtcccctgaggtatctggaaatccagatcctcaccgtctccgccatcatcggcgggggccttgtccttggcctcccctcgctggtcaccggttgaggtcgcgggggctttgccctcccgtcgaccctgccgcttttcctcatcagcctttcggaaccgctcggctaaattcttgaccgagcggcagtcggcgagactgtggcggtaagtgttgtgtaccgagcaccacttgtccgccgaccggccctcgccggagggaatggtagggctcggcctatcgacggtggcattttctttgcgcggggcccgcgtgggcccgtctgctgcaaggacatggccctcgtcatcggagcgggctggtttccttttgcctctcctatctcactgcttagagcgggaggcagattcgggggtagccgcagccgccgcaccggtgctgggagagttccaggcccatgcctccttcttctgggccaccttgtccgccagctcgaagagctcggcagtggtcttgagctccttggaggcgatcttctccagcatgcgattatgccgcacgctgttccggaatgcatacacaaccgcgtgggctgggatgcacggaatggtgttgcggacctgacagaagtgttgtatgtacgaacggagggactcatcatccttccgccgtacagcatgtaggtccacctcttcccccgggcggggatatgtgccctggaagttcgtaatgaactgctggcacagatcctcccaggagtgaatggagccggggggctgggtcatcaaccagccacgcgcctgacccttgagggccatgggaaagtaattcgccatgacccggtcgtcactccctgcgccacgataaccgtggtgtagatctggaggaactcggagggattgatgctaccatcatacttctccgtaaggttggggcgaaacttcgggggccaccggacattccggagactcgccacaaaggccctacaacccgtccccccaggggtgagtgtggggggagggccgcctcgtgaagaggagcgtggcgctccagatgaggaggcgccttcccccatacgggtagctcggcgctcgtctcggcgtcgctcgatgttgattcgagcgtcctgcgtcccgtacaggccgtcatggcacctccggctttccgaggcccctgacgatgttggaaccgtggaccgcctctagatcgtggccgatcgacgagcccttctccttgccgacgaggagagggtgaccgaggtacgcgacgtaccagcggcagcggatcggccactcgtggctaactgccactgggtagtagtgaccaagttggccacgtcgtccaaccagcgctgaacaggagtctccagctccgggtttaccgggggatgccgcagaagggcgcctgctacctgaagcgtgccttggggcaaaccgccgtctccatagtcgagacggcagcgtgccccggcgcgtcgcggcctccctccgccagggggcggagagagagccgaatcactgaacgagtgggatcctccctccgcgaaggttcgcggcggggaggagttggagaaccatggcgacggtgacgaggacctcggctctcgccggaatccccactcccggacagggtgggagtaaatgccaccgcctcctcctctactttcaggacctcgaccatggtcggctaaggcctggagaaaattgggacgaaagaaagcgacttcctctcggaatgcgcaaccgcccctacttggcgcgccagctgtcgaggagagatcctcaatagcggggaatcgtgagaccccccatttgtgagttcggccgggggcggaggctcatctcttggaaatcactcgctcgtccctaggattaccggcaagcttgcacgcagtcggattatacaggttcgggccgctatggagcgtaacaccctactcctgtatttgggattatggatgagttttacaaagatttcttcactctagaaagcgcactcgcttcctctctttctggagttcaggttttttgggcgccttcttctatctcagtgggcagggtcctccttttatagctcaaggggataccacatgcgccgcctctacctaccctctatcggagggggatcccactccacttttcctgggctttaaaccgtgccttctcccggaagctaagcaacaaccggttctcgagtggaaccaggcgctgccccccgcctgacacgggggacagccctatcattccctcataaatgaacgatgacctgtgacagcccttcctcgagtgacgctcggacatgacgggtcatacccacccccactccgccgggtacaagggcgacgtgaggacatggttgccctatccatcggatgtgacggtgtcaggccggtcacatccgttggacagaggttagctaggcgcgccgcacgtctgcccttaccgcattaaatgcggtgagggacagttggggcgtcgcacttttatggctgttcagcctgtgctctcgctctctccctccgctgcgtggcagccgggtgagggcctcggggcgaatccgcgggatagcccgagggggtgacgccatgcc

SEQ ID NO: 44748 - DNA, 12782 bp, Oryza sativa
gataccatcactccacgaaatgaagtttaaaagccatattgtgagtacctgcacgttggaattttctcaactagatgtggagatgaacacgagggaacacggcgtgtaccgcgatttcattatgttattattatgagattgcatctagtaacaagaaaatgtatgtgttagacaataattatgaaactgacggactaaccatccataccgacaacatagtgtgtgccaccgctccttttcgatacgtacaatgccctactatacgttttaattttattcctcattagcatttacagagtacgttaccatgatcgatctaacaaaaactctacttaaggcgccgaagaattaactaattaaaaagtgattttacagttcttgatacgatactgaaagataccgtgttttttatgtaaaatttaatacctcgcgatatcttcaataataataataatagaagattaataccttcaataacagtagaagatatcaaatttacattaaaaatttttggtgtatctccgaaggattgtaaaatttctcgtgattaaatgatagtgtagcatctgaccacgatcgaatcatgccagtttcagagcaaggcggcgacggtgacgagcttctcgaactggcgcgcccggccgcttctgcgacgtcggggaggcgaacggcgtgggctggactttccgttagtgggcctcattcaggcccactgttatcaccgccgatccacatttccgtcaataaaccgacagttgactcagatgttagttcaaagcattggccagagtgagtatatttggatctgtaataacaatatttactttacttgcagtttattcacgtgagctaaaccaacaaaaagagagagggaaaaaaacgaagacgggatacagctggggaagaaattagggtactcaactctgaaaaatcaaaacgaaggctagctaactatgatcgcaaccagagaacgtacgtactgaagagggttaactagggggctctcttaattaagggataatcgctggataatccagtccagcgaactgaagtgaagaagcaagcatattcagtgcagccgatgaggagtaggaggagcaggaggagtagaacgaggaggaggaggaagcggtgacttcttcatcttgctgatgaagttgacggcgatcctcatcatcttctggaactggacgaggctgtgctccaggatgaccgccatgtcgccgttgagctccctgcagctgtacgttcacatggtgacgtcgttgatggcgcgaagcacgagcgtcttggcgacctcgtcgtcgccggccttgagcgcggcggcggcgccgtggatctccttcatggcgctcgacaccgtcacgctgcagttgtcgaggcaggccttgaagtccggcacggacttgttgaacccggggagcttcccctcgaacaccgtcgccgccaccgcgccggactccgtggcggcctccatggcgacggcgaccagggacctgaagtccacctgccccggcgcgccggcgatggcggcgccgtggttcgacaccgacgtcagcaccgtctggatgtccagcaggcggtggcccaggtccttgacgcacagcttggagaacggccccgccgtgcacgccgccaccagcgggctagaccccggcgggaggcgcgcctgggcggccattgctgaggcgcacatcaggaccacgacgaacatcgccatggacaacaacgacgacgccatttaatttccttgtcgatcactctgctaatgaagcttttctagttgttattcaagatctgaattacagtaaaattcgatcaaacgcaataatatatataagctgaagagacagatctgttggtttgatcagtgagtggttcttctttgtgctctcagctcgtcgccgtagtcgctgaggctgggaggggttttctctggatggtgcgtgcatgcgcgccatgagtggtcgcgcgggagtgaactagcagaggaagcgggccagcttgtgcgagtttgccgcgctcttccctctcgccgtctcgcgtcgcgtacccgcgcccccgtacgtcaccgctgtcacggtgtcacattgacttttctagttgtgtggagtatgtttctgcagcgcttgtactctgtcagctgattgttgcgagaagaggtcggctaagccgtgtctcgtagactttgatcacatcccttttatatacagtgcaaagtagctcaaataatttcgcatgtaagtcccttttattttctattttactctttatattttgttgatttaggggaaaacttcaatattttacaatgaacacctcaaaaatcatgaacatttataaaatcacattccctcctctccaccggcaacttcctctactgaagcccctctctgccagcgccgctctccccccaccccttctgccgatgacactccccccaaaacactgatgatgctagcttccatccccatccgccttgtatggggccatgccatctcctaacgtgctgctcgagctgtgcctcggtccgccctgataaatcctaacgatgaacacatgttttaattgggctcagcagtattcactaaatatgggaaaggcggatgtggcatgaaatctctgatgtgtaaagctggggctaaacaacaactaggcacactgtgaaagccctaagggtactcacagtgcaagccacaggtatgaggagcctggactaggtcacaagttagaaatctctatctcacagtgaaaagtggctctaggatgacttaatttatcatgtgctcccttgtaattttttactttaatactcatatactttttaaaatttagagagtagtctagcaatttgcatagaacaccctaaaaatcagagaaaaaaaaatctactccctaacctcttccccgccacccacccgtcactttcatgttcccctcgcttcaccggctttaccactcacatcgtcggtgatgagctcctcagtggcgccatttctcccctctctcttcccggtgccacctctatccggacggccgtcgagtatattgaaacagcaaaaaggccgaaggcaactccgacggcgcgtcaaggaagccacgaatgggtcaaggcggccgccaatgccgtctcgtcgagctccgccttccgtcctctctttcttctccggtaggtggcggcagaggtgacggcatgaatctggcgaccctcaacggcgtggagtgagacaacacggatgtggcggtgggccttgatagcagaggactccaaggcaagttaatggctgacggctccgtggagtggccctctacagcggaggaccccgaggtgggccttggcggtggacctcgacggcagaggactccaatgcaggctgacggctccgtggtgcggtggagtggccttggcgggggctgcagatctggccgtagcgatgaggttccgcaacggctcgccgtcggccagtctgccgccaccaggttcttcctttctccagtcctcatctcctccccagctcgctggcgatttatggcgatcacggaagccacttaaggcgaggctacagttgtaatctccacaatgcgggtcgcgcccatctatcctcatgccgcacgccctcgatcggatcaaagaacctttggctcattttggctacgcatagtttgtttggtcactataggagcgaacgtggagtctaatctactacgtggaaggtcgaggggcgaacgacatgtcgacgcactatgaacgccctaacattgcagcacattgatatctgatattttgtctatcgggcttaggttgatggacagtagcagcagttgatcatatattgcacttgtttattgagttgcgcgtttactcgtgtaacgagattagaagtatggttaactttgtgtttatcacgcgttctcattggatgttatgcatagtatatctaccgttgacaactagagaccttttacagggtctgtattccaaaaaaagtagaaatccaacgctccataatgaaaggtaccctgtaaaaggtatttgagtattggcataggcacttaggtaccaagggtaaaaagataaatttgctagtagagaggaaaggaaagagttgtccgtaaattcagatcggtaccgcgtcggtaccagttaagttgcatggtactagcattaaagttctcatttacgtggttttctctagatttacatttttgtttccaaggacatggtagaactcttcccattaattctccattacgttatttgcatagttattttgatatttatattttgttcccaagaacattaaaatatcactcaaggtttacgttttaagttttacattttatttgtggaaaaaagaaaattgtagataaaatattcctaatgattgcgtccatctgaacatgctatgttaggttaaccaacaatatcagagcttctctcttgaccctatcttcttacaggttcacctattcaaaccctagaagaagaacatatgagaatatctcattttagtcccttatatgaaggaatttgttaactatgtaaataacgaatcaatcgtgcaaataagtataggagcagaggagatctttcccgatgcgcttgcacctagccgtcgatcggcccatcttgaaccctcaactgtgccgatatttctctggaccaattcaaaccctagaacaagaacgaagccggggtcaaagaaatgaggcgttgatctttttttttcccggtgcagaactgcagatcgatcgatgcattaaattgttcgaaagatttactttgttttctacctaacaattctggtgattgcacccaggtattcgattcactcaaaatgctccaggtattcgattcactcaaaatgctcattttttagtagttaattactccattgctactagttatgaaaattttattccatacttgcccctcttttaatcaatggttcacattgttctacctctcaataccttcaagtacctcgcaaacaccgtaaaaggtctctgacaactattataccagttgtgccgctgaaacccgacttgaaacccggctgtgtgtgttgtcaggcagcaagaaagataagacattacttacaaatcaccgacggcatgtgcgtacaatagacacattcaaacatatatactgcatctatttgatgcaatgcaaagatttatgaatgaattgagagggaaagttagaattgtctaataaccgtcatccagtttatttttatgtcttccaactagctcttggtatgcaatgttaccatacatctgagaagtagtaagatattatgcgcggtgatactactatgctcttaaaatcggtttctaaggttattaaaaagttattaaaaatttgaaggtatattgcttcagttccatgcctccttttgaatgaatgaatatttcaggagaattttgagaggaaattaacgtttcttgtaaaattcttgttttcaatatgagaatttctagcatcatctttttttcgtcgggacaatacatgaaagaaggcggtccgaatttcactagagtttaaaggagtttactacataaaagctcgttaaaccagttttgctgatgaaagtcgtattctcggcgcttacaagttacaacgctaaaaactacactttactacaatcgtgttgctagattagactagcatcctgccaaattaaccacttgtgtctgtgatccacaggccaacaggcggagtttcacagatgcacagaaaatacgaaaaggtggtccggtccgtcgtgagacagtcagagtttaaaaaaaccgtacggttattttgattatcatgtatagtaacctagctttaattttttttcctgcaacttaacaaaagagtagaaattccggtctgtggcatggaatgaccgttcaacggcgcatgattaaagggttggcgtgtcagcgcatttcagcacacactgtcgaatttctggagtattccttcttattggaaatatatgggccggccggcaatatatattttgtaagaaaaacatcaaaacaatcaactgtacacaccctcgcgcgatctcctttacggttctactaccacatataagcatgcgtgtacacacataatatgcaccatgcatgcatataatcacatgagtaattttatagttcttgagaaggtatcatgaggtatcatttttttctatcgtagatttgatatctcttggtatctaaatactaggaggtaccaaaaatttaatgtaaaatttggtaccttatgataccttctcaaggaccgtagaattgttctaatcacataaaaactgctcagtacatagttcttcacaaggccggccgaatacgagaggtgatcgatcgacgattcgaagctagctagcgtcccatgtgttgcacggcgggcgcggcggcggcggcggcgcggcgctccatgttgaggtgccacccaagcttggggtcgtagccgcgcgcggcgagctccctgtactcctggatgagcgcgcatggctcgcaccagcagtggatgcagcagtcgccgcagggctcgccggagaggccgtactgggcgcgcatcttgccgcggtaggtgcaggtacatccactggaacccggtgatcacggccagaaacacgtagagcgcgccgctgtggccgcacgacgtcgaccccctgtccacgatctccgccaccctcccgaacgtgatgcacggacaccaccatgtcatgcaacctgcagatcaaaatacatgtttgtttaggattaattgattaattctctgtaatccatacactacttgagaactgatctttactgcttggtcgaccgaaaaccacaatagtcccaacactgaaaatgttttttttcccggtttataactccaacagaaataaatgatctttagttctaaatatcatatttagttctgattcaccttctaacagggcctttcaggggctgggatctttcgtcccggcctatgcatgcttgccatggtatggtgtggccggaggcgcgcgccgcggcggcgagaacgtacgtacataggccgtagtcgtcgaagcagtcgcagaggccagacgaccagggagcggagccgacggggacgccgggcgctggcccggccgttggcttgtctggctgcatctcctccttaattcggttgcccctgctagctgcaagttcttgtgatcgacttgttgtttgcgctgggaaactgagcacaagctagctagcgggcgggacgatgctcatatatagcacgcgacaagttgcattggccccggtgtgatctggacatatctggttcggttaaaccaattagtcattgaggagaagacgaaggaaattccatgggacggggcctaaacctcgtcctctgtagtcgtccctgttacgattttgacatgcagaggacgacgtttaggcatatcgccttttagacgatatgatatgacatgatatatgcatcaagattacattgattagtcaccatcctgtccgttgcacggattattattgactaggcaaatggtggcagctgtttcattggcatccgggagaagtagtgtgtttgtcgataacggcagatccagtgcaattaaagagtatttagatgcatatccagttcaattcaagagtatttagatgcatatcgaatacagtatgtcatacgtatgtttataaaataaaaataaataaaaataaaaactgaacatgtttccgatgctttaatatgtcgtccgtatttgagtttgtttttaagttcgttcatttttaaaagtacataagaagtcgtataagaaacccttttaaaaatctcgcatgctaatttagaactaaagtcggacttctaattgctttacaattctcaccagaccgtaagaaagcaacgtgcaagatatgatcatcatcccaatgaggtttctggattagatatcaatactatcaaaataaaaatcccatatatactttttagaaaaaaaattaacaacaatacgattaaaatagtcttcacccgttgtaacgcacatgcatttttttcttaaaaaaaaaggaaaagagaacgtattcgacctaagaagcaaatgactttccgttttcggccatttgctatttttgatatatcctttttcggcccaaccacacacgatcaatccggcccattaccaaatttggccacacgttttcagactttcttttttttgtaattttcctgtggtctttattactccctccgtttcatactataagtcgtttgactttttttttctaagtttatagaaaaatatagtactagtatttttaacaaaaaaatatattataaaaatatattcaatgctagatttaatgaaactaaattgatattttagatgttcctaaatttttctatagatttgatcaaacttaacaaattttaattaggaaaaaagttaaatgacttataactagcatggtggcccacgcagattgcgcggctagcatcattatattttctcttatataatagcatatatgttttctcattatattattcaaatatattaaaatgacattataattttaaattttgcaataactatacgaaactacaaatgtgtaatattcatattgtattttatatacgtgttagttattaattatttttaatatcaaattttagttatttgtaaattatatatattcctatatgtactctagactcgtcttttaatatatttttttaattccgaattttttgtaaattgtatttctatatagactctaggctcttctttcaatattatttattttttatttttgattttttattatttctaattatatttatatgtggactctaaactcatctctcaatattctttaattttgaatttcagttacttctaaattatattcctatattgactttaaactcttcttcccatgtttttcttaattttgaattttagttatttgtaaattgtatttttatacagactcaaaactctacttttaattttattatgtttattctgaattttagttaattttaaattcctatatggactctatactctacttctaatattccttattttttaactctgaatttcttttttttcttaattgtatttctatatggactctatgctctacttctaatatttcttatttttaattccgaatttctattatttcctattcgtatttctatatggactctatactctacttctaatattccttatttttaattccgaattttagttattttctaattgtatttctatatggactctagtctcctcttctaatattccttatttttagtttcaaatttcaactatttctaaattgtatttctatatggactctagtctcctcttctaatattccttattttttaattccgaatttcagctatttctaaattgtatttctatatggactctaccttttctttttctccgattaatgtgagagtttctaggccatgagagcgaacgtggaggctccttttctattcctttaataatataataatagatatgtaacagagggagtatttaacaggccggcctaattcatccattcagaccgaattgggctttttctcttttacacacatgcatataaagtttgtacttagtccctcatattcagccatgtgtataaaatttgtatacgtatgcatatacttagaattcatacatataaactttgtattgtacccaatacaaagtatatacatgtgtatatacgaatagagcggagactagaagcccaatttggcgaccgcggcgagggctcaggaaggcgacggcgaggacgggagctcatcaggaggcaggagctcaggaagtcgatggggccggcatattttaagttcacttacttcaaaacagtcattcaaaaccaagtttattaaacatatgtggccggccggcagctaatttgaagcaaatacaacagatatataagaaatgggctgaagaacagactcgacgaggcactcatcttaagtagaccacccgtactattagcgtcgcatcggcgggttgtgcttgggcgggacgtgctggttgtttccgagccagccaagcgagggtttgtagccgaggctcttgaggtgcctgtactcctggcacagcgcgcactgcaggcagagggcgtggacgcagcagtcgcagcatgggtcctcggggaggtggaagctgtcgcgcatcttgccgcggtagcagcaggagtagaggcagtggcagtgggcgaagaagccgagcagcacgcacatcacgcccgccgcgcagcacgtcctctcccccctcgacacgatctccgcgctccgcccgaacgtgatgcacgggcacaccgtcgtcaagcaacctgcatatatataattagtttgtgtcacataaagacgtgaatattaaggaatgatctaatatggtaccaaatgttatatggtaaaattactcaatcaatatatatattccgggaaataagcttaaattagcttagaattaatagatggtctatacaataaatgcaatatatataatctggtgaaggacgatcgatagaatcatcgcaagtagtatagtactgatcgacaatatggaagtaatatatacgcacaaacttcgcagtcattgaagcaggcgaagagtccggatgaccagtcattgtgttgcggcctcgccatctcctccgatcctctccttcgctagtgcgaccactgaccagctgctgctgttgtgatcggcaggcttgctagctaggagcgatgagcatgagcttagctaggagcgtggctcttatatagcagtagcacgatcggtatgcatgcatgtttactgaaactttaaaacgatgatttttaattatatatattagcccgatctaactagcgtttggttgacccaattaacttagttgactccaccagaaccgaccggcaacactagtcaatgaggcagtgaatacctcggacatgacctagatcaggtctcacgagtcatacaatgtcgctggcagtggcagtagtacttcctcctccgttaaaaaaacaaaaaaaactaacataataataatataataataatataggatgggacatatcctaatacaacaaatcaatgtctatattcgtgtttgggttttttttttatggatgtagtaagtagtaccaactattatatattcatgccttagaaaccatgtttattttgattatcatcttaattagcgtgtggcataccaactatgtgcttgacagttgggagcttgggggatttcacaataactatgtacgttcacttctttttcgcgtatattgaagttccggtcagttaattagccaaccggccgccggaatttcgactccttcccaatggctatttcctgaccaatcttttcatactctatttttttattaaatggtgtctcctaatatttttttaatctcaaatgattaagaatttctttcaacgaggaaaatgtcaatcgatcaagatcaatatatcagttgcaagttgtcaggaaaatgagtaaaagagacaggttctgttcggcttgtttacacttacctacttcttggatcggtactacaacattagaacattataactagctagttactaacttaattagtaccagagttaggttaagatagtaccattagtaacatatttgtgcattgattgctggcaacagctaagctaggcacaaatgtactaggattctaggaactcatgacatttctgtgctgtcgttgcctgaaaaatgatccgttgatttggtcttagaaacctaccccacgagatcgatcttgagctcgaaaacatgagcccaatcagctcattacatatgtgctactgctactgaaagggctttgttgagaaaactgtgtgcttgaaacagccaaacataggcaggatcacgcctgatctgataggccattataagggcatactcagactgatgacgttttcaaccataatatcattatttgttaaaattgataattatgtggctacatttagtttgttattaaatattggcaatgtatatggaattttggcaacattttaaagccaatcctatcaaaattttgacaatgttatcaatttgttaaaattttggtatattgccaagttttggtaatatttattttggcactaatctgaacaaactctaacttgtaagtactgtacaaacaagacttccgagggtctgtactgcaggtcaaaattcatgcaagagaatacttgccatgcgaaagcctttcgttatatattggtatagtagcttcactgcttatgactcactcgattagttaagcacaataattaattgttgagaagaaatggagcaagggagaggaaattctatttgggacttgggcatattgttttggaactgaatattactacgagtagtaatgagagttttaggccccgttcgcttcaggtggcgtgcaaaatgtgatacataattagcagtaattaattatgtattaaacttcgatataatatttttttaaaaaaaagtacaagggagcaaaatgttgctcactacaagtagctcatccaatgagataaccggacaggactccagtgtatccggatattgggccgagagcccagatagcccatctggcgacatgccctccttgggccggatggtccatcaggagagcagctaaagataaaatatggccgcatgctcatcgctaagcgaaccagaagggcccacccaattttgtcgtgcggtaagggtgaggaatttttttatttttaattttt

SEQ ID NO: 44749 - DNA, 4537 bp, Oryza sativa
  unsure (1)..(4537): unsure at all n locations
ggtagcttttggcacaggcgaaaacagacgcgaagagcaaatattgttcgacattgtcgacatcccgtacaactacaatgccattttcgggcgtgcgaccttgaacaagttcgaagccatttcccaccacaactatctcaaactcaagatgcctggcccgacaggagtgatcgtggtcaaggggcttcagcctttggctgcttcaaagggcgatctggccataatcaacagagcagtgcataatgttgaggccaaaccacatgaccgggcgaagcacgcgccaaagcccgcccctcacaacaaggtaatcaagatacagattgatgatgccgatcccacaaagcttgtatcgctggggggcgacataggcgaagaagaggttgagaacatcctagaggtgatcaagaaaaacattgatatcttcgcctggggccctgatgagatgggaggtgtttcgacagatctcatcatgcatcaccggacagtcaagccggataccaagccaaggaacagaagctacgcaagatgtcagttgatcaccaagaagcagcaaaagccgaagtccaaaagttgctcaaggctagggtcattcaagagatcgaccaccctgaatggctggcgaatccggtaatggtgcggaaatcaaacggcaaatggcgcatgtgtgttgatttcacagacctaaacaaggcatgtccgaaggatgatttccccttggcacagatcgaccaactcgtggactcgacagctggctgcgaactcatgagctttttggatgcgtactccggctaccaccagatccacatgaacccggccgacatccccaagacagccttcatcacaccattcggcaccttttgccacctcaggatgcctttcgcctgaggaatgccggggcaaccttcaccaggttggtgtacaaggtcctttacaagcagttggggcgaaatgtggaagcttatgtcgacgaaatcgttgtaaaaagccgcaaggctttcgaccatgcgtcctacctgcaggagaccatcgacaacttacgcgcggtgggtatgaaactaaatcctgagaagtgtgtttttggtgttcgcgccggcaagttgttgggtttcctttgttttgaaaggggtatcgaggagaaccccgagaaaatcgatgccattcagcaaatgaagcccccgtcgagcgtacgcgaagtacaaaagctcgcaggccgaattgcggcactcaatcgattcctctcaaaggcagccgaaagaagtttgcccttcttcaaaacccttcggggcgcggaaaagttacctggacacccgaatgccaagcagcgttcaacgagctgaagcaatatctgcaaagcccgcccgcttagatcagctctgcggcggagctatctcccttcggcttgcattttgtcgcccgcactggtatcaagtcccaagtgctagctgacttcgtggccgaatggacaccggcattcacccctgagcccgagcccgttgaataaccctgggtgatgtattccgacggttcgtggtcgcacaagggggcgggtgttgcggcagtactcacttcgccggggggtgtgccgattcggtatgccgcaaggctgcagttcaacacaaccaacaacgcggcagaatacgaagccattcttctaggcctaaaaaaggcaaaagcattgggggttcggcgcttgctcatccgaaccgacttcaagttggtagcaagtcatgttgataagtcctttgaggcaaaagaagaaggaattaagaggtatttggaggctgtttggtctatggaaaagtgcttcgccggcataacggtcgaacacttacctagaggccagaacgaggaagcagacgccttggcgaaatctgctgcttgtgtggcccacattcgcctggcatcttttttgaagtcctatacgcaccaagtgtgcccgtagagagcctggatattatggcaatcgaccaggcagaactgggcgaagatccaaaagactggcgaaccccattcgtaaggtagctcagaagcggttggcttccggaggacgaagcagaagcaaagcgcctacagctcagagccgcaaagtacaagatggtctcgggccaactatatcgctctggggtgctccaacctttgcttcgctgcatctcttttgccaaaggtgaggaaatggcgaaggaaatacactaggggctctgtggcgcacaccaggccgcaagacagtagcctccaaagtatttcgacaaggtgtgtactggcccaccgtgctgaaagtctgtgttgagcaagtcaagaaatgtcaaagctgtcagcgccatggccgaagccaaactgcgccccaatacgagctgaagcctatcgcaccaatttggcctttcgccagatgggggttggacatcattgggctattcccggtggcgcgaaatgggtacaagtttgcaattgtggccatcgaatacttctcctgatggattgaggccgaaccacttggcgcgatcacttcggcagcagtacaaaagtttgtatggaaaaacattatttgtcgtttcggagtgccaaaatagttcatcactgacaacggcaagcaattcgactctgacaagttcagagagatgtgcgaggggctaaacctggaaatcaggttcgcgtcggtcgcgcacccacagtcaaatggggcggccgaacgcacaaatggtaagatcctataagcactaaagaaaaggcttgagggggcagcgaagggtaaatggccggatgaaatgctatctgttctctgggtccttcggacgacccccacaaggccaaccaagttcagcccattcatgcttctctatggcgacgaagcaatgaccccaacagagctaggggctaactcaccaagggtgatgttctctaggggcgaagaggggcgcgagttgtcacttgaactcttggagggggtgagagtcgaagcacttgaacacatgcgcaaatacaccacaggcacttcggcaacttacaacaaaaaagttcgaccgacggagctgttacctggccatctcatcctaagaaagaaagcgaacccagtggcggttggcaagcttgaatcgaagtgggaaggaccgtacctcatcaagcacaagtccaggacgggctcctttcgcctggcgnnnnnnnnnnnnnnnnnnnnngaccattcctggaacactgcctctctcaagcgtttctatgtgtagaatgggtggcacccaaatcgccaacttgtaaaaatgtacatattgttatgtaagcctttcggcactatgtaagcccttcggcacaaaaatgcaaaaaaaacaggaaaatgaaaaaagacaaaaaaaaactggatgtgggctattatccatcccggaggcccgaaccagtataaaatctttgtgtcttttgccttcttatttgtatgattgataatttgtggaaaaaccctaaggcaaacgcctgatcagcaaaaatgccagggggcggaacgaatcggccgaagccccgttcgccgaacgttgaaaccgcaacagcttgtttcgggaaacaactaaccgaacaccgttacattcgatcaaaatgaaagcacaagtgcttccttgaacgtagaataaaacagatcgaaaacggaagccgaaagctaaaaagtcatagacctatttcgctaatacacgcaaaggggccgacacgttccgacctaacgaaagcacgagaagtgacaatgcaaaaaattgtgaaaaggaaataaagcacatctttcttgacttcgaagaaaatatatatcgaagaatccaaaccttacatcatggtacaagtaaagaaaagcgatggcttctacagcccagcttacagataaattacattttcgcccccacacccgtccttactctttacggaatggtcggacgaactaggttcgtcatcactaccaatatcatacccacccttgagaggagaagggggcgaaacacagactagactgtaacgacgctgggaaatcgcctcctgccgatcagacttctgatggtttcgccaaaagcaaaccatatcctccaaacattttgaatgaacactatcgtaatcttccaagctttgcccggggtgcgcccgcatccagccagcaaccttaaaaaccttatagctgtggccgttattatcatttcacgataaacgggccgaaacgggcatcgcacctttggcagacccttcaacgccacaaacttctcgtttttgcttcgccaattcccagaggggggccaaatgcacaattttcagcgaacatcctgataaacagtgcagaaagggcaaaaggcaaatttcatagtaagaatgggcgaaaaagagtaaatattaggtaatgcgaaaatggcgcaagcgcatacgccaaaggcatcgaccataaaaagtgactaagaccgagtcatacattccaaatatccaaaaggccattttcggctacaataagaagggtaaggggccatcagccaaatatacattgttcgcctttcgtggcaaacgcaaaaagaaaaactacaaa

SEQ ID NO: 44750 - DNA, 2301 bp, Oryza sativa
  unsure (1)..(2301): unsure at all n locations
agacgcagggtgccgagcttatcgagcacggcgcggacgtaggggatgttgggcttgccgaagtgtccctcaaggccgatgccttcgaaggtgacgccgccatcggcgagttggcggaggcgggagacgtaggagtcggcactggagctgaggtcatcgcagacctcgacgacgttgaagtcgttgaggaagagcgtggctagcgggtcggcgcgcttggctgtgtcgaagaagtcgacggtggcgttgccgccaaggcggttctcatagaagtcgaagtgcagcatctcgttgctgacgtcccaatgcacaaagtcgcccttgtaccgagaaaggaggctctcgatgcggccagagacggcagcacgtagctgtgaccccgtcagattcttcacccatgctggcgtgtactttgggtcctcccagaagatattatgcccgcgcgccactgcgtcgttggcctgcacaaactgcaacagctggtccgccaccgtatagtcctccttccccgggtatggctccgttgcataccacttgagctcgttctcgaacaccgccgcattgaacctcttgttgaaccattcctacaaattcattaattaagtacattattattactaaattgtcatatattatatatcttaacaccaaaacaactaaataacatttaatgtctatcgctaccgattggatatagcgagctgtaacctagcagccgctatatgagctgagttagcgatccgtggtagcagtcactgtatgatataacaactaaaggcgtcgatggtgccaactccgacgcttgctccacgaattacgaatcaacacattataaactctttaatctatgttatgtatcgaaatatcactaatttatttctcagtttctttgttaatgtattataaaatcattattaatgatacacatactcaaatttatgtgtgattattaaatttcgttattggaacttagcttcagttatccgtggttcgctacatagacacctgcaatccgctacgaacctactgtccactatttgttttgttgcttaacacacgggttaatttcataaatcaatgctaaagttcgtcatatatctcagaaaaaaattaaggaaagaatcatgaaaacaataacctgataaagtttgttcccaaggattgtcctgctgatggcagaaccgaatgggaaatccctggtgatctgatgcaccgcgaccttggcaccaaccacgcaactccggttgctgtccgccacgtgaacatggacaaaccgcttccggttctgttcgtgaaaaaaattacatgctggcatcatcatttgctccacacttcctcacaattaagttggattttttttaaattatccatcgtgtgacagtttttttataatggattaaaccggtctctatacccaaaagagttacacagcctaagagtcgacgaaacagtataagtacattttattaccagctgaatacggtcctccctgtgctgattccattgttcaggtgaaaatggttgcaaagaggcacttctgatcgagatcgttgaagcatttgggcttgcagtctgcagtgaataaattgcaaactgcatgacgattaattaattcaccaagtcaagatctaaactaggttcagctaaatttgtatgccaatatattactgtgctctctgtgacttaaccgtgaggaattaaattaagtatatcacctggaaatanaggacagaagtttcttaagcgtagttgacgggtgaaaccacccttggggaagaccaacaggtcgttgtccaccaaaaaccttcccaaggcattgagatgcaacgtttgctagcgtcaatatcttggctttcacatgagcagttggtggcccatcgattttcacccagcctagagaaaatcaagcaagcaattccacaaggtaattttactcccaggaaatgacaaaattaagccagtagaattgcaggtccatcagaaatctgaataccaataacaaaatcaaattaaatgaaaagggaaacaattatctatttcacttgaatatttgctagtccaataatttttaattcacctaaaaaataacgattgcttgaagaaaactttcaagaaaatgctcaacagaccagtaccaaatagtaaagtcataaaatcagtaccatgccaaaaaagcaggggagcatgcatgaaaatgtgcgtgccaaacagtagaaaacagggcaggaaaattcgcatcgttggttcaatatggcagcatatatatgcacgatacgatgtttgggactccccgttttcttt

SEQ ID NO: 44751 - DNA, 2697 bp, Oryza sativa
ggtgttgatacctctttcatacagagtttatgcttcacaacctcctataatatggttcaggcaattgttcgccaagataccctttgccgtcattcacttcaacataaaattactacgtactcattcaattcaattcgttatctctagaatttgttttcaagataatccatttggtaattaatatttaatgtttaagactatcaattgttgtactgaaataaaattataaataaatctaataaatttgtgatagtatttttcaaggtaaatatatgtatagctttttaactaagcattttagaaactactagtcaaatttaaagggtttgatcatatctttttttctaaacatcaaatacttcctactagagggagtacaagataagcaagaaattctgcatttgtggatagcaccaacacactgcaaagttgcaccagctccatgtaaaattttcagatcaactagtcaaatactcattctttgaaaaaaaaagagagaagaaaatcagtttcactagttttgaaaacacgagcccaaattagaagacagaggaccaaaaccagaagtgacgaacaaaaaatgaagtgtgatatatatactcacaggagaagctgtatactgttgccgcggacatataatacaccacaaatgccggcaaatagttgccttcgtcctctgttctgaagtccgtcactttgttcccccagcgcaggatgccaccgttgtacagtgcaggttcaggatgcgatttgcactgaaaaagaaagcgggggttcaaagctcagacgcatacaggcccatagttttgtttatgcttatacttataagctaaaataaattttcgtcatataacatttgatttttaatcgtgaagttcgtttataaaaattttacacataattcttttttttacaaatgtgtaagtataagtataggcgaaacgacgaggctggtaaatcgatcagcataggagatgaggtagagaggaagagatctagacgatgcgttgcgtacctcagtgtaagctctgtaatcatagcgcactccatctgcaaaacagcaaatttgttttccttttctgtcaggcgaaatccataaagtcgggtgccaaaatgagcaggattaattcctcccatggatcgattggttaactcaccggaggatgcagcagggcgagctagcaagacgatgagcagcagcagcagcaagagcaaagccttccgatctgcagggagaagaggcgatgatgatgacgacagtgcagcagcctccttgtgcttcttgccaatcgccatagttcccgtcgtgagtgagggtaacacgagcacacagagactagctctctctgttgtctctcgtgatttcttcttggatcgacgtgttgatgtgtgctcacacggtatttataggaagccaagcaactgtacagctagctctagctagtgtctagataagttgaaaagaaacgcaaattttactacaagatattatggttttagttctgaacacgataaaagttaacttttttttcagaaaacagttttaaagtttgtgaaaatttgctacttttacattgcacacattaaaatatttatttctagttagatagaaaagaaaaatgatgtgagaggttaaaaatacccatggtttccacatctcagctctcttattcctcttttcgataagtttgaactttcatattttgactaccaataatttgttaatgcttctttttcttatggtacccctattaaattttataaccttattgtaattgaagttaaagttctacagttttgaccgaacgagaggggcattaagtttaaaatatttttaaaatgactatattttgtagcttatttcacatggcatcaaaagttcaaaacccatataatccctttgataagcgatgacccataaataacatgtagccatgtaggtttgtaatgtgtcagccatacatatgttggagcgcgcaatcaagctgaatgtagttgcactaaaacttgtgcattttgtaagaggtaaagcagaggagcaactatttttttttctccaagcatgaattttagattgaaccctcttttcttaccaaaagtttacgttaaacccctgaaacacatatttttgctttgacaactttgtatttgaatcttttttttcaataccattcttatctttgggtagacgcaggcagagacgccgagggtgtcaacgcagacacgcagtggtgaaaagatcttagtggggtacactgaggcctagttgccgttccggcttaactgatcgcgtgaaaaaatccgctaatgattaattaagtactccatctatctcttaatataagagattttaacattttacttgtaatatttgaccattcgtcttattaaaaaactttaaaattattatttattttttattgacttacgttattatccaaagtactttaagcacaacttttcgttttttatgtttgcacaaattttttgaataagacgagtggtcaaaaagtgtaagcaaaatgtcaaaatttcttatattatgggacggagggagtattaggtattataaatttttaaaataaatttatttagctttaaaaataatttcatatataaagtatttcacgaaatatgctgaaatgcacctaagactaaattagtttgatgacaacagtaaaaagatgctataaagta

SEQ ID NO: 44752 - DNA, 703 bp, Oryza sativa
ccagcttgcactgtagcaatccgacaaaactagttccttgctttgatcgacatttagagtaatcatagtgcttttagcaaaattgatttgcagtccagttgccttggagaactgcagcagagtctcctttagagcaagaacatcagcctcctccgcacaacagataatcaatgtatcatccgcatactggatggtggtacacagcctgtcttggtagattgcatgtctgatttcagtatttctttcaagcaatctttgtagcacatcagcaactaagacaaacaaatatggagatagggggtcgccttgtcgaaggcccttcttgcagcgaatccatctttcaaggactccattaagaagcactgcagacttggaggaggaaagcaaccccttaatccagctaatccagttttctgggaaacatctgacaacaagaatcttgaaaaggcttggcccaatgaccgaaataaacgcctttgcgaaatcaaactttaccattaatggttgggactttccttctgaagcaggctggaatcaattccgtccaatttttaaaattttaatagatgcatctccctttgaggaaaccggtttggtctaaatgtatcatcatcgggagtaccctttgcagccgtgttgcaagcactttggaaagaatctttactgagcagttctgaagagagatcggcctatatccatcgac

SEQ ID NO: 44753 - DNA, 966 bp, Oryza sativa
gcgtcggcgtggtaaaagtggtcgcagtagctgcgcacccagccctcgatggcgagccacacgtcgatgccgtcgacggcgtacgggtagtcctcgatgtggagggacacgccgccgcgcgccttggggtccctggacgccatccccctggttggaaatgttttagttaacaataaattctcaaatcaattctactctctctagtcaaaattattttacgtttaaaacaacaatatattcgaacttttaacattcccagaatttatgtaagattttttattaatatacagttgattcatggaatttttaaaattttatttgaatcttgttgtcaaatatttggctatcataaaatgcaccaaatgataccaagtgtgttgctacgggacattaatgtgtacgccgcaattgtaaaattgaagtggctaggcggatcgaaagccgttgatctcaccgagaagtaactaaaaattcagacatgcagtaaattaagaatttgtggttctattcattggcaatgtaggaattgggatgatgaattgattgtattttgtacctcttgatgagatcattaggcagggactgctcggtgaacctccaatgggcatagatatcggaggacatctccatggagtacttccccgggtacatggtcttctccaggaggccaccggcgttgagcagtatgctcctggccaaggtgttgatctgcatgttgtccttgaagtgcgggtccaggagcttgtggatcgggtgcatcgcgctcagctgcctcctcgtcgcgatgatgaacggctccactgtcgcgtgcgtgaacagcctgttccattcatggattaagacggtgcatatttttatggtcaagtcaaatattttgttttcagaacaagaagaatttcatgtcagcaagcattcagagaattgtcttgtttcagaacaagaagaatttcatatcagaattcagag

SEQ ID NO: 44754 - DNA, 6602 bp, Oryza sativa
  unsure (1)..(6602): unsure at all n locations
nnnnnnnnnnnnnnnnnnnnnnnnnnnnnnnnnnnnnnnnnnnnnnnnnnnnnnnnnnnnnnnnnnnnnnnnnnncaaactttttaacccttgatcaatggtcatattggaaaaaataacttccatttctctatagagacatattacattcatgaatggctttattcattgaaatacatgaacctgtgtggtggttataaaactctcaatcacatggggcttaatggtaaataatgtcattgtccacaatggtgcgttatattgccaattataggtcgcacacagaatttcaataagttatggctgtcctaaagtggcccaccttaattttttttcctattagttcccttggatatctgttgtcaagtttcaaacttttgttgatattcattcctgacattcattatacctaatttgtgtgctaggcaaagtaaaaaggcatatcgtcttattgatttctcggaccatttgcagataagtgtgtaagtgccccattctcctgcccttatcttgtagcccttagtgacatggctcatctggatttttctttcagttatgtcctaggtgctgtttttctgcagctttgccaagttttgctacttgcggaacatccagttatccaaaagctcatcgaccccagccttttcatacatcgttttacagaacgtaagccacactaaattgtattatttaaatttagcggctgaaaacacatgtgccatttcttgtgtacatctctacatttccatgcactttgaatatgcacatttggtttcttcaatgtggggagggggattgttcatgtcatgcaattataagaggctgggccaggctgttccaatgttggtacctgccacatttgccatggagaacatgttggagtgcaattctgtttggaaattgcaattacaacatgaattctgattcttaaatcataggcgctggttgattgatttgcagaattggatcgaaattgtggtattcgagtcctgaatcaaattttactcgaaacagtcataggctcttgcatttacaccccagtgagaagtggactgatggatggaccatttgataattcttgcacaaagatttatgtagcttttgactaatttcttcactttaatttatctaatctattcaacgtgcttttacattcttgtgaaaaaatatataacaattatttaaaatcacatatgatatttattttgaactatttgatagatttgtatatggtagagtcatgtgtagtagtcagactggggcatactatagtcaaactatctcctcgcttgtgttgctcatgtgaaggagttcaattgcaatgcaagctccatccttttatcccccccttttctgagatctttgcaaggcaatgccagaaggcaattgcttgggttagtaaggaaaccaaacatgtttagtctgattatttttgttttttgtgtcactttgttggttttatctgtaggtttactggggaagagggacaatgccgtatcagatacggctttacgcattgtagctagcatgaagcgagactggatgcaggctagcatatttttctccttccttctttaggttcttttttgtgattgtaataacttgacttatgttgcagactgggaggaaaccaagtggattgtgtggtgcagcactataaatcgctgctctctctcatggatatgattataccaaggcagatattgtaagcccaagtacttttgtctgatatacttatttagaattgtattctgaagtcttatgccctccttctgtatcagttagcatgtatcgggcacatgctacattttgtattttttataattggacatgaatatgattctatgctacagcatataatgacataaatttctgttttatgttttttaggttgctgttgtgcatgtttgcgaggcaacactaactaagcgcttgatagagtttgaaaatacagattcgggtagcttaacggtatggattctctctccaggaaattgccaaattcataggcgctgttacttaccgcatacagatgaaaatttgttgcaacgatgtatttgtaataaagatgggaatgacagcgctaagttgattgttggtacaacttttccctctgaaagtcattcttaagctgtctatgctgaaacatattgtaattactatcagtgtatggtgtctgttatggtgcaagtatttgacattactcatgacactaaagcaactattgacctaagcaagtactgattagggcagggcagcccatgtcaactagacatgcattcactttctttaccctgtccatagagctagttttaggtgcttatttttacccgttggttcagcatggtctatctggcaaaaaaattgggtattgccccctttcatgtctgttttttcatgtcatcaattcatcatccacaactgttatctactactccctcccgtcccagaatataagaagtttaagggttgaccacggttataaagaaagtaggtaaaattgagtggtgaagggttgtgattggatgagtagtgaaggtaggtgggaaaagtgaatggtgaagggttgtgattggttgggaagagaatgttggtggagaagttgtcatattttgggacggagggagtatatgaatattctttaagcaaatgaaatagtattatgctagattgtaaacgaaaatggtccttgaggtgtaaatgtgtcattgtgaagcccattaggggtccatgcaatgggcgaaggatgctgcctctgcccactactgcctaagcactgttcatggtgccttgtgctagttttatttagtttaaaaataagatgagattgaattatttatcggtttgtttccttagttttagagcaaagggcaaagggtttttgcctctatcatgcacagtacatcaggattaggattagaggtgtcttcatttcatacttaagtgattggacacatttccagctcgcattcaacgtattgtatccatgccaatttgcatttgattaaacattatattttgctgccctcttgctagattgaagaatttttggcaaaggctgatgaacaagtgcttgttactaaaatttcaccaaagtctggagaagtactttgcaagcacaaggataaagctgagcattttgctcatggactctgtgaaaaatgctacaacaaagtaacagacctttaccatgttcataatacatcagttttgggacttcattactcctgacacatgcatgactgttcagtttatgaaactgtctggtggactggagggtggctctgatcctccagctttccaacgagctgaaaaacaaaggttggaggctgctaaaaatgctaaaggaactgctgcatctaaagaggcagcactggaatcagtttgtgaggcacgcgaatctgatgttgagaataacattacgacaccgccaaaggtaatatgttcttaacatagttaagctcatgcttgttcccctatttaccatacattcttcctttgttagccaactaaataatgtgctcttttagttcattaacaagggcagaaaaaggtgacttttgatcatctagatcctgtacaagtacaacagttttgttatatgaatatgttgcattctcatgcaccacgtatatgagtataaatttacacgaaactgtatataggtcccgtttggaagtggcaatcagtaataatccgccctggattatttgttccatgcacctaaattatgattttttgaaaaactctcttatattgccttgcttagacaacttgttcctagctactactccatctgccccaaaaataagggattttgggtttccccattggtccacaaatataagagattctggagtactttcccaatccattgaaccattgcatttgtttctcactggtagttgcatcattagatgaaatctttcccaatcaaataagagggccgagagcatcaaagtaattccaccttatgtcacgagctccaggaagagactggattggatatgtgtgggatgtgggcggacgtggtttccggagattggacgtgcgatgccccgtgatggcgacgcttgaagaacgagatgagaaaacagagaaagttgatgagaagagtagattgaattcaagcttgatctttattgaatgaaagattgcttatataagcttatatgcaactgaattgcttattaaaagagataagaactaatgcaacaaaccggaaccaactaaacaaacttgagataagaacctattgccaagccggactgtagcgcgtccgaatcacgccattcatgctgccgttgcgcgatctgattgatcgccctcatcacgcgccgccgttcccgtgcatcccgcattcatacgcctccgatgatatccaattctgaccatgataccttaaccttaaactctgctaaaaaaaacctagcatacttatatattttcgaactgaaggagtatttgttaagtttatttctcaaaatattaatttaccgtgttaatcaagtagatcatccatttcatttcacccgtgtttcatcactttcaaatggggccttattttgacaaaactatagttttaagacacaataccacaaagctagtatctatttagcattgaatttataaaaagaactacatatttatgttctactataaaaaaaacttcagatttagcatctcatcacaaagctatggatttataagttctattaggacaacagtgtgaggatctaactcataaaatctatatatcttttatggtctatttagttctatgatctgtggtttaatctgcagttttgttataattttgtgaaatttctgaatttgtgattttttttctctatttattaaaacatctgcatttgttatttctgttgtataccatataatgtgtttttgtaatttgaatactcaatttaacttattttgacagaatataattggagataagcattcgacaattccttctgtgaaagttgctggtgattctgtagctacagaagatcctgaaggggaaggtttgtttgttgctgtaccatcaacgatgatactccacaagaaaattcatatttccattttaggtcccttttgataagttcattcctgctgcatgcatatttcatccttaggtaaaaatgataaagcagatgaaggtcctgaaagtctctctgatattgatgatgcggaggtacttcatcctatccatgagatcacttctatatatttcatagagtaacttatttatgtcatctttagatcttgaaagataatcagttaggctctttatgatttactacagtgctactattaatttctaggttgatgggtaccttcacaacgaggaagaaacacagtacaaaaaaattatctgggaggaaatgaataaagagtaccttgaggtagctaagctgattacatagtagcataaggactttcttattttaaccacatagtgtggttctcagctggttgctttacaggaacaagcagcaaaagcagcattagcagctgagctggcagctagaggagtggttgtggaagaggggaagaggaaagtatgaaatgtttctagtgctaccaacctttctatgccgtgtgttcactgtagttcgtgattaagcatggatatttcatatgtagagaagaagacataatgaagatggcaagaacgcaacacccgctcaaacaccagcagaagcaacacagaacatgttgaagcggaaggtactaatggtcaatacaccccgatgctttgtaaggtttttcatttacttttgatggagaataggagaggctccactacatattaatttcatataagggagttatttgtaagcagtaaagaatcagaagatgattagtgcattttaattatacttcgaatcatagtttcacaagatagtttataggataagtgcatggctttattcatatccatagtatgcctactcatgagactgtcatgtggtccctgcgctcagatgttccttggcatgttatagaaaatggttgaaacttgaaactgaatggttttaaattacaatacatcaatacatggttagtccaaacatgaaaaattgcagattttattttaaattagattttttgcttccagcatgacatgctctttaaatggtctaaagagaaatctacattaaacacctacggaatgttcatctccaccttcttttggtgctttccatgttgtattaattagatctaatcatgtgcaacaaaatccaacattggttctccaacaatgaaaaagcaggggcagatgtgccaatgtttgtggtgttggtaggtgaaactaaacacctacggaatgttcatctccaccttcttttggtgctttccatgttgtattaattagatctaatcatgtgcaacaaaatccaacattggttctccaacaatgaaaaaggaggggcagatgtgccaatgtttgtggtgttggtaggtgaaacaaaggcccataagaaaggtatagaaaactgtggacatgtttgcatcatcttaattggcccataagcgaggaatttgctccaataagcccatagcaattaagcagacaccaattgaattgagtagac

SEQ ID NO: 44755 - DNA, 1454 bp, Oryza sativa
aacccatgaacccatgacagatgcgccttgctctacattctgtggaattacagtcagatactactactgacttcattatggtctactttgttattttctgactgaaaatacatattgaattattgatttttgcgggcagaccaaagatgaagatggcaaagcagataaagagatggacttcaacgatgagtatggacaggacacaggtgatggtgaaacattcgaaggtggttatgattatcctgattacaactatgatggctatggtgatggagcctacggcgattatgatggtgttgatttttaatacccgatatatcaatgctgggtagaattgttacaattttatttgtgtgtgtatggcaacaattatcaattttacatgaatagttctgattagttgacgaaaacggagttaatcagtactcagtagacagtatagcagtgtagctcgttgatttctctggtgatatgttgagaagctgttgtagtaactgtattatttcattcagcgacctatacttgcaagttgtatattaaaacaggcctcgaagaaaaaggaaaattttgaatgcctcatgaggtatcatggtctacacattcgacaggagtggtgtgcatgtcgtcatttgcgtgaaatgttgacttaagctgtcctgattggcgagcacgtctagttttgagttgcagtgcacagttctttttttctttaatgcagcgttgaatgtttgtttgctgttgttgatgtagtctgatggtgatgaaagtagtgtgcacttcgtcgtttgcgtggctgtgttcctttcttcagctttaaactgtaactttcttgttttctagcacgttttgtaaagtgttttttgcaaataactttttatatagaagtttctttcgatgattagggctattaccttactagtggtctgaaccagtataatctatgtcttctatgtgtttgatgtcgtatcgtgtaaatcatcgaatcaacgtacctcaataccttcataatacggtccgtgggtatccctcatcgataactgttcatcgtcttccttagccgaaggcgagaaacaaaagagggaaagtcttcctcagccgaaggcgagaaacaaaagaggggaaagatgggcacggtgctttgggtttacgacttcacgagttgttgtcgccggcaaaatcttggtgagagagaaggggagagtggtggagaacggtcatgtggagtggggttgacgacatcatgagttgtcgtcgctcggtgcagctagatgaggttggttttgctggattcggcctcttcctcctctctactgcttggatttggtcttatttggtccaccttgtagctcccgacctctcgcgcacaaaccatcagtgaggatgctgccacctcaaccggcccactcgtgttggcagccgggcacctcttccatccataaagtttactgagaaat

SEQ ID NO: 44756 - DNA, 3177 bp, Oryza sativa
attttcgaatgtcactgggtggtgtgaatctattcctttgttatggcctgtttgcattgattactctattccttgataccttgggatattataatttgactagttgagctttatatatattggttcaactagatgttagatataattgcttagcaatgcttagaaacattagctcactaatgggatgaatcatatatactacattattatttatggttatatttaatggtagctcacgatggttaatcgtgttatgataattaattggtaattaaaatatgattaatggtgggttgtgagcacatggttttgaaggtcgtgctcatggcaattaaggaccggttcgcgagctactgttgtgaaacattaaccgtgccaaccacaagccagcgtgggcaacggctttaccttttgtacagcatggttcattgcggagcaccagactgagaagtggcggagataagcccacgggggtcgctggggagtccatgccttgttttataagggggtgattatgatccaggaatggtgcactgtggtgagttgtgttgtgcaaagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgggttgagcaatgtttttcgtgattagtctcacacctctcacaataattattgatgctataactggtaataatttgtttagctcctggtttggagttagatctgtacaaccgggtatggttgttcaggatggttgggcctgtgcagcatgggtgtgttgttcagtgttgattaaaatttctgattaattactccactgttttacttctcttaaatgttttgctaaatgctgcttttgcaaatgagcctatattatgccatcctttggtatccttgtgcacttgcatatttgctgtgtggcttgttgagtatgtcatatgctcattcttgcaataatcaatcaacctcagttgaagaaaaaagatccagaaggagaagacgtttggcttatactccagttgagctgcctgtgggagtggagctgaagccatcgctagaccgttattccgctgctgatttcttttcttttgcaagtgtgaaacgttattattatgatggatttgtatattaaattgtcagtttgtgtacctcggctgattcctagacgaggattttatgcacaaataagttcggaaattactagtgaatttctgggcgtgacaaaacttctttcaatattgcttatttttaattccgaatttcagctatttttaaattgtacttctacttggactctcctttttctttttttttctttttctctgattaatgggggaatttctagcccccacagcgaacgtggttcctttcgagctgtcttaataatataatagattttatttttatttcgaattttgattaatctcgtattgggttcttatatagaaacttctttcaatattgcttatttttaattccgaatttcagctatttttaaattgtacttctacttgaactctcctttttattttttttctttttcttcgattaatgtgggaatttctagcccccacagtgaacgtggtgccttcttttcgagctgtcttaataatataatagattgtaattgtatacttatatgcaacttgtgtgtatatggcaaaaaagcgagctggtacagtagtacacagtcgcgtgttttaccatcaacaccatattttgcacacaaaaattctttttacctccagatactaaatatattggggcactaaattttatattagagatatcaaatttatactaaaaagtatctcgaggtataaaaatttgtggtacaatgttgtttggtaaaattatcttgtaaggaaaatatcacaagttcgattttccttgccccggaacctacgtgattattttcttttgcctagcaccatagagttaggctgtttttagatgcaggggtgaaaagttttgacgcgtcacatcgaatatacggatactaatttgaagtattaaacatagactaataacacaacaaattatagattttggctataagctatgatacaaatttattaagcctaattaatccgtcattagcaaatgttagcaccacattgtcaaatcatggactaattaggcttagaaaatttgtctcgcaattttacatacaagctgtgtaattagtaatttttttgtttttatttaatacttaatacatatgttcaaacgttcgatgtgacagggtaaaaaattttaccaagggatctaatcaggcccttagctggccagcaacaaatgcttagcagcatttacaatcatggcagcagctaatataaattaaatcaaacatattgtcagcagcaaatattgagtaaacttttaaatggtagtacagtgtcacacccggagttttatgacttcaagaatttgctttggttaaccaggagaaaacccctgttaaccatgcatttaataatcggaattgtcaggtagaaactttttttccaaattctctttgctctgaaaatcactaacaggacttaaagagtaaatattagatcaccagaggcaatgttgctaagttaaaagtgtcaagttagattttttcttcctttgcctttggttgtgaattgtgcctaattctctcccctctcagtccgcagtttcgttttgcatgacgaaccgtatcagtgtcagttcacgggaccgttttcattcctttcctaaaacggcaccgcattgttttttttctttttgggaaagtcctagcccccttgtttcctttttcctccccgtctccctagccagccgcgccctccccctcttcttttcgcgcgcgcctcccccttcccttgcccgagtcgggtctccctcccctcccttctagtcctactcccactacgactccacctttcctaatccaatcctcccctatataagttgttgtcgaaatgacaactgcctacgtcggaagacgtggatactcaacagtggttggaaagaaagtaaagtgtattggactgagaatttttcttgggatccccccattacatggccctatgagactatttatagcctgattacaggttcttact

SEQ ID NO: 44757 - DNA, 1290 bp, Oryza sativa
gccacgtggctgccatacgtggaatccacgttggatgtgacgtggcagatgacgtgtactccacatttgtccaagccacgtggctgccagacgtggaatccacgttggatgtaacgtggcagatgacgtgtactccacatggcggatgacgtgtacgccagtatgctagagccacatggcagtcgtatttaaccccacgtgttggcatttcatatgtccacgtggcgttagcgtgcaacgccacgtggccaaatgtggcaacgccacatgttctcattttgaggcgccacgtgtctttatgacaggtgtccttacctgatacagccacgtgttaatatgttttgatgacacgtgtcaaacacattaaggattcaggtccactcatttgttctggcccaacccatttggccacacattttacatctagttgtggcccagtccactattagttctagaaaatttttagcattggcccatttggagcaacaattagaactttgcacacattacaaataggaccaacataaacattgaacacagataccaacttcattacaaatagccccaacatcaacattaacattgaacacagaaaccaacttcaccgatgatcccaaacttgtgagcaagtgttgccatcacctccactggcagcagcagccatggcccgccgaggtcgacatcgacgatgttgccgaagtccttgctaacaacatcgatcctctgaaacacctgataatcaaacgaaaccaagtttcagattataccaacaccaaatttctgattctccaaatcagattcagctgaataataattcaggatcaattgtttttctgacctgcccgagggtgatggggaggagcctagcaacctgatagtacataaccatatgttagattattttttttatgcgctagataaacaacaagaaacaatctatagatacgacattagttttttaatgatagggctactttgcaacaccaatctgatgtccccataatatattgcactaacatatctcaatgtccccatccccaacccacctcatttcattggccaagcaaacaagcaaccgaactagaatgcataggagtttagcactaaaatttagacactaaagttatgatacgagtaacttcctatacatgcttcatttctacagactataggcatatagcatgaccgtaaagtgtggtgtaaagttatggacaccatttaaacatgcttcatttctacaaagtacatgcatacaacggttccaaaatttatatcaccagtggaacaatg

SEQ ID NO: 44758 - DNA, 2316 bp, Oryza sativa
ccatcttcatggatgattttagtagcacgaagaggaacattatcggccatgtctctgggtggttgatgagcgacagccgcgaagataagattgatgactttgtccaagaaatggagatgacccgcttctggccgctggaaaggagagaaattattgctgaggtcctcctcaagaatgtagacctgaaaaccaagtaccactgccctgagaaatatgaaaatgaagaacgtctcgctgatcataaggcccagtgtagcttcagacctgttacctgccccaatgatggatgccgagcgaaagtttctgttcgctgcatgcaagaccatgattcagcttgcctgtttaaaatccttacatgtgagcagaactgtgagaagcggcttctgaggcgtgatatggataggcactgcgtgactgtgtgccccatgaggcccatgaaatgccctttggtgggattcctctctttctgagcgtaatcttgagcagcactgttctgagtttcttcaggcacacctccataaactcctcaaggctattcataagaaaggttttacagatgaggggctcaaggaccatgctctactgctggaaaaggttaggctcctgatcttgttaatttacaatgtgtaacatacgcttttcaattaaaatggctgccttattttcttgatttggaaacattgctgtcaaactattgtgaaaaagaagacatacatggactgcagcaatatgatttactgaaataatctggttttgttctgcagcatgacaatgatggtaaactggctaaatctcgggatgtaagatctcttactaatgttgtaaagaatcttgaagccaaaataaaagatgattcgagttagagtggatggcgtctccagagcaaaatgcaagttttttttgaggcagcaaaatgcagcatggatattgaatggtatagctgaagagttgtttccactcacagtatacacagaagagtacaagattctgcacgtttttcctttacaactataattttcccctcatgatttttcttttctcaaaatcggttagttttttatggtgtaaaagtataacattattttatccttgctattttgtccaaggaactcttttttttcatataaattgagaataatttatcaggaatgctaatttttgtttaatttatggaagggcgatgcttgaagtaagggatgtttttcccagtctaattccgttccctgtaccagctaaatactccctccgtcccaaaaaaagacaaaccctggtttccgtgcccaacatttgaccgtccgtcttatttgaaaaaattataaaaaaaattaaaaagacaagtcacgcacaaagtattaatcatgttttatcatctaacaacaataaaaatccgaattataaaaaaatttcatataagacggacagtcaaagttggacacggaaactcagggtttgcctttttttgggacggaggcccactagctgaagttaaatgctattcctcacaatgttattatttgttttttggaaactttttttttcaatgatccagatcaaggttaggaacactagcatttatcggtaaactgttggaatagtttaaattcaaattttgtttttcgatttacacttagtaccgtttacatgccctcacatgtataatgcccattgataggatatctccacctcctacaagttgtgtcgttttcatttatcatggattcgtgtatgatgtttatttcaatgtataaattattacaagaatgtcaaacatcttttttttcaactagtccctgatcggtaaccattattcaaattctttttttttttgctgggaaaaccgttattcaaattctaatattcgatttagatttacagtaaaatctattccctctatttcatattataagttattttgaattttttctagccaaatttatttaggtttgacagtttattaaaaaaattagttcggttaaatgtaacattgaatatgttttttttccaaatgttgctatattcttttattaatttgatcaaacttaaaaaagtttgactaggaaaaaaaatcaagcaacttaaagtcttttttatatgaggggaaaaaagagaattgaaaagatacgcaaaacaaggtgagctttagcgaacgattaattgagtattaattattttagattttaaaaaatagattaatatgatattttaaagcaatttttctatagattttttttataaaataaacatcatttagtactttagaaaatatgcgcgtaaaatacgagggagtttttctgtatctaccgaatcaatttctct

SEQ ID NO: 44759 - DNA, 1591 bp, Oryza sativa
tctagatgtttttgttggtaatgccctgattgatgcttacgctaagtgtggtttgatggaaaatgcggtaaaggttttcaacatgatggaattcaaagatgtggtttcttggaacgcaatggtggctgggtactcccaaagtggcaactttaaggcagcctttgagcttttcaagaacatgcgcaaggaaaatatcccattagatatggtaacatggactgctgtaattgcaggctattctcagaggggatgcagccatgaagcactcaatgtatttcgtcaaatgatattttctgggtccttgccaaattgtgtcacaatcatctctgtgttgtctgcctgcgcttctttgggagcattttctcagggtatggaaattcatgcctactccctaaagaactgtcttctaaccttggataatgattttggtggtgaggatgaggatcttatggtgtacaacgcgctaatagatatgtactcaaagtgcagaagcttcaaagctgcacgctccatatttgatgatatacctctggaggaacgcaatgttgtcacctggactgtcatgatcggggggcatgcacaatatggggactcaaatgatgccctcaagcttttagtggagatgatttcggaaccatatggagtagccccaaatgcttatacaatttcgtgcattttgatggcctgtgcacatttggcagccatacgtataggtaagcagattcatgcttatgtgcttcgtcatcaccaatatgactcatctgcatactttgtggcgaactgcctcattaatatgtactcaaagtgtggggatgttgatacagctaggcatgtattcgatagcatgtctcaaaagagtgctatttcttggacatcaatgatgacagggtatggaatgcacggtcgtggtagtgaggccctggacatatttgacaagatgcggaaagcaggctttgttcctgacgatataaccttcctggttgttctttatgcttgtagtcattgtggaatggttgatcaaggtctatcgtactttgacagcatgagtgcagattatggtttgacacctcgggcagagcactatgcctatgctattgacttgctggcccgctttgggcgattagataaggcatggaaaacagttaaggatatgccaatggagcccaccgcagtagtttgggttgcattactgagtgcctgtagagtacattcaaatgttgaacttgctgaacatgctctgaacaaactggtcgagatgaatgctgaaaatgatggatcttacacgcttatctccaacatatatgccactgcagggcggtggaaggatgtagcgaggatcaggcacttgatgaagaaatcaggaattaagaagaggccaggatgcagctgggtccagggtcaaaagggcacagcatctttctttgtcggagatcgatcacacccactatccccacaaatttatgctcttctggagagtctaattgatcgcatcaaagctatgggatatgttcctgagacaaacttcgcattacatgatgttgatgaggaagagaaaaataatcttcttgttgagcacagtgagaaacttgct

SEQ ID NO: 44760 - DNA, 2373 bp, Oryza sativa
gaggctcaccttatatttatccactctatgggctgggtgagctgccacaggttagggaaattttaatgttaaggaaatacctgtcatactgcatgtgcatgtttttaagatggtcatatataacgctttcttattcaaatatttcttattcacagggttttgctcgtttaagtgctgtttatggtggcacttacatgttaaataagccggactgcaaggtgtgattaccatcaaccctgtcattacttgcatctctggatgaccagacaacctaataaaactttttggcatgccatacatgatcttaggttgaatttgatatggaagggaaagtctgtggcgttacttcagaaggtgaaactgcaaaatgcaagaaagttgtttgtgatccttcatacttacctaacaaggttaattttctttcctgtattcaatttatttaccacatgaattttctttcagtatgttcatttaggattcctagatgatgtacttccatcttaacacattcacagcaaatttactattttttcttcttcccttccatttgttgagaagttttattaactacaaccacatttgatgttctgtatacatttattaacaggttaggaagatagggaaagttgcacgagcaattgctataatgagccacccaattgcaagcacaaatgactctcactcagtccagattattttgccacagaaacaacttggacgcaagtcagacatgtgaggcctttctcaatcacaaacaaatactgctcaccttatgaattattacatttgcttgcccattgcttttaacaaagtttatttattcccattttgtaacatttttattggtattctcctgttaggtatgtcttctgttgctcatacacacacaatgtcgctccaaaggggaagtttattgcatttgtatctacagaagcggaaactgacaatccacagtccgagctaaagcctggaattgatctacttggtcaagtagatgagctattttttgatatctatgatagatacgaacctgtgaatgaaccatctcttgataattgttttgtctcaactgtaagttttgcaatatctgatttttgaaatgagcattaagtttgattgtctagactgtaacatatttctggtccacactccctgcagagctatgatgccaccacacattttgagacaacggtgacagatgttcttaacatgtatacattgatcaccggaaaggtagatgtgcttccgcctttcattttctttaatctttaatacatgtaatgcttctatattttgtttgaaacacctttttttggaaaggatgaaaattagccgggaggctatagagaggactagagtaccacatatgttgtaatagcttgacttttgtgtcaccttaaattctaaatccaaatccattctgttggctattgtttgttttacaattatgtattctacccttttcctaattcttttctcattgcactattgcaggctgttgatctcagtgttgatttgagtgctgccagtgccgctgaagaatattagatttcacaaccaaagctcaatcatttcacaaagatatgctttttcttggtgggtaccgcaggacagatcgtaacgagtgactggtatagttattcaaactccacgttataccgagtgttctggccaatatggcttgttgctagcagtaatatgcacaactgttggccaagatgactgaaatgatggtggtttaatttgatacttcagtaatgcaatggtgtaaacagtgtacacactacacaatgacggtcgggcgttttgtgactgatgtatcataactgctggataattttgcatgtctacttctgcagtgttgtgttctttaccttgcattttcaggtttcagttgggtgtgcctgcctccggtatcagccggtagggtagcatgagtagattttaccgagtcatgcgaatgaaaattataatttaacagcttaacctacccagaatatcttattcctggttggattaaccaaaacttcaggacaaatttaaatgtgtttgacggttctatttgttcttccggttctacctgggatacattctcaccgtttggttggttaccgatgaaatttgaaggcccattgtccgcttgcaaggaccgggaaatttaaactatttgccacttttacgaatggcaactcttcaaatgctatccttatggttgttcttacacaattgtcatcggagagacgtttttaataatttgctacttttgctgatgtggcatgccacctcatactgccagcgtggttttgctgtgtaaattttccgttttacccctgatgggccctaacaaacggggaaatgggaaaaggagcaaga

SEQ ID NO: 44761 - DNA, 5357 bp, Oryza sativa
caccacctcacctcccttcgagaactcgacttggcaggatgtggtgccctgactgcactgccagaaaacatcgggaaactctctgcacttgaagcactatatgtcggaccgtgctctgccattcaatgcctgcccgagtccataaaacaccttactaatctccggcgattgaacatttctggttgccctaatttggtcaagcgttgcgagcaagaagtgggggaagactggcagcttgtctctcatattcctaatttaataagtgactaaggctctgagggcagcatccgacccttggtacgttctggagtacctgtcactgatttgctacatcagcttgtgtttgctaatgttctaaggtccctgctttatttttatgtatgagtattgagtttacagtagtctcttatactggtactaaaagcacttgtatgcttcgtatttcaagtttcaacacagtcttgcctgcctctcttccctagagtgtggttctacttgttcctcccaatataacatgtcctctacaatcgcactcctgttttcttctcgtaatgatagatttcatgccgatgctaataaactacgcttcttgcgtacaggttttcagattggagaaagtgataagaaggattggactgtcgaagactgtctgctgagtacatttcttcttctgctggaccattcagaaaatgcttccgtgcttcttttgtactgtatgctgatcatcttagatctataccgtttaaagagtgtggagactacaactttactctggatctcgtcttttgtacttctgtatattggtcatcttactctgctagagtctggtctcactacacgcgtttggttagcatgtgacatgtttttgctacttactcttgtggtttctgtgaggagtcacatttgatcgatcaattactcttgagcttcctggaagcggtggtgatcaagcttcttttcctgactaagcgatatcctaaactgtacaagggaaggatatatatatttgtagtctgctttactgccatttcatgttttgctaaattgtcaattccttatcctcagattcatcgtaaaaaagtatgttttgaaatcatggaaaaaagtctaatccataaaagttggtgattgcatggccctttctttatgtatcattttaggatgcaggccgtggcaccttcgtaggtcactacagtagttcatttgaattcctaaaagcttatgaaaacattcagctagttcaagtgtgtgttcactcctattaacattgattaggacagaatgaaaaggttttactcctattaacattgagaagataactggacaaaatgcaatctgaaaaccgcatataagcaggcaagatgttctatgaagaatcctcatatcggccttggccgattgtaccggaaacgaatccatgcctattctatcacgcaaactcgggtagaaaatattaaatccattaaattcttcttgcttgacttgaatagattccttgaccaccttacacgggagcttggccccaacaaggccaaatagcaaactaaccaaatcttatctttaacttcttgtcttttaacttaaaacatatctatctcttatccatagcagcatatctcctaatttaataaaagcaaccaggcattgcggccggtgctacagtaaccctgcagataattagcacaaagtacgcctagataaaattcattaatcccaaattgaacaggagaatattattcattaatcccaaattgaacaggagagcaagcatggtacgcatggcaatagaaagaagggtagaacggcggcgattatattggacaaagcaaaacattatgcttcttactggaaggactgaactttctgaagttctgaattaactaaaagcaaacaccatatcaactcgttacaggacaagaaggccacagatcaagggaacttaattgggggaatcgaaacaccagtgccaaattaagaaagtttgcttgtattatatcatgtccgaacatgtaagattgggctgaatgccagttctaaacataactgaaacagaaaagatgctatttctttcgacactgtacagaagttaacccctatgttttttttctacaaggactagagggctacgaacttgtttcactgaaactgctggctttgtacacggagcacctactatcagctgaacaaatagaaccaaggtatagaattgttacatggctggatttaagatctggacagcacaatcagacatctggaatctatagcgacaaagcatatgcaaataacccatctatctaaactgatcttcatgcacaattgatttggttgagcaaactgttgcacatatcatgtatgtggaggcctcggcaacatagagttagccagttcttcattcaactttacaggaaggggtggcatctgcctcattatctcaggaacatcgcctatcttgctataaaaatgaaaaaattgttggtacataattgcagtttcccaggacaagtgatgaaacacccgcaactaacttaatcaataaataacatctgtatttcaagatcacatgaaagaaagtgttcggttattaaaatgtaccagaaaagcattgatataccaaggaggggactaaaatgacattgcaacttattgatatagaatttaggccagttagaaacttagattccaaagtaaggggactacttggggtacaatctgaagtggagaagaaatgaatttactttagaagactcaggaatgagagaaaaaaaaaccataagagccagataaccaatcatgggaagacaaatctggtactcaaatcccgagttattcaagattgtacaaaaagcaaagtagagaatcttactccttcaggactgcaagtatattatccctagtttgacataaaagagggatgttctcctgcacctacaataaatgcaatcattattagaatattgacagcatagcaaatatcaggtgaatgtgacaggtatcagtcatacctttgtgaaccaaaccaatcatacaaatttcggaagaaaaatatttggaatacattcttttaatatagcatacattcaaatggctgctcctttccccaacgtacaagtatataaccatcatgaaatgggtactaataaagtaaaacacctacagttcaatggaaattgcattatgggtttcctggacccgtggttctattaccaagtgaaattcttctagaaccttgcaattattgatagaatgcttgtccatgcgtgatttacgggcaacttaagaaactaattgcaacactacatcttcagcgacaatgcataagaaactaattgcaacactatatcttcagcgacaatgcaatgtaaaccacagccaatgtagatcataatagccaaaatattattcatataatcttatcatgctggggctgagtgctgaaaaaataacagagaagatagaactagaagtacctgcatgtttgaaatattggtatagatctggttcaagatctgtgcattgtgctcaagaatttgaccagtttggcctccaattgctgcaatgacatggaaagcactgatcaaatataatatcttaattcaacgcttaaaatctcaacatagtgataattgttatattaatgaagatgcttctaaagttacagcatgcaacttcctattcctattatatttaaaagtaaatagtactctactactggatcacaaacaggataacatcatacagtataaatatttgcaagcatcatgttctactatttactctattttaaattttcatacatgctctggaaaacttcaggtttggacaaattacaaataagttcaataatatatattttacataataaagcagcatcaacaaggtcgaagagaaaaaaataaagaaggaacaaaggattaaatagccacatgcctggaaccataatatcaagaaaaaataaaagcaaacaaatgagacaagaaagtcaaaatatgagtgctagtactaacaaaacacttacttttgtatgacacatcatcatcatccatgggaagaactggaagagaatatggagcagcattaggtcgggccactaggtgagctggcccttttgatgaagaatcattggctctctcctacaggttagtaaaaaaatatacattttaatcatgcaagaaatttaaaaacaatgatgcttcttttaaaacatctattcatttttacatatttacatccaaacacctatgcatttttacatatgtgaaacactgactttgcatgtgccaccttctaggttgctaaaacacttaaaagctagtaatctgccttttaaaacttcactagaaagaaagaatgtcggttaccgctttcatgaaatcaatagcttgccaaatcaggaacaataatagtgataaaatagggaatcagtagacaagtgagccagatggtaaccttcttttctttgtttttcttagatgactcttccttccttttcttgttactctcctttttctgcaagagatgaaaaagttgatgagattatataacaatatttgttaggcagaagaactatagtgcatgtaatatgaaacatcagaatgtttgaaaacaaaattcactagacataactatctgttgatggcaatactggtcagtttgcatggttattacaagcctacaacttcagttaatttttataataaaaaacaactatgatgcatgacttggaaggattcatttctgaaagccgactgattttgaaacagatgatgtgattttggcattgatgtagtgtggatgtagatttaatcgtattcactagtgaagaagataaaagatgatgatcatgatcatgatcatgatataataataataagaacagtaatcatgatgaaagttgtaggtggtgctcaatatggtattagtaatggagatgctagaacctagcatctatgttagattcactatataaacctgatactccctccgtcccaaaatataataacttttagctctcaaggtttatcccaaaatataacaactttttgaccaacattctcttttcaaccaatcacaaccctccaccattcaattttttcacctacctccacttttcaaccaatcacaaccttctcccatttaattctacctactttcttaatacctgtgtccaaccctaaaaatccttatattttgggacggagggagtaattgcacaaggaactagtaacaggccatccggaaaccattggctaagcatagcaaaaaacaaagtgaaattacttgattgatttaaacaattaagcaactaataaacataatgagaatgataaaataataatatgaggtactgaattatctca

SEQ ID NO: 44762 - DNA, 1208 bp, Oryza sativa
  unsure (1)..(1208): unsure at all n locations
ccaagtctccaaaatttctttcttagctaataaatagtacccgccgatgataatgttgatgagtagtagaatactatcagtagagagtaccatatcagtagagagtatcataaaaggtagtcaactaattgagcatatgaaaatattttgtggaagacggggtgacggagacgcggaagcacaagctgataaacctggactactacatcccgccggacgagcggttcagcccggggaagctggcggaggtgctggcgatgggggtgcaggcggtgacccacttcgtcatcccggaggcccgctccatcttccacggcgacgtcgtcaacttcaagtccacggagcagctgcgcgccgacctctacggcaagccgccgcagccggcggcggacgccagggtcatggacgagctcaagtcctccgtgccgtcgcacaagacgtacaagcaggtttccaggattgtcaaggacaaccccgccaagttccccacccctcaagtcatccactgtacgtactgcgtctgtgccagtacgccatggcattgcagcttcttgatgatctcgcgcgattgaatttttttttttgggggaattttgcagatgacactgaggcgtggaggagcgacgaggagttcgcgagggagatgctggcagggctcaacccggtggtgatcaagcggctggaggtaagaacagctgaaaatgttttgacatgtttgatgagctatgttgatgtgtgattcgtgctttacaagtggatatatgtttttaatcattttttcatagtattaaatatgggttcgtgtctaactcttcgactttcacaaggtgtttccttccaaccaaagccagattaccacggaccatatcaatacccagaatggaagtttggcccatccacaagtaaggggattccccaattttaaatgaccggagattctcccgttccaaattatttaatagccggttcttggcaccttttttaagattacacggtagacacacgcacacacaggcaatgccacactcacacctccgcaaatgaaagcacacctgcatgtatgtaatattcgtgggcatcaggatttgaaccctggtagagtcatacatccacgagtacaccaccacaccactagnnnnnnnnnnnnnnnnnnnnnnnnnnnnnnnnnnnnnnnnnnnnnnnnnnnnnnnnnnnnnnnnnnnnnnnnn

SEQ ID NO: 44763 - DNA, 2152 bp, Oryza sativa
tgtttttttttcacggtgatatcaaatgtttctctttgttattcaatgtttctgattgctaggagtacaagattagggggctattttaataactatgtttggttctgtcgaagggtatacctaacaatggtatttgtaaaaatatgtggatctttggtactaagatatataagaatgtggtaaaaaagatgggagatatagacttttatatagatttgtgccctactcttgttagcggaagctagtgttactattatatatcaatatctcatgattacaatattaagggcgacataatctaatctctatcagcttagcggcgtaaagctctcacatttgctggacggctagcttagtccacttcctcgaataggaactcaatgatattggatgtagctctagatctctctggtcggcttgtggctttctattgggtttgtctagacttgccttggtgtatgttggtgtatctttgcttgtgtttgtttgtattgacacgtttcctctcctccgagagtcttgtatttatactctcagggtgcccacctgtccaagtaaaaataatgaagtaaggctatgttctttaacacctcttcccaacttctactctttcgttttttgtgtgcacgcttccccaaccactaaatggtgcattttttaaaaaatctatatgaaagttgatttaaaaatcatattaatacatttttcaagtttattttagctaatgctctattaatcatacgctaatgaatcactctattttacatgcggggaggtgaagttcccaaccttcaccttcgaacataacctaagtatagatacgattcaaatagaacttgtaatatttgagtaggactctatttctatttttttaatatgaaggaccttccaatcttccatgtatgatagtatgaggctttattccgtatatgacttgatatatggtgaataccgccgagtctaatacacaagtatgaggtctcacgtatccaggacacagatagtttctattctaatttcttcttatataaataaaaaaatagccttaatggaatgcaatttttaattgtggataatggattaccacgcacacattttcaacatcctaaatggcaaagaaaaacttactttattatttgtaaaataactttttacaacatttttcaacaatctaattatcatttcattcctttataacctcaagtaattgtcacaaacttatccatgagcacattcatacagccactatatattccctgtgatactgtgtttttctctcaactttcccaacctctcatctctcatttttcgtgtacatgcttcctaaactactaaaagatatatttttcacaaaataaattctataaaaaattactttaaaaattatattaattcatttttaaaggttttatagctaatacttaattaattatgcattaatcatttggttttgcgtcagaaggatacgtgttgccctctagaccaaacaactgtaccggaagcatttccacacgcccccattactcgtcggaacttttgaccggcgctgaagaaaacatatcccgcaatcaatgatcataatcagcccctaaccccttcccttcctcccttctccctttcccctcccctgaacggcttgtacggaggaccggacagctgggcagccagacgcgcagggacgcggtcgacgactcgtcatcacaacacactccgcccgcgtccgcgaggacgcgcagggccgcacgggggcgcgcgcatccaagccgtgtactcctggtgtgtacgtgccggagcgagtacgcgaccgcccaatggaattcgcggccgctttgaagaagcttgatgcttcgcgctggcccgccccgtccccgtggttggttggtttggtttggttacttgctactactcctactacgactactattccctccctggtttgctcggacgaacgagtcgtggactcgcgggttgggtctgcgcgtctgaccgcgtggcgttgctcacacaggcgagcgaaagcgagagacacaggcgggtgggggggcgacagagagggagagggagagggagagggagagagagacgccgccggtttcttccgcctgctcccgctcgttcttcctcggggtgggtgggtgagccggtccacgag

SEQ ID NO: 44764 - DNA, 5492 bp, Oryza sativa
  unsure (1)..(5492): unsure at all n locations
ttgggcacaacgagactatagagcaagcgacgcctccttttctttttttctccgatccatcaggtgaactaggccatgcgtctgaacttgtctcccttcccccctcttcctccggctgcttcatcggctccttaccttgttggtgacctagaaccgcgtgtagattggcaagattattttttgttttttgtaattttttttgcatgtgttttctcgtgattttaggggaagcttctcccatctcgttgactattgagaacggatattcgaatggagtgagggttttgtatggctaatcgtgagctgagctgggtgatctggtcttcgtgacagttctgagcacgaactggggaactggcttcgcattgaggttccaagaaggtcaccggatttggcgcatgggggtctccgccagctgcttgtggggtggctccgagtcgagggggaaccaaaatggttctgctgcggtgacgtctcctcgttcaggtatagtatttcactcacttggttccagagatcatgagctagctaatactgtcagaattttaatgctgcttgcatttcaaggtctgcatttgcatttaggaaaaaccagtgttgttttacatgaaaatggcgattaaattactacctatcctcttctgccatgtacacatgttgctccaggatatatatggttatggatgtgtcgaacaatcattctttggagagtctactgagaggattttctttttctttatgttattgaagcattcaaagggatgaaatgatgagaaattcatgttttttttaataataggaggaacgtctgaatattttctgtcttttcatacataggaaagtgttgttggcaagtttctctttttaagacaaaagcaaggctcaacacaccaaaactcacacaatatatgcttcatgagtataatcatcactcaagataacacatccgaaaaaaagttcttgatgttcttatgtcttcctttaagcagtgccatctgcaaggaagttttgagcgagctacttcctgcattagggcttaggggtcctgttggaaactatactgtgtaaaaaaaaataggaaacaccatgtaaaacggtatgcattataattaatcatgcatatatgaggatattggtcttaaccttagagcagtcaaccttaatggccactatcatgttttagtgaactaatacatgtacttctttttattacttctctttcctatttttctaaacaaacattgatgatatcacctctggaagaaatgcaggtcaagtaatatcaagagctggaagtaatgtacgagtcttctccctaaaggagttgaagcttgccactcgaaactttcacatgatgaactgcgttggccgtgggggttttggagcagtgtacaaggtgagaaatggactcactttgtgcatcatattttcctggcttcttactttatggccttttattttatcatcacttgctagttttactgtaagaattctctcttgatattttgtaataatacgttttataagtctgcaagtatataatgaataacaactaacaagagtctccttcacttagggaaacctgaaagatggcactcaaattgcaattaaaaagctgtcagctgaatcaaagcaaggggcaaatgagttcttgacagagataaatgtcatatccaatgtcaggcaccccaaccttgtaaagctaattggttgctgtgttgaagggactaacagactactagtgtatgaatatgcagagaacaatagcttggcacatgctttacttggtaagttcattaaatcaatactgacatattgatcaagtaaagtccagccattgtgttaaatttacctttgtgatcaggaccaaggagtaggtgtattccgttaaactggcaaaaaagagcagctatttgtatcggaactgcttctggccttgcatttcttcatgaggaagcacagccacgcattgttcatcgtgatatcaaggccagcaacattttacttgataagaaactacttcctaaaattggagattttggactggccaagctttttcctgacaccattactcacattagcacacgtgttgcaggaacaatgtaagtacatgtaaatcttttgattatttacctgctcttgtaatggatctatgcacattacgtgtagattttttccagaataatcagctcagtgtatgaatttttccaggcagttttgtcagcttactattgttgcctctatttctagtgacccaagttgacctgtcattgtcaaatcacttaaattgcatcttgcttagtctgtgataggatcattttacttatcgtttgggatgttatttctcctgcaggggttacttagcaccagagtatgccttgttgggacagttaaccaagaaagcagatatatatagttttggggtccttgtccttgaagtgataagtggtgaaagcagtagcaaatcgacttgggggcaagatatgaatgtccttgtggaatgggtaacacacttttctctcctcaccagagcactagtttgcagcaattttaatgcccacatcaactcttgatagcagtagtattattcattgattcatgacagtgtaccagcttttccttatgacatacatctacatggtcttgttcatctggaaaaaaaataattaaagctttgatgtggtttaaaatttaaatggcagacatggaagcttcgagaacaaggaaggcttttggaaattgttgatccagaactggaagaatacccagaggaggaaatgcttcgtttcatcaaggtggcactcgtgtgcacccaggccacgtcccagcagaggccatccatgaaacaggtggtggatatgctatctaacccaacagaaatcagtctggagaacttagtcgcaccaggtgtgctgaaagaaccccgccatcattcaagtagttcgggtttgacaccggacacaacctcaaacagaagcaccaaagccaatccagctgattcctacagcacacagaccagagacatgaatagctatcagttgagcacgattgaggtgtcgcctaggtgatacggcacactgcgcgctttcttgccagattcagaggggctcccacattgtcagattttgctgcgctgacagagttttacttggaaatgagaaagtgaataggatatgcttaaagccctgatccatatgcatccggattgaggaaatacacaggataggatgggcattgctgtgggttgctgttgtacacttgtacagaacttgtagttatacttttagggatgcattgcaagagtagtgatgtcttcagacacccaaaagaacttcaccattcgaagacgtggtgaagaacagggtgaagagttgtcacgtgatgatcatagttttaaggcttatttggataggcatggattaggtttaatccttccattttgatgcagaattggttcattatctctgcttatctaaaggacttaaacctaaaccccacctatcgagacaggcctttgatgacattaccttctttttaccgcttattggccccatttttcttacatcgtagctagtgcaaaaacatgtgatttgagacaatagttgtttctggaaatcctttgtacactgattttttgttcttttgggagttctcatatatgaagtgaccgtctggactctggactgtatccatttgtgataatattatagtgttgttgtattgaattttcaacagcaattattggattcctgatttcgtgcaatcaaactcagcggggaatgtgcgtgtcattaaatatcaagactattgagcttacacaatcttggtcataaggtgtgaattaccatcacaccccttgcttcttgggatctaaaatgttgataattctgccatgaggatgttttgtgagtgtagcataagcgatgcccattcgcttttgggtttcttttgttttctccaacttgctttctgctgtatatatactctgtagctgcaggggattatcatataatgttggtcactgctattgtttctctgctgtctttcttttttctgtaagggttttcatgctaaatgtataatctttggttttgtgccgggtttaaacctatctttatctaaagacgtctaaaatattcaaaatagtctctcttttttttttgaagtcattcaaaatagtctttgttttgatgtgtatcttaatcagcacatttagtgaatggttatcaaatgattcanagataagacgcacattacttcccataaaatcactgcaactgggttcttgaccaggcatattatattattatagtataaaaaataaggaaactgcaattaactgaagatgataggagaagaacttgacaaccgtgcaccaagagatgacaataccctgtaagcccctgcttgatttaccagagagccactatacatgcctccaccaaacaaaacaatctaaaagcatatacctttctaatgaacacagctaataatacctcacgaccataacctccagtttattcgattcacatgacaacataggcttattgcttctctcaactcactgatgatacctttcctgctaaacatgcagcgagaagaaccatgaacaagaactacaaaataactctcttgagagagactctattccttgtctacgaaagctgattcagcaagatcgatggctctagccagagcggctgccttgttctcgcattcacgttgctcgtcgtctgggctgctatcagcgacaatgccagcaccagcctgaaggtgagcgacccactcccggcgcctctcggtgtctttgtatgagtacatcgtgttgtggcttggcgctgttgagaacacaatggtgcggagtgcaagagcgataagcatgtctccgtcaaatgatatccctccaaggccgccactgtatggtcctcgtcttgtgacctctagctcgtctatcagctccatggctttcacctggttatgtcagacggaattttgttaaacaacggtttgttccagaaaggaatatgaagtcctgatgggtaaatgagatgtatttgttactgtacgcaaaaaggatatgagcaatgtgatcgaagtcaacagagcaaaaaaagaaaaaaaaaggaaaaagttctagcataattctatgcagtagaagacttcaaatagactaccaagaggctacactgtcccaaccatatggcttgtattgcaaaaatgcaaatatgtcaaacaatctctactgacatgagtgtggaaccaaaatgatctacacaaagaataaatttggcaaacatgcttaaaaaaaagacggaatggaggttggacagcacatcactagatccaaataaggagattgtaggcaacatacctttggtgctccactaactgttccaacaggcaacgcggctcgcagggcatcccaactttggagatgatcatccaactctccactcacctgtaaatcattcaaacaatacattgtttttcag

SEQ ID NO: 44765 - DNA, 6098 bp, Oryza sativa
ttacatccctaaatttaccttctgttccatgtgcttccataatggatatggtcacaactcaggaagattgtaatatttccgcacttccatctttcagattgaaaaaacagacagctataggaaagggtatggctctggtaagaaatgggatggtgggcctggtgggggaggtcctggtggtggcccttatgggggcggccgcggcggtggaggcggcctccgaggtcctcgcacactatctgacatccgatctaacgatcagagtaagtgctgagtcaaattccagtttttactttgctgtggccttttttggcacatctaagactaaccaacctcaaattccagattctctccctgcttgtggatcctgctgcggttaacctgtacatctgtcattgtgactgctgaactatgaacgactctaagatccttttgatgtcattttttaggagcaagtctgaattctgaaaattttagaacgtatataatcttcgctggttaagcaggatataagaacacttgttacatgttacatcttctgcttagaaagatcatctatgcattgtgacattgtcaaaacacgagtgtaatacccagcacatattatgcaacttgtttctgacgtgatctccacgttgccttcatctgttcacttgtaattgtgagtttatgcatgtttttagtcagttaaagatgtgtccttcaatggacctgcacgaattcgtgaagccaatgccagataatactactacgttttgcgttccaaaggcttgttgcgcacttgtgcggggttgtgctgtactcatcaaggggtgctattgctgcgacgtggggcgcaaaactgcgaaatgctgtttatgggaacttctatttgtgttcttcattaggcccagttttgctctctttacatatcattggattatcagacatgcttcctgactttgatttttaaagaaatttctatgtattagtttctcaggtactccatctgtcccataaaaaaccaacctagtattggatgtgatgaattttgatatacctttgtccagattcattgtactagaatatgtcatatttcatcctaattccttttttcgggacggagggagtaatagtttttataaaaaaaaacattttgattcttttttgcaatagttaattcattcatttcttttttactaatattattctaaattttctatcatcttttcgcttatgtttatacttattagccaaaatttgaattttcaacattaaatttggagttgattttaaggttttttttcatcgaagtttatttttcagcctttgcttttaggtcgccaagaacacgtatataaaagttttgttcacaatttatttttcgtttacaaatatattatttggcttattcctataataagccaaacgatgacctcctatcaaaacaatcgaatagcccccgacgtcgagtgcaagtagtgtgcttgaggctgtataattgctgcggcgtttgggcaacagagcctccgaaaacaccttggcatgtacacaccttacacttctaacagaagctcttgaactattgccagtggtggatcgcaaaattggtttgttggtgtcataatgtatcttcggtgtcatattatgcgaattatatttagatcatgtttgtttcagcttaggattattacaatctaaattattagtaataatatgaaacaaattggtaaattactatgatagattattataatctataaactatattagtataatctggtaatcccctctaaacatgattttttttagattattgggtggctaaagacccactacccttaaaattttacgcaaattatctagcactgccatcgaacccaatcgatcgagcacatccgctttctcactcccccggccacacgcgcatccgtttcctctcttcccagtcgtgtgtgaatccgacgtctccactggcagtgcgtgcatccgcttcctctctccctagtcgcgcgcgaatgcttccccaagcttgaaccctacgcgcaaatccttcccgagcccccaccctgcgtcctagctcctttgccaagccacgtcgccaccgccatctcatccttctctcactctgcaatagctgagggcattatagacattagtctttcaaacccaataatccattcctccaataattcggagaaacaaacaactcataagttactctactatagattattataatccaacttatagtaatccgactcaataatctgaattacaataatcttaagttgaaacaaacaggattttagaccatagtgttataatatatagataaacaacataaccctatgttttacccaaatttatcgatgtcatttgatgttgtcccatatattgtagatccacccaatactaccctctaacatagatcactgacatacgaaccatgagatgtggggctcacatgtcagccatttaaagcatatggcctagtttacggcatatatgttccaacgctttactaatattatacatgggctgaaatggccacgattcaagccgagcccatgcaagcatttcgtttttgagaactccatgcaggcattaggagaagaaatatatgcaacgacgacaactctaggtgggtggagttgattgatcaattggtgaaatggtgagctgaggctcttggcagcgatctgtttctggcttcaaacttatcgatttcttttgtaatcctctcctctttcactgtcctagatccttctagtatcttctagagacttgtatctcttattcttttcctcctcgctccaccaaaataattgtgtgttgtattcagcattattgcaaattctgattggagaagaggctgctaacatattaatcttgagtgcctgctcatgaggtttccttgcaaggccatacgtccaacgaccaagaacatactatcaacaaacttatgaggctgaacatatccagcaaagttaaggggccattacggaacatttctcccaaaaaagaacttgtccatgaactgaacatactggcaatgtttaggggctctcacggaatatttcagcccaaaattccaaaagcatgcagaacatgagagagctaacaaatacgtgactgacatgtgggctccacggaccgtgaccccacatgttagccgcttaaacaactctcgatgagccaaaatgttcgtaactgtagaccccgtctcgccttctctctcctctcttccctctaccttccctttcccctctctccctccttcccccgacttcctccccgtcctcggccatggcgttcttctcccatcaccacctccagcagccgcatcctcaggctccgccgccgccgccgccgcagcagcagcagcaaccggtgcccccttccttcaggtacgcgatctcaattccattctctgcgcgttcgtgcgtacgaattttcgcgctaaaaattccccgccggattccgcgcttcatggcaggaacgcgctgccggtgccggtagatgggcagatcccggcgcctcttcccttcttcaacccgccgccggccttccaggaccagcccgcgcagccaccacgtgagtttccattttctccccacccaccgcgaagaaccctcgtcctcttcgcctggttgaaattccgcttcgattggcgctgatagcatagggcttttgccccgtactgtgtagtggtggacgcgatggggcttacggccgcggcggggctagggtggaggcagcctagggagcaggagctgctaggagagaactcccagatgtcgtccatcgatttcctgcagacgggctccgcggtgtccactgggctggcgctctctctggaggacagacgccatggcggtggcagcggcgctggggctgggaactcctccggcgattcgccgttgctcctgctcccgatgttggatgatgacatctctcgcgaggttcagcggctcgatgcagatatggaccgcttcatcaaggcccaggtcaggcactcgtaaacctttttcgttgtgggattagctaatacgaaaaatgaactaatgatgttattactttaccagcatgtgttacttgtatgaggtattcatgatcattttgttagggaaaactagtgaagcgtcactgtttcaggccatatagtttttgcaggtgaagggcacacacagatagtttcttttctttgctaatgttagaggtttccgcctttgctaattgctattgacaccatgctgatcgttatgagcgtatctctacatgagcagaccatcttttttcaaggaattccttcagtactccacctgaagaaaaccatgtaaattttaacaaaaaggtgaacattaggctatgtttggtttacaacccagataccactctagatgggcctatgcaggcctagcaactctattggactaaaaccctttctttaaccaaaatgatcatcctgaagttactgtctttgaaccctcaagtgttacatattatacttggtggtacagctaacccatcagtatacacatgggactgctatgtgactcctgaatcctgataagccacggtgttagacaaaatggaacgaaaagatagaatttctggtatcctttgtcttagttaatgtgatctgcctgctacattattgtaggcactgttgcttaaagacaaaactgcaatgcattttcagttgatgaaataattaaccagaaggttctatccgtgtaccacctgtgttcttagttccttttgtcttctgttgattggataaatttcagttgtctattcttgatttgcttccatcaattgaacttttaaacaattgctttacctgcaaaatggacctgatcttcaatgttggtcggatcattcatttaacctttggacactaaacagtattatttaatgtacgttgggtttcttagcccatgccacatacatttacggtaagctagtgaattcagctaatttctaggcaccaggaatgtatatctggcttaacatgttttaataatcaaagtggggagaaagggaaaaagggcatgggcaatattatatataaagcaaaaagggagaactttgatcatgtgcttcagctgagctgtcagccttctttttggtgacgacttgatataagttactattgacttccggattatatgatatctgtctacattcttttattccacgtaaatggtgctggtgatatgaacccccatccttattcctcaaaagaaatcagaagaagcaaaggagttagtgaactgtgataagaaaaagatacacttggcagtatgttcccaaataggactatgcattggatggatggtttgtttaaatacagttacaattagtgatgtaacttatgtttaatatttcacaatattttggtgtgctaactaaatttgtcaaattggcagagtgagcggcttaggcagtccatattggagaaagttcaggcaaagcaatttgaggcgctggcctctgttgaggataagatacttagaaaaatacgggataaagaggcagaagtggagaacattaacaaaaggaactctgaacttgaggaccagattaaacagttggcagtggaagttggtgcgtggcagcaaagggccaagtacaatgagagcatgataaacgcactgaagtacaacttggaacaggtatgtgcccatcaaagcaaggatttcaaagaaggttgtggtgatagcgaggtggatgacacggcatcctgttgcaatggtggtgccgccaatttgcaactaatgccgaaggagaacagacactccaaagatttgaccgcatgtagagtctgcaagtcaagcgaggcttgcatgctattgttgccttgtcggcatctttgcctttgcaaggagtgcgaaagcaagctgagcttctgcccgctatgccagtcttcgaaaatacttggcatggagatatatatgtagaatagaatttatgtattactcgagtatcgtcccagatactgctgtgtttatacaacagtctattgttaaactgtaccactagtatggaccaacatgagatgccactggatcgaaaagaccaccatttatggtggatgtactgctgcaaatgtt

SEQ ID NO: 44766 - DNA, 14483 bp, Oryza sativa
tagtactaaagttgcacttcttttgggacggagggagtatatattatgaacctaattactccctcattctctaaatgtttgacaccgttgacttttttaaacatatttgaccgttcgttttattcaaaaacttttgtgatatgtgtaaaactatatgtatacataaaagtatatttaacaataaatcaaatgatagaaaaagaattaacaattacttaaattttttgaataaaatgaacggtcaaacatttttaaaaaagtcaacggcgtcaaacattttgggatggaggtagtaacaaataacttagaataagttgtcttagcaatacattagcatttaccaacaattcagaataaagttttttgaaaaaaaaatgttttttgttttaaacgtgggagtaaataattcacccaatagtccggtaaatgagcataaaagaacgtgcttattcgcctagagtaaggttgaagtttcatatgttctctatgcttaaagcaagtttaatagtatagcccactactagctccaaatcatatatatagccaatttatataatagttgcttactatactattaatatctggtcccacctatcatacgcacattacgttttggagtccgtaatgcagctggctacagatctgtagctcgctgcttttctctctcttcctttgtgtctttaaaatatgtttatagttggcttatagcatgctattttacctgctcttataattccctataattggcttactcttgctataaatccaacaataaaatgtaaatcaagtaggtttattttctatggtggaactgttcttgttgacagtacgcttgagagtgattaatgcagaacttggaggagtaccatgataatattaacacatcgagtcatatcaagctgtattgcttgagaaatactcctacttgcattttttagggtgagaatttggcccctgcagaggacagttgccctttgctctccacatggagtcatggacataaaggtctacatttttcacccagggaggtcttgcaatttatcaaaatgtatactaaatagtcgggatatgtgcttttgtaaaccataaacatttcaaacaaagttgcgtgaaatgtaaagcagcctcggttatatcattttcagtggttctttgggagttctggtataacctgagcagctttaaacttgtgttctttttaggtggagtggcatgaaagtacaacgatgcaacccaagcttacaaatgcattccacatacatttcaaatttagttgccgtacacgcatagcaaacattggatccgcactttacatctaatcacctgctatcttcggtaatctccggccggattacggacattatgacctggtggttagcaaaaagccccctcaagaagtatctttcaagcccagcaaatcgattgctctcgctgggtgtctgttgtttctattatttcatggcttgatggggactccattggtgaggaaacggcagacctgttctggctacagatatatcatatccagctgacagtgccttccggggtcatatacaaagccgtggccagtagccccttgcaaaaaggaagcttcaacatatcaattattaaacagaacttcaacgctacaaaatatttaaataaatgaatctcatagctgtcaagctctaataactactatacttaaaaaaaccaatgtctcattttgattttagataataacagagaaaacattccttgtggtacggcgtactccctcccaacccacctttgtccagcggtgttgacgcctcccaaatccaaattaacggtccccaactcccaacgatgctgccggaccacgccagccagcgtaacgcaccaactcgctcgccacgatgaatgctcctcccctcctcgctgcctcgctagctcctcctctccccctaccagcaagcacccaccaccagtccactccacagtctcccacagcgccaccacggtgtccgaccgtgcgagagcccaagagcgagagcgaccgtgcgcgcgcgcgtatgtggctcgaaatcgcgagatatccacgtgagattgcgcagcgagacgcgagcggtcggcgcggccgtgccagccagctaagccgatgaaccgatccccctccctcccacagcccacacgccgccacccaaagcagcaatccaccaccatcatcgtcatcataacgatcgtctcctctacatagcccacaaccgccgggccgccgctcctctctcctcttcttccaccaagccaccctggtcccacccgtccgcggctcgagccccccctcaaaatcccccaaccccgtgcgtgcccgtgcccgtgccccgcccgcccgcccgcgtgccggatttcgccgtaaatcggcagcgtttccccgtgcgggggggcagcggcggcggttggatggcgctgtccgcgtcggcggcggcgtcggccgggcggggggcgcgggcggagaaggtggggaggatcttcgagcggttcgatgccaacggggacggggggctggaccgcgacgagatggcggcgctcgtcgtcgccgtcaacccgcgggtgaagttcagcgaggaccagatctccgccatcctcgacgaggtgttccgcacctacgccgagttcatactccccggggggcggggcctctccctgccggggctgctacgcacctacgacgacggcgccggggacgtcgaccgcgacttcctcgcgctgtcccttcccccgctcgagtccggggagtcctccccggagatcgccgcgggggacccggccgccgcctcgtccccgccctccggcgccgccgccgccgcgtcgctcctggacgaccacatcaagccgcttggagcagccggtggggcgccctcgtccagctcacgcgccgcggcggccgcgccggcgtgggcgacgtcgcccagccacgggattgcgttcgactcctcctgggcgctcctcgacgacctggagatactagtgaagcgcctccgctccaagcagctgcggagaacatcctccatcgacacgatcaacggcagcggcggcgcggggaacaacaatttcgactccttctccgaggccgggtggtcaagggagatctccggccaagcggattcggcttcgaccgccgcgccatgggacgagacgagccgcgactacctcaccttcgtcaaggagctcgccgtgctccgcacgcgcgcggacgcctcccgctcacgggaggaggccttcgacaatcacatggtcatcggcagggcgctctccgagcaccgcctcttccgggacgcgcttagcagcttccgccgcgcctgcgagctgcagcccactgacgtgcgcccccacttccgcgcggggaactgcctctacgcccttggccgccactcggaggccaaggaagagtatctcctggcgcttgaggcagcggaggcaggtggctcccagtctgcggacatcctcccacagatccatgtcaaccttggcattgccatggaggctgaggggatggtgctcggtgcctgtgagcactaccgagaggctgccatactgtgtccttctcatgcccgggcgctgaagctcctcggtagcgcgctctttggtgttggtgagtaccgtgcagccgagaaggcactagaggaggccatcttcttgaagccagactatgctgatgcacactgtgatcttgggtcagccctgcatgcgatcggggatgatgaccgtgcggttcaggagtttcagaaggcaattgatctcaaacctgggcatgttgatgccttgtacaatcttggtggattgaatatggatgcagggcgctttgtgcgggctgcggagatgtatactcgtgtgttgagcatccgaccgaaccattggcgtgctcagctaaacaaggctgttgctttgcttggccagggggagtctgaggaggccaagaaggcactcaaggaggcatttaagatgacacaaagggtagaggtgtatgatgccatatctcatctgaagacactgcagaagaagaaaccaaagcctcccaaaggaaaagatgatagtcaaggagaggaggccttcgttgtagtggagccatccaagttcaagagggttggaagaaagactaccttgcggcaggaccttgctaatgcccttgatataagagcctttgagaaaacgacaaagcttggccgctgtgacgcggagcttctgaggaaagagatgaacgagactgatgtccccatatcctactcaggcgctggcaacccagagaagtcaatacggaaagcagctctcgaggttattctccacaggctcctatctttcctcaagccagatacctttcagggttctgtgaaggcgattaacgaaagaatcctctccgtccttgatgcctctggttctggccgtgttgaccttgggatgttctttgctattatcgccccaatttgttctggtcctgtggataagcgcaagcgggttgtctttgatgcacttctttggcgtccggcaagtgaaggaagcaggggtcagattaggaggagcgatgcactgtcctacatcaaacttcttcgtgctgtttatatacccacccatggggctagcgacatgcttgaaatgcatggggagtctgaccccactatggtatcatacacggagttcctcgaaatgttcaatgatcccgattggggatttggaatcctaagcacattggtgaagcttgaggacagcgatcacattcgtcacggccgccacacctgctcaatttgccgatatcctatcattggttcccgattcaaggagacaaagcactcctttagcttgtgcaatcgatgctacagtgaagggaaggttccatcagcattcaagttggatgagtacaggttcaaagaatatggtaacgagtctgaggctcttatcgataagtgcatgtgctttaatttacattctaagaagctcgaagctgatacttgatcattcgatctttggtgtcgattgctcgagcatgaatctgtgtatcccctttctaggtgcaaagatctctagatagtctcctgccctcttgtaaactaaggtgctgttctgttcggagttttctgaatgtgttccaactacttgaaaatcctaatcaattagctattgttcgtccaagtgtatgggagtgagaacatgtgaattccaaacacactgttgttacaatccccaatgctcttgtttaatagagatccttgctgatatccatgaggttttatttgaaccaaacaattttgggctatttttttctttaatcacacttgtatgatttatagcttgggttgcaggaatagatggtaaaatcactatgtacattcagttttaaacttctttgtaagttggtctaacaaagattattttctaaggcagtcatcatgctggccactcttcatcatttcattcggatcgcttgcatggcaccacttgagctcattgattcttttctgatggctgttgccgaatactacaccctatcttatacggctcatatattgatcaagctgagacagatcagacgaagggaggacaggctggattatctgggtacgcatatgcattcgaatatttatcatgccataccgcccctgttcctttttcctggtaggttgaactatggaggtgtttttctgactccatttgactgctcttcaggttattgtttctgcattcttgtgcttccactccgtaccgctgaatgctgaataataatcaagtccatgtcacatgcgtctcaattcaatttgtcgccttcaagcatcccagctcttgccgcaaccctctcaagtgtgatatcgatcttcgctgtcaaagcagttgtttaatagagattcttgctcctcgcatgctttccttctcgtcagaaagtgccctgttgcgctggtaccccatgctgtccaagtaggtctcccccgtcaaaccgcatgaggtccaacccagcagtgacttctgctacctttacactgtcttccctccttgctttcacagatcggtccctttttctgccttgttcccccgcggccaactggaaaagcagaagctccgtggcacagcgtcacgtgggcagcgcgggctgcggagacgattgcagcgagccaggcgtcacgccgtgtttggttggctgcgatgggtggtagcaccggtgtgtggcaggctggcagcgcatcgtgcccagatagcagcaacagtgcgaccgggcggcaatccgcgattttgcgagccacgcgcggcagcgctcacacggggttcgttcgtgtgagcgctcacaacgtctttggcatgggcgcgcatcgcatctcgggtatggcgcgtccaacccttctcgggttgttcagagttgataagtaagattaggttagcaataaactggacatacatatgttcatgttgataagtaagattaggttttttttttggatggaggggtaggtctgaggtgtttgttcttcgctgtaggcaatctcagctcgagggattgcaaccgcgtgaacacgatagcttaatgatgtatcggccagcggttggaagtgttcatgaaatgatgcatacggcagttggcagtcttcaggattcaggaaaatatgcatgcgctttagacatcaggagattgacatattgagttcgatttgatgacagcatttttaaaggggatgtggcacaatgagcttgctcaacagtttgacttttacagttgtaagacttccaaaagattggacctgtaataatttagcacacatccaaacccaaaattgagaaaacccaatgctgtccaaagaaaatgtttgcagctgcatgaaactcttcacaccacatgacatcattgagatgctagccagaattactcctggtagaaaaaatcaatttattcccatgaattagaactaaacctactcacagtcaaagtatacaaaaacattgtacagaggggtctgtaagcattgggagaagctacagaaaacgacctctcatgcctttttctaataacaaagaaagacggaccaaaaattatgaagggatcttcaagtaagttgctagctatacccgttatgtatagaacctgctctgttcttggtctagccatttctgataccacagggcaatatacagaggcaaatctttcttatctatgctccaagcttgccaagaccaaaacaatttagtaccaaaagcaggcacagaaaagtatcagcaatgaaatggcacacatcacagttgtcaaagaatcgctccatcactcttcatcctcagaatctgcattatgatagcatccgataattttagtgataagatgcagtaagaaaaaccttagctattagaattcctggttcaatgaatgttcgattttgtatgttcttgtaacggaagggagctcctaacatttgcaccacaacgacttgccacagggtgatctaatcaacatgtgatttgtttatcacatattgcccatgctcatgtgaaaaaattgaaggccagtgtttattatttcaatatgtaagccattgggatctcccctattgaggcagattctcttattttttatttatggatgaaaaaaggtaaaacataaaataacgaatatagatcaccaacgagtgattaaaccaaaggttttcttacctgatcgaacatcctctccaacctgtcctttattgttcaattgtttcattatcattaagcatatgagtttccaccagtaaatatggaacacaagtaaagtgaggagcattgtgttgaaaatgtaatacaatgttgttgggaatttctccagcttcctcaaagatatgatggactgatagctgcacattgcaagaaaagacacaaaactgtaagtttgaaccttagttggtaaaaggaacagaagatattatgtcgagaagtacaaacagaccttgatgttttgattatccaaaatgggaagtaaatcagtcgtaacagaagccaggagagagcaaaaaggccaaaaaacaagctagccccgagctccttttctgtgtatttgcacagtttggcggtctcaagaaacacatcactcgcatcatgcaaagccagaataattgtcccaatccgaaaaaatctacaatataaaaaggatttaattgtcttagagccatgcttatactgcccttatgttttatagtgcaaaaggtaataaatatgttgcttaatagctcagaatcaacagaaacatggtgaacaggactaaaaaagaacatgtctaataaagcaaagtggtttcaaaacatctatgtattgttagatgacatagctatgctgcaagcaagaagggtagctgatatgtcaacactacaaatttcgtttttatatctatgtgttttcagataatcttactgttcttcaatttatccaaggaatcaaactactagattgcttttatgtctatgtgtttttttcagagataattttttactgtttttcgaaccactaggacttaactcagtcacagaaagatttggataatcgctgtagtccagtttacatccgaacataagagaaggaagtagttgaagtgcaaaactagcaaatatatcatcaaaggggcttgaaagaaattacccagtcagatatgcatatccgatcagaatagatgttacaacatgatgagacatcatcacagcaaaatcttttctgcgggtctcccaggcaacgagagcaaaaatgctgtagatataaaatccacactggcacatgtagaaaagcatcaatgaggacctgcaagaaaaggacagcatatatataaggaaaatggaggtaaatcacttactccctccgtcccaaataaaccaacctcgtactgggatgtgtcacatcctaatacgaggttggcttattttgtgatggagggagtaaccccaaataacaggtttatgagaactctaatcctgggacattttggtcagcatagcgatgaaaacaggggtttggtattactacaagtgcatgattataagtaattaaaatggctcggaatatgagtttcatgtataaaacagaaagagcaaaactaaagggtgctgacaacaacagttttatgtttttttccctagctaccttccttctgcagtatactagcaatgtatcaggcatagagcgcatgccatacaggtatgctcatagatatgcagaacgtacgtaagagtagtttacactcacgtcatgtattgatttggccagccctcgaagtattgcattgtatctaacgaccagggttcctgctttattatcaagaggacccatgcttgaacagaaccatagtatgtcagcttccaaatcgactcagagaacttgacaatctttgcttgcctgacctcatcattcatcagcttagaagccttgctactgaaacagtaagctgccagtggctgaaatgaaacatacatagggactatatgtaaggcgtaaattctcaagtgcaactgatagttattctgaaatttcaaaagcataattttatacaggcaattcggaaaattgtggacagaaatgaaataaaaaacatacaggaaccaaagctgtggttatctaagggcttagctatatagctaccactttatttgcaactgtacatatttttagctaaaacatgttataaggcttttccgaagttcaaacaaaagagaagccaataggtagccaaacaacatatggacatatggaatttacacttggatccaaaattgaaggtaaaaattaatgtacaagcctaatgtgagtatcaactcccttgatccgaaagattgtgagagagtacttcaaccaccataagacaccataagagttcaaccaccataaaacaccataagaggacataggaaccaagggtggcagacaagctcatgtctttaaagtagagtactagcaaatgacaaccacattgatcataaatagccgccatagccaatataatgcaattaatgacatttctattttggaaaaaaaaagcagggcacagacagcacttcacatgcgcatcgtcgatacatcgaattgtccggatcaaactgatcgggtacgagtacggccataaaggctcgcagtgccagcgagatggacgagcaccgctgccacccagcaccttgcgtcacccccccgggggagagcattggggaaaccgagtggagaaagagatctcgcggaacccggcacgaatctggcagggggtccgagagctgattcggttttaccttgtagacgaggcggtcgaggaagaagcgggcgcagaagaagccgacggagaagacgagcgtgagggggaagaaagacgacgcctccgggccccggatcgccatcgccgacaacccaacagagccccctcgccgtccgcaccaccacggcgaactcccgcggcagggcgccccccctctcgcgcgcgcgcgcaccgataatgtgaagggttcggcggttggggagggggagcgggaggaggcccaggcggcacgcgctgctcctgtttcccttcctatttctacctctcgcgcagggcgaggcgaggcgaggcgagacgagacggggtttggctttggtttggacacgatggaggaggaggagatcgagccgagggagagggagagagatggaggtggtgggggtgcgtgctactgttcctctcctctctctcccttgtgtttgtgtacgcgtgtggaatatgtgatattgggatctctctcggtgtctccgtgtctcggctgattcggttcttttaatcgtggggttcagatgggaactctctcgatctgtagttatggacttatggttcgaattaattggagggtcttccaagtagtcccaacatccaaagaatgttggcactggtagtgtttgtataataattttttcaacccataaaaaaatgtgtatacgttccgatcacaatttcctttcaaacccaaaattacatcatatacaagttctaaagccggcatgaattttataattttggtgataggattataggattgttttgtcttttggtcaatggcgtggcagatattcatttggttttaactaacgttagtttgaactcccttttcttcacggtgcatcctacctcggcacaccaaaagcgtgatgtctcctgtaggttgcttaattggagagaaaaaaataaaatcaatgaatttgccaactgtcatccgacagaaagaataaaatactttaactgagcttagtttatccaatctttcttgtatttgagtaatcttacaaagcttaaagcatgttcagatactgcttcaaacatagaaattgaattgattcatgtaaaattactacgttggaacttggaagcgactgacttagccaaattgagttaggccctatttattttgggagcatatcaggtggaaaccagggagcctgtgcaaccttggaaactctcaatcacatccacaggatgagcatccgatggctagggatagaggtgggctaaatttgcaaataaccgcccgccagcccctctgtctgttttgcaaaacaccccctgcgccatccgcctcccatcacttttacacccgagcccctacgccagtatcgtctccccacgactcgcgatccagccaccgcctctgatccgctgcgccgtctcagatccagccgcgccgtctcatgagtcccgcattgggcttcgccagccacgcagtggtggtcggaggtggccttgctggcggccgccagggagatgtcctcgacggtggtggtccggttcaggatgtcctcgacagtggcacctctgtccagttctgtagggcacgaattggagccacgggcagcagcgtggcgcatcatcggcagcaacgcttcaccggcacctgcgcatcaccggcaaaaaatgagaaggggcttcactgccagcaattactaggactccatcagcagtgagaggcagcatgacaacttcctacaggtcaggctcgatgtgtggcaggatgagtacctcaaggttcatggtcagtggtttgctattgtcacacatgtgcagcaggcacccaagggcagtcctgccactgcttcagtcagtaccggatcagaaactgagtaatggcaattgtgcctgaacaaaaggcgtcctcgtctgggactgtaatgcctgaacaaaaggctctgcaatggcaattgtgcctcctgtgtaatgaacttgtgtgtggagcattgtgtgtaaaatttattgaaaaattgtatctcagttgtttgtaccagaagactcatatcattgaaaattcatgctaattttttagtgattcagcaatggtgcctcctatgtaatgaacttgtgtgttttaatgattcaacaattgtgtgtgaaattgaaacactgaaacattgaaaaattgtatctcagttgcttctactagaatttttacaaggtgtttacaatcactaaaatactgaaacattcatgctgttttttccgagcactgatcagcactgaaactgagaaacattgaaaaacgtctcgctggcgtcgcgggcgaggactccatgccgactcgctagcgtgcggctgtgacttgagggccaggtcggcggcgactcgcgtaccacggcggcagccactcacgggtgacacgcggacgatggcggcagcgactcacgggcaactcgtggacgggacgggagaaacgaacaggcggcgtgcgcgctggggattagggggagggggtgatttgaaaaaagcaagattagtatggctaatggtgggcgcttaagtgcaaaattagcctacctctatccctacccatcagatggtgattatgtggtcttgattgagagtttgcaagtttgcacaccttccctggttttcacatgatacgttcccatttattttagcttaagattattataatctagattattgagctagattactgtaaactgaattataataagccgacataaaataaattgttagctgtttgtttatctggattattagctgtttgctagttgttatccacccaataattaaaaaaagcacatttaggccctctttttttaggcttataagccaacttataagtcgaaaagtctaagccaaaacaaacaagcagccttttcatttggcttttttgaagctataagccactctaacactattaagccaaaagctagattggagaagcttttttggcttatatgagatagatatatgactccaccactaaacttaggacattaaatccactggcttataaatcatataagccaataagctgacttaaaagtctaggccaataagcctaagcctaaacaaagagtgccttagagtggattaccatattatagtaatctggctttatagattgtaataatctatcgtaataagctatttgtttatttcagcttactcctaataatccagattataataatcttaagctgaatcaaacagagctatactcccaagtttcattatactgaacatgtttagacactgctacaaacatataaattgaatgaactggttatgtaaaattattttgcattccaagcaattttccgtcgcaaattgagttaatactctcattttgtaatattcattaatatagggcaccttcattacgttcattaggccgtgttcgacaccccttgttaccacccctctccctcgttttccacgcgcacactttttaaactgctaaacggtgcattttttttgcaaaaaaaaagtttctatacgaaagttgcttaaaaaatcaaattaatccatgttttgaaaaatagctaatacttaattaatcatgcactaatggatcgcttcattttccgtgcatactgtttcgattgggaagaaaggatgccgaacacagccttagtgtggttttggaactggcaccaagtctataaagggttgtatcattgttggtttttatatgagccaacactcatgtttgccatttgtgttgccttttatgtttaactagtaatgttgtgactgtctagtatatataataaaggaaaaagtacgaattactccccgaactatcgcggtcatccgaattacccccatgaaccataaaaccagatattctccacccccaactatgcaaaccggacgaattacccccccgacccaatccacggtggtttggtctatgtggcgtcaaaaagtaagaattaccccccccccgaactatcgcggtcatccaaattacccccatgaaccataaaaccagatattctccaaccccaactatacaaaccggacgaattacccccctccccgacccaatccgcggtggtttggtctatgtggcgtacatgtggcatcccagtcagcattttttaatacacaaaaatggtgggacccacctgtcatactctcccacctctctctcttcccactttcctctcaatctctctctctctcttcccctcttcctctcaatctctctctgtctcagatgtggccggtgctaggcgcggcggggcacggcaggcgtggt

SEQ ID NO: 44767 - DNA, 1768 bp, Oryza sativa
gccgcccgcccccgtgcgccgtgcccgcagccgcctccgatcggccgtcgccatgacgccgccgatccgtaagagagatagacgaggatgccacatgtacgctatgtagaccaaaaccactgcggattgggtcgaggggggtaattcgttcggtttgcatagttgggggtgataagaatgtccggttttttggttcggggggtaattcggacgaccgcgatagttcgaggagggtaattcgtactttttcctgtaaggaaaaacaaatgtacattagataatgaaattttagtccatcacccttttgcattcacacagatacattcatacacactgacttgattcaagaataggaaacaaaattatcatccgtgggtgatctaaactaacaggattatcatcaatcaaccaagaatacccatccacattacacgtctccccaagaacaccacaagaaaaattcttatgaaatgtgacagagttaggagttgggacaatagaaacttgggtggatttgcaatcttggccttggtctatttcatgggtttgactaggcatatcagtgttggttccatccacacacaggcgctaataagaccaaatcacattagtgctagtttgtgtttggaattaacactgatgtttatcattagtgtcggtctttttactaatgggttgtcacacttaacccagttggaaatttgactttgccttgttttactttgatcactccaattttataaataaaacttaatgagtattaaaatatatttcatatcattaaagtttgtttgttacacgataaatatatataattaaagttagtttgttacacgataaatataaacatataaatcatgttcattgttgtaaaaaaaggggtttaaacggtattaatgccaatggttaaactagagcaaagggctagtcaacattactgaatgagtaaatttcacaaaattgttggtattttgcacaatctatcataaaactataatgtttagccttgctcattagatgtagtcacctgacctatggtacccatctgcagtctcaggaagtgatatgtaattaggtattagatttttgcatttcgtagcttccgtaatcaagtgtagctatatgcacctacatgcttttgtgttacctcttctttgagtaaatatgtagtttcctgatattgtaggtaggtcccacatgtcaggtgacggtgaatctaatgtgcaaggcaaaaacctgtagttcgttataatggagaaactaaatatgttgttttgtaagacaagttattaaacctatagttttacgatagattgtgtaaagatttatgaaatttctcaatgtataaagtttttaaagacacttatatatacataattatttttttaaaaaaatcataccgtttagtggcttagaaagtgtgttcgccataatctagcatctagtaactgaaaacaacattgtctacatggtgtgttgcttcatagcatgtacataagaagccatgtactattgtaaactatattgcaatagattgcatcaaagttaaggcccgttctctttagataatagagatgcaaaatatgtgtcaccttttaaaaatacgatttctccatgatgtttgtacatcagaatttattacacaactttttctaagttatttaataactttatagtctataatatttattaatctatgtatttatttatcggctaatagctgaacggaacatgcccatatagctgcttacttcaagtgtacagttgt

SEQ ID NO: 44768 - DNA, 821 bp, Oryza sativa
attcctgcaccccttcagatgggccggtcaccaaatcaatatcaactgatgtgggtgatttttgaggcaagacagcttgagtctgactgctgcgtagttgctgacaactttcatgacctgcacagcaaaagaaaggctcattgcactttttcaaaagtagagtaggtagagatacaatcgcagctaaacaatggcattgagttaacttcaattgagcagccatggcatatattattctttatatgcacaacagcatgtgcaagcaaatgactataaactcagactgttttgacactcaatagttggatattattttttgttaaactcaaattgtcgaatgcacggattatttaatactaatagtgcgaatggtgttcaatatgtgtttcctgaacacttggtagaagtgtattttttttattttttttcaattgtacaaaccaacatggtagggtacttctacagagaaactcaacagtatcaaatcaccaacaatattcacacatgcatgcgtgcgcgcgagcacagaaatgtgtgtgtggtgacggctaagtgctcaccatcagtagattccaatgctttgcagtgctttcggttcggaaccttcagtgctgcaccctgattcttacccctgcctttcctctgttttttctgagggctttcatctgaaattcaggtcaaatattcaaatgtgatatttctggcatgatatcacctgttgcgtgccagtcacaatgtatagtaaatacataacagaataatgaccagactggtgaagcacttaagaagttaatagaaatgataaaaagggctgcaggaat

SEQ ID NO: 44769 - DNA, 2751 bp, Oryza sativa
ccttatgctcatctgacccatgcggtagccttctcaggtgtccaatgtaacttggttgggatatcccacatggtatagttataactgtaaaaaaataatttacatgtgtccaaggacccctgttgggccttagtaggtacgcccctgggctcaaccagcccaactacaggttattagagaagaaacaataagacattcccttggataatctgccaacactaccaaagagcgcatcagtataggctctggagcgacagtagtcacagtgtgatgccactatcatcggaaacttcactggttggtgacttggtgtcattaattgagacatgttccgccagcactcactatccttctctgcctgacacaattgggcctttttgtcatgcttgctcagattcgtctaccatcttcatcatcctcatctactcgccctttttttctcggtgctattttaaataagtctatttgaatttggattttttttctctcaattaagtccatttgaagctatgaacagtcatttttagactagtttgatagccatcaaaggatagtggttatacagtggttgcaaccttatatagtgattttttttgtcatcgataaacagataaagaattaaaaattgtgcacaacaccctaatttaatcatgtttctacctgagttatgtattgttttgacatgttctctccctaacaaaagtggcacactagacttatatgtcctttaaaagaactagttggaccaaccgaaattcaacccaacgggtgaatcagaacagtatggactaccgagaagacgcagacaacagctaaggtaggcaaaattcaagcaatgtaccttcttgccggcctctgatttccgcggccttcctctctttttcaccttctccggcgtcccatcgcccgcggccaggggagggagaccggcacctcctgcttctcctccgcctccgcccgccttgggaggtccccacgagagcttcgactgaacgcaccgccgcaaccgattcccgtccgcggaagcaggcgaaggagtcgccttcgccggggaaggggacggcgacggcgtcggcgtcggcgcctcgggatcagcagatccgcccatgggaacgagcgagaaggcgaggcggagaggaggggatcgactctagggtttgggtttttgtgaacgatggggggaagaagctcagagagagtcagagtgagcacagcgggagacgggggttggattagcttcacgtttcccgcgcggtgaggcgaaacgcgggcagatttgggcgcgccgcgcatatataccgcgcgtccgcgcgcgcgcggaggagctttggcgccgcggtcagagggcggaacgggatgctggagcctggaggccgaggagacggacactcgcgtctcgagtctctgctgacacgcggcagattatttgatactcgttttcatgtctctcttgattttgtgaagaaaactgtaatcagatttttttttgagagagagagtgcaatcagaaactattttatgtcacttccatcgtctgttgataagaaattatatatatcactagagagacagggcctattccactatttccagcttatcatgttggatcaattctgcctataaataggttgttaaaacgaaccaaccatgacagtataacaataaggcatcacgataattctgggcattttgattgtccatagcataacagagtttggatgcacaacacatagcaaggtttagtcccatgcaagcacaggttcaaaagaaatccacgaggcgatagtttagaggaagataacagctaaatatgtgaccatggagcttatcctctcaaccacgtgttcctgtaagatgagttatcccgcagtgaagcatcatgtggtttgtactccatcagatagctgtgtggcagcttcagatgcctcttaattgaatctcttaatgtcatcacagcctgcacgacagaagaaagaaagtgagtacaagtctagagttcaaacataatagctattgtagcatttgtgttgtcccaaacctggtggtcagatgcattacggttccagacacttagaatgtcctcattgaaacgaacactgagtacaacgccacaaacatcatcactataatcaagttgatcacccactagcaccaacacctgagatataagcacaataagcaaaaggagttactaaaattcaagctaccatacatgtgcaccataaagaacagtttggtgaagcattgaagagcatctacaagttaatagcagaactggacaagcctcctgagaaaagtacatattattctgaaaacttttacatgcatatggctggtctcatgcatcattagtcattggaaccttgaaagaaccatttagcagtttgaaatcattctcaaggtgacttctgcgaaggtaaagaaaactgaatgtggaacatgctagtcccagatcatggcatgaaacaagccatcagaaaaggtttgaagatgctaaaggttatacagtatctggcatagacctaaatatagttgtgtaccatactgtgatgtgacaatgattcctatgaaagtcgggccctttgattcaaaggaaatttataggaatttcagagggtttcattctataggattttttttcctatataacctttgaataaaaggaatcaatcctacgaaattcctatggaatgcatgttcccatacaagttttggaggaaatttagggccccttggaatcgcaggaatgag

SEQ ID NO: 44770 - DNA, 931 bp, Oryza sativa
tgcacctgaccacgtggaactatatatacagtaacctgtattgactctaaggcttacattaccgtcggtaaccacgcagtgaccgtccttaccgcggaggtacggtaatagaaataccgcggtaacctccttaaatttaaataaattaaaaaataatttaaatttttgataaattttgcatgatttttcacggttaccgtgcggtagccgtgcttaccgccggggcgcggtaactcggccccagcggtttgggaaaccctgattgactccacatgattgtcaaacattgtgaatccggccgtatacaccaacaatataatactatgattgtcgaaatgaaacatatacgtttaaaaccatgcttgtaaagaaatctatctttatgatgttatgttttagaaagtttgaactatttccctgaacatgcagaatgtgacctttcaaacatgaatgccactcctaatgtgcctgggttttacaatatcatgcgattacttctcttagttttttagatctctttctgttagtaatttcttggtttttagtaaccatgatattgttgagtagggtaacccctccccaaaagataagggaaccctagttgtgttagcatgttctcgtgtatagagtttgttccataaaattgaaagcgtaaaatttatgtcaagtaataacttacatgtaagatgtacatacacaccacatgtaaccgcgaataatccttagcacatgtttaaagaaacggagtctagcggtaaatccttgactaaatattttcatgttcatattttctctgtttcataatgtaagtcattctagtattacctacatacatacatatagatgttaatgaatctagacaaagacatatgtcttgattcattaacatatatatgaatgtgtacaatgctagaatgacttatattatgaa

SEQ ID NO: 44771 - DNA, 3647 bp, Oryza sativa
  unsure (1)..(3647): unsure at all n locations
aataagacgaacggtcgaacacgtgctaaaaaatcnncggtgtcaaacattttgaaacggatggagtatatatatagtgccaaaaactgatactgcgagatcgcttcagaaaacgtgggggtaaccactaccctctccctccccgtgcatcaaccgctatatggcatcgacttttctggactacatacagtactgaagatgtatacgtgcacacaccatactcatacaacgtcgagcgagcgagtcatatatatcatagtaggctatgtttagttcagcgtaaagtttggattttggttaaattagagatgatgtgactaaaaagttatgtgtgtatgacaggttgatgtgatggaaaatgactgaagtttggatccaaactttagatctaaacacagccgtagtacacaccatgaagcctgtattttgattgattgcctatcaaggccactagctactggttggtacttgtagacttctccagccacttcgtgcgtacattaatttgagcggaatttgaggtaagctcttttaacggaagaagacttgagcagtgagtactatcagcgcaggtataatagagtacgataagctgacgacacaagcatccacgtcatagaaatcataggtggaagagagagaaaaccgaagagagaaggcagcgggcgctaatgcaatcgccgagctccatcacaggaaacgatgcaagtcctgagaaccagcccttagtcctagcttttgctcaatgacttaaccattgctacatcaaagattgggtagaaggaaacaagtctcattaaaaaataaaaatcaactgcttagggatgtgtgggtaggtaacttagcaggtagttattatacgtatcatctattagtaccatctattacttacgtgtataaattttcagcccatcaacaaacgatactattaaacttgctctcaagatacattaacctcaaaacaaacaaaatactagtgtgtgtttgcagctagcagcagctatcattcttcttttatatacgtacgttgctggtgggtttcaccattctttccatctttccatttactgtaagccccgtttgacttaggtgaaaaattaagattaagcaaggatacataaaatgagaaagccattaatatatgattaattgaattttaattattataaacttgaaaagtggatttatttaatattttagaatttaatattttagagtaacttctacataaaatagatttatttattattttacacgaaatacaccggttagacgtttaaaaagcgtgctaacgaaaatcggaatagaatatgcatctcaaacagtcaatttgattctccttatgagtttctgtatgactgccatgcactgaagctgatatttgttttttctgaatgaacaggaaaactgtccgttatattgattgattaagcggagaataatcaaaagacacctcaacaccatacccaaagtgaagctgaaattgaaaagctcccccttttatttctggatcactgggtgccaatcagttttgttttccagctttaattctcccatcatcatctcaggaaaaagaattaatatcagaaaacacataccagtgggctcacattacgtgtgtttctgtacacggagagagagagaaaaaaaggacgaaatatatagcagcaacagcaaaacagatggctaaaaattccttttccaccacgtttgcacatgcatacggtgatgggctagcctttagctatagttagttcccgtcatccgtccatggcttggcacggaaggaagcagacaggccaagtgcagcatcgatcgagtataccggccttttaggctgcgttcttatcacagtttttccaactcatctccctcgttttccgcgtgcacgctttttaaacaactaaacggtgcttttttttacaaaaagtttctatacgaaagttgtttaaaaaatcatattgatccatttttgaaaaaaataaatagctaatacttaattaatcatgtgttaatgaactactctgttttctatacctataaagagtgttcccaacaaggagcagccaacacacccttaatgggttcagtttcagcttcatctcatctccttttgtctttccggctttccccaaaggaagccatctagatcaagctttagcatgtgcccatggctggctgcaatgcaagtgcaggtgcagcctactacaagctcgatcaccccagagagaccaaaccagcagtggctggattttggatgtccagtagtaggctttctttttgggagctagctaggggatgtccaacagctgagatgagtcagatttgaccagaagaagagacatcttaatttggcgatcctggaaaagcctacgcgtccaaggagctgtaaaatcccatcgctgggctgggccaagtggcctgcgcctcttttgcggtggcgccgagtggcgaccacgctacacaccgtgcggactctgactaccgcctacgtggggaaagaggcaggcgtgccgcgtgcagcgtggtgctccatctgctgcagggggaagggaaggcgcgcggccgcgactcgtctcgcggcgcggggactcgcgtgccaactttgaaatgggccttgagatggggtgggctttttgacaggcggatgtcatataggccttgtagcgtaagcgcaccgcaaaggcccaattcagccacgcacgtctttggtcgctactatgagaggcctgctggcctggtgccccgacgacctgcttacctccgtcagaagttttgacaatgaaaaatggaaacttgtggttcgcttgaggtctcttggtttgtcgatgagtttcaaaattgttcctgaatcaaaatatcggatataataatattataaaattagatcacactgggttccaaggcaatattgctcctggttttaggtgattcatcgtcagtgtgggaaccacatgtcagggtatttcagtctaaaaaataaataaaagttgatggaccccatatgccaatgacacaaactctcctccttctccctctgtttctctcccctccctgatgcgaagagaggtagccatggcgggagcggatgaggccgggagtggaggaggcctgcgacgatgaggcgggagcgggtggtcgacgacgtcccacatcagcagcaccgcgccctcaccgacgacgtggacactagcagcatgtccgggagggagcgcgagagctcgcggagcggttggcgaatgctaatggacgaggccaaagagtcaaagaggccatcgatgcccataaggcggaggcgccctgtggtcctggaggcgccgttgacacaacaacaggggcggggtgcggcgaagcaggtctgcggcacggcgaagaggtgcgcggcaacgacaaactagttggtgggtatggcggcgggcaacaatgcggcgctcgaagaagttgcccgtgaggctggagtagccatggacgccatagatcggggcctcttgcttagctagcgggcgacaccgtatcaactgctcgatctatgtgtccaggctgtcgcatccctcgctgtcattcccgtcgcctcggcatcctctcccaggccatgcccacttacatctgacagtttttcttggacatagactgccctcacagaccaa

SEQ ID NO: 44772 - DNA, 3563 bp, Oryza sativa
atgttagggactaaaaatcattatcttttttttttcaacgtaggtgtgtcggtcgatggcctaggtgtgtactcggtcgtcgtcgtgagtacggacggcgacggccggagcaatttgccgtttaaccactggcctctcatgcggctctggccatgcatggaggtagccacatgtcagtagggtcgagttaatggcagagaatttttttcatctcgtttttcagatttggcttcgtggagaggtgccagtggctaattactagctagactgccggccagtacttggctctttcccatgatccatggaattcaagtattaagttagttacttggtgttttggcatattattgtactagatagatcattccaaattaagtatgggtgatggcaagtgaaaaaacatatgatatgccaacatggagggcggtatgctctaggtagatttgcatgctccaattgtcttgggcaagttgcttgggaaacaaaaaaaattagtgcagagacacatcaataattgcttacgagtgagtagtatttagtgattagtatgccataataagaaagtgttccatggccccagcaagttggaggtcaagttgtcaaattgaagttagccgaatgcaaacacaagagagtatctgtttcctccggaaaggtgaagggctcagtgttaattaagagtaaaaaaaaaaatgaagagcgcaggtgaaagattttgcacaaattgtcaaaaccttaaaatttgatcaaatattgcccaaaactcaaatatttatgattggatggaattaacacctaataataatggaggaaattcaaccttgattccttgaacataccacgtctaagaaagaaaaaaaaagaagatggttagtagaataatattttgaaatggttaaaaaaatccatcagcatttatatatagcaaccttctctcttctttcgattacatgagaaatgcacgtaaacacacactgctagtatatcctattactacatgctaaacataaggaaaccataagctcatacttcatacaataggtacatatatgaaaacagtccacagctatgtttgaaaatgggataggctgttggcaaactttgataggaaagagaaaaaagcgtaataataaaaccatatatttttagagattttcaatgatccacttatttccctcaatttattttttgaaaagtctaacttatgtttatttagttggctcatcaagttaatgtgttatccttaatattccatccatcaggtgagacgtgactaggaacaaattagtgctcacttacaaagcttcactactcaagtttggttgggagaatcttcttggttcaattgtaacctacaactcaccactgcacagatgcaaccaaaaaccatgtgagacaagccattgcttctgtccaacattaaagacaagaacgagagggtatcatggaaggaacaaaaacaacgtaaaaactaataaattaatgcatagtgatgccaaaacctggctaaaccgcacgaacagtccgatgttgacagaatggttatccctcctatagcaatctaggatgtgataagtaagactcatcctatgagtacgaattagaatatactcaaagctcttgaacatactcaaagctccaaaataagccaaacggcttatttacaaaaaaataataatttatgaataaaacttttatatacgtgttcttagcgatttaaaatcaaaggctggaaaataaaattcgatgagaaaacttcaaaatcaaatccaaatttaagattgaaaatttaaattttagctgataaatataagcataagcgaaaatatggggctgtcaatgtaagttgccagtattgggagggaggaagtagcacacagaaacattgagaaggaactgtgaccagctcagttagtaaaaggtgcatgaattcttggccagctgccttcatgagatgtccctctcatggatcaacttatctaggattattaattttatccttaaagagacaactgacattgtgaaaaacaagaactacaatagatttccaaattgttttgatacttctgttgaagctcagatcatttactaacctggtaatatatccaccaagttaaaagagtggcgatgatacagtcaaacgcattgtttcatccatctactgagaaacctacgtgttctactcaattactctggtgaaacatacaaacatcgccgatttgtacggtttaacaagaaaaacaaagcccataaaccctacgcaatattttagccccgatttctctctccccgtgtttgctatacttgtgttcacaactaatgaagttggaaactaaatacaagcatccaaaatgagaaagacattagaacataattaattgacttttaattattttaaatttgaaaaaaatgatttatctaatattttaaagtaacttatatataaaaactttatccactaaatatattgtttagcatattgaaaaacatgctaacagaaactaaagtaaaatatgtatcatcagaaaagaatgccttagagtaggtacaatagcagactataagccaactataaatatattttattaaaaaaataaaagagaagagataagagcagcggactatagatttgtagtcagctatagtacggattccaaaacacatgtgtgtataacaggtggggctagatattgattgtgtagtatatatttatagataactattgtattaattagctattaaattaactatagatgatttgaagctaatagttggctataggattaaacttgctcttgctaccagtctacctgtgccggcttaattccctttcagctagcacagtgccgttccggcgcggggccagtgccaagaacggctcaagcctccctgtataaataacccgctaggtgcccactcgtacttggcaattggcaactatctctgcttcccctgttgttccctctcgcgccaaaacatttgccggcaaaccaaaaacagaggaggagcacacacgcacgacgcgtggtaggagagtacgggtacggccatggaggtgaccatggaggacgtggccggggacttcgagttctccggctgcggctccaccaccaccacctcctccgcgtcctccctcgacgacggcacggggatgtgctacgcgtggggcgagctgtccccggtcgccgactgggccaacttctgctgctccgacgacgacggcggccacgacctgcacggcctcatcgagtccatgctctgcgacgacacgctcgtcggcgtcgacgacgacggccaagctggcctccaccacgcggatatgttccgcgacgacctttactgctacggcaatggctccaacccgagcagcaccaccaccacgaaccctggctcgccggtgttcgacgacccgacgcagggctgccccgagaagggcctccggctgctccacctgctcatggcggccgccgaggcgctctccggcccgcacaagagccgggagctggcccgggtgatattggttcggctcaaggagatggtctcacacaccggcagcgccaacg

SEQ ID NO: 44773 - DNA, 14826 bp, Oryza sativa
  unsure (1)..(14826): unsure at all n locations
cacggtggtcgaggaggaaggcgaagccgagaaggacgacgacggcgactcggccggcgacgccgcggcgggcggcttcgtgcggcagttcatggaggagctgcaccgctactccgcggtgtgggactctctcgaggccgggttcccgacgcagagccgggtgcgcggcctcgtggagcgcgtcatcctcgcccccaacatcgccggcgccgtgagccgcgcgtaccgcggcgtcgacggcgaggggaggtgcgggtgggggcagtggatgcgcgggagcgggttcaccgccgtgccgctcagctgcttcaaccacagccaggcgaggctgctgctcggcctgttcaacgacgggtacacggtggaggagacgggtcccaacaagatcgtgctcgggtggaaggcccggcggctgatgtcggcgtccgtgtgggcgccgccgccgctgccggtgccgtcgtcgccgccggagggggtgtgccagcccgtcgtcgggatggcgccggtggccaccggtggcttcgcgcggacggagtttgactatattgattcgttccttgtcgagccagcttacgcgctagtttgagtcgccatctagcttagctttggattggatgtgatcgcagaattcagacgtaaaaaaaatgtagctcccgtgtaagttgagttccgttggtgtgtcaaaactgtcactcgcaagacgttgagagttgctaactcttagtacgtgtgtgttggtcgttctcattcgagagattggttagcatttgatgttgcacaaaaatttctacgtaggagtgcactattgtgcttgcttatcaacggtaaaagttaatcgtaaattgttgccagcatattgactttgttaaaaggaaattgcatgcatacaacccaattatccgactcacgtacgactgaatttgataaacgtttataaatggttgcaatgcatatgaatatgctttatttgatcaatctatggttacatgtttctatttgtatatgagttgtacaactgggtcatacgtatagcagtactcttgttaaaaatacaaccaccatgtaaacaaaatggcactttctaattggttgggctacagctgataaacctgaaaaataaacaaaccaatcaaaaataatttatagataaaacttttagaccgatatcattaccagtttaaaaaccgacgttgaaaaattgactagacgaaaaattccaaaacttttgtttcacaattcaaatttttgttcttgttgataagccaacgagcagagactacgagagccatcaaagctggagtcgggaaagctacataggcactataagagagagagaagggggcaatcaattagtaaactcaacaacaataatcgaagataaaacaccttagggagatgcttgtgtcttgattggaaagcaatattattgtctgtggatggacctcgatagcatggatccggtaggaccctctgtgagtttgactagagagctagtcatgtgagagtgaggggcttgagctcctctagagcgctagaatagattaacacaaagacgtatacaggtttgggataccctagaggtgtaacatgctactcttgttgtggtggtttctcgttcgtccttgaaggatcttacaagtttatcgactactcaaatagattatcttcctttctcttatgggtttcctaagaatttgactcaatgtgttgaagtctctcctcagttacccaacatcccaccccctcctttggtcctcgctcttcccttatactttctctcagggacaccacataaccacacttcgagggaagattttattcgtatcaacgtaaggtatggttgtctcatcaatagttcattttctctcttgctccatcagccgcaggttaggccttagtggggcccactgtaagcggggcatggcaaattggtgagagtttgccatgctaacctgcctaatccactagggcctcaggtccgtcttgagcggggccttcttcatgcggggcacgacgacaacttgccacatgctcccattcaatccaccaaacatgtggtgaatagggttcgttgtgccccggtaggtgcggagtccgcctttcattacctagtgagaggcagaaacttgagtgggtcctagtgaggacactgtagtcaactatgccctccgattatccatgcccgtgtcaggaccaacacagttgaagcgttagttgaagcgacgagtggcagttgctgcagttgccgccctatcttcatgctttctgctccatggtagataaccgtcccataaagcataaatgggacccagtgccagcctaaacctgttgttcagcctctgtctaaggattgtcctcgaggtgccctaagtggtgcattcttcttatcctgggatagaccacgtgccactccacatcaatctcctgtacggataacaggccaaatgaagagatacgtggcacgttcctggtgcacgtcgattgcctgagaccgcagttattgggtcactgacaaatatactctctctggcccaaaatataactactcatgaagattgttaaataaattaaggagagagataaaaaatgctagattgcccttaattgtcaccaccgttcctaatcccagcgagaagagggatgaaagacaaggtttgggaaaaatggacatttcacttcccttcagtgacaaaagattaggaagaatagcaagtctgtcatttaaagagtgacaaatagttaaactgcattgctaaccttctgttgacaaaaaatccatcctcaaatcttgtagattttgggctaagggatgttcttcacgattaatgctccgggtgtgtctcatccaactctggtgacttcctcttctcctctggttccgacaacaccaccaaactccaaatggaggacctacaaattaaggtcatgagttggggatgagggatggaagaaaagtgggaggtcaccgcctcgcagggcttagagggatgaccatggtccatgggagatggtgcccaacattgggcagaggaatgggtgggcggctagggcatcggtgctgccaaagcgcgtggacggtaggcggcggtgggcctgtgttgcaggtggcaggggtaaagcagagcgacgagttaggaagtggtgaccagtggtagcggattcgacagtgaggaaccacttgagacgagaaaaatggctgggtaggggacctcgtcgttgatgtcttgaggaggacaacggggtaggcctgcgcatcaaataagtgtcggttcaagcatgcggtgctgaaggaaaaggaaaaaaaaaagagaaagggattaggatatggatacatgtatgaatccccaagcaatccaactatctaaaattacaagattttgagtggtgtttctgctaaagatgtactccaataaatagccaatagttaaattttcccaacaggcccatcatcacgtgattcgcacgggttgcacgtcggttctggacttctgatgcatcgttcggggagtgccgggcacgcagaggcgttggtgcgttgcaaaacaaacatgtcaaaaccacggagataaccagataatcctcgcacatctcgcttcccatctcgtttccaccgcacctttttcctctcggcggaaaatcccagcctcgaatgtgccaacgagctcaccacaggcactgcacagctcgtgcgcaacgcccagaggaggccgtgggcttcctgtcccgcgtccgcgcccaccacatccgcaattccgcacccgaatctcgcggcgtcgcctcgtcagacctcagcccacagaaaacggaaaaaggaaaaaaaaacagccaagccgccgccgcgcggagcacagcggctcagcgtcagcgagcgagcggcggcgcgcccccctcgtcacgcacgccgcactcggctgctacggtcctcacgccgcttcggcttcgcgagcggacgccggcgcgcgcgcgcgttcggcgagacgcggcggcccttctccccctcttgcacaccccccagaccatgcgcgtctccgaccacgctgctctcccgtcgcgctcctcccagcagcagcagcgcctgtccccgcatggcgagccccgacaaggtcggctgctcaccggagccgctgcccctcgaccgcctcctggccgagctcgccgccaacgccgagcggctcgggaggaggtgggaggcggcgctccgcaaacggggaagggagggagccagagcggcgggcgtggggttggaggagggtaggaaggcggattcggcggcgatgcagctgcacacgccgctgttctacgccacctgcgccctcggcgggctcctcagcaccggcctcacccacctcgccgtcactcccctcgacctcgtcaagtgcaacatgcaggtctttcgccgtgttactgtagctcaaatctctagcttccccaatgactaatggaactcatacaaatcactagctccctaaatggttaatggaattcgtgtgtacaatgtattcttgcaggttgaccctggtaagtacagggacatttcatctggatttggtgtcctgctccaagagcaaggtcttggtggattcttcaagggctggatggccacgctggttgggtacagcagccagggggcttgcaaatttgggttctacgagttctttaagaagtgctactcggccattgctggcnccgagcatgctgagaagtggaagaccttcatctaccttgcagcgtcggcatcggctgagatgattgcagatgtagctctctgccccatggaggctgtgaaggttcgagtccaaactcagccaggatttgctcggtgcctgacggatgggtttccgaagattgtccaatctgaaggtgcctttgggtatagatactgcatttcttgtatacaattgtgacttctgttcaaagtttatttggggacatcctataatacaatgtgcgaatttcaggctttataaaggactacttcctctctggggtcgccaagttccttgtaagtcaaatgtctcgttagcagttatctttcactagagtattatatttgcatgtcaggtttttaactgcataatgtagaccataggtccatagtaatggggcaaataaaaggtccatagtagcaactaacatttgacagcaagggctatagcaaaatcctctggtgagttactgtttttgctcatgttcctactgaaaggatattagattttgtgtgcaataacattatgtgccacgagcgttgaccatgaagagaagtcttgaagtcgcatgctcacaaagagccatcgttgacagattgatactattctaacataccaaattgcccattctactgaatgagtgccactcatcgttgctattttctgacagaagaataactttagctggcactattttataactcttttttgagagttagtattttagtagtctgctctcctaataatgctgcaagacatagtctgttgcactttctcgaacaaactatattatattttcttacttatgtggctactctatggaaaaattgtcaattgtaactattatcacggtaacaacttcagggcatccctcgaaatttacactacgaatttaattcattgcaccctaagtagaagtcaagatcagctgtagttgtcaaaactgaaaacaatcaaatggttgctgtagctttaagctatgtatactagatacctcatttgttttgctcagcttcttagtttgctattcttggaaaaaaaaatggatggaaaatttaacatcaatttgtcaggatgataaaaggtgggagaggagataatcttccaacacgtttatggggaattggtttgttgatatcgaaatatgcccactttagaaatataccactcaaagttaccgatgcacttcaataccacccaaagtttcaaaagcatagataattagatatctgccataccatttttttaaaaaaaataaatcaaggcaatgcacttactaacttttagtggttgttttaatgaggaaaataaaagcaggtttttaggggggaaacgacttttaattcgacttttaattccgttattccagaatctagatatatgtaaaatcttgtttggctgggcaccaaaaacattgtggagtcgttcctgagaaaatacgatttttccagtttcgaggaaacttggttttatccaggatctggtacatgaaacaaacaaggatttacctaaaacaagattaaggtaaactagaattaataaaatgtagtgtaaattgcagataggaccacatcttttaaaatgtaagatgctactaagtcccgtacagatgccagcaattcttatgccgtttccttttaggttgttattctcacttgtgtctaaactactttcaatttccagatactatggtgaaatttgcttgctttgagacaattgttgaattagtatataagcatgcagttccaaagccaaaagatgaatgcagtaagccactccagctagcagtgagctttgcagggggatatattgcaggagtcttctgtgcagctatctctcatcctgcagacaacctggtgtctttcctcaacaatgcaaaggggggcactatggctgatgtaagctgctagccctctcagtgactttcatataaaaaaaaagttcttacacctactgtcaagtaatgttctactgattttgtttaactatttctgaccaatgcattgcactttcaggctgtaagaactctaggagtgtggggccttctcactcgtggccttccactccgtattattatggttggtactcttactggagctcaatgggcaacatatgatgcatttaaagtctttgttggactgtaagtacatcatggacagttcgatttttgtattgtgatgcctaccagttatttatgaatcataagcgtttgtgaattcaatctccaggccaacatctggtggattcattcctagtcctgctgccaccgatttgcgccaggtggatcatgaaaagcggagttgaccacatcgcgtaaatgttgtgctgagctactacccttaatcggagtagatgatggcaggcagttgctctgattttcatgagagcgggaacgtaggagatgacctgttgagcgaatttggaacacaattttaagatttagcagtaggaaattcacattcaaggggtttttgttgctacctcttgaatgacaggcaagtgcaaggaaggcaataagcttgagggatgtatttggcacattgccaaactgatctgatcatctgatgtttcaattggtcattcttgcctctgttggcatttcctctggtagtttccatacgactgtttatccagcgtacatgatagcatgaataaatgaaaagaatgttaaacatgggtcgcaactatatggtcctcaccgaaatcaactgaccaaagcaagagcaatttcgcatgaaagcagcccatcaaggagatctgatcggtacatactgaattatcgatgttgtatgtatgcttcgcgcaattgcatagcacccagctcggtgctcacgggcacacaccgtcaacgtcagacaatacaagaacaatgtgcgcaagcgcaatagacaccaagtgctttgaatagaagtatcaaaagtatcaaggtggaaaatttcttaaaatcgacaatactatagtctaagagtacatgtaaatatataatgtatttgacaacatacaaatttgggtcaaaaggcattctacagcaaactaggcaatcattgcaacatttgtagcccgacctcagttgttgtcgcttgggtcatctactgctgcggcccaggaaatccttgcattggaggacgaggaggtgctccaggagtgaagttagccattgcaccaccggtcataggtgggggtgggattgatcgtggaggtccatttgcaagtgggggcggtggtggtggaggttgagtaccaccaacaggtgggggtgggatccttgggggcatacccataggtgcatttggtggaggcggcggcggagcctgtggcgggggtggcggaacctgcggtgggggtgggcgtggtggacctccagatccatttggcaaagtcccaggagccgcaggcggcttattagcttctggttgtcttgttttgaagtatagttggagctgttgcaaacaacacgaagataagttgagaaccaagattgctatgaaggcaggctaaatagcctaaattatgaacaatgaaaaactatattgtactcacaatgtactgtttcttgtctggatcccaatagttgaagaatttatctgctgacttgtcgatctctgcgcttggtatctgcaacagcaaaaattgttagcaaaatacaatggccagttgatctgaaatcctagcagcaaaacattcaaaacacacaccttaaagccaataatttcatagggctctgctgcaaaaagtagatattgatactttttatcccaagattcgactttctgtacaaaacatcagtctgttaggttactgttgatacatgggagtaacaaacaaagcaacataccacaaactgaaaaccgaacaatcaggcaggttgattgctttacctgttcatatgatgccatgaaacggtgccttggcttgctgttttcttcaatttcaggataaccaatctaaaagagaaatatcaaaagttatcaccccagcgtacaaaattatatacatgttctaatgttataaggataaattttaaaaacaaaatatcctcaaaatttgtcggtgaactcatttatccatcaccattttgaatgtgatagtcctcaaaagtcccctcatcaaaagatgaaactccaggtaacaatattataaaactagtttgcaaatgtggatgtaagggaaactatagaaagctgacattgaacatgaatatggagaaaaaaaaggagctaacttaactggagtgacaaaaagatcatttccataagtatgtaactttgatgccctacattacatgacatgaaaagaaaaataagcaaaattatctctatatatatggagtattggaaagtgaactaatttgttctggacttcacaatattaacatgtaaaaacatgtatgaattaaattcaagtgccaaacaaatgtaaacgcaatgaacactgacctcaaaaagaaatgagtgttgcttcatgtcaggatcatactgcttagtcacctgatacccaggtcttccaatcttaactgaaaaggaaggaaagataattaaaatattttgtgttagattcttccaacagattcgaccatgtccagatagctggacttaaagatagcataactatccccaaagatacagacaacatgaaagggttcagataagaaactggtcatctttgagaattgagccatactcagttttaagccaaattatgagctcctataaactttaagtatagtaaaacaccattctggactagaaattgctatactccatgaagttttcagaactaatccaaatattcatgcttaggctccaattgattagcataaccgaatgtccacggtgagttttcattttcaaggctttttcaaggtgtcatactgtcatctcctcgtctgaatttggtaattagctgtttgaccttccatcggtagattgatttgaagaaaagattctatcattcaatcatttatgaacaattttcattatatttagcagaattcacccacacaaatttgccgctagacactaactaccaactacatacataattttggatctttttttcaactgagagcaaaccaatatgatttagccatacttggtagaaccaaacaaagccagaatgcacaacagtttagtgctaatattcacattataaccaaaggacgttaatcctgggggaaggagacgagaagagatgttttactcaccggacttgcggggcgcgaactttctcttgttgggctggggctgcgcgggcgcgtccttggcctcgcgggcggcacgcttggcgaggttggtctggtgccgcttcccctgcgtgtgagccaggtagttcccctcgttgttgtgcagcgtcaggcacagcttgcactcgtagctggacacgaaatcgagcgggattagcgcgagggagcaaaccgaatcgaggaagaagaaagctagggttttagcgggtgggaggcagtacctgccgaggtggttgcgcatgaagtaggggtccttggcgaggtcgatggtctcgagggcgaggcggcggaggcgctcccgccggtcgatggcctcattctgggcggaggcggcgccgccgctgccgggcttggagccccactcgcgatccatggcgtccccgctcggtctcgccgcctctcgagtctcgacctgtgctgtcctgctcgtatgcggtgtgtgccctctcctccctcgatttgtacacggtgcggctcaggtcggttggtttttaccagtagcggctatttttgggcccaagcccacttcgttgcggattcagcccaaacattgctttatccttcttttataccttaccagtcgactagtaaatattaacataggagtactatacaagctatacttaccaagttaccatgtttccaaaaataaaaaaaaattggactaaaaatatagtcctaaagttagagatgatatgggctaggtttttgtttcaggaaattatcatcctaagtttctgattgttttcattttcattgaatagtagccttactgtattcttttttttatctccaaaactatctcaaaattatcctatcgacgctatccgttttttaaaagtggctggatagcatctactattcaaaccgatttcttcctacaattgagtaaagtatctttttttcccaataaataacgttcattctaggaatttactcacttcaatctgacggggtggaaaaaaactcgaaactcatgagctaactcaacttgttgtaaaactcggctcgactcaggttgagtttaaacttttactcatttgcttaatgagtcaactcgagctagctcgtgacttactcggttagctcgttgagctcgtgatgcattaaaatagaagttaattgtctatatatttacaggtgtaaaggtcgtaaattcataattatccattgtagcacaatcttatgagtcatgatgcataacatgtcaatcgtaatctttggtcataggccaacaaattatattgtatatgaattttaaatcatgtattttggtgcaacgagtttagtgagtttaatgagccaactcagactttttaacgagtcgagtcaagttcagttttttacttgttatgttaatgagtcgagccaagctagctcgttaatttaacgagtttttacgagccgagccgagttggctcgttagccaccctacttactggtacattttttttctttataggacaacaccatcggccttataaatgtgagtactattcatgaaaggctaatgactatgatgaaaaagaacaaaacgtttgtacgatggtatttcgcacaaattacatccactgaaaaactatcacttgtaaacggcaaatattttttttccgatcacacgaagacacgaacgcgtaccacgatcgaagccgaaaatgagcagaaccattctgagaaggggtctaataccatcgctgtggtctgtggctcttaggagcgtcataacatgaaatacatggtagtccatgcatgtccttattacacgataactctagtactaatcttattcgatcacaatttgcccaacatttgccatcaagtcccagagatcaccaggcactttctatgatggcccggcaaacacaaacaatacatcaactagtacacctttgttgctgctaaaaccagcctatcaaagtatcaatcaccaagcacgttgctgctactctgctcttccaacgggtaagggatcgtggcgatgtggttatgagccacggtgccgatccacagcttgcgccccacctccctcacctcgctcaccagccgcatcacctcgccgccccggtcctcgagcacctcgacgacgtccccttcgccgtcgaggagcgcgacgagggtgtgcatccgcatgctgaccatcttccccagcgtccgcatcgtcaggggcagcttgaagtagagcgttcgcagccacggccgcttggcgaacacctcctgcgccgccgtcctgcagcagtcgatcgccacccagaaccgtccgccgccgccgccgctgctcagtcgcacgttgtccgggaaccccggcaggtcggcgaacacctccacctgcccggctcttggccttccagccagtaccgcattatcctagaacagcatatgcgtgcaatgttaatcaattctgaatcttgtttaacctttagtattttcagaacctgtgaaagcttgtgccatttcacctgcagtttgttgtttcggagaagaggaggaactgctggtcgtcagaaatctgcacgccattcgggaagaccagcccgctcagcacgacatgggcagctttggtttctgggtcatatctgagcagcctccctgtgccttcaccttctagcagaacgttcagatgatccctgcacaactgattctaatcagaaaatcttgaacgatagaaggaaatagagaatcgatacaactgaagagagtgatactgcagctgcacactttctgttgtatctcgtgctcgtgtcggtgaagaacacggagccgttgcggtggatgtcgaggtcgttcgcgaagttgaccgggctcccgccgacttctctcgcgagagaggtcgccaccccgccgttcggaccgacggacatgagcccgtagtacgcgtcggcgacgtagagctcgccggtctcgccgtgaaacctcagcccgagaggccggccgcaccgtcgctccatctcgtgctgcttcttcgtcgtcgactccaccccattggcacaaactttctccgacctttttttgcaatataagaacacgtaattgtacactgctacgagaggtgttttcgtggagggcgagagcaaaatgcaggcgaggtgttcgttaccagtcagggctcatgacggcgaacgtctcccacccggcgtcctcccccatccaccgcacgacgcggccgtcggcgaggccggcgtaggggccgcggccgtggcggtcgaactcgatggactccggcccgaacacctctccgacgaactccagcctgccgtgcctgagccggctgccgttgtcccgcggccaccgcgccatcacctcgcggtacggcgccagctcgtgcctcaccggccggtagtccaccccggcgagcgggccgaggtggaacgggtcggtgaggagcagggccagcgccagcgccgcgaagaaaaggtgcggatactgcaggatgccatcgcgccctctctgtggacgctgctgctgctgcttcttctcttccatggagatcaggagcgagggaagacggaatttgcacgcagaggaaagacggaattggtggagacggtgatcttaacttaaattcttaatgcctttgcagcgaaaatatatattcgatgcatggaggttgcatgagtcagcgtgattgtttgggagtaggtgttctgttggttcggaatagccaaggaatcttgtgctttcgaagtggggatttgcatgttttgcattgctggatgacggtgcaagatgcacaggtcaacaagcatatcacgatgcatgtaaccgaacccggccagggctgagggccctgaccatggccattgctagcgctgtaaagcaaaaggtgcatcacgaagaaggaagaactccaagtgtccagaagttcaatcgatgccacccttctaaacgtgcaggaaaaatcacaagacacaggcaatggtgtgtcgatgttgcaagaaaactaactctaagtcttagctaaaacatttactgtggttgagcatgcgttgggttatagggaagtctatttgtccctttgttttttttgttactttaaaattcaactaaaaaactattttttataaatatatcaatgaccatgaagtttaaatttgacttacataggtacaaataaaaataatgaatttgaccattcataagcaaatttattgttttttgtttctatttgtgtaagtaaagtttgaatctgtatttttaaaaaaaatcatatattcatctgtcttttcatatatttttttccaaaaaattatgttttttaggtgacgtaaaaaaataacggcgcgttctcttgagggaaaataaaccacctcttaggtttgaaaatggtcaaatatatcttaaaaatcaatgacgtttcatattaaaaaaaaccggagattatcttaaaagtcatttatatatggtttcgataacttagtggtataaattttaccatgttccttaatcaagagttaatagtcgaggggtaaaacatgcttatgctgtgttattctcccttcttttcctacccaccttcatctttttttgcgcacacgcttttcaaactgctaaagtatgttttttacaaaagttttctatataaaaattgctttaaaaatcatattaatccattttccaagcttttttagactgataattaatatcgctctaatcgctttctttgtttgcctcccgaactcaacctactatggatctcttagcttttgcataagatgtcatgtaggatcatgtgataagatggaatagagaaagaaagagagagaaagagaggaagagacgaaaggacaatctctacacaaaactacaaacttataggaatccgagagaagagaccaataaattaagtgaaaacaaatagagaaaaattagtatagcatatca

SEQ ID NO: 44774 - DNA, 1147 bp, Oryza sativa
tttaccaaaatttagtaaggttaaaaacggcatcaaagtgaacaagccctaaaccttatactatcttctctatctaatgcattatttgaccatagaaaggtgagacttgagagcgccacagccggaagattatttgaccttttgaattcatctcgaacccacatccttaatccaacggctcacaaaagcacaattgacgtggcaccttcttcctgccgatgctctttcctcaccggcatgcaggccaacaattcgtgtcactgacacattgggccccatacctcaacgaaaacttcgggtctacgagtcaatggccaataaaagacgcaaggcccgcgaccctctcaccggtctctagtctctccacgcgcaaggaagaaggttcgcgaatccccttctcccttcggtttccccttcttaattcttctcgcctcgagcgaaaatcttatcattgtagttctttccatcgcagagggtgggctagggcgatccggggggcgcgaccatggcttacgtcgagagaggtaatccgatttcccctatccggtggatgctgtgagatctgcgtctataatctgttttgatctgtgatttgtgcctgtgaattcgttggcctacccggtttcgtcaaataatcaaatcttggtttttcgtgtggtcatatctcggtagtagatttagatatgtgggtaaaatatgcaggtgtgtgcagattctgacgctagagtaacgagtacagctgctatgttacagcaaatctaaataagtatccacataccacagctagcgatttctaatagtaatggcttaatattgaccaacctggaaagcagggataaatttgatggatggagttgatatatcaaaattaaaactaaaaatggctgctctagaatgccttgtttaacgtttcctggacccttttcactttcttgcctcttgaaacttccattcaccttccatagaatggagatgttttgagggctattgtttctcatttgtgagatatacctctcaattgttagatgccaagaaaaaaagtaaagagtattgaatagttaccgaccttttcgaggaaaaaactaactagttaccaggttttctacatgaccaatcgttcaccatcactgagagtcaaatgagattg

SEQ ID NO: 44775 - DNA, 1224 bp, Oryza sativa
agatccatatggatacaaaaatgtactgctagtaggaagtagtaggtcataacacaagtaagggtggcttatggcatagcggcatagcatcttaaagcccctttgattcacaggataggcaaagcacacgaataggaaaaacccaggaataaaagtggtgtgcttctttaattctacaggaataaaaacacaggaaaagataataggagcccttcgatagtgccataggaaaaacaaaggaaaatttacaaagaggttatacctcttggtatttttcccatgaaagtgaagcataggaacatagtcctataagccaaagggaaacataggaagaaaaatatgttggaatttgaatcccataaaattctttgccactcctaagaatcaaaagggccctaacaccgtaagaaatgttagctgacagatgcaataaacctttccttatgtaatccattattgacatattgctttcaaaagcagagtgagagcagtgacactgtaacattacagcaaatagtaaattgcataatagatcacctacaggagagaatgacagccctgaataattgtagcttttgtcatcacctacacaaatacttcactttaatcagaagtaaagaacattcacagccctcgcggcaacacctagccataatgtgggaccttattttaagaaaaaatgatataatagtcactaaccaaaactactgcaccaaaatcgaaagcagtcacaatatgttggcaacaaagagccccaccttcggttttttcggctaggtagcgggcttaactctcttatgctgaatgtaccttaactgatgcttgtgcagtctattttccctgcacggagaagtaaagcgatagaaatgaaattgctatggatccagatgtgatactgaagaggcaaccatcttaaacatcaaaggggataataaaatattatctggaacttatgctaatcaggtgtgaatgatgctatgtaaatcctaactggtaatgtaatacgcactaaacaccttgtttcatctccagggactatgtgtcttgtaactgaatctgtatatagcactgaaaagtaagtaagattcagaggccccgcaaaaaaggtaagattcagaggcaatgcaacggcatgaacaaaaagggaaaacttcaataagctagtattggtcagcagcagcacatccacatgacagcaagcatgaggcagagcaaagcagtaca

SEQ ID NO: 44776 - DNA, 15039 bp, Oryza sativa
attcctgcagcccttatgtaatacaatcaacgtaggttgtatccattctaaagaaaatcaaccctgctttttctttatgaatgtaggaaacatgcatggacttaatgaaattccttttttatgctggttttagatgaatttgtgtttcactctgtttcagaacaaagaattgcatcacaacaggctaaatttgtttagagcagtgcaagaacatgtttgcaggaataggaccttgaagattgttgttggcaagatttctatatgcaaaatttggtcaacaattgcacagaataaaaataaagcatacaacataattcttagacgcgataaaattttttacagttcaaaaagctcaagtttgccaagttcagctggaattcgagctttgcacaggcacagctcttttcatgattgttacagggaggagggttgtcagttgatgacaggaggtcaggattagttgctttggaggtgacaggctaatggtcgcatttgctttagcacatctacatctttaagtttctattgaaaaatagacttgtgatggtgatgacaaattcaatttccctttaagttattttgagactcctccagtctttccactattcattcataaaaaacataaaagattggcatgtggtaatccatggcaaatgattacaaaaccacagaacacatcaaccatgaaactcaaaagtacctgcagagctagtccataacctccatcaaattcttgttcgaagaaaagtagctgtagataaatatttggcaattgagagaattataaataatattccaaaattcaaaagagatgcagaacataaaagcttcaattccagagcaaccgaaggaataatcaacatcataccttaaattcactttgtgcggctgagttgactctgactacaatgcctgaccgagcttgttcttcacttattgttacaccataaaaaagagcacacttcttgtcagcctataaatagaaaaatatatgtggtagccatcccattataaacaagatcataaaactggtagtggcggaacctttcctggtgctgatgatccaactgggagtgatctcaatgtatctgttccacttatagcttcttcaagaacattcaagacaaaaggagaactggaaggataagaactgagggcatgttcactttgatgccaaaaaaatccttaccaaattttgacattgccgaaattttggcaactatgccaaaattttggcaactggcaagatttcttatataagttaccaaaatttggtaaggttgaaaatggcatcaaagtgaacaggccctgaacctttgttgcttaactcgaccaaattttttgtgttgacctaaaccattgctgaaagaatagaacaggaaggagagaactgaatcctttctaattcttcattataccaagctgtcacagaccatgcgcagaggacgtcggacccggatgcttgaaggggacaggtttgatggagatctcaacggccaacttctgccaatccgcttcctccatcctcgcgggccgcccgcttcttctttctccaccggtcaaactgtcagatccggcgaggaattgagctgccgaccacggagcggcgccgtagatttgggtaggagggaagagtggagcggatgggcagagtggagggggccggaggaggtgctggcagaggacggcggtggccggaggacgacgacgctgggagacggataggagagagacgaacggagaaggctgccgccgctgacagaaggggagggagaagaagggaggggacacggcgacaacagcaacgacgggcgccgcatctgtcctccctcgtcgcaaccgccgccgccggcacaagtgaagggagaaggaggaagggagcacctgtgccggctccgacgggcgcctcgcccgtcctgccctcggcggtgctgccacaaggtgaggtaggagggagaggagagggagaaaaaaggggagggaagacatcggcgtcagctcgaacgcgccatccgccccgacgccgccgtgagggaagggagaagaaggggggagcggggaaaccggtgacggctccaacgccgccgccaaatcgccgatcggaagggggagcgaaaggggatcggggagggcgacgtggggaggggagcgctcgtcgattctacgaccaggtaaggacgtatacgaacggccagattttgtccacacgtgggaaacaacggctctgatcaggtggactcaatcagaaatactaaaataacgagggattttagggcaaccataatgtgcatggaaactaaccttaaggaataaagtagtaatttttgttgtacctttgtacattgggagatgagctagggagagaatagtgctatgtgcaaccttaagcttaaggctagccataagaattaaaaaaatatatcatggctttgcaacatgcatgcacactttcaatcttgagtaaatatgtgtctttttactcaatgggtcccaccttaaggtcaagaagctaccacatacattgtagcatgtactatagataaaacaatataagaatgtgggtctcatcttatggctcagttgatctaaaacattgaggatgctcttatgcaaaattcgatggcgtggatcggctgagctcgcggcaaatctaggacgtttaagatatctagttgacggagcgtggggctcctcaccgggagaccgcgcaggcccccctttgccggttcggccgggggcgctgagtgaggttcttcaccctcgatctgtggaacgttcgcgagagagcaaatgcacaagacatgggcgatgtatataggttcgggccgctgagaagcgtaataccctactcctgtgttctggtgaatctgtgtgtgaaggagttacagagcaaatggagagcaagagagttcaagctctagaacccctctttttccttctcttctggttcttttttcaccctccctcccctcccccccttttaggtgggcaatgtcctccttttatatctcaaggggataccacatgcacttcttctacctactcttcttttgggtggggacccaccctatcttgaccaaatcttgactcgcgcctccgcctggaagctaaatcaccgcttgtccttgagtgatgcccagcgccgtcactcgtcggacacaggggatcaccctatcatttcttcattaatgggaggagatcttcaatggccgctgtctgaatgaccctccgatgggatgggtcatacttacctccactccaccggaagcagatgcaacgtgggagcacggttgtctgccgatgacgtgaccggcgttagtccagtcacagaccggtcattcttctccaccacgcgtcagtttagcatgccgcacatctgcccctcttcatacagtgacttccttgcaacggttgcgatgaagcctggcatgaatcgagtcgggactgacgtgctaactccaggagttaccacgccggctccagctcgggacgagtgccaagaggctctcatcattccgacgggacggggcgaggcgtgtgacaggccgcctgctgccacgtaactcgcgatctgaccggtctgtgaccggtcacacattgcgaccggtcacggaccggatatgcgtgcgccgtgctgcattaaatgcggcgtggcgcgcttgtccattccgcaataaatgtggtttggtgagcgccgctgtgcccacctaacccacacacgtggtgccaataccacagggggtcggggcgccccagccctcggggccgaaacaggagcagcccgacccctcggggagacagaggagggggtgggcacgtctccctcgggcccgaccccccgagggggtcaggccacgtgggtgaccgcggctgcccaagtctctagtcatgatactcccggtcccatgtcaccgacagtagcccccggcgttatgccagggcgttcgcccccctcgagggaagcgctcgggcgtgacgccactctttagacctggtgacaggtggggccgctctctacaggcgggcaggaacccagcggtcgcaaatcgcgcgcatcggctagggaaaaacgaccgataacaatgagtggcctcttcaagaccgttacattactcgagtagtgcgcgaatcgggacgagccggttcatttcgcctggagatatgatgatggcgcttcggtcggcgagcgtagttaacgcgcgcacgatatatcccatctcgactgccacggccgcacatccgcctcgtgcgccgcaaacgggcgagtgggattagtggaggcgtgggcgcgagaaacgagggggcgagatagtgggcgcgggaaacgaggagccgggcatagcgttggcaagggtataaaggcgccaaggaagagattcgtttccttcctttcgccattattccccttgccttcgccgtttgcgccctaactccttgtttcctgtgccctacccttgccgcactcactcgttctcaagctcctcctccgccggcgtcatggcacggggctccgcaccgctcgacggtagcgtgctgccgccttcccgcatcgtgagcgagaggcaggccgggctgccgcgccgattcatgccggaatctgccgccggccgggaggtggtcgcactgggtgagggacgcccggcgccacactacccggggcggtccgtcttcttcctctctttcgcaatggcaggactggtcccgccattctcttctttcttcatggatgttctggagctttacgatctccagatggcgcacctcacccccaacgtggtaatgacgttggccatcttcgcgcacctgtgcgagatgttcatcggggtgcgcccatctctccgctgttccggtggttcttcaccgtacagccggtgtcgccgccgtcggtagtcggtggctgctacttccagccgcgggggccggtgctgaaccgctacattccctgcgtcctccgcaagaagtgggacgactggaagagcgactggttctacacccccctcgccgatgaagcgcgcatccgacttccgagccagcccccggcgcaggcctccaactagcgggcgccggtagatctgggagacagctacgacgccgttcttgaccgcctggcaggtctgcgatcccaggggctcacgggggccatggtgtacggcgactaccttcatcgccgggtcgcgccgctccagcggcgcgcccggggcgcctgggagtacaccgggtccgaggactacatgaggacccaccaggggggcagatgggactgggcccctgaggacttcaagatggtggtccaacgagtgctgaatctcagctccgtggaggcatccctcatcccccaaggagtcctccccctctgcagcgatccagattgcgccaacatcctgaccatcatgcaggcggtcggggcgtcggaggaacgggctcctcgaggtcacgatggcgcgggcgggagccgcaggggggaacaatctaccccgggagggggtcgtgcttctgggccccacgatgggggcctggggtgcagccgtcctgccgacgcccgggggaagaggaagcaggagggtaccccttccccatctcctccccgagggggcggggcggcgcgtgccagcagcaggcgcccggagggtgccgtgccgacgtcgcagcccgagggggagcgaaagaagaagcggctccgcaagatgagggagaccgaaccatgccggggaaaccttatctccccccaaggtggtcgtttagccgacctcctcgcaggttcgtccccgcgcccactgcggccgtattcattctcccatctcccaaggcaagttttcactcacccgtttctttttgtcctctggtttttcttctgcctcagcgagatcccgtcgcgcccctcccgccattccaagtccggccagtctgaggccgaggagacggcgaccgcggaggcccggaggcgggaggctgaccggcgagaagccgcagaccgccttcgggaagccgaggaagctgcctaggaggccgtccgggttcgccaggctgaggaaaccgctcgggaggaggccaaactccgccgggccgaggagtccgtccgggaggcggaggtggcgcgcgcacgccaagcggcctgccaagcccccgacccgactccgcccgaggcgacgatgacttccgaggccacccacgacgaggtcgcgggtgcaccgctcgggcccgacccctcgggcgacgtttgggacgtgccagcttcgggggacgcccctgggtccggcacgtcgatcggcgggccgagccgcgcggcgcccataccgagacggctctcccctctgccttccgctgccctactgaaagcggagcccctcctgcaggccttagccgtcgcgaacaccacggtgctggacgggctaggtgcccagatggaggtcctgcaggcagagcgaacggagctcgacgcggcgtgggtgcgcgtcgaggaggggcggcgctcggtggaagccatggtggaggcgggccgcaaggcacatcgccggcacgcctcagagctcgaggcccgtcggagggagctggcggagatcgccagggaggtggaggaggagcgggagactgccctcatcgccaccgccatgctcaacgaggcgcgggacgatctccgcctccaatacgggagccgggcggcggagctagagaagaaactcgacgccgcccgaggagtccttgacgccgccgctgcacgggaacggcgggcggcggagaacgaggcggcgtcccggcggcgcgaagaggcccttgaagctcgcgccaaggcgctggaagagcgcgcccgcgcgagggagagggacctggcggaccgcgaggccgcctgcgccgaagaggagtccacactccgcctccgcgaggacgcgctcaccgagcgggagcgagctctcgaggaggccgaggccgcggtgcagcggctggcggacagcctgtccctccgcgaggcagcgcgggaggagcaggcgcgccgtaatctggaagacgcccgcgccgagagggccgcactggatcagcgggccgctgagctcaaggcgcgggtgaaggagctggacgcgagggcgcgcagcgacagggcggccgcgggcgacggcgacctagccgcccgcctcgcagctgccgaacacaccatcgccgatctgcagggtgcgttggactcgtccgccggggaggtcgaggccctccgcttggcaggcgaggtagggcccggcatgcttcgggacgccgtctcccgtctagaccgcgccgggtggcaagcgggcctctggggcggacggactgcgaagtataccgccaaccaggggggcctcgcccagcgcctctcagagatggccgggaccctccagcggctccccgaggagctcgaggagacgatcaagtcatcctcgagggacctcgcccggggggcggtggagctcgtactggcaagctaccaggccagggacccggacttctccccgtgggcagcgctggacgagtttcctcccgggaccgaggacgacgcgcgcgcgcaggtccgggacgctgccgaccacatcgtccacagcttcgagggtacggccccccggctcgcgttcgccctcgactccgacgaagagggcggtgacggcggtgcgggcgacagcggcgatgaggccggcgacccgggcgtgtcggaatgagcccccaggcccatgccaatcttatatagttttttctttcttcttccgaggccttcgggtccccttcttgtataaactaacttaatctgcaatcaaataaagaggaaatttctgtgtcaatcctatttgttgtgtgtatgagacgaggatggtctgtgccgcggtccttctgtgtcttagcttgaacaagggctcgtgcccgggtcccagcctcaaacggcgcgggtcggagctagtgcctggggagatccacatgtcgagactggccaggccgggagcgtggtgaccgagggttatggatgacccgattgtgggcctttgccgattcccccccggagttcaccacgccccggggcacggctcggttctgggccccttttggcgattttagccgtcccgggccaccgagggcaggatcgagcacgagcgtgctaattcaagtcaagattcttcaaaaggaaacaatggcacaaacacagtccttaggaaatcgaaaatgcttttattgaaatacggaagagaaaaaagacaattatgtgtatgtggtagcccccggccaaccctgcacgcccgggggggtgcggggttggcctgagcccgagacctgacacccgacccccactaggggtagaagcgacgaaggtgttcgatgttccacgggttaggcagctctgtgccgtcgcccgtggccagccgaacggagcccggccgggggacgccgatcactcgatacggaccctcccacattggtgagagcttgctcagtccagcacgcgtttggatgcggcgtagaacgaggtcgtcgacgcagagtgatcgggcccggacgtggcgctgatggtagcgccgcaggctctgctggtagcgcgcggctcggagggccccgcgccgccttcgctcttccaagtagtcgaggtcgtctctgcgaagctgatcttgatcagcctcgcaatacatggtggcccgaggggacctcagggtgagctcagatgggagaaccgcctccgcgccgtagacgaggaagaaaggcgtttccccggttgctcggcttggcgtggttcggtttgcccagagcaccgctggcagctcctcgatccatgagtcgccgtgctttgaggattttgaaggtcttggttttgaggcccttgaggatttccgcgttggcgcgctccacttggccattgcttctggggtgggcgggggaggcgaagcagagcttgatgcccatgtcttcgcagtagtcacgaagagttcactagtgaactgggtgccgttatccgtaatgatacggttaggcaccccaaaccgagcagtgatgcccctgatgaatttaagcgcggagtgcttatcgatcttgatgaccggataagcctcaggccacttagtgaatttgtcgatagcgacatacagatactcgaacccgcccggggcccgcctgaacggacccaggatatcgagcccccagacagcaaacggccatgaaagaggtatggtctgcagggcctgggccggctgatggggttgcctggcgtggaactggcacgccctgcaccgccggaccaggtcaaccgcatcgttgagagccgtcggccaatagaaaccctggcgaaaggccttgccaaccaaggtgcgtgaggcggagtgggctccgcattcaccttcatggatatcggcaagaagctcgacgccttgttcccgaggaatgcacttcaggaggactccgttagccgcgcgtcgatagagggtcccttctaccagcacgtagcgcttggagatgcgctggacgcgttcactcccttcgcggtcctcgggtagagtcttatctgtgaggtacacctggatctcagtgatccaagcaatcgatctaagggagctgggagcgctcccctcgagtcccgaggcctggactccgacgggcctcgggggccgttcaggcgcgtccgtctcccctagggggtcgggtcgcgccgacggctgggcaagcctttcttcaaaggcgcccggtggggtctgggctcgcgaggaagcgagccttgagagctcgtcggcgagcgcgttatcccgtctgggcacgtgccgaagctctatcccgtcgaaatggcgctccatacgccgcacctggcgcacgtaagcgtccatctgcgggtcagagcactggtactccttacagacctggttaacgaccagttgggagtcgcctaacaccaggaggcggcggatccccagtccagttgccaccctgagtcccgcaaggagtccctcgtactctgccatattgttggtcgcccgaaagtcgaggcggaccaggtatctgaggacgtctccgctcggcgaggtcaatgtgacccccgcaccggcaccctgaagagacagggacccgtcgaactgcatcacccagtaggcgatgtgaggcagctgcgaggggcccgagctggcctcggggatggagacgggctcgggagctggggtccactctgccacaaagtcggcgagggcctggctcttgatcgcgtggcgtggttcaaagtgcaaatcgaactcagagagtttgactgcccatttcaccacccgtccagtaccctctcggttatgcaagatttgaccaagggggtaagacgtaaccactgtgacccgatgcgcctggaaataatggcacaacttcctcgaagccatcagaatagcgtaaagcatcttctgggcctgagggtatcgggtcttggcgtcccggaggacctcactaacgaagtagacgggccgctgcacctttcggcggggccgatccccttcgccagccgcatctccagggcgcttttcgtccgagaggccgcgcggggcgcactcggcttctgtgtcgacgacctcggggtcggagggcgacacgcgcggccttcccgcagtggccccggggccatcctgggggtcggggtctcctggcaccgtcagacaagcgggcagagggccagctccggtcgtcgggggcctcgggccgccgttcggctcgggggcctctcctccctgctctctcccgggtcgagtcgatacagggtgctcttcatccgagaggccgcgcggggcgcactcggcttctgtgccgacgacctcggggtcagagggcgacaagcgcggccttcccgcagtggccccggggccatcctgggggtcgggggcgcctggcaccgtcggacaagcgggcagagggccagctccggccgtcgggggcctcgggccgccgttcggctcgggggcctctcctccctgctctctcccgggtcgagtcgacacagggtgggggtgcgcggagcgagggttgtcctcgtcgcgctccacgaccaacgccgcgctgaccacctgcggggttgccgccaggtaaagtagcaacggttcatctggtttcggggcgaccaggaccggggagaactaaggtacgccttcaactgagtgagggcctgttcagcctcctccgtccaagtaaacggcccggaacgtttgaggagcttaaataggggtagcgccttctctcccaacctcgatatgaaccgacttagggcggccatgcagccgatgacgcattgcacatccctaagtttgctgggggggcgcatccgctctatagctcgtatcttctcggggttggcctcgatgcctcgggcagtgaccaagaacccgagaagcttgcccgcaggcacaccgaacacgcacttgtcggggttcagctttatgcgggcggagcggagactttcgaaagtttccgctagatccgagagtaaggtctcttggttgcgcgtcttcacaaccaagtcatcaacataagcctcaacgttgcgtcctaactggctacccaaagaaattcgagtggtacgttgaaaagtaggtcctgcattctttaactcgaaaggcattgtcgtataacaataagttcctatgggggtgatgaatgcagttttttcctcatcctccctagccatgcgaatctgatgataactagagtatgcatctagaaaacacaaaaggtcgcaccccgcggtggagtcgacaatctgatctatacgtggcaaggggtaagggtccttaggacatgccttgttgaggtcggtgtagtcgatgcacatccgaagcttgccgttcgctttggggacgacgaccgggttcgccagccactccggatggatgacctcacggatgaatccggcctccagaagtcgcgccacctcctcgcggatgaaggcttgacgttccggggcctgccgccgcactttctgccggatcggccttgcgcccggccgcacggcgagacggtgctcaatcacctccctggggaccccgggcatgtccgccggtctccaggcgaagacgtcggcgtttgcccgcaggaaggagacgagcgcgtcttcctatttgtcgtccaaaagaccaccgattcgcgtggtcttggacgggccgtcgcccagggcaacctccttgaccgggaccacgtcgcacgtgatcatccgctgcctcggggcggccaggacggaggcgctgagcctctcgtcgccaccctcgggcttggacgccgcgtcgagctggtccgcgcgctgtccatacaagcaagcgcgacttggaggtcgccatggacggtgatggggccaccagggcccggcatcttcatctggagataggcgtagtggactgccgccatgaacttcaccaacgcgggtctccccaggaccgcgttgtagggcagactgaggtccgccacatcaaagttcacccgctccgtgcggaaattggcggaaccaccaaaggtgaccgggaggtcgatatgacctagcggccaagtgtgccccggcgtcacaccgatgatcggctgggacggccggagcaccatccccggggccttgattgcgtcaaaggctgcgggggaatggatgttgagggctgcacccccgtctatgaggacacgcctcaatttcacattgcaaatggtgggggaaaccaccatcgcgatctgtcctccccgggcaacgcacggcgggtggtcggtctggtcgaaggtgagggccacctccgaccatcgcgcccgccgcgtcgcctcatgggtaggggccgcggccagaagctctcgcttcatggccttgaggctccggcgagaagcatgagcgcacgctcccccatcgacggtggcgacagtggcctgaggctcctggaaccccaggttatcgtcgccatcgtcgacgtcctcggcgggggccttctgcttggcctcacctcgccggttgccggcgggggccgccggggccttgccctcacggcgctcctgcctcctctcctcctcccacttcctcgtccgctcagccaaacttttgaccgcgcggcagtccgcgaggtcatggagggaggtgttgtgcacggagcaccacttgccggtcgggcgctccctgctgggagcgccagcctccttctttctgtcgctcgcaggcctcccctttcgggtggcccgcgaagcgccctcgacggcgaggacgtgcccctcgtcgtcgaaataggccgacctcttcttcctcctcctgtcccgccgccctgaccgagcggcggacccgggggcggccggagctgccacaccggaaccagaggagttccaggtccaggcctcctccttgcgagccacacggtccgcaagctgaaaaagctccgcggtggtctggggctccttggaagcgatcttttcgagcatgcgattgtgccgcacgccccccctgaacgcgtagatcaccgcgtgtgcggggatgcacggtatggtgttgcggacttgacagaaccgctgaatgtacgagcgaagagacttatcgtcctctcgctgtactgcgtgcaagtccgcttcttcacctgggcgcggatatgtgccctggaagttcatggtgaactgctggcacaaatcctcccaagagtgtactggtggcaagttcatcagccaaccccgcgccttacctttcagggccatggggaagaaattcgccatgaccctgtcgtcacccccggcggcctcaatccccgtcgtatagatctggagaaactcggcggggttgacgcttccgtcgtatttttcggtgatggtgggccggaaccttgggggccaacggacgttccaaaggctcgccacaaaggctcgacagccggcaccgccaaccggggacatgggaggctggcccccatgcccggaccgaggtggcgctccggacgaggaagcgcccttcgttgcgtgggcagcacgacgaccattgcgtcggcgctcaatattgaggcgggcatccggccccccacgcacatcttcttgggtcggaggcattgacgagggaatagcggacgaacggcgggtaacggccgccgctcgccgcgccctccgcctcgacgacacggagccggtggtagcagcgccagaggccttgggggcgaaggaccgcccgccggcgcctaggcgctgctgcgccgtcatgaccaagtcggccacgtcatccagccaacgtcgagctggagtctctggatcggggacgacgggcgggtgacgcaggagcacgcccgcagcctggagcgcgccctggggcgtgctgccatcgccgtagacgagaggcgacactccccgtctcgccgtccttcttcattacccgtgggtggtgaagtcgcggatctttcgaccccctcgagcgcctcctcccgcccaagacttcggcgaaagggggacgatggagtacgagctcgacggcgcgggttctgctccctgtcgtcaccgctagcgctcggagagaggttgtgcgccactgcccgttcggccattgggctgagcgggagaaacttggcgcacacgaaagaggacgagggcttagaaaaacacacgcgccccctacctggcgcgccagatgacggagcgtggggctcctcaccgggagaccgcgcaggcccctctttgccggttcggccgggggcgctgagtgaggttcttcaccctcgatctgtggaacgttcgcgagagagcaaatgcacaagacacgggcgatgtatacaggttcgggccgctgagaagcgtaataccctactcctgtgttctggtggatctgtgtgtgaaggagttacagagcaaatggagagcaagagagttcaagctctagaacccctctttttccttctcttctggttcttttttcaccctccctcccctcccccacttttaggtgggcaaggtcctccttttatatctcaaggggataccacatgcacttcttctacctactcttcttttgggtggggacccaccctatcttgaccaaatcttgactcgcgcctccgcctggaagctaaatcaccgcttgtccttgagtgatgccca

SEQ ID NO: 44777 - DNA, 1732 bp, Oryza sativa
gtctgtgaccggtcacacaatgcgaccggtcacggaccggatatgcgtgccccgtgctgcattaaatcgggcatggcgcgcttgtccattccgcaataaatgtggtttggtgagcgccgctgtgcccacctaacccacacacgtggtgccaataccacagggggtcggggcgccccagccctcggggccgaaacaggagcagcccgacccctcggggagacagaggagggggtgggcacgtctccctcgggcccgacccccccgagggggtcaggccacgtgggtgaccgcggctgcccaagtctctagtcatgatactcccggtcccatgtcaccgacactagtatacagaaaactccatactgttctgcacctaagattgggcagctttgagtgctttagcggccacatgcttaagaagtcacgttgcaccgtgccaggtttaagtttttacgttttggaacataggggctgtttggtacagcttcaactcctaaatattacttcaggagttgagtctggagtggagctgtggagctgcataaacccagctccacaactctagtacattttgtgagagagcttcacccaactctactcccagttttagtggagctgaaactgtttagctgagctccagcttcaggagaggtggagctgaaactgtgccaagcagaaccatattattccattattttatccaacaaatcccaatttcccggtggaataaacggagcacgacaggaacgaagagagacagaagaaaaaaaaagaagggccccaccaaatttacccccactaccgcaacggcagtttccgtattcacctccccatactttcccctcttcctccccttccaccaccacccccacccccacgaacgcaaacccccacaagtaccacctcgcaaatgctccattagctcccgaaatccaaaccacccccctcctcccctcacgggctcacggcctcacccacccaccaacccatccatccaactccgcggcggcggcggcggcgatgacgacccgatccaacggcgagcaccaccacgggccgccctcgtaccagcagcggcgcccgcactacgggggcgggtacggcggcgggtcggcctcgttccgcggctgctgctgctgcatcttcctgctgctcaccttcctggccctcctcgcgctggccgtcgcgctcgtcgtggtgctggtggtgaagccgcggaagccgcagttcgacctcaaccaggtgtccgtccagtacctcctcgtcaccccgccgtcctccgccgcctccgccgtgggggggaccgtggccgccgcggtccccgccgcggcctacctctccctcaacatcacgctcctcttcaccgccgtgaaccccaacaaggtcggcatccgctacggcgccacggcgttcgacgtcatgtaccacggcgtgccgctcggggtggcggccgtgcccgggttcgagcagccggcgcacagcacccgcctgctccagacccgcgtcatcgtcgaccgcttcaacgtgctccaggccgacgcccaggacctcgtccgcgacgccgcgatcagcgaccgcgtcgacctccgcatcaccggcgacgtcggcgccaagatcctcgtgctcggcttctcctccccaaaagtccaggtaaaccccaccccgcccaaacccaacttccccctaccttcgcggaagcggccgattacccgcgacctgatcgtgaaagctg

SEQ ID NO: 44778 - DNA, 6774 bp, Oryza sativa
aatggagatagataagtggatgtgacccgtgtttgtcgattctaatctctctttctctatctaatcctgggttccgattcctgtacgtggggggtaaattttgagctctctcacctcaccctagaggaggaggtcgccgctgatttttgtgaattactgtccggtaattatcactatcgcccaattcgccatggtcaattccttcatctttcttcatcgttctcaattacttaggggcaaagggaagtggtgggagcgagcgagcgagcgggtgggatctgtcacctgtccgctttccgctcggttatcttctccccttgttcgtgtccgtttgcccgtttggtgcgtatgccattgtttcggcgtggtgtttattcgtttcggctcggagttggtgggactccgctgtccggtgcacgctgccacggccgcacgcccatgcccatgtcctcccctgggtaatctggctggctcagccggcagcggcgccgcggcatggagacgaacgagttaggctgtgtggatggtcagtaactttcgtggtggtgaccggtggtagtggtggggacgaggtgtactcgagaatttacggttacctggaaatgaggggcgtgggttaggcgataaaccatttgtaaatgcagacctgcagagttgcggaagaacgttttggagaaggaacgtggcccttccgtgttgtgtcgagtgtcagacggcaggaatataccgtagagtagtcctcatgccgactggagagtgtcttgaacctggttataaaggtttgtttagtttggggaaaaggaaatttttatgtgtcacatcgaacgtttgaccggatgtcggaaggagtttttggacatgaatgaaaaaactaatatcagaactagcctggaaaccgcgagacgaatcttttgagactaattaagtcgtcattagtacgtgtaggtactgtagcacttatggctaattacagactaattaggcttaaaagattcgtttcgcgatttcctccataactgtgcaattagatttaatgcttcatgcatgtgtccaaagattcgatgtgatgtttttgagaaaaatttttagggaactaaacgggccctaaattagtatctgagttagtgacttgaacctggttaaattagtacaaatctcggtttgcatatggcttggtagttcttgttttgattcctcaataactctggtgcacgaacgtgttatcttcccgaattttaaaccgtgctgtcctggaatttattggttggtagaaggattctcgaagttcaatcttggtactagtagatccttttatcgaatcgaaatcttgccacagttggacactcggaggtttataatggagtgcattgattcgctatttgtaagtagcctaagttttctctgttaatcctaagtcaatattcttggactttatatactttttcctcggtgtacttctagctaccatattcgtgtaaacaggtgggtctccggacacagcaccgggtttggacttcccaggcttaacgtaagtattgtaattagctaaattgaatctcggttttcttgacttaaactatcacaagtggctgctttcacaatccgttgatagcggccagtgcgagattacgttggtacgttgcggcaggccgtcgtagtcgtgaaatgcatctgctcctcgctggggccagttttttttttcttttgtgtcccttccgttgagttcccttgacgtttttgccttctgatttggtgtgtagcgacaatcattgctgacctaacccgagactcgcgagctaccgtaacctcgccgtttcctacgtcgccggacctgcacgtgtgcgtcacaggctcataaatcatcgccacggcctcggatttttgttctacgttagcctgcctttcgctgttgccattgcccattggaactttcgtaagatggatttttgagtccgtttatccgtcgaagaagctgtactcccttcgtcccacgtaatacaagagattttaagtttctgcttatatatataaggttatactatttaaccactcgtcttattcaaaaaatttatgcaaatgtaaaaaacgaaaagttatgtttaaagtactttgaataataaagtaagtaaaaataataataattctaaatttattttaataagatgagtagtcaaatagtgcaaacaaaaatttaaaatctcttgtattatataagagatttgctattgtccagcacttggtaccccaaggtaccagtaccaccaggtattgaaacaaatctagccatccaatgtttaggggtaggattgggaatgagtaaaaatctcttccaatattgagtcaattaatctcgttcctgagttcttcgtcaaaaaagaaaaattctcattcttggaccccgctgcatgcttgtgtccattgtttcctccctcatatgcgcgtctttgcagttcttccttgccgccggtgccgccgcctggtccgacgactcgccgctgctggcgtggtgcttaatccgacaactccacgaccaattcgctgcctcggccgccaacaccctcgctgctaccgtggcacctggtatgacctctccacggccaccttgccgtcgcggccggcaacgcccctaccgccaccgcagccgcccgccatggccatcgacgccgagactggatctcgcagagtcgcaggccacacatgccgcacacggccgcagatcccgtagccctaccgtcgacgccgggatcagatctcgcaacacgtcgtcgccgacgctagccctgtgacacaccccgatgcttgccaccgccgtcgaagctggggctggatctcgcaggctgcacgccacctcgaacccttgaaccccgcagctcgccgtcgccgccatcaacgctggccccagacctcgtcgtccgtcgatgctggtcccgcggcgcacctcgctacctaccgccgctattgacatcgggtctggaacccacagtctggtgccgccatcaacaccccaccacgcaccccggaggccggcgtctcgcccttacatgtgaaaagtctatactacccttccacctctctttaagaaacggtaccactataagagctaatggtaccgcacggtaccgagcaatctcaatcgtttgatttatcccaacggatagctaggatttggtaccgccttcctctgctggacggtagcaaatctcattatataactgagggagtagtagtgatgaagaggacactgtgcggtcggtcgagttaggctgtcacggcgcgagtcacgtcttgtacagagcggttggcgaccacttcactctactatacggagtactttgatgtggtcaatggcagtttcgttcgtcaatccgatgcggtacatggcacagaggagtactcctactggtgactggtgaacactgtagatcacagtggccgtctggagtctggagtctggaccgcaccagcagacattttggggaatcgttcgttgggctccaccgtgcaagagatggtggagaaatgtaccgatgccagactgccagtggacacgtagtggcttattgctccctgatacgtgcagcgtatccaataatctgcatgacctggaggcccttggccttttggagcttgtggtgcgaccatgagaggctggaggattaatggtagtgtcagttacgcaccagttttcagtttgagctgattataggagattaggagttggtaggagtagttgctaattgcaacctgtgcaggcattgctaattctgcctttatacctgtgttgactgttagtgtttttaagagcgctcaagctcactttgcgatcggcagccttgccccacatatcaaatgcaccgtacttcattgtccataactagcataatgcacaggcagaacagctttctgggtcaggggtttgctttaagaaggtgttctttttatactttgtagtacatttcttctcgcggccgtagtcgagtacgcagtctgcgcatttcgtcgttctttcctcttctttccaccaacgtagtattgcaatttgcacagcaaagcgtggtgtaaatatttataatgaacgtgccacatcattgtatcagtttgattaacacccatttctaaaatcatatggcagtagtggcagggaaattgctacagacagtttcagagcactgaaaggatccctcgactttatcagatggttacgagcgacgccatcactccattgtctggtgcgctagccgaagctggagagcaatttgaaactttacaaaagggcaccactgctcgctgattacagcaaatgcattgaccaactagtagaaactgccacacacacatgtggcgaaacgcacgaagttacgaggcccagaagagccaaactgggttgagcaaatgagcccacgaggctagtctacacatcggacgtgcaggaatccacaaagaccacaacacggaactgctccagggttgtcgcgtggttatcatgcgtggtaacatttttagttttttaaaatcacgatacatctcgtgataattatgtggttttttagtaagcacgcgattactgtgtaaccgtcaaacggtagggtgaaacctcacccaaatgctatctctcggcacggacgcggaatccgcaccgaacgagccttccagcacctgcatcacatgctccccatggttggtcacaacttcctctgctggatgcatcatcatgcttcctgcgatcttggacaagtagcagctgcatgtgcgtggtattcctcttcccaggattccacatcacctcaattgtttttagcctttgaataatttataaagggtataaattacatctcttcatatcatcttaattgtttttaggttttggatgatttatcaaggatataaattatatctcttcctcccaaaagacacaccatacaactcaattatttataacttatgtataaccgataaatgtaaaaaaaataaacacgggaaaaaactgtatataggtaagaaagaaaaaaattttaaaagtcatatctactttattatcgtataattctcctgcagcaacacgcagggtaccatctactccctccatccacaaaagttacacctgtttcacatatgagtttttccaaataagttgttcttatgtgtagtctttatgcattgaatgaagagataaattaaatgttttattagaatccaagaagtcatcaaaatactcattggttgcatgctttcatttactccttgattttgtaacatccaaggtgatttaatttctccttggttttggtgttaaaaataatatgcgtaacttttgtggatggagggagtagttagaaaaaatattactgctacgagtaataaataaaacctttggaaattccaaactaaaaatgtccttaaacagggccatctttggttacgcggaagcgccgtgagccactcccttctcggcgagtacggctccgacaaaataaatcaccgcgcgtcgccgggggcatccaccgcggcgacccttgacttcctcccccttctctcctcctcccacaaaacgtgaccgaatccggctgatccgagcccgccgacctccccggcttccccgatccggcgacgatggatggcggcggcggaggcgacgccttcgggtccgcgaccgcgccgctggcctggcacgacttcctggagcgcatgcgccagccctccgccgccgacttcgtcaagtccatcaaggggttagctccgccacaaattttcggtgctaggcatatgctcgatctcagttcgtggtctagggatccgagacggaaagcgtgtgccgcgattggttcgtgttacgcggcgcgtgttggttcgatagtgtgtggtgcggggatgggcgattttgctggtatagtggggatttggggagcatttggcgtgggttcaaggggattacgtcccgtgtccttcaatatgtgttagcaaggcgatatgaccgatcgccgtgccggttttgtggggggagcttaatctagggttgctgtttgtctcttcgcctacctgttaaccgtcgtctgtgtagttccgagggaagtttaatgccattcctattttctatgtctagggttactgcatttggatagatgagtcgcagcacaatcgatataattgatcagtgtgccggcaatgcaacaatgcgatgtgtgtgggggttgtttgaggaaaattgcatgatcggtttatgcactttgggtgaaatatctaccttggatacagagcatagaagttaacatgcttatttagaaatacatgagttgggatttatgcacagtggcaatgacacatagtagccaaggttgtatctggagattcaacagctgggaggacaccatagttaattcttgacaaatacgcttttctatatgttaggccagaagctgggaatttggaattaaggctttgtaaactagtgagtttacttaattcttctacatgtaggagcacgcttcagcactgccttctttgcctttctttttttaccttttaaaatactagatccagcatccataactaaccaatacttgacatttatgtatgttttcgtatgggaaatacatcatttatgttgttatgtttcatgttatacagctttatcgtaacgttctcgaacagagctcctgaccctgaacatgatagtgcggctgttcaagaattcctggaaaatatggaaggtgctttcagggctcacaccccctgggctggaagttctgaagaagaactagaaagtgccggtgaggt

SEQ ID NO: 44779 - DNA, 2591 bp, Oryza sativa
atatgagtatatgattcttgattcgtggaccatgctgtctttcctttttgacatgatcggattaatgcattgactaaaatctgttagacaacgggatgaactaaacatcctattttggttctactttaacatgagatgaattatttctgtctttcattttccagttatcctattttctggtgaccatgcctgcttgccaaagattcaggcagtcaatccatcatgttatcataatctctgtgtttaacagagatacataataaatgcatctgacttgtatttactcccatcggaaatttggaatgcacggcttcatcaaattatctcaggcattttgattaagaatgtgttggagtactaggaaggaacttagcatccattattgatagagaagaaaatggtgagaaaacctgcgttagaagggattcgaactcaggctggtgctctgctcctggcagctccctgccagccgagctaggtgcctttcttagacactttgattaagactggcagttacgtggaattattaacttattccactagtcatgttgctgtttttaaagtgcagttcaaactcgatacttttaaacttaaactctcctttttcactctcgctctaccctttacctaccgagttcctcttcatcttattgatatattccataaaatgtcataacgttacttgcatattctccaatatatttgtcgttatatcaacatttggattgtcttgtattgtgattttagggccttgagaaatacgttatgacaaagctgttcaatcgggtatttgcttctgtcccggaagatgtgaagagtgatgaagaactttttgagaagatgtctttgttacagcagtttatacggcctgaaaacttggatatcaaaccagaatatcaaagtgaaacatcatggctggtatggaagttgatttcctctctttatacatttttagatttgtgaagatctgttacagtgcagaacctttcaataacattgaactacttgggtattgaggaacctgttgaacctgtctgtctgaagtatatttataaactaatgcttacatgtgaataacattctgcccacttcttatatacactcgctatttagtttatggcattatcatcacagtaatgctgccactgtcaaccctaatctgcgtactgtggtctaatgtcaattctttttgcttgcaaggaccttaattaagggaatacttccagtggcatgcattaactggctcagtgttcaaatatataaatgttctttactaacatatgttcccttctttgtacagcttgcacagaaggagctgcagaagataaacatgtataaggctccaagggataagcttgcttgcatcctgaactgctgtaaagtcatcaacaacctacttctaaatgcgtctattgtatcaaatgaaaatcccccgggagctgatgaattccttccagtcctcatctatgttaccataaaggtatgattcactacttgttaaagtactggttgatgatacaaatgaaccatcaaatattgacaatattatattaagttgttggtgctgtattggagaaagaaaatttgccccctttgatatggcacagattaggtgtcgacttgatggtgactatttgtgtattacctactcaactttgatattttctagaaaaaatataagcctattattggtgcagtggtacgtgatttgttgggcacattgcctcttaatagagttgtcagtgcgctgtgcaacctcatttactgttgcttcgtattacttttaagtcccacctctacctatctattatgatgcaaggtccatgtctaatctaatagtgagttttgtactgaaatagtttgccagatttgagagcaaccttgtcatgcactcatgcccatcagtacatgtgcttagagcaaccatgaatctgtgaaccatcagttgggcatccctcctctagctaggcactacatcagttttgattacaaatgatggttaaactttcattacaaacctaatagttggcatttgagtggttgtggacttgcttttgaaaactgcagcaaatgaccataaagggcttaagatcagatcatgtacggttatcactttacttttctcttcattaccggaaagagcttgtcaactactgaatggtaagagttaatgatatatgtgctcttctagtttggcctctcaaggtattacgtgcttctggaattactgcagttagcctaaactacccttgcaccgcaattcagcattagttgtagttttgttctatcatctgaactacaatgttatgatccttttgcctgaaaatcatctgtaaagtgtttttatttgtcatttaaattaaggtagccaaaagaatttaagcagtagctgttcttaatgcaggcaaatcctccacagttacactcaaatctattatatatacagcgatacagacgtcaatcacggttggtgtcagaagctcagtatttctttacaaacatcttatccgctgagtctttcatttggaacattgatggggaatcattaaccaaggaatgaacgagattaccaaaagaaggggtgcaggaat

SEQ ID NO: 44780 - DNA, 1473 bp, Oryza sativa
tcctcctcgggctcctcccacggcgacgagaacgccgtgccgccggggccattagatccatgaacttcggcgacgcgaacgcgtccagctccgtccacagctcatggtccccctccagcggcggcgagcaaacgttggccgcggcagacgacgacgacgacggcgtcgtcgcgtggtccagcacgtcaccgccgccggagcttcccagcgtggacagcgaggtcgctcccgacgtcggcgtcgacgacatcgcctcggcgctgcacgagcagctttcgtcgacgacgacggcggcggcggcggcgtcgaatgcccccgccgcggcggccgcgacgcgctggatggacctcggcgacatgtcgcccgccgccgagtccgtgcccccccggtggatgtcgaggcggcggcgagacgaggcggaggaggggaagttgaggacggcgtcggagcccttgaggcagagcagcgcggcgtcgtaggcgcgcgccgcggcctccggcgtggcgtaggagcccagccagatccgccgcttctggtgcggcgccctgatctccgacacccacgacccccagctccgcatcctcacccccttgtacggcctcaccgccaacgccgctgccgccgccgtcgtcaccttcccatcacctccgccgccgctgcacgacgccgcgccaccgcctaagccggccgccgccgtcgcgccggcagcagcaatgcacttgttgctcgtgttcttcaccatggccgcgcgcgcgccgtgtcgaggtgctcagtgcgcagtgctcgctaactccagtagtgtcgcgtaagcaaagccgcgggttatttatagcgggcgatcagccgatcactcgagttgagtcccagcgcacgcaaagggcaggagcacgtcgtcgtgtggaaagggtttcgagttagagccaacccaaacccaagctatctatctctatcgctcgcctttccatttggacgcgctcgctttaacaaagcgggagtactaccactacccttgtagtgttctcgcttcgtaaggatttgccgaaattttcaaaggatttttcaaacggacaaggctggctagatcgcacaccagctcggacaaatctgtacctgtactagaatttctagctcgtactctcgaactctaatgtatccaatgtacgtacttgtactaagaagagctcggggtctttaactgttactgactacttggctcctcttcgacgtactcgttgtattgccgatcgattggacgaatttgccatcggcttattactacatgagaagctagctggagaatggagatagatcatggcgatggcatggagaacgggagctgcctgcctgcctgacgaagtttcagaggttgcagcgctaattgtcgcgagagaaatgggacttccacaagcatgcacgggctgccgaacctgcctgatgctgtcggaaaacttataatggagatgcaggggaaaa

SEQ ID NO: 44781 - DNA, 862 bp, Oryza sativa
cgagggagagaggggctggcgcctacccactgtctcgcgagcggcacgaagaggcggtcgtacaccatctttgctcttctttacgttgccgccgcctccactgttaaagccgggggctctctctatcataagatatgggtagagtttaggcgaggtgacaccaccagcgatggagccctggcgggatcaatgacagggaaactcttccattgccgcataactcacctcctctgccccgcctgccccgcttcctctatgcccttctccccgtatccccttccttgtagatcgtcatcgtgatggacaaccgcgtccacgagcatgtggttgagaccacggtgcattggacggcgtgcgtgtcgagccaccgaggtcccgccactcatcggattggattcgtgcgtgccgggccgccgaggtcccgccatgcgttggtgtggtaagaagacgaaagaaagaagaaacaaaacgggaaaaaagagattgatggaaaatgtgacggcagtggcacgatttcaattttgtataatttcattagcatggttacgaatagacgaattgtaatggcatatatttgaaatggacatatttgcaattggagtaaattgcacccatggtacaccaacttggcaagtgggtgcgatatagtgcaagaagttgagaattgaacgtccgagtgcaacaacttgataagtgggtgcgttctaatacaagaacttgataatttactccctccgttccatattgtaagactttctagcattgtccacattcatatagatgttaatgaatctagacataatatgggcaatactagaaagtcttacaacataaaacggaggaagtagtattttggtgcatt

SEQ ID NO: 44782 - DNA, 776 bp, Oryza sativa
  unsure (1)..(776): unsure at all n locations
nnnnnnnnnnnnnnnnnnnnnnnnnnnnnnnnnnnnnnnnnnnnnnnnnnnnnnnnnnnnnnnnnncaagcacgattcaagatgcaggcatgatgatggagcaaattatcatagtataagccttaaaagaaagggaaaaaaaagtagtggttcgtctcagagagaagctacagactgatcagtatccacttacccagaaccaaggtgaagtgtgggtgctgaacccgaggcgagcttcggatcgagggtgagggaaacacctgcgaccttagcagcacagaggatggcaagtggtggactatcctgggggaatgctagtttcggctccattcagctccttgcaagtcctctcaaagagagggaacctacaaattaaaatgttgtaagctgtacaatttacatcagctaaataaaccagtatgcacttactcatcgagtccttatacgagcaattttagcaaagatataaaattccagccttctaactcaaaaatcaaaataaataaacatcctttcaaaattacgtcattttcaacaaactgaacatctgataagaatgcagtcagctgggggttatgacagcaacctctaaagattggggttatgatagcaacctcaaaagagtaccacatgagcagtagaatttacatgttccctaaaaccaaaataaaattccaggatactacccaaacaagtcgattactcaaaacttgatttgaagcatcagacggtgagcaaaacgaactggccaacagaatgctcactgcccccaaaag

SEQ ID NO: 44783 - DNA, 2309 bp, Oryza sativa
gtcagtgttgcgcgattttttagaccagatacaaaatattggcactcaacaggccaaaatcagctcttacagtcactggcgctcacaattcaagcaataccattgcaaacaaccagagcaaccatttgaatcgccattcagaaaactaaacaaaaaatagaagtttcgcaccaagccaccgtacaagttatcaggcaccagattggaaaaagcccatatcaaaaaaaaaaaaaagtatcagcgtgtactgcatatttgcattgccaatccagctcgatgttctacaaccaggccagctaatgaatggcagctactccatggcactacaaagcatgtcgtgtgtctgacctattaccaacttacagggagattgtatctagcgtaatactatatcaaatttgatcttttgagctccgatacgacaccaccgtcttcttggcttttctcattgtacagcacctgtgtgtggaagaacaccgtcaaattaggctcggcatttcaggtttttttttttttttttgcgatcattctagaaattttaccttgtcaatgatcccataatccacagcttcacttggactgaaatatttgggccgtttgatgtcctgagcaatctcttctactgatttaccgatatgccttgacagcagcttaatctgacataaaagtgaattcatacagtacattataggttgaattgtaaacagcctactgaaatagactgcctgccccttcagttcatgggtagctagtgcaaaatatgaatgtagcatggctgaaaataacgcaagggaaacctagttcgtatcaaatctaatgcaatgcaactaaattttcaccaacatcagttccaagttccaacaagaagtttgtatccctataagatcttggcttcagataaattgtgtgtagccattcttaaggtgggttgctgcaaataactaaaataagtatattgtcttttatcatttccaaggcacgcaaatgctgccccaaaatataacaaagagcttcactttcaaatcactgtatccacctaattttcaggacatcgggatcctggcagtgattatatgaagacagaaactattgttcagttgccattcactccctaagacaggaggccaaattttctattgctcacttctggtaagattataaatgtgcctaggtagtattgttaatatggataacagataatctatacttcctcttaaaagactgcattggtggtggtgacagcgaaactgccacctcacttcttcccgctgcagttctcataaattaccgtcctgatacttttttagaattacagaaccaaaataaataggttgcaagtacttggcatatatatgatcaaggtcagcattcccttatcctaccaaaatataagggatttggcccgtgagttacatgagcaaaatcccttatatttttgggacagaggtagtaacaaacaagcggataacatatttcatgcaaaaacatattttatttattttaggaattattatgacatattttcttttatgcctaggtgtagcacagcacatgcatttagctattcaatgtataattttgtttacctgataattcaggtaagttaagaactctaacgttcttgtcttgcggcaatgttcgattgaaaagcaccagttatgaactagcgaaattgttatgactgataagacatgaacatgttaaatattgatttagtttgaaattaagctgaaattatcagttctttcttccagaatggataggaaaaaataggataggctatccttggaaaaaataccatttctattttcacatttcggatttcttttcttgctatgtcaacatctgtcgcctgtccttgaaagcgaccaattggctgcacattaaaggtcagaagaataagatcattatcctcgtatttcttggaagcaaagactactgatactgtacagaattgcatgttcacaaaataagtatatccaagtgtgcaccacaatcgaagagcaagaatgtgacacattctgctacagtgtcttattagtggtgtgtgatagacatagacttgtccaaggtagaaactaaactgctctctattaattgatggaaaagaaaatgacctgctttatcattatcgtcgacgatggaagcgcagcacggttacctttagcaccagcagccaagagtaaagcagcttctccccatgcattgccaacacacaaggtgaaaattggaactttgacatacctgtatttagtgaaaacatgagacagaattccagaaattttactacaatcgctaggttgcatgag

SEQ ID NO: 44784 - DNA, 1953 bp, Oryza sativa
  unsure (1)..(1953): unsure at all n locations
nnnnnnnnnnnnnnnnnnnnnnnnnnnnnnnnnnnnnnnnnnnnnnnnnnnnnnnntatttcttggaagcaaagactactgatactgtacagaattgcatgttcacaaaataagtatatccaagtgtgcaccacaatcgaagagcaagaatgtgacacattctgctacagtgtcttattagtggtgtgtgatagacatagacttgtccaaggtagaaactaaactgctctctattaattgatggaaaagaaaatgacctgctttatcattatcgtcgacgatggaagcgcagcacggttacctttagcaccagcagccaagagtaaagcagcttctccccatgcattgccaacacacaaggtgaaaattggaactttgacatacctgtatttagtgaaaacatgagacagaattccagaaattttactacaatcgctaggttgcatgagcatatttcgtaaaacaacaagtacagacattgaagaatgaatttttggatgacaataacagcatgtattggcaacggctataaccactacaatcttccaaagactagtaacccaagtacaactagtagaagttaaaaggtgaatggaaagaactaatggagagttggagaccataagctaaacagattttattctattctgcaactaaattatgtgtagcacgaaaaaaaattcctggtaaatgaaaccttgagtctactgcttgtataaatttacagtatttgaagctggtagtaggatataatcactatatgtcaacacaaattgggaataaggtattatagtagttggtcaagtattgtagtatttgatcaccagtatttcaaatggtaaatacaaaagatggcggtcagatggaaatagctaactggtgggctggtggctgtggctcatgttggggagagattactgcggtcttgcgctgagcagcaggaagctgattcctctattttggtcacatagggtgtgtttggttgctacactggtggagattggcctggcctgcagtgagcttgagcaatacacagctgtatttggttgtttccctaaagagttgtctgactcaggccaccaaaaatatagcctctggtacagtgcacactgttacactagacatagatccacccttctgataacacggatagaactagaattttatgagggagaatcatatgagacatatttatgtgtctttgagttccatgtgaggtatatcctgtgtgtctttatatcttggatcgtgctttccaccatatagtgcagtccactgaatttctccatctggctaaggttatagaccaatttgattcgaacttcctatacagtaaaagagctgctcataaggaactactagtatgaaagttgacattagagaacagcatcaagaaacaagaggaaaatcatttggagaggaagcaggaagatcaatagctttgagagaaagtggtgcatgtgtaggaaatcacctcatagcatcatatattgcaaaagcttctgtctcatagcccaatttctcgccattctaagtaagaagggagagaaatatatcagaaaattttatgctgaaaacagaacaacaataattctgattgaagaaaacattgtagactgttaagatgatgtgctactggaaaaggtgataggcataaaccggaattgcattttctagcccaataaaaacttttgagttcctgcctcacttgctaatcacttcaaagatgtataaactgcacattatctgaatcatttggcaaagtaaaagaatctgaacagatcattgaaaattgtggggggcagagaccttcatgatccacaagctaccctagattgagacgcgcgtgcccgttcactaatcaaccaagcccagtgcaaatcgtataaccaaaattgaatcaaatgcagcaaacctggttgtgccggggtaccgagctcgaattcgcctata

SEQ ID NO: 44785 - DNA, 1282 bp, Oryza sativa
  unsure (1)..(1282): unsure at all n locations
nnnnnnnnnnnnnnnnnnnnnnnnnnnnnnnnnnnnnnnnnnnnnnnnnnnnnnnnntacgtgtcgagctagggaggcatcgtgctgtgtgccgtgcctgccatgctcgagaatggacagtgtgaacgcggtcgcgtggtgcgtcacggatgaacaccacgatggtgttccgctccgaactggacatactccagtgatatggagtactccctccgtccaaaaaaatgttcaacgtttcaccgtctgtcttatttaaaaaaattataaaaaaattaaaaaaataagtcacgcataaagtattaatcatattttatcatctaataacaatgaaaatattaattataaaaaaatttcatataagacggacactcaaacgtttgttttttttaggacgaagggagtactcttgaagatgtactcaataataaatacgggccgaattgtttccggaccaatactaggtcccccatctagccctaacatgtagggcccacgtagatcccacttgtcacatcagttaaaactggactcgagacatcgataatcaccgcttttacaagttgaacataagggacctaaagtgaacttgcatatttctcgggccgaaattatacagcccgattagggcccattaatacagccccaattcagtctctgggaaggccatcccaattcccaaaccctagccgccggcggccgcaccacacatccccgacccaccgccgttgccgcagccgcagctcgatcgcgagcgagaggggctagcggaaaccccagcagcgtgagggctaagcttcgcggcggattggagatgacgcagaagcagagccagttcaaggggcaggggaagaagaagaccatccctcccaaccgccatggcaaggcgccccacgtccgcaaaggtacccccgccgcaaagatctaccggcgcctccgtccgtccttccgtgccgttctctggtgctcttcgatgcttccctgtcgccctgcgtgttttgattggtcgctcgattcttgcagggaagagggccgtgaagccgaccaagttcaccaaggacatggacgccgataaggtagactcggtttactgaatgcttgctctattcatcaatcagcacctgctttctccctttcggacataagatgttatttggggcagcatttggagattgggggtctagccttctctgagctctgaagtaggcaagaaacaaacatgaattaaactagtgatacatgcaaaccaaatatgttctgtttttgagtgatataagatggaaag

SEQ ID NO: 44786 - DNA, 1710 bp, Oryza sativa
  unsure (1)..(1710): unsure at all n locations
nnnnnnnnnnnnnnnnnnnnnnnnnnnnnnnnnnnnnnnnnnnnnnnnnnnnnnnnntgtctcatcttctccttgcgcttccatgagcacggagactagtttagaatacttctcgtatttatcctggcggtattgcctctgaatattcacatgattggcatggaaggtggacaaagttttgtctatcatgtcagcatcagtgattttctctccacatagcttaagacaagtgacaatgcggtgaagaactgagttatattgctccacatatttgtaatcctggaaacgtaagtgaagccactcacgttttgcttttgggagcaaagcctttacttgatggccatagcgatccttcaatgagtcccaaaggacattcggatcttcctcagtcatatactcattcttgagagtagtattcaaatggtgcctcaggaaatgcagtgcctgatttttctcggctgaagttggtaaattattaactcctccagctgatgttgcaatagttgggtcctgaatgcagttcaggagtttcttagcaccaagcatgattttggcatctagtgcccatatcaggtaattctagctgctgactgctagttcagcaaaatctctcttagcaatatcagtcattttcctacactagtcatgcaaaattcaataagtactgcaagtaagagcatgacaagtgtgcaaatagtaaattgtctggttatccaaatttagtactgtgtcaatatattcccataattctcccaacatttctcagaattgttgtactatttatttaggtaccaaagtaattactgaattactaacccattaaatagtatcctgaaaaaaaaataaaacagctaggaaaataaaccataaatatgatgctctctcgtgtgtactaaatttcaaattatgagagctcatttcctaaaaaccatgtctctaggattctatggttgattcaaaaattaactaataaacagttaatatacagaaaattgaaagtacggaataacaaaaaaaaaagtgatattctctgtaatttctatgatcccgagggactattccgctaaaattccaaatccgcgtgtatcctgaaaattcaaggacatattcagaagtttgcctttttcgggccaaatttcgattcgagcccgactccttttataggcctaatttatactcggcccacctctatgtaccggctattcaaaggttaaccggcccgtcgggaccgtcgtcctgctaatggccttggcccatatgcggcccaacaagggcgccgcaccttatccaatcgggtggctagggttgaaaccctagcccctaattccaccgattcgatggcggcggcgggtatcccggtggctcatgcgggcgaggcggcgaggttgacggggctcgtcatcacggcggggtcgacggagctcgtcggcgcggcggggtcgatgatagaggcggagcggcggtgaggctacaagcagcaccgacgccggcgtggttggctacgggccgtatccggcgtccggcaaacgcagctccttgctgtgcgccggtggaatttggctcggcatgcgggtcggcgaggcggacggctatcggcggcgggaggccgcggcggcttcgacccccatcccagttgcgtgcggtagcgcgggaggcgtgccgtgcgtgccggcgggggggggggggatgcgggcgcggtctcctcagcgt

SEQ ID NO: 44787 - DNA, 2210 bp, Oryza sativa
aaagccgatggcacgattctgcggccatcggtgaagcgggtggccggcgacgcgtgctggcggcggcgagggcacgacggcgcatgctggcgtcatcgactcggtttcgtcgtcgtcaacttcaggaggacggcggcgctggcatgaggatttgggccgattcgttcggaatcggcaatcacgttagccaggtacgcgattcttcttatgtgcatcgcgattacaccctgaacatagcgtcgcccttcgaggcatcactagttctaaaccgtcgttcttgcagcggcttgtctgatccgttcgtgcgtctagggcatacggtatccgtgtatttgtttgcaagaaaagaaacccagcgcaaaggctgggaacagatctaatcggactatagcgataaccgcttctcgttcgatagatcggttgtacaagggataaccccatacgcctgtcgcgcatggggtggagagccgcaaactctcctgctacgtgcgccataagggacaaatccacatagtacaacccatcgatcaaacgattagcggagaaataaaaataacagaaaacgatctagcaagtttatcgttatccctatagaacgagattaggacagatcgatgttgacaatataccttggctgaagagcacctcgtgctgataacgtattaggattcacgttgtcaacaatcgaacaagcacacacgaacacacggacacgaaagtggagggcaatcaactttattgatgtttctctctctgttacaagtattactttgccctcaacctcactattgtatttatacccacaataggatgtcctatatggatacatacatatatatttggtataagcccactttattaataagaaaacagaagaatagaaggaggaggtaccgtgatcctcacgatcacagtcctacaaatccgactccttcgggagatcggtttcataacagaaaccatgtgatcaatggggaaaatacaacacaggtggaaacaacctcttgcacagtgcacacttttacaataatatcccaccctgatctatcttttttaaagctagctcatctcgagtaattttattgggccacatggcagtgttaaattttgagataaatctaagaaaattaagcataagaagaaatagccaaaagaaaaagaaaatacacaaatccaatttctagaggcttcccagtgatccatccttttgagataaatctagagaatatccataagaaaagaaataccgagaagcaaacaaaaggcacaacatctagattctagaggcttcccaaaatatatttcccctttgtaatctatctcgtgctggttggtttcgtgccagttgattggctgccctcaccaagagcgacacgtggcgagatacaagcggtggaaagagtgtcgggtaagaaacgctctctataaaactggcaagcgctcaagttatgacgttgaattgaaaaaaagagagaagaagagccactccatacgcgtagcttaggccacacagcaccacaacccaatagtatgtgattggaccagtgcaaacacgtaaaagagagggaaaaagaaaaaggaaaaaaaggaaaaaaatactttgtaaaattctttgcacattattcggggcatgtatcgtgatcatatatactatgtttcgagaaactaaaaacaataaatagaaaaactaaatgacataaacaatttgctcttttctaggattgaatcaaactttgtaatcctgataaccattttctaaatatatgtataatctgcttatactacaaaagaaataatatgtaaatctttcaatttttaaaaacactataattcggataaaacaaacacttatgtcggtgttgtagtcttatttcatatctaaacatcatgatgctcaaaatcgtacaagaaaaattaaatattttgtatgttaataatgtggtttttaaagaccaaatacataggctaatcagctggcgcgctaaccaacgcgttgatttttctacttaaaaacaaaacatggaccactagaatttttataaagatatggaggagaaataaaaaaacagggacattgagtatatggaggagaaccatagagaattttatgtgggtatggaggagaactaaaaacaaagggcaactgaattttaggatgatataaaagacaatcatgtagaaaacacaagtaatgaacattaaagaatgag

SEQ ID NO: 44788 - DNA, 3316 bp, Oryza sativa
  unsure (1)..(3316): unsure at all n locations
nnnnnnnnnnnnnnnnnnnnnnnnnnnnnnnnnnnnnnnnnnnnnnnnnnnnnnnnnatttgctcttttctaggattgaatcaaactttgtaatcctgataaccattttctaaatatatgtataatctgcttatactacaaaagaaataatatgtaaatctttcaatttttaaaaacactataattcggataaaacaaacacttatgtcggtgttgtagtcttatttcatatctaaacatcatgatgctcaaaatcgtacaagaaaaattaaatattttgtatgttaataatgtggtttttaaagaccaaatacataggctaatcagctggcgcgctaaccaacgcgttgatttttctacttaaaaacaaaacatggaccactagaatttttataaagatatggaggagaaataaaaaaacagggacattgagtatatggaggagaaccatagagaattttatgtgggtatggaggagaactaaaaacaaagggcaactgaattttaggatgatataaaagacaatcatgtagaaaacacaagtaatgaacattaaagaatgagtacaaacagtacatttaagtcttggggtagatatgtacaagttatcaatcttacaaatatatcaaacggttgttggcaaccgcgtatctatccatgcatgcaagtgtgttacaagaaggagaccaaacgattaaacagaagtaataatctttcgtaaaacactcgaactgaactaacgaatctcaacaaaatctcacaaaattaccacacaaacagaagaagaaacgagataagcactagaccgattgtcccattaatcatcaatcagttaacgagaatgataaaatgtctataattaagatccaaaagaactgacacagccgattgaaacatatacaattcacagtctacattctgcaacgcaaaattaaattaagacatacatgcaaattcatgatgcctcctagacctacgataattacttgtgaactcatgacgaagaactccttcatggccttttgccaggagcattcgttagcatgatcattttagaagccatggctggaagaaatacctctcgtaatgtctcacgttggatctatccaataacatgttctctaacatatgcacattatcgatttggtatcttcataccatgatccataatacatgatcatctatcaatatatgtgctgatcatctaatcacatttgtttcatatgtgatatttgattagggaatctttgaataaatagtaacatacaacataaagagtttcatgaatgatcacatatttattaatcaataataataaaaaatacctgcagtctgagctgacattgatgcggctagcatgcctatggctaccaccacgccgaagaccacaacggcaacggcgatgagcacaagaaaaggatgcttcgcttctggcgtgcagagcgtgcacaacagcagggcgacatgtctatctcatgttttgcaaaacgtaaaaaccagtggtattgtacactttatagtcatttgtatccacaaacgaagtatacgcaagtgcactacaatgtaactagagatgaaaacggagcggatacggacggataatgcatataccatattcattttcatatttttttccaaatacgaaaacgaatacgtatagctcgaatacgaaaacaaatacggattatctcgaatataaataagaatcgaattgatcggactcgaatacgaaaacatttttttctcggaacacgaaaaccaaactcaacttctaatataaacaaatatcaacatatataattagatccttttatataaaatgtagtatactttataattttttaaaaaaacttaaataatattaatagtgtagactagtgttaagaaataaactactattaaaatctaaaaaggtatattgaaggtcatagagttataaagaaatggagtatgtctcatggcttctgcagatatcctaatagcactgttcaccggatatccgaattgttatccgtattcgacggaaaccccgataccatattgtcagggttacgaataacgcctaccctccatccttggatatacgatgtatactgatatggtatacccgcgcatatacgggtgtttcctgtatacgttaaggaaatctatcacgtaacataaacaaagtccacaattggaaggagtcctactcggacggaactgggtcgttaccatatcgtgtggggtccgatatctccgagttctacttggagatcgactaacccgcgatataaaaggaaccccccgggaggacctaaggcatcgaatcttaccgccaacacatccaccacagcctacgaagccagagcctacatgagccaagtcgctgggtgatctagtcgagccaactcgactacgatctcgtcggtatcgccgaatttcattattccctttgtaatatgtggtttccactatataatcccatatcaactggactagggctattacctaccaaggagcctgaaccagtataatcctcgtcttctgtttgcttgatgttgtattacgtaatcctcgtaccagcgtaccccaataccctctatatccggtctgcgggtatcccccgtcgacacatatttgtattcgtatctgggaaaaatatctgtattcgtatccgtatctgtactatccaatccgaaaggtatccgttttttgtttttctctggagcgggcggaaactatccgctccgttttcatccctatatgtatgtgcgagtgaatgtataacacactctatttgttatagtagtgcagcagtgggagagtagattattttacacactctcgagagaatttttctcattatttgcatgtcgcttatatagttataatattaaaaaaattgagaaaatatattagtgtgtgatatatatatatatatatatatatatatatatatatatatatatatatatatatatatatatatatatatatatatatatcattctataaacattaagttaaaattcaaattttacaagtaaaaataataaattacattacaactaattaacttacatttatagtcaaatttatttttttctttcaacatgtagaagttaaattttgccttgcatatttgtgtagtaatttatcacatattagtctaccttgttggtattttttaaaaaaaaacataattatttgagagtgacatgcaacaacgagagtacataccctcgggagtttatagaatagtggtgtgcaaaannnnnnnnnnnnnnnnnnnnnnnnnnnnnnnnnnnnnnnnnnnnnnnnnnnnnnnnnnnnn

SEQ ID NO: 44789 - DNA, 1013 bp, Oryza sativa
  unsure (1)..(1013): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattttattctattctgcaactaaattatgtgtagcacgaaaaaaaattcctggtaaatgaaaccttgagtctactgcttgtataaatttacagtatttgaagctggtagtaggatataatcactatatgtcaacacaaattgggaataaggtattatagtagttggtcaagtattgtagtatttgatcaccagtatttcaaatggtaaatacaaaagatggcggtcagatggaaatagctaactggtgggctggtggctgtggctcatgttggggagagattactgcggtcttgcgctgagcagcagggagctgattcctctattctgggtcacatagggtgtgtttggttgctacactggtggagattggcctggcctgcagtgagcctgagcaatacacagctgtatttggttgtttccctaaagagttgtctgactcaggccaccaaaaatatagcctctggtacagtgcacactgttacactagacatagatccacccttctgataacacggatagaactagaattttatgagggagaatcatatgagacatatttatgtgtctttgagttccatgtgaggtatatcctgtgtgtctttatatcttggatcgtgctttccaccatatagtgcagtccactgaatttctccatctggctaaggttatagaccaatttgattcgaacttcctatacagtaaaagagctgctcataaggaactactagtatgaaagttgacattagagaacagcatcaagaaacaagaggaaaatcatttggagaggaagcaggaagatcaatagctttgacagaaag

SEQ ID NO: 44790 - DNA, 3441 bp, Oryza sativa
  unsure (1)..(3441): unsure at all n locations
tacacacataaactttcaatttttccgttacatcgttctaatttgaaccaaacttctaattttggtgtgaactaaacacagctaaaaaaataccgtttctcgcaaaatctttctgtaaataaactcatgtaaaatttgaacgagctcagatctcgaggaacgctgaattgctgaaacaaaaaaaaagggaaagaaaacaaaaaagggcaagtgagagaaaagataaaggacgccgttggcggcggggtatgcagcaggtccacgacgacggagtgagtgaagaactactgaaagcaacagtagccgcctacgattattctcctaccccgtctcgaaacaaaacaaaagagaaaaaagggctcgtcagcttcagctttcctccctgtctcctggcaagctcaggacacagattccttcccgtgtttctgctctctcggcctacgagcaattggtcgacagctccagatgatcattttgctagctagagatgatcattttgctacgagttcttcctccttttaatttctttttccatttgatattttccctgtacgccatgggtgacgggtggggcccattctccgcgttcatgcatgttgcttgatgccgtcgtgcacagccacagcagcccgtgactcgagaacatggacgaaaacctggtgaggacgtgaggttcgtgtacgtggtggagattaggttatggcaagtgaggccagtgtgcacaccccatgttctcttgttggatttcctgcttatatcactacacgtgagatgataaggcaaatggttgcgcttgtgctgttgtgcactgtgtctgtgtccatccttttcgatcgatctcttcttcttttttggacatatatatttcctgtccatccttgatcagctaggtagctaagaattttaagtttttttttctttttgttatgtagtacgtccacatcacgcgtaacagactcgatcgtgtccgtgatagcgtggcagggagttacgagattaattagggcccatgatagcctaagctgcagctgccgcaacccacaagcctttgctgttaagagattgatgaccaatcgaggccgtcgctctcgacaggttggatgccatcgatcgtttcgccagttcgatcgtggccgccccgcgcgcgagagagccgtgcgtgcgtgcatatgcgtggacagtgcgcgcgaccgtgagctgccgcgctcgcgtccgcgccgcgcgcacacgtcgctctcggcggaaacagagagagagcgcggggcacatggcctcgctcgcgtcgttgccgagcaagccatgcatgagcacgggcgggtcgctgttagcggatgcgcgtcgaacgagtcgcggatttgccagttgccatgcaccaaccaaccctgctgcctgttggctcgtcgtcgatcgctacggctgatacatacgagatgaacatgcaggtggggtacagggtacaggccactatagggacgggtgattttttttttttggtttcgtttcattctggtgattttcgagtcggttgggccaccccgatcgagttgcataggacgggaataagtgggccaagtgtagtttagcctaaaataaaaggaaaaagtacacccaaggtccctcaacttataatcgagatacaaaatcatcctgaaaccgtaaaaccagatatctcgcgtcccttaactaatcaaaaccggtcacaaaaggtccctcagtggttttgaccctagttttgtactacgtgactactgagtcagcgtgggacccacgtgagccccacatgtcaaggtaatccacgtcagccgcctctctttttcacctgttctctcccgtcgtcatctctctcactcttctcttctcttctcttctcaggcaagccgggcggcgctgctggggacgaggccgccggggcgaggcgggagaggaggcggcggcggcagcttcgacgcgggagaaggcgagggcgcacgtctgctccgatggcggcgagtgtcgtgcgtgtccgacaagtccggcggcggcggagagagcttgctccaagcgtcgcggatcttcttcctcgccattctctcgccggtgaggcactcataccgccgcatccgcgtgtggtagatcagcgccagcatgtactggtcggtgtcgtacacgtcccgctccggcagagcgccgccgctggggagcgccgggccaaacccgtcgttcacgacgagcttgcacacgtccatcgacctcgagtacagccggtaccaaccgcggagagagctcgtacttgtacactcgccggccggtgcaccggtctgttgacactgtaatttggccagttgggttatttggtttggcaaattactgactggttagtgatttgcttaattaattgctttattgggaatttgtgtgctgagttaacggatactacacgtgggctttgcatgcatggcggtgtgtcgttgcctcgttgggcagcgaaggcattgctttgcttcatagatggcacagcctgttgtcacgaagaaccaaatcaatgtggtgctactggtttgcgaagagacgatggagatggaggcccatgcacggcgcggcgcagtggttggatgggttttgcgtgaaggcatacgtgcgtgtttttggtagagctagagataaacttttgtttgacgccgacgtgctccggtggcaggaccgcacatgcggcggcgcgaccgccggtggctctgggcgttcgccggcgcgccgcgcaccgggagcaccaagaccgtgcgcgcccagatcatcgagcagtgcaccgcgtcgccgtcctgcacccttcggaagctcgccctcggggcactacaactcgccgaggcggatcatggagctcctcgagtccgcgtgttctgcatccagccacgcggcgagcgactcctacacccgcaagtcgacgttcgactccatgcttgccggctgtatctcggtgttcctccacccagcgtcggcgtggcagcgccttgccccggcggcctcctccccagcagcgctgcttgcctgagaagagaagggaagggtgagagagagatgaggaagggagagaataggggaaagagagaggaggctgatgtgggccaagctgacatatgcaactcatgtgggtcccacgctgactcagcagccacgtaggataaaaccgaggtcaaaaccaccgagggaacttttgtgaccgattttgattagttaaggcatgtgggatatctggttttgtggtctgaggatgattttgtatctcgatgacaagttgagagaacttgggtgtactttttccaaaataaaacaatggccgcggtcctacgaatcttggatttgctttgcatcaaacgagttccattttccaagcatcttgaannnnnnnnnnnnnnnnnnnnnnnnnnnnnnnnnnnnnnnnnnnnnnnnnnnnnnnnnnnnnnnnnn

SEQ ID NO: 44791 - DNA, 1614 bp, Oryza sativa
  unsure (1)..(1614): unsure at all n locations
nnnnnnnnnnnnnnnnnnnnnnnnnnnnnnnnnnnnnnnnnnnnnnnnnnnnnnnnnnnnnntgaccgattttgattagttaaggcatgtgggatatctggttttgtggtctgaggatgattttgtatctcgatgacaagttgagagaacttgggtgtactttttccaaaataaaacaatggccgcggtcctacgaatcttggatttgctttgcatcaaacgagttccattttccaagcatcttgaatgcgattaggtgccgacacgctgcggttctagggctcatgtcatgtcagggagttaaggtgcagatcgaccgggaattaatccgctttttatgcatccgcgtctccgggccggggcctgctgtaatgtgtgcgccatcgtgtgcttgggccgggctaggtcatcagcgttaggaataagttcaccggccgtgtctcaactttacgtcgagtctatttgaagtcccctaaccgcaataccagataagtgtacggtgtacccctaaactatgtaaaaccatcccaaaaaaggttccgagtcaatatagaggcctggtttcactgacgtggcttcttagtcgcaaaaataattaagattaatatatggggcccacatgtaagtgagagaaaatggtgtgggccccacatttctcctttcttttcttttcctcttctcttctctcctaattctctcgagtgggcgcggcggtagagggggagagaggcgaccggtggcggagcggggacggtggtgataggagagggagagaggtggccggcggcggagcaagggtggcgagaaaggggaagagaggtcggcgcaacggcgagctcggccagctcgcggctgcggcgggagaggagacagttggtgcgacgttgagctcggcgtggtgcggtgacgagggagaggagaggagaggagaggcgcatggcacggcgcggcggcgtgggagaggagcggcgtggcgcccacctcttccctcttcgagcgcacgctcaccaacctcctcgccggcatccccgccctgcttgccggcctcctcgccctgcttgccggcctccccatctccttcccctccactcctcgcgcctcttcccctaagcggcggtcgtcgacgttggagccccctctttgccggtcgccggtagcagccactgctgaccacaacgactgccttgcgcggacaggggagagagagtcgacctgcaggcatgcaagcatgtggcgctcatctgagcccgctgccgcccccatcgacacgttgcgctccactcctctccctcgccggtgcgccgtgcgctgcttctctcctcgtctccctcgcgcgcaggttggacgagctcgaacgggcatgccggccgcgtccccctccccttccaaaccgctttgccccactacccgccaaccgttaccgcgctcgcttgccgcccaccgtatgcatccgcgcatcgccactccgcccgccgctggcctctctcactgaagaagagaagagagaagagagaaaagagaagagaaggagaagaaaagggaagaaaaaaagatgtgcagctgacatgtggcnnnnnnnnnnnnnnnnnnnnnnnnnnnnnnnnnnnnnnnnnn

SEQ ID NO: 44792 - DNA, 1733 bp, Oryza sativa
gtgctccgtgcgctgcttctctcctagtctccctcgcgcgcaggttggacgagctcgaacgggcttgccggccgcgtccccctccccttccaaaccgctttgccccactacccgccaaccgttaccgcgctcgcttgccgcccaccgtctgcatccgcgcatcgccactccgcccgccgctggcctctctcactgaagaagagaagagagaagagagaaaagagaagagaaggagaagaaaagggaagaaaaaaagatgtgcagctgacatgtggccccccgcatccttttttaaatattttgctgactaggatgccacatcagtgaaaccacccatactaccataggatcttgagtgtacgttttgagtgagtttaggggtatacatttctgattttgtggttaagggttaagggacgttaaaaaatctcgctgttaagttgagggaccttgttatcaccttgttaggcataacataatcttactaggaaaaagtccatattgagttataaaaaaaagtccatattgcatctctcaacactacactataattcgcatctcttaaccgaagaatagatatggaggctcactcaatcacaacccactcgttatttaattgcaattattaattttagaaaactaaaacgtctttgtctatctacgatggcatgttttattggacataaattcgtactccctccctcaaaagcgtttaagcatacattcaatctcattattcatcactttatctactctcagtctgccaatacaattattctcaacttccacaaaccccaatacaatagctacactaaaatgagtttattttgggacaaatgaaataagttgaaaatgaacttaatatgatacggaagaagtaatttataaccgtgacctgctgccatatgctaaccgtttactagctccttgaggccatttctcccacattccagtccaggttccttcctatatgcatgcatgcatgcgatactgtcttatcatggaccgctccacccctctgaatctccgatacgcgaaggcgttatgtcaaccatgcatggactggctggagagctaggaatgcgtacacacgcgccaagccaagcccaaaattagggcgacgaacgggacagccaagatctatatatgcctcaatgccgtcgtccccactgggcgggtgcaaaaaaataggcagccgtagcgatcgaccttctccgacgagttctctctttcttctccttcccccggcaacgagcctgacgccgctcgcgcccgcggaggggaggggaggggaagatctagaaccgcggggaagacgacggctgatggctagctatagctgattgatttagcggctcaacatatataccaaggcggcgcggccggccggcacgccggcagggtggtcgccggcgaacctcgcgtagagctcaccctccctcctccggtggtctgcctccccctgcattggcggatcgaggacgcacgcacgtacgactcgttcgttcgttcactgccatgccggcccgtgccctcgccgtcgaatcgtcgtcgtcgtcgtcgtccctgcgcgtctgtgacgtctgctgctgactcgtggatgtagcttgattgctcgccgtacgtcgtcgacatgttgctgtaacgagccgaaaacaccagcgaaggtatggatgtgttgcatgtgcgagtcgatcatcgccattggtgtgttgcagtttgcacagtatgat

SEQ ID NO: 44793 - DNA, 4134 bp, Oryza sativa
  unsure (1)..(4134): unsure at all n locations
gtatggatgtgttgcatgtgcgagtcgatcatcgccattgttgtgttgaaggttgcacagtatgatttgagtaattttggttgcatgcatgcatggcagtccgttgcgtagccggccggcctcacctccggtcgcgacgccggaggtagcgtgaattcgttttcatcggtcaggatggcaatcgcggtcggccattgccgcgagctgagtccccccggtggcggcgtccgcggccggcactgccgcctccgctccgtcacccagctagactgcccggtgttcgacgaccatgacctggacctggaccgccgagagcgcaacgggcacgccggcctgtcgccgcggcggagcctctcctcgccgtgcttctccaccgtcgtccctcccgccgccgaccgcgccgagcccgcgcgcgacgacggcgagaagatgatgccgcgcgtggagatcgtcgcgggcggccacgcccgcggggtgcacgagctcatcgcggaggccgcgggcgccatcgcgacggggacgcgcctcgtgccggcgcagggcgggatcggcggcgcgctgctgctcgaggacggccgctccgtcgaccacgtggcggtgatcaagccgctcctcgacgacgcgtcctcgccgtcccacggcggtggaggaggctacgcgagcaaggccgtgctgcgggaggtggccgcattcctcctcgaccacgacggcttcgcccgcgtcgagccgaccgcgctgatcaagatctcgcgacccgccatgccgacgaccacggcctcgatccagcgcttcgcggcgcacgagtgcgacgccggcgagctcggcccgtcgcgggtctccgtggcgtccgtgcaccgcatcggcagcctcgacgtccgcctcctcaacatcgaccgccacgccggcaacatcctcgtcaagaagtcgccggagagcgagtgcgccagcggcggcagcacgttgacgccgctggacctcgtgccgatcgaccacgggctctgcctcccggagcagctcgacgacccctacttcgagtggctgcactggccgcagtcgtcgctgccattctctggcgccgagctggagtacgtcgcgtcgctcgacccgttccgggacgccgcgatgctccgcgccgagctgccgtcgctgacggaggcggccatccggatcctcaccctctgcaccatcttcctgcagcgcgcggccgccgcggggctctgcctcgccgacatcggcgacatgatgacacgcgagttctcggcgatggaggaggggctcagcgcgctcgagtccctctgcaagaacgcctacgattcctccaccaccaccgccggctcatcccctcggaagcaccaccactccgacgactccgacgacgagagcacccagttcggcatggacgacgtgcccgccgggctccctcctcacctcttcctcctcggcggcggcggcatcgccaagagcgtgagcttctccgcggcggagcagggcgccgccgggcgcggcgccgcgcggaagcgcatgtcgttcaaggcgctgagcggcgacgagtgggcggcgttccttgaccggttcgagcagctgctgccggcggcgctcgacgccaagaagcgcgccggcctgaagctcaccaggctgggcacctccttctgaattctaatctccgccgccgccgccgccgccgacgacgacgacgtcgccggagctagagaagaagaagatcgaggtcgagagcttgtgtacacatacaatgcgtgtgaattccgagagcccttgttgtatttgtacgtgacgtgtgccagcataggtgtgtgagacgatcgatcgatcgagaggccatcgcgatcccgccattgttgcttgcgcgagaggttgaagttgaaccctaacatttgatgctataggggagccagggagcagctctggaatggtaacaaatgttccaacgaagctgactagcagtgccaacgatccaatgcatcgagcaaaacacaaacattgctcattgttgtgttgtgatattgacatgtgtttgtctatcgatctctgtctcggctgtctcggctgcagtttccatggatggatacgtcattgcgtatacgaattcagggggtgcttctacgcttcactcattcagagttcactttgcaaatttttttttttgtttttacactcatcctaaatgagtaagcagagatcctgtattcctgtcaagctttttaatagggaattgctaaaacactgtcccaagtttttttagggtaaagaacttttaaatataacttatagtattatagttgtagtttaaaaaagggtaaatagctaatttagtccctcaagttttaccaaaggctcaatttggtccttcacgtttcatttttgttgacggtgggtacccgtagaccggatatagagggtattggggtacgctggtacgaggatctacgtagtacgacatcaaggaaacaagagacaaagattatactggttcaggccccttaacaggtaatagccctaatccagttgatatgggattatatggaaataaccacagattacaaagggaataatagaactcggtggtaccgacgagatcgtagtcgagttgattcgactagatcacccggcgacttggctcctgtagttttcggcttcgtaggctgtggtcgttgtgtaggttatgagatttgatcccttaggtcccccaaggggtcccttttatatcgcaggtcaggcggtctccaagtaggacttggagacatcggaccctacacgatataataacgacacagtcctatacgggtaggaatctttccattggcggacttcgtgatggatttccttagcgtgttcagagaacgtctgtatatgcaccgctataccgtatttccgtatagcatacatccaagggtagagggtataccttatccgtaaccctgacagtagcccccgacttctacttaaatgaactcgtgtaaccaatcgcgacttctgatgtcggagttgttgtcgttctcgactggtcgatctcggtgtagggaccgtagagacaaagagtgatcgacaacaccatgcgaagtctaacggttatgagtgaatttaaattgaagtccaaggaaccgcttcgcgcaacggacccagaaatttccggcgtccatctctctcctttccttgggattcgcaccgtcagtagtgcgcctatttaagggagttttgggaatccattttggagtccggcagttgtgagaaactttcaagccttccagagctctttgtcttctccgcttccgcacaaaccctagcttgttcatctcggccccttctccggcgatcttcgaccggaatggacctcgacaagtccacttctaccagcgtgtcgctggagaagttgcaggaggaaggcgctctccctggtcgcgggaccatggagagggaaccaggaggtactgaacctgaacctgtcctgggtcgcatggttgcggtcgaggattacattctttgtggttttgttcctcctccatccgagtttcttcttttagtcttgaatttctacggtctctctttgctccatttgaatcccaattctatcgccttcctcagtatcttttcccatatttgtgaggcctacattggggtagagctgtttcttgacctcttccgcttctactatgagttgcgttggatggaatccaacagggtatctggatgtgttgggttccgacttcgggatggcctgaagtctcgctatatccccttccagtgcccctcttctcgtagtaaatgacgggcgaggtggttctatcttcagatagaaaactcggacccagtctttgttgttcttgaggaacaaccagacaagatttcgtcttggaccgtcaaacccgccttaaccccctcccttcaatccttcatcgatatcgtcgatgacctccgagtgcgagagttgtcgggatatgaagtcgctgccgacttcattggtaaacggatccagccgctccaggctcgagcccatccagcctttgactactcagggcccaaagacgcgacccgggtttctccttggggtatttttnnnnnnnnnnnnnnnnnnnnnnnnnnnnnnnnnnnnnnnnnnnnnnnnnnnnnnnnnnnnnn

SEQ ID NO: 44794 - DNA, 1526 bp, Oryza sativa
ttgctccatttgaatcccaattctatcgccttcctcagtatcttttcccatatttgtgaggcctacattggggtagagctgtttcttgacctcttccgcttctactatgagttgcgttggatggaatccaacagggtatctggatgtgttgggttccgacttcgggatggcctgaagtctcgctatatccccttccagtgcccctcttctcgtagtaaatgacgggcgaggtggttctatcttcagatagaaaactcggacccagtctttgttgttcttgaggaacaaccagacaagatttcgtcttggaccgtcaaacccgccttaaccccctcccttcaatccttcatcgatatcgtcgatgacctccgagtgcgagagttgtcgggatatgaagtcgctgccgacttcattggtaaacggatccagccgctccaggctcgagcccatccagcctttgactactcagggcccaaagacgcgacccgggtttctccttggggtatttttcttgtattctgggttccattccttaagtgcatgttcctcccgacttatcgattttggttctcgatctgcaggtctgaacagcgagaccgtagggcgccgcatcggtcaagtgatgatcagcggccctacaacagcgagcaatgtccctgttcctctctgcgagaattgggcagccgaacgtgaagctgcaatcaatgtaagtgtactcggcagcccttttgcctttttaacccgtgggttgaaaatacccgtaggcctagcccaatatgcagatggcccaaggcccataaccatcaaaaccctaggtataaatcctcttttcctcactcctctaaatcctattccccttctcctcctatcctctccctcctgtctccgtttctccgccgtccctcatcccccaagcgcccaagccacggccgcaccgcacgggcgcacgccacacgccggcacgccaccgcgcaggcgcgcacggccgcagcaccagccgccagccggtctcggtctcgccgatggagtagggcgccgccgtgcgggcagccgccagcgtgggggcagacatccaccgcgtcggtcgccgcctggggcagggtccagggagccagggacgctgcttcctaggggcgggatagccaccgcatcgatcgctgcttgggggcagtgtcacaccctgaagttcttttcccaagcctaaattgaatttttaattggcctcaagaaaatatcggtgtaaaagcaagagagaaaccctaaataaattaatgcgaataataatcggaattggcatatggaatttttcttgagttctacatgtcgaaatgtgctaacaagatttttagtggaattttcagagctctagaaataattttaaccaattaaaatcgagcacaagcaatatttaatccgaggaaaatcatttccttcctttaatttcttttccctcctttttctttttcgaatgggccgccggcccatcctcttctctccccctcgcgctggccagccgaaggctacgg

SEQ ID NO: 44795 - DNA, 1391 bp, Oryza sativa
  unsure (1)..(1391): unsure at all n locations
nnnnnnnnnnnnnnnnnnnnnnnnnnnnnnnnnnnnnnnnnnnnnnnnnnnnnnnnnnntataaatcctcttttcctcactcctctaaatcctattccccttctcctcctatcctctccctcctgtctccgtttctccgccgtccctcatcccccaagcgcccaagccacggccgcaccgnacgggcgcacgccacacgccggcacgccaccgcgcaggcgcgcacggccgcagcaccagccgccagccggtctcggtctcgccgatggagtagggcgccgccgtgcgggcagccgccagcgtgggggcagacatccaccgcgtcggtcgccgcctggggcagggtccagggagccagggacgctgcttcctaggggcgggatagccaccgcatcgatcgctgcttgggggcagtgtcacaccctgaagttcttttcccaagcctaaattgaatttttaattggcctcaagaaaatatcggtgtaaaagcaagagagaaaccctaaataaattaatgcgaataataatcggaattggcatatggaatttttcttgagttctacatgtcgaaatgtgctaacaagatttttagtggaattttcagagctctagaaataattttaaccaattaaaatcgagcacaagcaatatttaatccgaggaaattcatttccttctttttattttcttttccctcctttttctttttcgaatgggccgccggcccattctcttcctctccccctccgcgctgggccagccgaaggctacggcccagccgagacggccgcctccctcctctcttcaggtcgccgacaggtggggcccacctgtcgggcccgtctcccacctccagccggcgccgctgcatcccgcaaccgccaccccgctcgctcccgcgtctctcgggccacgtcgcccacgtcgctgcctgcgcccgccttccccgcgcccactccctctcttctgcccgcgtccgcgcacgagacggccgggattcaatttttgaatcccgcctctctctcctccccacctctctccactccgccggcgaaatcgcggccaccccggccacgatcaaccctcgtgagcctatataaagcacccccgttccctcctctctctttttcgttttgcaatcgcccgctcccgtgcactccaccgccctagcaccgtccccctcctttccaccgccgccgccaccgctccggccgccgctagccgtcgctagccgctgcgccaagtcacgccgtcgacgtcgtcgcgttcgccgtcgtgcgggccaccccatccacccccctcccgttggattccgccgccggaacccactccgcaccgtgtgccggtgagtaatgccgtggccgccgccttcggccggtgttcccgccatc

SEQ ID NO: 44796 - DNA, 8429 bp, Oryza sativa
tcgcgccgtcgacactcttcgccgtctgccgccgccgccccgcggtagcgccgccgtacgccattgctgccgggccggcttgagctgcccgtgcgcgccagtcgcgcgctccccgccgccgtccgatctaccctcgggtagatctcggggccatcggttcagctgcccgcgtggctgccacgtggctgccacgtgtgtgccacgtcgcgccacgtcagcgccacgtggtgcactgctccctccccggtccgtggacctggttcatcgtggaccgccacccgagtcactgccatgtggggcccgcatgttgacgccgcccctctctctccccgggattttatttattgcgcaataaatcaattaaggatttttctgtttatagtaaaaacacagtgaatcttctaaaattcatagaaaattcatctgagctccgtttaagcccattcaagtctcagtaaatcaagaaaaatgcatagaatccattaaaaatggttttgttctctgtttcagtagtcttttggcctgtttgtattgtttgctttgtatgtcgcttagattccggctctcccggtgctccggtgtactttgaaatagtcgccgaggttcctccagcagcagagcaatgcaagtcatacttatcacttgaacatgttgatcctatattgcaaatgctctattgttttcccttaaatactgcattgttttataatgttactatgggatgtatatctactgtacaaccatgctatttttgtactatgctcctttgttagcttgggatataacatgactagatattgcactagggattgcttagccatgtttagttcaactagcacacaatgggagaatcacattaatgcatagacttcaggttctagtgttggtgttggattaaagcctccgtcctggtgttagtcaattaaaatgcattaaatggtgggctatgggtgcatggttttgatggtcgcgtccatggcacttaaggaccggttcgcaggatgccctggaagaacttatcgtacttaccacaagccagcgtgggcaacggctgggcttgtagtgtagctttcctctagttgacgcatcgaggcaagggtgggcgtgatggagcggggcgggccctacgacggcctctgtcgcttccggattcacctaggcacgagaggggactgcccgttgcccgctggggacgggggtgaaacctgaggtgtggtgtgcttggctagagggggttatgtgaaaggtcctgtcacagcctctttccggtatgtcgtggtggcatgtcggcgcacggtaacgtgtcatggggctgtgtcttgtgggtacagttgtacacctctgatcagagtaaaactattcaaatagtcgtgcccgcggttatgggtggtcaaccagattcaccgtgattagtctcaccctagtctagtctaatggaattggttagttcaggtgaatggttgggcctgttgcaacgtggtgtagcgttggacagtggatgattaatattgattagttactaccactgttttactgctttgaactactgtttttaaatgctcgctttatgcaaatgaaccgctctacctatcctttggttatatcctgcatcatacccctattccggtatgacttgctgagtatagtgggtagtactcagtcttgctctattttcccccaaaccctagagtttgagtacatgtcagatggtggcttctccgaggagtaggcttcgtccgtgccgtcgaggatgcctatggagtggtgttcccgctgcagtccaagtcaaggcttagctccagttatcttttaatcttccactgcatttatgtaagacttttatgatgtttgtaagacgtggatctgtatgtcaactttgtcgtttgtgtaccccggccggtcctggacgggggttttaatgcgcattctgcttggaattctattcgggaatttctgggcgtgacaggcagggacgccgcgcgccggtcagctgtcggcaggagcgccgccgtaggtgcaatgaggtaggtcgctggatccggctggggccgagaccgtgagtagagatggcttgctgttgattttgcaatgtggtaggctgtatgtatcctgtatggtttgtttgagccttagttttttaatcttgttgtgtacatatcactacagcctataaccttattgagttattgttgtgcacaattgaaaatgttgcgggtgcgggtatgggggaatttctcacccgcgagcgggtgtgggttttttagtgggcagatttagtttcaatgggtgtgggtacggggagtggaaacccgtcgggtccatacccgttgccatctctagtcgggccactcgtggaccatcaggcagcggcgtcgctgaaggaggacgtcgccaaggaggcgtctgatgccgctgctgctgtggccacaacgagcggcgtcaacgttccaaaaaaggggaggaaattctcctccgtgctcgggaatcgtcggaagacacccaccccctcggtaagctctcctgtctgtccattgcgtagtcggaaagcttccatctcacatcatgctcgttatacttcaggcctcagatgcatctcccccgcctccgcgacggcaacggcttgtaacgcttggcgagaagtaagtggatgaatttgaggttttgtcgcttcatcgaactcttgcagtctgtcctgattgtagtctttcacagggcggcgcgggctaaggcggcgcaggacagatctggagggaactccagcgcgtctcccgtggtggcctcgacggatgtcgtggtcatgaccaggagccgtgaggcgacgcccaacggccctgtcggcgatcttgtgcctactcaaggctctcctgctgacatccttacctgggaggagctccaagtcgagatggggcgcatcctccaggccggagctcgcggcataagacatgagattgcggaggcaagggcggcggcggcatcgtcggcgaacgagcgcgccgacaagctggcgcgtgacttggcggaggttcgagaggacctccagaaaatgagggagctggtggccggcaacgagcggcaacggcaggggctcaagaaccgcatgtcagaactcgagaacaatctgtcggagatccccggttcgctgcgggtcacttacaccggcctacactacctccccagggagtgtggtgtcagaactaccatcccggggaattccgacaaagttcttgctgacgacttcgctcgcggaactggcaacggcgatggaggtgatcccctccaagcatccggccaggatcgggaagaaacgtcaaagcggaatctacaccggaacgtgcaacgtcctggggtgtgtgaagttggcgcaccctgaacttgatctccagaagatcttgtatcagggggcgggtagcaatgcgcgcaaggatgtgatggaagaaatcggcgacatgggggaatccattctcccactttttgaagagtagggccaccgctcctctgtaccccttaaccaatagcgttttgtaaaacttttgtcggttccgactacctttgtgtatgcaatcatcaccttagttttctttggcgttttgattccgggtactttgtttgttgtttgtagagatgtcgatgtcgaggatgtccagcagcgcgggcagcccaaattgccggtagtcgttccggcacttgagctcgagccgtatgtgccgcgggacggcatagaccaggatctgcccgaggagacggacgtggcgtcgactcctttaggttggttcttgtcgtttctatttcctttaccttgtctgtcttaattagcttgacttaggtgtttgcatgttaagcagacctcgacagtgcgcttgttgatcgcgaccgtcgcatccagtactggaggacgaagttcgaggtcgccgaacctgagaggactatattggaagtgaagagggaccgggctgtggaggcgctccgaggtcgcgaggtatggttcaactcgtacctcaggagttgctgcacaaccatggccattatctgcagagagctccgagtacctcacggggatcccgaggagttagcggctggctacatctcgtggttgaacggggcttgtgctcaccttgaaggcatcagggggcgtatcgacgaggccctgaagcaggagtgtcgtcgatcgagccgatacgccggagggcacgtgctggcgtgtatacgggatcatcgtccgcagttgcacctcgagttccttcacgaagggttttcccgttctcggaggaatcctgcggagatagacaacctagcaaagtcgatggctccgctagcggagaagatcatccagtcaatggattggcgttggccttcctggtagtgcttgcatatctgtgacaaacatcttaggaaaattgtaatatattttggaattctttgcgatctgtaagaaatgcttgtgaaatagaaaggaaatctatctaactaagctttcttactctggatgcggtgtgcacgagtgtcttctcacttcgcgacttcgatcagtcacttgagttatacactctcccgagcccccagccttgtcgtcggagaactcttctcggaagataaggctcttggaccttcgacttgccttagttgaacaagcactgatcctagcccctagccatgaagttggaaaaatccatttccgattacacggcttggttaatacgcacggcgagaactcttacacgaccagatcttacatggtctttcatctctgaaggatccgacaaggccttatcagctctgggcatccccagccgaagttcccttaggttcctcggaggccttgtcaagacggcgtaaagggacatgatgataggtttcaacgctaggtgtcgtatgggtaagggatcatcgggaaggggcactgtgattgaaatctgtgccttaaaacagactttgaagttgtaagatgtcttacaaatatggacactattgacttatacatagaatttacgcaattggtcaatgttccacgaatttgctaactcacgactatcgccgtctgcaatcttgaatgcgcccggccgcaagacttgtgtgatcgtgtacggtccttcccatttgggcgagagtttgtttcgccctgcttggctttgaactcgtcggaggacgtagtcgccgaacgaaagtatgcgtgctcggatgcgtttctcgtgatatcggcgtagggcctgttggtagctagctgctctgagggcaacccgttctcgatgttcttcgagtaggttcacgtcgtcgtttcgctgttcctcctgatcctcgtcggagtacttctgtactcgtgtactctgatgtcgtaacacggtagggagcatggcctccgagccgtacacgaggaagaagggtgtctccttgttggacgttgttggtgtggtgcgcacggcccatagtacagaggggagttcttcgacccacttcttatcatgtgacatgagccagtcgtagacaccagtcttaatcccttgtagtactataccgtttgctctctcgacctatccgttactctgagggtgagaaaccgaagcgaagcatatcttgactcccagtccgatgcagtagtcttggaaatcggcgctgatgaattgggagccgttatccattatgatgcggtgaggcaatccatatcggcaaaatatccccttaataaatttgatggcgttgtcggccttgatttcccccgtgggtgttgcctgtgttgcctcgatccatttggtgaatttgtcgatcgccacgaacaggaatttgtagccgtcctatcctcgtgggaatggaccgagtatgtcgagcccccagcacgagaacggccaagtgagagggatggtttgtagtgcttgcgctggtagctttgtgtgtttgctatgaaattgacaagcttcacaccgttgtaccatgtcgcaagcgtctttgagggtggttcgctagaaaaatccttgtcgaaaagcttttccgactagtgtacgaccggaggcatgtgaccctgacggagcgtggggctcctcaccgggagaccgcgctggcccccctttgccggttcggccggggaccctgggtgagactctaagctcccaatctgtggaaggttcgcgagacaggaagcacacaagacgccggcgatgtatacaggttcgggccgctgagaagcgtaataccctactcctgtgttttgggagatctgtgtatgaaggagctacaaagtatgagccagcctctccctcgttctaggttcccaatctggaaaagtccaaaaaatcctccatctaagtgggcaaggtcctccttttatatcttaaggggataccacatgcaccatttccctcttttttgtggggacttcccccaccttttcatacgagccactcggtccgcgagctgaaaaagctccgcggtagtctggggctctttggaggcgatcttttcgagcatgcggttgtgccgcacaccccccctgaacgcgtaaatcaccgcgtgtgtagggatgcatggtatggtgttgcggacttgacagaaccgctgaatgtacgagcgaagtgactcatcatcccttcgctgtactgcgtgcaagtccgcttcctcacctgggcgcggatatgtgccttgaaatttcatggtgaactgttggcacaaatcctcccaagagtggacagatgcgggtggcaagttcattagccagccccgcgcctgtcctttcagggccatgggaaagaaattcgccatgaccctgtcgtcacccccggcggcctcgatcccggtcgtgtagacctggagaaactcggcggggttgacgctcccgtcatatttttcggcgatggtgggccggaaccttgggggccaacggacattccgaagactcgccacaaaggctctacagccgacaccaccaaccgggggcacggagggctgattcctgcgtccgtgttgaggtgacactctggacgaggaagcgccctccgttgcgtgggtagcacgtcggccattacgccgccgctcgatgctagtgcgggcgtccggccccccacgcagatcttcccgggtcgaaggagtcgacgaaggagtggtggccgaatggcgaacggcagctgccgctcgccgcgcccttcgtctcgacgacgcggagccggtggtagcagcaccagaggccttggtggcggaggaccgcccaccagcatctaggcgctgccttgcagtcatgaccaatttggccacatcgtccagccaacgttgggctggagactccgggtcatgggcgacaggcgggtgacgtaggagcgcgcctgcagcttggagcgcgccctggggcgtgctgccgtcgccgtagacgaggaggcgacgctccccatctcgccgcccttctccacctcctgtggatgtcgaagtcgcggatccttcagccctctcgagcgccttctcccgcctaggactttggcgtggagggggcggtggagtacgagctcgacggcgtgggtttggctccccgtcgtcaccgctcatactcggggagaggtcgtgcgcctttgctggctcggccattgggctgaacaggaaaagcttggcgcacacgaaggagtgcgagagctcagaagatcactcgcagagccccctacctggcgcgccagatgacggagcgtggggctcctcaccgggagaccgcgctggcccccctttgccggttcggccggggaccctgggtgagactctaagctcccaatctgtggaaggttcgcgagacaggaagcacacaagacgccggcgatgtatacaggttcgggccgctgagaagcgtaataccctactcctgtgttttgggagatctgtgtatgaaggagctacaaagtatgagccagcctctccctcgttctaggttcccaatctggaaaagtccaaaaaaatctccctcatctaagtgggcaaggtcctccttttatatcttaaggggataccacatgcaccatttccctcttttttgtggggacttcccccaccttttcataaatggacggagatttgtatcgttgccgtccgagtcaccttctgatgggacggcccacaactacctccactttcaccgggagcagatgcgacgtggaatcgtggccgcctgctgacgacatgaccggagtcagaccagtcacgtcggtcattcttgtccaccacatgtcagcttagcaatctacatgttcgcccttcttcacacaacatcttgcttgtaatggttaggatgaagcctggcatatatctgatcaggactaacgtgccatctctgggaggtaacacgctagctccagctggggacgagcgcctagaagccctcgtcctgacgggatggggtgaggcgtgcgtcagaccgcctgtcgccacctaacccgcgatctgaccggtctgtgactggtcacagaccg

SEQ ID NO: 44797 - DNA, 2620 bp, Oryza sativa
ggcccgaccccctcggggggactaagagaagggcgaacacatcaccctcgggcccgacgtcccccgagggtgccaggccacgtgggcgtttgtgtctgcctcaaacctctagtcatgatactcctgatcccatgtcaccgacagacccgcagaccccttcgtgtatgtcgaggaggaggtgtttgtcgtcgtcggacgagacacatttaagaagtacctcgtttggcgccttcttgtatagatcgttgccgatcatatagtagatttttgcttgacgagttattttctcggcttctgcgtcgtcctcgggcaactcgtcactgcttatgaatttgatgagtggggtccgccagtcatccatggtctcgatgtcggcaacggcgcgctctgcctctgtagcccccgagcttatgtcgggggtgactgggctatcttcgtcgtttgcctctttcactgatggttttgtcaggatgtccagaaaggtgccgggttcgagtggctctcgtctggacgcacgccgtgctacatcgtctgattcgatgttgtccttgcgatatacgtgtcggacctcgatcccatcaaatcttttttccagcttcctgacttctgcgagatacttggacagctcagggctagagcatttgtaatctttgtgcacctggtttgcgactagttcggaatcccctttcacgatcagtcgcttgactccaagtgcagctgcagctctcatcccagcgagtagtccttcgtacttggctgtgttgttggtcaccctgaagttaaggtgaattgcatgcttgaaatgatctcccgaaggtgatgtcaagatgaaccctgcacctgctccttggctgttgagcgcgccatcgaacgccattgtccatgtttcgttgtcggtctggctgtctaacctgttttcaggcatagtccaatcggctacgaaatcggcgagaacctgggacttgatggttgttcgtggtacaaagtggacgtcaaactggcttagctcgactacccatttcgcaatgcggccgacaacgtctttgtttctcacgacttcaccaagggggaaggcggagacaactgtgaccctgtgggcttgtaagtagtggcgtagctttcttgacatcatgattactgcgtagagcagtttttggatctgtgggtaccttgtctttgcgtcgtgtagggcctcactgacataatagactggtctctgcaccttttccctttcgacaacaatgacagtactcacagagtagggcgtggcggcaatatagaggaacaactcttcattaggttggggagcaacaagtacagggggatttgacaagtagcgtttgagtgcgatgaacgcctcttcggcttcctgtgtccatacaaatttgtcttgcttttttagcagtgcgaagaagggttgtcctcgttctcccatcctagcgacgaacctacttagcgccgccatgcatccggttagcttctgtacttccttgagtcttgtgggcgacttcatgttctcgattgccttgatcttctcgggatttgcttctattcctctgccagaaacgaggaatccgagcagtttgcccgacggtaccccgaacgtgcacttctcagggttgagcatgaggcgatatcgtctgaggttgtcgaaagtttcccgtagatcgtcaatcaacaagtcgcctgtcttggttttgacaacgatgtcgtcgacgtaggcctcaacattgttacccagctgatcgctaagtgccccttggaccgtatgctggaaagtgttccctgcggttatgagtccaaacggcattttaacgtaacagaatacaccgaatggtgtgatgaatgatgtcttctcctcgtcctcttttgccatgctgatttggtggtagccggagtaagcatcaaggaagcttaacagctcgcaaccagctgttgagtccactagttggtctattcgagggagagagaagtgatccttggggcactacttgtttaggtcggtgaagtcgacgcacattcctcacttcccgttagacttccgcaccatgattgggttggctagccactctggatggagtacctctctgatgaaaccagccttaagaagtctatcgagctcttctcgtatggcctgtttccgatctggtgcaaatctccgcagtttttgctttactggcttggcatcgggtcgcaccatgagtttgtgctcaatcacctccctggggacccccggcatgtcggacggataccaagcgaatacgtccgcattgtcgcggaggaaggtgatgagcgcgagttcctatttctcattcagtgatgccccaatcttgaccgtcttgtcggggttggcactgcagagtgggacgattttgattgcgccgtctggtttcggcgtcttagtcgttttgatcactttcttgggtggctcggctgtggcgggtgggctgggagtgtgctcgaccatgtcaaggctccgcttgttgcattggaccgccagctttgcgttcccttggatagtgattgttcccttcgggccgggcatcttgagcacctgatacgcgtagtgagatgcggccatgaacttcgcgagtgccgttcttccgatgatggtgttgta

SEQ ID NO: 44798 - DNA, 1030 bp, Oryza sativa
cgaagattgaggggtgattccatggaagtgttgatcggtaggtgtcaactcgcttcgtgggattcccattgcgtccaaagtgctagcgaagagaagattgatggagctgccgccatcgacgaggactcgcgctaccttgatattccgaatagtgggttcgaccacgatcggataccttcctggtataacagcagccttggggtagtcttcatctaagaactcgatcttctgttcagaccacttcattttgggtgcagccccctgccatgtcgaacaaacctcacgctccacttttttgtattctcgctttgaagagtacgctgtgggacctccgaagatgtgcgagacatgaagatcggaatctgggtacgcggagtctgagtcctgagtggttgcctcagttgccttctcgactacacgtactcgcttgcctttctccaatgccagctgcctttccaacgattttttgaagatgaggcactcctccagagaatgtctgtccgacttgtgtatggggcaccatattctctttgtatcactgccttgtgggtctgggtgtttgggcgggcgctcgtattcagatgcaaggacttctgcttgagctttcctattcccactcttgtcgcttttcttcttgcttgattcgggtgcgtccttggctggcttcttctctcctcccacctttggtttgtcgtttttgcgtctcagcgcgtcgtctgcatgggcacatcgatcgacaacctcgaacaaccttcgagtagtagtgattcgccttgttgccaaatcctgggtagtatagcaatctctgacaccggttttgaaagcgcggatcacagaggcatcagtgatattggggatcgtatttctgcactcattaaagcgccggacatagtccctcaaagattcaccctgattctgtgttaacgcgtgtaaatcgttttcgatcgcgtggcgcttgtaagttccctggaagttcgcgatgaattgttgccataaatctgcccatgaagagatcgagtaaggtgggagg

SEQ ID NO: 44799 - DNA, 7852 bp, Oryza sativa
  unsure (1)..(7852): unsure at all n locations
nnnnnnnnnnnnnnnnnnnnnnnnnnnnnnnnnnnnnnnnnnnnnnnnnnnnnnnnntccaccgaatgtctgtccgacttgtgtatggggcaccatattctctttgtatcactgccttgtgggtctgggtgtttgggcgggcgctcgtattcagatgcaaggacttctgcttgagctttcctattcccactcttgtcgcttttcttcttgcttgattcgggtgcgtccttggctggcttcttctctcctcccacctttggtttgtcgtttttgcgtctcagcgcgtcgtctgcatgggcacatcgatcgacaacctcgaacaaccttcgagtagtagtgattcgccttgttgccaaatcctgggtagtatagcaatctctgacaccggttttgaaagcgcggatcacagaggcatcagtgatattggggatcgtatttctgcactcattaaagcgccggacatagtccctcaaagattcaccctgattctgtgttaacgcgtgtaaatcgttttcgatcgcgtggcgcttgtaagttccctggaagttcgcgatgaattgttgccataaatctgcccatgaagagatcgagtaaggtgggaggtgcatcagccatgaacgcgcagaacctttcaacgttgttggcaaatagtgcgctaatgcgttgtcgtctgccccagcagcgtatagtaccgtggagtagacctggaggaatttttcagggtcagtacttccatcgtacttctctattgcttcgggtcggaatctctcgggccatcggacatcacgtagagaacggttgaaagctctacacccagcgctgggggcagtgggttgtcggcgatcatgtgtcctccatggacgtctatcggatgacgaagacaaagattatgatgatgatgatgatgacgatggctcactcggctctggcgtgcgattccgagggcgacgttcaggttctcaagaattctgtcgccgtccaccattgttgtcctggcgccggtcaccattatcatcaccttaatgctgacgcccccgaccgtcatcgtctggtgtccgctgcttgcggttatcgcgatcgcggcggttgtgacgatcacggtgatgttggtcctcgttcgagcggcctcctcgctcctcgttctcgtgacgtcgtgaagaaacacgatgtcgggaacgattctcgttgtctcgcgcgcgtcgtgcttctcggcggccattcagatggtcgcggagatcgccggtgccgcgaggtggaggggtagctcgtgcgggcgacgtccgctgctccggtggttcactgtcggcaccgccagctgtcggtcgttccggttgtgctctggtagcagctttctcgaacgcgttactgagattggctacagattcccatagtcgttccgtccatcgtgcgagatcatcattaagcacaggtcatagggagcttctctcagtattgcgttgacggtgccgagatgttgggctggcgtggccgtctgattctccgcctctgcgttagcctgtgcagacgtgctagtcccaccaatggcaaacatgtcacgtggtgtactggaagatgacgagccatagtcttcgagcaagtgtaggactgatggttcacggggattgatgtcgattactccaatgaatcgatctgaggttatcgtcgctccttgttccttgtttgtatcctcgagagaggttcctgactgctggaccttaggaggtgtcgtcttcatggcgcggaaaaagaccttgcagcttgagaagtcgtgattcttcgtcttgtgaataggacaatagacatcacgagttggagaagtacgctggattccacgctctttgcaagcacggatttcagcttgtacattgagaaaaacccagcaagcttgcaagttgtgcttcctggacttgtggatatgacaccaggacttggtgacctcggaagttgtcctcctcggctcgcagtccttgtcaaaaggacaaggctcggccgcactaggaatcttctcgagctcgtatgacgtcgatgttccgttctccgccacggtgggaggatccttcgacatgggaccgtccgggtttataaccacggcgttctcgtttccggttattgatggactagccgagattggcaccgtggtgtaaaccaggaagacgatttcgccgacttgagtccacaccagcattgttgaagcagggattccttggatggggccggtgtcgactctgttgtcgacgaagctcgatgtcatagtagtagaaccttgagcaccaagtgctcctacctggcgtgccactgtcgacggtgggtacccgtagaccggatatagagggtattgggtacgctggtacgaggatctacgtagtatgacatcaaggaaataagagacaaagattatactggttcaggccccttaacaggtaatagccctaatcaagttgatatgggattatatggaaataaccacatattacaaagggaataatagaactcggtggtaccgacgatatcgtagtcgagttgattcgactagatcacccggcgacttggctcctgtagtcttcagcttcgtaggctgtggtcgttgtgtaggttatgagattcgatcccttaggtccctcgggtgtcccttttatatcgcaggtcaggcggtctccaagtaggacttggagacatcggaccctacacgatataataacgacacagtcttatacgggtaggaatctttccattggcggacttcgtgatggatttccttagcgtgttcagagaacgtccgtatatgcaccgctataccgtatttccatatagcatacatcaaagggtagagggtataccttatccgtaaccctaacaattttgtccacatagctcctctaaatactccctccttccctaaatgtttgacgccgttgacttttttaaacatgtttgaccgttcgtcttattcaaaaacttttgtgaaatgtgtaaaactatatgtagacgtaaaagtatacttaataataaatcaaatgataggaaaagaattaataattacttcaattttttgaataagatgaacggtcaaatattttttaaaaaatcaacggcgtcaaatattttgggatggagggagtatttgttttgtcttgaaattatccttggaccctcttaatatgccatatggctatttctagtcaatatttctattaaaaaaatatcttttttgcccttaatttgtatacaactatatactagaaaagagaaagtcaacatgaataaacaacattacaacattacatatgtacttcccattgtttcaacatgtgcacatgaaacttaagcaattgctatcgtatacacttgctggtacataatttattttggttttacataatatactatgtattatctataaaaaattcaagcatgcaatttttctcttatatatgtgaatgataaggggtataagtgtcatttatgaagagagttgttggttcaaggataagtttgaaataaaataaaaacttgaaggactaatatggatagattgaaacatcaaggactaaactgagccttaggtgaaacttggaggatcactttagctattcaccctttaaaaaacttaaatcaacatggagaagaacaatggcacaacacaggaaatctgaagtagtaccattttccttcaaattcaaacatatttagaatttcggggaaatcatcgcgtttgaatttgggtggtggaacgatcgagcgaacatgtgggccgtgggctctaccatcagggcccatcaccaatggcgaaagcccagcccactcggctaaaccccaacacgcacacttcgcttccttctcccccattccccttcctcatctccgcctcgcctccaccggccgtgatctcgccgccggcgccgccccgccgcccctgaggcctactagtagcgacctacaagtaccctgttttgtaccatcctaggagcgaatcctccccctgcggcagcggtagcagatcgcgatggccgcctcggcgcctcctccggccgagccgccgccgccgccggcggcggcggcggcggcggcgacgaatccaccggcttcgaccgcgcccacggtctgtatcgatccctcgtgcgtattcgtctggcgcccgagttctgacgtggttgggtgtgggcgatgatgcaggaggacggggaggtggaggagggtgccacgccaccgagaacttctgcgttggggacggcgaactggggtaccgccaccctcgtcggcgtcttcgccgggctgctctacggcgggagcaaggaggccagcgcctctgtcgtaagttgctactctactctatccgcctcctgctttctatcattggctctgtatgataaattgcgtgaaattaaaaacaatttgaacaaatgaatggccaccagatggaagatatgtggttgcatcgactgataactattttattggtcttttgatcacagctcacagatcatttagacctgaaattgtagagctagagcagaattgagaaatttcctttttatcgaaacaagctaccaatctatataaccaagtgggtactaaccattaaggtctcctttagaactgggattctagaattttgattaagataattaaccatgtccctattttgaggtgaacatttatatccttttttcctgaactccttacaccaaataaaatgaaatgtcttcagttacaacattattgtgctgtattttacagagcaaagacgctgaagtgatgttgaagatggggagcaccacagacaagcgtgagcagtatagattgatgagagatgcaatggagaaaagattcatccgggttgccaaaggatcgctagttggtggtgttcgccttgggatgtttactgcaactttctttggcatacagaaccttcttattgagaaacgtggggtgcatgatgtatttaatatagctggagctggctcggctactgcagctgcatttggacttatatgtatgtatctcttcatgtccagtttatacttttgtttagatggtggaaattttggtcacctcaaataatttgaagtgagcttatgaaatatgtttgtgatactgtgaagcctgaattgcattcaaatattcaattactgattgtaatagaataagaatagccccagtcatgttttgaaagaaaaatgacatatttttgaagaaaacgaggttatcatgtacccgtaatatgtatgtaattcagtatagacaatcttgtgtcgtaagtactattattttggggaaagtcgtctgttgtagtcatctaccagaggttctgaaggttagtaggttatattacttgtcttcctctataaggtttgcttcctttataggccttctaccgctgtgagcttctaggtcctagccatatgatacctgaaaatctgattggtggaatagacttgctaagatatatagccctacttggatttttctgtcaccatgatgtgctcgattttttcccctgtaccttgaaggatgtagattaatgtaagaagctcttaaaataggttccttgaatatctaataaatcctgttatctttgactttggttttcaatctgtgtgctcagaaattattactacctgtcagggttaattgtgatctcattgccacatgatatgatgagataaatcattgttttatgatattgtttgtattttagttctgattctgctgtgcaaatagttggttaacttcattaactaaggtagccctcagcatccttagtttatcttaactgatgatcgttcatcttcagtgccaggttcaccaatgtggcgtgcaaggaatgtattggttggatcagctcttggtgctggagtctgctttccccttggtattactctactttctattcaccaatgaaaaatggtcattttagttcactcgaacatgcacatcacttgattgaatatggtcctgataagctgaataactgatatttagtgtgttccctggtagtactagattgaatcatgtgaactcaatctatgctttaacaactttgagagtacatttaattgcaggactcttggacatagttgcatttcatgttgggcaggatgcatttccaaattggtagttcttcagcttatattgcctactgatggattaccatcgcttagccctgttcatcttcagcgcaagggtgctcgatctttctataaacttatgaacagtctcaatgaggtttgattgggatttgggacttgggaatcatttgccaagccatttgcatataagaagtgcatttagcatttgcatataagagctactactagcacactgtcatcaattgccaagccaacaactttatgcttacacgatgaccgtgctgtgctgacacattctaggatgctggtagcttgattttttgttcaataagtcagccttaaggaattcttttacaggttggatacagttgaagctggcagagaaagccaatcttgagatggcaagttcgaaaccaacagatttggtggaggaacaaggtaatcaaagcggcgttggtgccgctatagaacgacttgggcgcagcctaaagaagtaaaaatttggaccatcgaaggaccttttttttttctcataatctgtgtgcgttcctgaagaccgcaggaggaacctgtttcatgggctgcactacttcaattttttcttctttcatgtgcctcacgctgtagtgctgtcaaactttgaagcagtaacagcaagggccacacggagcctccgttgtgggggaaaaaagagcatttttgataaaaatatcgtattcgttggatgtgatgatgcttgtgccattacagtttgtgctgaatttaccctcggtaattcttcagttcacgaatactattttgtacgatgtattccttctcatatgatagatcagccaattctcatgatagaaatatgatagagcataatttaaccacagaaatatgatcgatcagctaattttcatatagtcagaataaaaggagcaacaaaattatttaagtttaaaattccaatcaacaagtttacaacaccagttttatcaggaacatgattcttgtatttgctgttccagaaaccatcttataggttcctacttcgttgcggacttttgtcgtccatctggaatagcgaaaaggacaattggtttggaagaccggataaatggagcatcacacctgtaataccctttcctttcaagctgtatgatttctccttgtttgagattccgcatgtttgcgtctccaagagccggaaactcttggcaagtgcatggattaagattgtcaaggaaattatcatcttcttccagctgcaaaaatgccacagcaatatttaaaatactagcagatgatgctactcaatcatggaaggaaaacatcgatggattcatggaagcgaaaactcagagacatcatccaatatgtaaagaaattaataaagaaactaaatctcttctagatcgtgctccaagaacaagtatattgaccattccttcacaagcctagcttttctgatactgtgatacactagtattgggtttcatacactatctattgaagaagtctaaggtgaacatagtcaaacttaacagactaagggcctcctctgggattttgaaacataggaaagtctcaaaactatcgtttgattagcatacaggaaaaacgcaagaaacttagacacatgaagagaaaaacatgaggtgaaacctcatgcttattttccttcaaaattactctaggaaggtccatttcataggaannnnnnnnnnnnnnnnnnnnnnnnnnnnnnnnnnnnnnnnnnnnnnnnnnnnnnnnnnnnn

SEQ ID NO: 44800 - DNA, 1198 bp, Oryza sativa
tctccaagagccggaaactcttggcaagtgcatggattaagattgtcaaggaaattatcatcttcttccagctgcaaaaatgccacagcaatatttaaaatactagcagatgatgctactcaatcatggaaggaaaacatcgatggattcatggaagcgaaaactcagagacatcatccaatatgtaaagaaattaataaagaaactaaatctcttctagatcgtgctccaagaacaagtatattgaccattccttcacaagcctagcttttctgatactgtgatacactagtattgggtttcatacactatctattgaagaagtctaaggtgaacatagtcaaacttaacagactaagggcctcctctgggattttgaaacataggaaagtctcaaaactatcgtttgattagcatacaggaaaaacgcaagaaacttagacacatgaagagaaaaacatgaggtgaaacctcatgcttattttccttcaaaattactctaggaaggtccatttcataggaatttcaaaggaattgataggaaacaatcctttgtttcaaaaggactagataggattattttccatatgataaaatcctctaaaattcctatggtttttcctttgattcaaagagggcctaattaggtattaatactacaaaattatagcaaaagcagtagagtaccaattgttcagtactataagaactctgtttctcatgtggtattgcatctgtacgatactagcctactacttaataaaggaacttcaatttaacgtgttacctttttctttttgattaggtagtcaaactctaccaacgagagagatacaagatcttcaatatctggcagccacgttagctttaactttgtcatcttaactgacccctcaagatggagttccccaagcagttcagttataattccattctgtgtcttgatttctttgatgatagcatttccccagtccatcagagtaacttcctcaccgatgctaataactgatgcatcagcactctccaaccaaattttgtttgtgaaggttgtagccttctttccagcaccttcgtatttcttgtgcctgggtaagactcggatgaatggttcctctggaccattagtaagagtgaaaagcacacgctggtctttcagaacggcagtatgccttccacacactggatcaattatcttctt

SEQ ID NO: 44801 - DNA, 1560 bp, Oryza sativa
aaatatgcgtgcgggttgtcaccatcgcttaacttaactttatctaaggcttattctactccgtgaactcagagctggtaagcaactgaattaacaaagggaaaaccacctcaattgcattcaactgaacaaataggcataacactcttaatcctattcgcccattctccgtggatattatgcactcccagtgaatgtaaatgaatcttttcagtcgacgctcataggtgcccggctcttggcatttgaacacggcatcgaaacctgacaatctatccctatgtttttccctcacggcgcaacaatctgatggcatcgcacaacagtgggggggagggggggcacaattaggtgggcgtgtggaaggaaggagagtaaaaaaaacctgaagaggaactggcggttgaggttggagacgtcgatggtgtccatgtcgatgacgtggatgttcttgaatccggagagcgccaggtccttgaggagctcgcaccccagcccgcccgcgcccaccaccagcacctccacgaggctccccagcgagtcccgcagctgcgacgcacagggcacaacgatcttcatctcaggacaaacgcaagaaacacacacagacaaagagagagaggtggctgaccccggggctggggttgaagtcggcgtggacgaggttgccggggcgggagaggagcatgtccagatccctccaccgctcgggctccgtcggcgggtcctcgtcgggggaggacatctcgccggccctgcttggacggtgggaggggaagaatcgctggtagaagagaccctagtagaaagagagattgctgatgcggcggaggagaagaggagggggaggagaggaagggagaaaagaaaacccaggggctttggcgtggacggctaggatgcgtggtgcgtccgatcggacggcagcaaccgaggtttccactttccaggctgatcgagttggcatcttatcacgcgtacaagggactcagttgcgcctttggggcaatagagcgcatttttagatttttaacacggagtctgagatactattttgatcaacgatatttataaaagtaaaatgttttaaataaaaaaaattatatattatgatagtttgtttaataataaatctagtaacatcaattttacattattaatcttttttttattttttttacaattaatagtcaaagtatagcatatgatagagttaatttaactttttaaaatttgctattataatttgtttatttggatcaacactattataattcgcgtatgatttgaaacatatcataaacctatgtatttttacttgtattggatataaatatccacatcttccttcaacatcctccttgtatcctttttaagttggagaccaggcaacgccacggcgtctagcggcacgacttgcttgacgcacaccaacctgagaaggattgcacgtcacattgacttagagaccatcctctggtgatagatgaagaagaaagaaaagactcaatctaacaaaatgtgtccggtagggatgcacatgatgatagcttatttgat

SEQ ID NO: 44802 - DNA, 1512 bp, Oryza sativa
cacggagtgtgagatactattttgatcaacgatatttataaaagtaggatgttttaaataaaaaaaattatatattatgatagtttgtttaataataaatctagtaacatcaattttacattattaatcttttttttattttttttacaattaatagtcaaagtatagcatatgatagagttaatttaactttttaaaatttgctattataatttgtttatttggatcaacactattataattcgcgtatgatttgaaacatatcataaacctatgtatttttacttgtattggatataaatatccacatcttccttcaacatcctccttgtatcctttttaagttggagaccaggcaacgccacggcgtctagcggcacgacttgcttgacgcacaccaacctgagaaggattgcacgtcacattgacttagagaccatcctctggtgatagatgaagaagaaagaaaagactcaatctaacaaaatgtgtccggtagggatgaacatgatgatagcttatttgatttcagagccggctctgggctccggcaagaagtgcgatggcctagggcccaggaaaagtagaggcccagaccttggtatgtattagttataccatatggacgtatacaagtttctgattgaatcgctgcccgcataagcgccacttatacgcgaccgtccgagttccaaacttctgttttctcgtctcctctcctctaccggtggcagtctccgccaatccgcctccagcgccctctacggcgcctccgcaagtccgccgcacgccgggccgccgccgatccctgcagcattcagcccttcacagctttgtctgttcgccatcgaccggccgacacaacatgaatatctgcctcaacttccagagtgtctgcgggtttcaatttatatgtactatcgtgctgccgtgctgcaaccatattgtccattgaattgaactactgaagtaactaattagtcattagtaaatactaaagatcagtttcctctgtacgtttaggtttgcaatgttacaagaaagattaaatggcttggctatgtgcatgcattgagaagaatgtcttggacaatattgatatcgataccgtattaatgattttgcatcaagaaatacccgaacgagtattttttttaagagatgcaaatggatgtatgtcatcttttcttttgtcaagtattattaatgaagtccctggagcttgatccttagtcaagaatccttagtcaataatttaaggtaaccatagtaattctattttactgctctttttgtatttttagcaacatatatagaggatattatcaatatttattttcagcatgattagcggatgaatgctttaaaagtatactttaaaaatccaaagtgcatatgtgtatatatagagagagcgtatgcctaagggcccatgtcatggagttgatctagggccctaaaaaatgtagagccggccctggttgatttatgcaagcttcgaatgggggggag

SEQ ID NO: 44803 - DNA, 993 bp, Oryza sativa
aaaggtcaaagaacaaatgaattacgaagacaccattaaatatagctatgaaatcacaaacggtaactcattagaacattacctgctcaagtataaattgtaccaaagcttcaaccttcaagccacgacgtactatgccttgtacagtggggaagcgtggatcagtccagtcctccacctttttgttttgtacaaaccagagaagcttgcgtttgctaagaaccgtgtaaaccatattcaacctgctgaactcatagatttctaccctccttaaccccatttcttgaaggatacgatagtactgtgcattccgatcatggtattcacttgagcggagagcatgagtcactccttccaatgcgtcgacaaatggacaagcaaagtcataagttggatagaccttgtattttgagccaatacgatgatggggatcagtgttgcaacggtagtatacaggatctcgaagtgatttgttagggtcctgcatgtcaagtttaccccgtacacaacactgcatacccctttcagttccattgatcatctctttccacaatgacaaattatcctgaacagtattatttctacatttagattccacaccatccattctctcactcctcatttgctcctttggtgtatcatcaacataagccttcccttgcttaatcaaattttcagccatttccattaactgcggaaaataatctgatgtgtaagtaactatatcatattttattcccagtgtttctacatccttcaggacgttctcaacaaattcattgctttctttcgaagggtttgtgtcatcaaatcgaactatcaggcgccctttatatctctcagcaaagtacttgttcaaaagtccagccttgcatgaccaatgtgaagatacccactaggctcgggggcaaagcgaacgcagacctccccaacttttgcacctgggagatctacttcagggattgagatattatgcttaatcaggtgtttctc

SEQ ID NO: 44804 - DNA, 2871 bp, Oryza sativa
  unsure (1)..(2871): unsure at all n locations
nnnnnnnnnnnnnnnnnnnnnnnnnnnnnnnnnnnnnnnnnnnnnnnnnnnnnnnnnnnttgaatcaggtaatttctctttcaggcttggtgcaggagactttcctatccccctttttccaacataagcagagacaacttcatctagtgtgtctgaatagtctgctatgctgttgaaccagcgaacaaggttttgatatttcttggacctccttagactttcccatcgttggcctgtccctaaataaaggggtgccactccaaagtaagtaatataaacatatagaatgataaaatatagattataaaagaaaccagacaattacctgcaagatttgaccatactacaatgtcagcaattgacaagccataactaaccaaaaaggttcgtgatgctaggtatccatctagaaatgagcaagcagcttcaaattcagatcctgaaagaatgactggggcgtagtcgagccattgatcaacctaaacatgcataataacaggaactatgaatactcagacaatcaataaattcactgagtagcaccagcgatagcaaatagtcaaccagaacatacatatgctgcctgaatagcatcctgaccatagaaactggtaacagatgcaacacgagcaatgtaacgaagaattgtgttaacaccgtggataaaatccctgcacagaatcatgaaaggttcagatgttcagtgagaatttttaaactctaaaggggaaatactgagaaggataaatactaatggaaaagaggagcaataatttggccaccaaaaatattgttttgatgttccatgaagactagaatgacataaagaaaaaaataatgctgaaggttgctttgtcaaaccctactatggaatagaatattatgcaccgaacttgccattccaagcacgattcaagatgcaggcatgatgatggagcaaattatcatagtataagccttaaaagaaagggaaaaaaaagtagtggttcgtctcagagagaagctacagactgatcagtatccacttacccagaaccaaggtgaagtgtgggtgctgaacccgaggcgagcttcggatcgagggtgagggaaacacctgcgaccttagcagcacagaggatggcaagtggtggactatcctgggggaatgctagtttcggctccattcagctccttgcaagtcctctcaaagagagggaacctacaaattaaaatgttgtaagctgtacaatttacatcagctaaataaaccagtatgcacttactcatcgagtccttatacgagcaattttagcaaagatataaaattccagccttctaactcaaaaatcaaaataaataaacatcctttcaaaattacgtcattttcaacaaactgaacatctgataagaatgcagtcagctgggggttatgacagcaacctctaaagattggggttatgatagcaacctcaaaagagtaccacatgagcagtagaatttacatgttccctaaaaccaaaaataaaattccaggatactacccaaacaagtcgattactcaaaacttgatttgaagcatcagacggtgagcaaaacgaactggccaacagaatgctcactgcccccaaaagcctcgatggaattggaaggaagctactactaactagcagcacgtaatccccgagggccgcagcacctcatcgcatcgcatcgggtccgggtcccctataccccgcgccgccggccaaaatcgcgcgaaggccgaaacctcgcttaactagggggggcgccccgcagcttgtaagtcggttgttcccacggtaaagaagggtcaagggctcaaggctgagatcaacaaagcgactcacagtggatgccggcgcggcgggcgagggcgacggggcgggcgcgccgccggcgagggggaggcaggcaggcgggtctctcggcctctcgggggagggggagggaagagcagagcgcggcttctagcgaaggaagagaagggaaggcccaaccaagggaggggttaatataaacttggccgctgccgtgcgaatcgcaaaagatggtctaattctgcgagccagtggtagatcaaatggtttccaacattttccgttccaagggaacctggcatctcctgttttccccgctttttttccgtcatcaatttcctttttctccgattatattctttccgaaccatatatgtatactgaaaacctaaaaatactataaaaactactattagattaaaaaaatgaacttatcctgagcaaaattttattacttagtaaaagtttctctcagtgaaatgaacaaatattagatgtcctttttttttatcaaatgttagtttttcaggttttcactatatttatgatttacactgcatatttgcattttttttaaaaaaaaacattagtaaagcagatgcgcgtacaccaacatacactcacacctatttcagacgagcacaacatttccctaattacgtaaagacacgcactttctcaaaagaaaataaacataaagtacagacacgcacaaacacaactgaaatagaattaaattcatgaatctagtaaaattcctaccgaaaacatatccactagtgcggcacaaaatttctaaaccctgatagatgaagtcagtgttgcgcgattttttagaccagatacaaaatattggcactcaacaggccaaaatcagctcttacagtcactggcgctcacaattcaagcaataccattgcaaacaaccagagcaaccatttgaatcgccattcagaaaactaaacaaaaaatagaagtttcgcaccaagccaccgtacaagttatcaggcaccagattggaaaaagcccatatcaaaaaaaaaaaaaagta

SEQ ID NO: 44805 - DNA, 2880 bp, Oryza sativa
  unsure (1)..(2880): unsure at all n locations
nnnnnnnnnnnnnnnnnnnnnnnnnnnnnnnnnnnnnnnnnnnnnnnnnnnnnnnnnccctggagcttgatccttagtcaagaatccttagtcaataatttaaggtaaccatagtaattctattttactgctctttttgtatttttagcaacatatatagaggatattatcaatatttattttcagcatgattagcggatgaatgctttaaaagtatactttaaaaatccaaagtgcatatgtgtatatatagagagagcgtatgcctaagggcccatgtcatggagttgatctagggccctaaaaaatgtagagccggccctgtttgatttatgcaagcttcgaatgggggggagacgccacgcgtatgctcagcgattctgacttaggaccatctaggcattaaaataactccataacaatgtcaaaagacgccatcattgttattgccatcggctgctatggtggttgttgcatgatgttgagttgttcgcggatgggaatctatccttgctctgaccccatccgatggtgatggaaacggagtagaaagaaagcaggttgccttcatcacttccttccctctaggatcgattagatgtagcaaagcatgtacgatggacaactaatgaaaaatattcattttcactccgtcttgcatgtcttggtcttgtggcgtttattgttgccgtctgagcgaacatatcatttctctcaacgatgtgttcttctcccgtttctgactgcttatccttaatattacattgtgtacaaagcaaaaaaaatataataagaaaatagatcatgcgtagagcaaaaggagttgatcaaatacaataaccagagtatacatcacctttcgtgtggattaactcccaattaagatggtttgtctattgtattcttccatggaagaatgcagtatcagtagtaggtctgaaagcttattgggataaattagctaaagagagggtgtagtgtgtatggcgacgtccttttatagaaaatgagggtgcacacaacatagcattaggtgacaagtgccccaatagagctcatcaacggaattgctgctacgcctcaccgaggcaatgctcggtaagtcccaagctccctagagcccatccatttcgtcgtgctaaagtcaacctaaatagagccccacctctaccggtgctccacctcgctagcccccaacctccattggcacttcccttagctgcgccgctccaaagtgttagcccatcgtgccgagctatccttccacatacagtgctggagaatatgaacaggaaaaatcgagaaatagaagggaaagaagaaagaaataaatgcaattatatataaaaaaagcaacaaaaatggttaaaccaataacatatatctcataaccgggaaattataacggatgtgttcaaatttattttaagatcggaaaaaaattagtggcatatggatcggattatttttttttcttacagaactgacatgtgacgattgaccaacactggcacagggacagtccagatgaacccacgtcctaacagtcaacggcgtaggcctcttcgttccgcctccgcttatccgctctcggaggccgcatccactcacccagcttcgctcgctcgctcactctgccccccggactgcctcagccatggagacggcagccgctttctcccctccccgagtctccccagacgcccgcgccatgttagctaccctccccgcttggcctatcccccaacttccgcctcgccgcccgcccccgcgctctttccgcttccgcccccaccaccgcggcggtggcggccaccaagcagcggttcttggcgccgccccgcccggaccccgcggcgccagaaggctgcggcggcggcggcgccagggacgtcgtcgcgatggtacgggctttgcctttcacctgctacacactacctggctgcgtggactgaaatggcgtctcatttggttgggatgcttgttgcgttgcaggtggtgccgttcctgagggggaccgcgtggcagcagccgccgccggacctggcctcgttcctgtacaagaacaggatcgtctacctcgggatgtgcctcgtgccgtcggtgacggagctcatgctcgccgagttcctctacctccagtacgacgacgccgagaagcccatctacctctacatcaactccaccggcacaaccaaggtttgctgcatttgattcaattttggttatacgatttccactaggcttggttgattagtgaacgggcacgcgcgtctcaatctagggtagcttgtggatcatgaaggtctctgccccccacaattttcaatgatctgttcagattcttttactttgccaaatgattcagataatgtgcagtttatacatctttgaagtgattagcaagtgaggcaggaactcaaaagtttttattgggctagaaaatgcaattccggtttatgcctatcaccttttccagtagcacatcatcttaacagtctacaatgttttcttcaatcagaattattgttgttctgttttcagcataaaattttctgatatatttctctcccttcttacttagaatggcgagaaattgggctatgagacagaagcttttgcaatatatgatgctatgaggtgatttcctacacatgcaccactttctctcaaagctattgatcttcctgcttcctctccaaatgattttcctcttgtttcttgatgctgttctctaatgtcaactttcatactagtagttccttatgagcagctcttttactgtataggaagttcgaatcaaattggtctataaccttagccagnnnnnnnnnnnnnnnnnnnnnnnnnnnnnnnnnnnnnnnnnnnnnnnnnnnnnnn

SEQ ID NO: 44806 - DNA, 1194 bp, Oryza sativa
  unsure (1)..(1194): unsure at all n locations
nnnnnnnnnnnnnnnnnnnnnnnnnnnnnnnnnncccagtcctttagactccatacatcatcaacaactacaaagtacctgcacaataaaaagagaccatcacacatcgtccatgcttataaaaacactagctaagctaatccttccttaaaaaaccaagcctccgacaactacatcctctcaaatccgaactacaagaagcatatccacacaactggcaagtacattttaatttacaactttcgatggtaatcaataacaatggtttgcatctttcttttcttttcttttcttttcatctaagcgaccacatatgttcttttgaattttaaattatatataactatttattaaaattttataaaaagaatataactatttcaaagcaaatttgatggcaaattaaccacatgattgctatttggtgcacgtgtgttttactagcgtacactttttcatataaaagtttttctatgaaagttttagataaaaatttgtttttcgaataaagtttttgagataaaagtttttagggaaaaaaaagtgtgtgctaggaaacgcacacgcgtacgtgatgcgtcaaatagcagtacccaattaaccaagcaatagaatttcagttttggtgagcaacatgcgtgccaagtagtaagtacctcttgtctctcaaatgagtgctgcaatgggcgaggagttggggaatgtccttggtttcgatgcctctgagtattcgtcgtgatccgtggtcgtcttcttcgtggagcagcgtgaatctcgcattggcgcgaagagctgctccaccaacgattccagcagagctcgaaggttgcagctccgggtcaccgtcacgaatgccctgtgctggatgccccgcaccgcggggctcttgtacaccatcgccgccagcgtcgtcttgcctaggccggcgaagccgacgatggacaccacctttcggcgggccgagccgtcgtcgtcgccgaccatgtccagcagcttgaggacggctctggtcttgctgcggacgccgacgagactcgtcgacgcttagtgccggaagacggcggtcgaggtcgtcgtagcagcggggcgcgtactcgccggagctcgacgccgcggcgggcggtttcagcttgtaacgcagccttcgctcgctgaccatgagcgcgcgggccttgaggctctggaccttcacgg

SEQ ID NO: 44807 - DNA, 1347 bp, Oryza sativa
  unsure (1)..(1347): unsure at all n locations
nnnnnnnnnnnnnnnnnnnnnnnnnnnnnnnnnnnnnnnnnnnnnnnnnnnnnnnnatctctgattaatctggatcgcctcctgcctaatataatccgatattcctaaatgcatgatgatgcatcattagctttacgtcgacccaatcagaggacaatccatgtatatatgctctgtcaaccataagtactacctaccttcgccctactaaacaccaccaagcaacgtcatgccccacacctgaatcatctcatctctgtagaacattaatccatctctgtttagttagcttgtcctcgatcgaaacaggggggcaaaatccgtattacgaatgttaacagagcttagccagaatggaaatgccaacccgatgtactcttttcagaagccccttgcacgtctaaacaatcagtgtcattaatacttaaccttatcgccgatttcccggccatgttcaccttgttctctcccttgttttactcactaatcctacgtgccgctaatgactataattaacctgtcgtctccatcggattccttccttgctccacgtaggacgacgggcacctgtcacgcaaactgcaaagctagcttggcaggcagcgtgcagagatccatggagcccaaccatattctgctccctaatctctcactctcacactgtcacacacagacacacagtctcgctcactacatggctacaggccgtatagtaccacgtactactactgcacatgtgttctcctcgtctcatgtcatgtgccgcatgatccttcttctggctctctgcaatggcctccaatcaagaaacagttcagtcacgtactaatcccttagtcccaaaatacgatcatctttactctttccgtctaaaaaaatctaacctgaaaaagaatgtgaccctcttagtacaatgaatcaggacgaatggttgtcctaagttgggtttttttggacggagtgagtagttcgtaaaaaaacaccgttgatgagtgtattggtaaggatattaaagaaataaaattcatcgatttgttgaccgggataggttgagaaaagaaaagtgaatttattttggaacaaatgatataacccaaaaatgaatttgttttgagatggagtactttctcccgtttcctaaatataagtatctctagaatttaagtttttacacacatcatagttatttttagataacgattcaaatgtacaggagtctaaagcatttccagccaatcagatgtttaagaggaggattctaaccaatttgaaatctagctaagatggttgaatggaaatttccgttaatcaatctagagattctcataattaggaacatagaggtac

SEQ ID NO: 44808 - DNA, 1143 bp, Oryza sativa
  unsure (1)..(1143): unsure at all n locations
nnnnnnnnnnnnnnnnnnnnnnnnnnnnnnnnnnnnnnnnnnnnnnnnnnnnnnnnnccacaccagctagaaagagtgctcaaggattctcacactaattatttgtttgagtgttagaagttttgctgtacgtctatatgtttatgtcagttcttcataagctagtttcagacagcagaatgttacacctgtgccacaggggttaaagcaaaagaagttcctccccttctggcatatttgttcataagaatttgcattccataatatttttgagggagggaagaggtgtgcccagcatctacaggtagtaaagacatggtctaattatattgtatttgtaagagtgtaattaccataatcatgctaaactgtgaacaaatgggcataattacacactatccatgcatatatcaaatgctgacatgatgccatgcaagcctggtgcctggttttccttctaccagtttaaagagggttgagcaccccaaggcacactatgcatccttctacctatttgaatatgttttcctttcagtgaaacgtggcagatgtcaatgtcaacacatatgatacaaagtggctaattagaatgtgatagtttcttcatgtgccaattcatggatgttgaaagttgatcacacacttgtgctgtatatgagatattgttataacttctaaacctgatattgaactcaatgaaatttcaggtggacatgagcctgggtggcgtgatgttccagtacatgatcctgtagtcaaagatgctgcagaccatgctgtgaaatcaatccagcagaggtcaaactccctgtttccatatgaacttctcgagatcgttcgtgcaaaggcagaggtcagctattgtgaattcatccatccaaagattatcttttcttttttgtatctaatttagtaatgctgagcttatagttcacttaggcagcgttcgagagggtgagagagtgagtttgtttgtttcgttttccgcgcgcacgtttcccaagctactaaacggtgcgttttttgcaaaaattttctataggaaaggtggcttaaaaaatcatattaatccagttttgaaatttaaatagtaatactcaataatcatgagctaatagctcacctcgtnttacgtatcttctt

SEQ ID NO: 44809 - DNA, 9864 bp, Oryza sativa
  unsure (1)..(9864): unsure at all n locations
atagatcgtttttttggccatcttttttagtggaggagatcaattgatcagacggaacctagcgaaggctagaagtattcaaggttgaacagatagatacttcatccatccctctgaaaatatacctaatataaggtataatcattttttatccatgtctcgttatatataactctccaatcatattactttcatattatttgcatacatcgaggtgaccttactgaagagacgattaatttctttttttttaatttatgtgttagtagtgttgtgcgttatattttgggatagagggattatctatagctgctttaaaaagaaaaacagagaaaaatgggttaatttgatccatgcaactgcaagagtaaattgcaccgctagtgtatcaacttgataagtgggtgcaatatggtgtaagaacttgataaatgagcaatctagtgcaacaatttggtaggtaggtgcaatttagtataagaactttataagtgatcacataaatacaacaactttgtaaggtaggtacgattttgatacaataaattaagaagttatgtggcaactttattattgggtgcatatttatattggtatcataataactagtaactgaaaatcaattaaactgaatgtataaattattatatttagttgatatttgagaaggtgaagaaaacaaaaaattcttaaaaggtaattggatgtaaattatatgtgcaatataattcttaaagattacattcaatactataaggtaatatccgtaggattatgtaatgttatattgacatcgtgaaaaaaaaatcacctagcatatgcttagccaagttaatgcaccaaaatactacttcctccgttttatgttgtaagactttctagtattgcccatattatgtctagattcattaacatctatatgaatgtggacaatgctagaaagtcttacaatatggaacggagggagtaaattatcaagttcttgtattagaacgcacccacttatcaagttgttgcactcggacgttcaattctcaacttcttgcactatatcgcacccacttgccaagttggtgtaccatgggtgcaatttactccaattgcaaatatgtccatttcaaatatatgccattacaattcgtctattcgtaaccatgctaatgaaattatacaaaattgaaatcgtgccactgccgtcacattttccatcaatctcttttttcccgttttgtttcttctttctttcgtcttcttaccacaccaacgcatggcgggacctcggcggcccggcacgcacgaatccaatccgatgagtggcgggacctcggtggctcgacacgcacgccgtccaatgcaccgtggtctcaaccacatgctcgtggacgcggttgtccatcacgatgacgatctacaaggaaggggatacggggagaagggcatagaggaagcggggcaggcggggcagaggaggtgagttatgcggcaatggaagagtttccctgtcattgatcccgccagggctccatcgctggtggtgtcacctcgcctaaactctacccatatcttatgatagagagagcccccggctttaacagtggaggcggcggcaacgtaaagaaagaagnccaaagaaatggtnngtacgaacncngnccnccttcncttnttncccgggnttttggggcccccccccgggcccctttttcccggggccccgcgagacagtgggaggcgccagccctcttccctcgtcgcggtggcctgaagggctgcgcgagccttctcacgcacggtacggagcaaaacaatgatttttttaagtttaatagaatggttcacttttagtttttgagaaataaatctaggttttctcttgaaaatattagttttttcacttcctattttcggtttagaaaactcaaaaatagaaatttagaggtggattatacacttttgttggtgatgctcttacgctattagggtgtgtttggataatgggaaagagggtgggattagaattgagaaatgaatgaaaggttatgattaaatggaagagggtgaatgaacggttagaatttaaagatatcttttggtaggtgaaaaattatttcccattagccaaacgctgccttaggtattacagttctaaccgctcatatgctctatactatatgtctatatccaacggccctccccgatttccccgaaacgctactacccctccgccacagcgtccacacccgcgccgccgccgccctcaccctcgccgccgcgcatcccgcggtcccaccgtcgccgattccaccgctgccacggacaaccccgccgcccctttccttcctcgccgtgggagcgccccccccctccaggttggctagcagctagctccgccggccgcccttccccgatgggggcagcggcgtaggcgccgccatcagccgccgtacgtatgtgagcggcgcctgcgcacgcctccagctggtccgcgcgaggtaactgtgtggggtaaaattcctctctagtcttcgctttcgccatatcgcattttcgagaatacctaatgccgtagtaagccatacgggggtcgttttattgcttttatgcttaagtcacacacttcgagcaagtctattgaatctatactcgggtagaagtaatgcgcgctcatctccaacgcctattttgcaaaagaagaagaagaagcagaagagagaaacagtggcttttgtactactcttgcacatagaaccccttctcgacttgctatcaacagttggtttgaaacttagcatttctttgttatgcgcagttttgctgaaccagatgccgatgcagtgacgattcgttggccgaggatcgcgttcttataggcccgatttgcaaaggtactactgcagtggcggagcttgagagagattctagatggggccagctattatagagtggaaatgttggtaatggcagaagtagaatttgtagaagggctattcatattgtaaaataatttccaagcatgtttttgttaagaaaaaatatatgttatacctaagtatagctgttaaacaggtggaaaaggatcactcaagttataaaagacaacatatcaaagttattgtaaattaacaggttttaagagagctattttattaagataaaaatgtttgtcatccataggaggaaaatgatttagtaagcaattaaactgaagaaaaagaatggacttctcaggatttgaacaccaaacttccaagaaagcatctgccctcttcacttgctaatcaattgagcagaaaataaattttcttactagatacttgttaagtatatatgtgtttgctgccaaagctgagggggcaacacccaggttggcctccatgaagctccacctctgtactattagctgttgttggaactatattggtcgcatcaagcttccgccaatgtttgcagggttaaaatacttggtggtctgtcatgctgtatgttgatgttatgcattgcttttggtacaaccgagttcctttttcctgactggttccatggttggttgagatatggatgctatgtattgttctttaatgttacactttagcaaaattttcccagattacgtaagcaactactccatccattttatattataagtcgttttgatttttttcctagtcaaactttttttaagttggaccaagtttatagaaaaacataatagtattttaaacacattatattatcaaaatatattcaatgttagatttaatgaaactaatttggtgttttagatgttgctaattttttctaacttataatatgaaacggagggagtattgattacaaacatgatggctacttcatttgattttatttagcattagctgtttcaatcttggcaatttaccatttccatctgttgtgtggttttatttatgtaggagtgcttgtaaatccaatcataccatttcgattttcatttgaccaaggataggcaagaataggaggaaaaaggagagtggcatataatgacgggtggatcaggtgttgtggtgctagacaatgggggtggtcttctgaaggctggatttggtggggacatgaatccgactgctgttgtccccaactgtatggccaagccccctggttccaagaaatggctagttgctgaccagctgcaggcacaagatgttgatgttactggcatgacattgaggcgtcctattgatcgtggctatctcatcaatcaagaagtgcaacgggaggtgtgggagcgggttatacgcaacctactgcaggtggatcctaacaactcatcgttgctactggtggaaccacagttcaaccctccagcactgcagcatgcaaccgatgagcttgtttttgaggagcttggtttcaaatctctttgtgttgcagatgccccttcccttgttcacctttatgaggctagccgccagccatcgctgtttcgagctcaatgtagccttgttgttgactgtggcttctctttcactcatgcatctcccgtgcttcaaaactttacactgaattatgctgtgcggcgcatggaccttggtggaaaggccctcacaaactatctcaaagagctcatttcatatcgctcccttaatgtcatggatgaaacactcctcattgatgatgcaaaggaaaaactatgctttgtatcccttgatgtccctggtgatcttcgtcttgccaggtctgttgccattctcatcccaccacatatggatacatgcttgcctattgtttagggttcaaatttaacctgatttcaagtttatcttcaaggtcaaatggtccttcacacagaaagtcctgctaagaatgttttgcttgtgtaaccagcttaatgagatgtagatagcttagtatcttatctttggaacttagtgctgtagttgacaaaggtggctttgtgtttcatatgtatgtatgaagggttggtatttcctttattagaagctagattttgaaactttgaattgcacttctgggacagcacaatcactgattgagatggtaatagtttttcattaaataattagttggtccacgtgttgaatacagttgaggtttttatccatctaagtttcaattctaaatagtttttgtagtgtctttcctagtatctaagttacaaacatgctatgcaattatttgcaggttatcatctaatgacaacccttttagatgctcctacattctccctgatggtataacatacaagaaagggtttgtgaaggacttggatgaggcatgcagatacagctctctgcctgctaatggagaatcggttagaaaggatagttctgacagcgataggagcaagtttgaggataagaaaaagcctgaacttagtcaaaatgtaacatctcgagctataattacatgcttaatattatttggcatcatctaactgggttgttcctattcaggaatttgtgttgaccaatgagaggttcctagtgccagagatgcttttccatccaattgatctgggtcagcagatctactaaaatgtcatgtgtactttgagctgttcattgttgctctgttaatctcactactgtgcatgttcataggtatgaatcaagctgggcttgctgagtgcatagttcgtgctatacaagcttgccacccacatcttcaacctgtgctttttgagaggtatcatttatttattgtctgaattctgaacctatcttgacatttgaatatacatccatgttactatgtgttggtttgtttccactctccagaattatcctgacaggaggaagcacgctattccctcgattcaccgaaagattgtaagttgatctttttattatttttgtacatcagaaataccatctcaaggggtgtgggatttattgtttgctattcacagggaaaaggaacttcgtcctcttgtgcctgatgactaccaagtaaagataattgctcaggaggagtatgtaccactctatctcttttgcacacgtgcgctgttggacatgtatagtcaccaacttaccattaacatcctgttgctttgtctagcccaattcttggtgcctggagaggtggatctcttttggcgcacaggcctgattttgaatcaatgtgcattacaaaatcagagtatgaagagatgggttcaatgcggtgccgtcgtagattctttcactgaaagttgtgtgccagcagctcagtagaagtgcaatttgtaagtatgattcagcactatctagttcaggtcttgaagaaatactcattaattaggcaaacgagaagtttggttctagaaggtaatgatgcacaattttaacacgtggtcatttttttacataggaattagaagctattactccatgtatctggtcccccttattactggcaaccaattctttcagccttcctaccagctaaatatgcagatatagtccttaccagggaaaacctttgtggtctaacaccctcggaacacagttgctctgagataaatggtgaattttgcttttctgctcggtgaaaagttttcttaatttttttccgagtaaacagcgtgcatggaaatattttattagtcatttactctggcaatacctgacctgtgtacgccacacagagctttagtttagaaacaacagtatgcatgatcgtcttttagaagcataaatattagtatgttagtttgtatattcagtctctggaattttcgagtcttctgtccacctttgagctgaaaatgaccttgctgatcgtgtgattggcttgaatggtatattaactattgctagtacgctgagcctatgagatatgcacctattcacttgtgagatatcctctaaaaatgtctttgttcaaaaaaaaaaatcctctagtgtttactgaaatgcacttatgtcatcaaaattttacgagcaacattgctggcacttcacgtagcaaactagcaatgatttccagataagagtcacaaaggaacaacacacacacacacacacacacacacactccgactgctgatacagaatcttacagatgtcaccagcaagagttcagccacaagaacagaaccactagtacgtagataacaagtgcagcgacatgcatggtaacaattgaattgccaactctcagataacaccaggactcccctcaggcaaccatggttaccttcttcatccctcatccctcaaccttgtcgcaggtgtctctcaggcgtatcttcggacctcaggatccagtacttctccatgggatgatgggaatgacctcctgagccttcagaattttgtgcaatgttcctaggatagaagtcggatgtattccttaccatcgaaactgcacagtttatgaaaccaaaattacatgtcttttctagataatcgattaattagcgtataaaactcgaatacatgtagaactgattggtgcataaaagagggtcagttatgtacatacccagtcgctagcaatgtatcagctggacaattcagagtccatctccattggtcgatctcccctgtaaactctcggcttgttaggatgcttcttgcacacagctaccatgctctccaccacggagtcgacgatgacatggccaaagaactcaacctccttgagccttgggagcttgtcaatgccggagatgccatctgcaggctccttgaggacggcgagcgtgagcctctcaagctcgggggcgcctccttggaagctaagctcatcaaggttgggcatattgtccacgatcagctgcttgagcctcgggaatagcttctcccggaagtggagctctctccccatatatgactggtagtagagcttgagggagaggaggctagggagcttgcctagctgctcgatgacctccttgccatcaaggaagttctctcggagcgagaggtcgaccagattgccgaggtgtgagacccaaggaggcaacatgctaagcttgccccagaggaagaacttctcgaggaagatgggtggcgagtctagatctaggagttcctcgaggccagcgtcctcatttaaccagtggaggatagacaagctgcggagggagtagctgagtttgttgagggacacaatgaatggcttccatttgttaggccccttttcacagttcatgacgcagagcttggttaggctaggtaggtcacccaactcgcccatggcgatgccgctcgacgtgacgttggcatgggcaatggtttggagggactccatggcgctcaagccaggtggtattgtcatggcctcaaatggctcaaagagcttgacacggtggctccttgtgtagtatctgtacctgcctgatagaagatgcctcatgtgtcctagccgggtgatcgtctccggcaactccctcacatcggtttccctgacgtccagtgtcatgagctgtttcagtctcccgaccgaccgtggcagccgctgcacgcctgtgtccctaaggcttaggtacctcaagagggagagcttgcagatgtcgtccaattcacggctgcttagccaacgacaaccttcgagatccagcaccctgaggagctttaggcgcttgaagctaattgatggcagtggtttctcgatgcaccggagcatcaacagcgagcgggcgcaagacaagtctacggacgacaagacgtcgtcctgaccctcgccctcgcccttcttccttctcctcctaaacctaaagatatcctcatcaccaccaccactcctagattgttgcccctgcggcatgtgggagccatggacagatagccgccggatcttgtcatgcccagtcgtcgtagccgcggtatgttggtgacgcccgtagctggtcacgctccccaacaaggagatgaagttctcctccacgcacttggccgtcatcacctccagcatgatgtcgtgcaccttacaacacctaaccacgccattggtggcgacccgagtgggtgtgacgatgctcctgccaacgaactcgtctatgtacttgccggcggcctcctcgggggtccactcccgcccaccgccaacgaacccctcggcggcccatcgccgcaccaggggcccccgcttgatctcgtacccctcgcggaagacgctgaggtagaggaagcaagccttgaggtggtagggcaggtcgtggtagctcagcgacagtatccgcctcatccccctcaccgccgcgctcgtgctcagcccggagcccagcttgccgcacaccttcgtccactccaccggcgtcttgttctccgcctgggccagcattcctcccacactgactatggccagcggcaggccgccgcatttggtcaagatgtcaccggagatgccctccaggcttcggtactccgacgggcaatgctccttctggaacaccgtcttgaagaacagctctctggactgatcgtttggcagaacatccatgaagtgaacgcgatcgccgggaagcgagcagcagctctcagcaacctgacggttccttgtagtgattattattcgactatgcttgtcattgtcgggaaaggctggcttcaagcttgcccagtcctccagactccataagtcgtcaacaacaataaagtatctgcacatgaaaaggaatgcattacatattcatacttaatacttataatattgtgatttttacggtttctgaagagatcctgaaaggcaccttctttgtctgatgttagttaatttatagcacctccagatttcttaacactagcaagataccgatggaaaccaaatctacactaggaattgtgtgatatctcctactagttgctcatggatagtaaaagattctcaaaatatttgacaaagttctgacatcccctaagtgattagaatccaacc

SEQ ID NO: 44810 - DNA, 2144 bp, Oryza sativa
ccgccgcatttggtcaagatgtcaccggagatgccctccaggcttcgggtactccgacgggcaatgctccttctgaacaccgtcttgaagaacagctctctggactgatcgtttgcagacatccatgaagtgaacgcgatcgccgggaagcgagcagcagctctcatcaacctgacggttccttgtagtgattattattcgactatgcttgtcattgtcgggaaaggctggcttcaagcttgcccagtcctccagactccataagtcgtcaacaacaataaagtatctgcacatgaaaaggaatgcattacatattcatacttaatacttataatattgtgatttttacggtttctgaagagatcctgaaaggcaccttctttgtctgatgttagttaatttatagcacctccagatttcttaacactagcaagataccgatggaaaccaaatctacactaggaattgtgtgatatctcctactagttgctcatggatagtaaaagattctcaaaatatttgacaaagttctgacatcccctaagtgattagaatccaacctcctaataactactataatagttttcgacgactatttcctcatctaaactactacttcctccatttcaaaatgtttgacaccgttgatattttagcacatgtttgaccgttcgtcttattaaaaaaaattgtgaaatatataaaactatatgttcacatgaaagtatatttaacaatgaatcaaatgatatgaaaagaataaataattacttaaattttttgaataagacgaatggtcaaacacgtattaaaaagtcaacggtgttaaacattttgaaacggagggagtataagatagagggtgtatgcgttatcaaaatttgaaaagatgaaactgtctgaatgtaattttggcaacaaaacaatcaaccaaccaaaagcattttcagttgaaaattaagtaggcagagacagagacaataatatacctcttgtcgctcagatgagtactgcaatgggcgaggagttggggaatgtccttggtttcgatgcctctgagtatttcatccttttccatggccatgatctccttcctggagcagcgtggatctcgcgccggcgcgaacagctgctccagcagcgactccagcatggcgcgaaggttgcagctccgggtcaccgtcacgaacgccctgtgatggatcccctgcaccgccgggctcttgtacaccatcgccgccagcgtcgtcttgcccaggccgccgaagccgacgacggcgaccaccttccggcgagccaagccgtcgtcgtcgccgtcgtccttgtgttccagcagcttgaggatggctctggtcttgctgcggacgccgacgaggcgggactcgtcgacgctgagcgccggaaggcgacggtcgaggtcgtcgtagcagcggggcgcgtactcgccggagctcgacgccgcggcgggcggctccagcctgtacctgagcctccgctcgctgaccttgagcgcgcgggccttgaggctctggacctccacggccagcttgtacatcgcccgcagcgtcgtcagcggccggagcgccgtcctgcgcagccagccggcgacgacgaggaggccctcgtcgtggttccggtcgccgccgacgtggtaccggaaactgtcgatgcagtcctccgcgtcgtacgccacctccctcacctgcttcatccacgtcctagtctgcaacccaaaaaaaacctatgattcatcatttcaagaacacgaagaaccaattgcgttgtataaaaaaactcttttctttttctaatatgttgacgtgcaatactttttagcgttcgcgaaaaagaaaaaacaaggcgcgacgccacggcgaggggctgacctgctgggactggtggtagtcgccgacggcggcgaggtcgcggaggcaggcgttcatgctctcgaggtcgtccttgagctcctggatctcgtggcggacgccgctgaggaggacgtacttgtcggagaggaattcgccgagcttggccaggaggatgcgcaccacgccctcggtcgagctcaccacggcggcttccatggtcaattgccgcagctaccgcaacccgagtgtagagtcaatcagctggcctcttcgaat

SEQ ID NO: 44811 - DNA, 703 bp, Oryza sativa
ttcaacttgtaaaagcggggattatcgatgtctcgagtccagttttaactgatgtgacaagtgggatctacgtgggccctacatgttagggctagatgggggacctagtattggtccggaaacaattcggcccgtatttattattgagtacatcttcaagagtactcccttcgtcctaaaaaaaacaaacgtttgagtgtccgtcttatatgaaatttttttataattaatattttcattgttattagatgataaaatatgattaatactttatgcgtgacttatttttttaatttttttataatttttttaaataagacagacggtgaaacgttgaacatttttttggacggagggagtactccatatcactggagtatgtccagttcggagcggaacaccatcgtggtgttcatccgtgacgcaccacgcgaccgcgttcacactgtccattctcgagcatggcaggcacggcacacagcacgatgcctccctagctcgacacgtacagcgcgcgccagcaacatcagatgctgctgcttgttcgggaggagccccggcatccgctccttggcatcgtcgttgatgagcctagccaggtcgtcgacgatgtcgccgctcgccaccgcgtgccggccgtggaggccaccacctgccgcgtgatgcgggtggcatagtacccgtccttagctccgacatggtt

SEQ ID NO: 44812 - DNA, 1874 bp, Oryza sativa
  unsure (1)..(1874): unsure at all n locations
nnnnnnnnnnnnnnnnnnnnnnnnnnnnnnnnnnnnnnnnnnnnnnnnnnnnnnnnntttcagttcctcgttattatgataccaatataaatatgcacccaataataaagttgccacataacttcttaatttattgtatcaaaatcgtacctaccttacaaagttgttgtatttatgtgatcacttataaagttcttatactaaattgcacctacctaccaaattgttgcactagattgctcatttatcaagttcttacaccatattgcacccacttatcaagttgatacactagcggtgcaatttactcttgcagttgcatggatcaaattaacccatttttctctgtttttctttttaaagcagctatagataatccctctatcccaaaatataacgcacaacactactaacacataaattaaaaaaaaagaaattaatcgtctcttcagtaaggtcacctcgatgtatgcaaataatatgaaagtaatatgattggagagttatatataacgagacatggataaaaaatgattataccttatattaggtatattttcagagggatggatgaagtatctatctgttcaaccttgaatacttctagccttcgctaggttccgtctgatcaattgatctcctccactaaaaaagatgggaaaaaaaacgatctataatggagacagcagacaggacatgaagcagaaatcagcagccccaaactcccttgctttggcatgtttctctacatagtagttaaaatgcagaaaaaaatcggatccctaacccgaatatctgcagagatccgacggtataacatgttgaatattcatgcaagtacatttggcatgttaagcaaccaaagagtggtgacttgagaagtatcaacataggatttcacattcacaagctgtatggcatagacccacggttcccttgagaagttacacgaccagtatcgtattatcacactaagagcaacaggaacaaaaggatagtgtagtgtcttcttttcatcgatgttaggaacaagttccagcctatgtcccgatagaaacggaagggtgcatgttcactgttttcttattgaacacaaactacataactacagcttaatgtggcaaggttcactggctgctcgattcatcatgctcttgttgcatctggttcagtacaaatgccccttcaaggttcttgtggacctcggctttgaacttctcctccttgtttcccctcttaagtttcatcagaatgtcaaactttgcgaagtcttcaacaacctgattgataaccatatcagaaataagggtgtgtttgaggagaaggggattgaggagattaagaagatacgtaaaacgaggtgagctattagctcatgattaattgagtattaactattttaaatttcaaaactggattaatatgattttttaaagcaactttcctatagaaaatttttgcaaaaaacgcaccgtttagtagcttgggaaacgtgcgcgcggaaaacgaaacaaacaaactcactctctcaccctctcgaacgctgcctaagtgaactataagctcagcattactaaattagatacaaaaaagaaaagataatctttggatggatgaattcacaatagctgacctctgcctttgcacgaacgatctcgagaagttcatatggaaacagggagtttgacctctgctggattgatttcacagcatggtctgcagcatctttgactacaggatcatgtactggaacatcacgccacccaggctcatgtccacctgaaatttcattgagttcaatatcaggttnnnnnnnnnnnnnnnnnnnnnnnnnnnnnnnnnnnnnnnnnnnnnnnnnnnnnnnnntatatata

SEQ ID NO: 44813 - DNA, 1913 bp, Oryza sativa
cgagggacgcggagccgacgaggaacaggtcggcgccggcggcggcgacggcgaggaggaggaaaagggggagcggagcggcggcgaaggagaaggcgggccgcgtcgtcgcagcaacgcgcatcccaaactttcccttcgttacggtttcgctcttggggcttgcggttgcggcttctttgcttcgtgcggggggtttctctctttgcgacgaacggggatgacggtttggctgttgaggcgagtcgatctagaaagagagagttgagagcggtggcggaacacgtggcggggaaggtgcaggctacgcctacgcggcgtcgattcggacggtggggcgtggggcccaccaccatacttgggccggaactggatctccgaccgacgtgcggcccacatgtattgggccattcggtatcgcggcctcactgtggcccatatatgaatgcggcctagggagtacctatacatctttcgaaagatttttataatcgtatcacacagatttttaatctttggattaaaatccgatagatataataaaaagcaaaagacaattaagaaacaccataatggacactaaattaccatatcctcaagaaaaagaccaaatccaatacaaaatttaaaatttacgtgcgaagattcaaaaattacagtgtaacttacaaaagttacagtgtaagtttcataaattacactgtaacttacaagaaaatgcaatgtaaaattgagagagaaaatcgagtgatagataagaaaaaaaatctttcgagtgagatatagcaaaatcgcttttaaataagtagattcgcgggtcgacgtactatgtgcggccgataaatgttgggctggaatggaaatgaggcctacatgtgaccgagaaatgttgggccgtaacggtatagcgtccaacgtgcggcccatattgttggcacgggacaggatcgccgcctacctctgggccattagtattgggccgaaacaagatcgtgcactaacataaggcctataagcattggggttgcaatgggctcgggatgaacggcccagattagcttgttttgttttttttttaattttgacacattttagctggttttggttgctagtttgctaccgcttgtcgaagccgacaattagcgggacgagcttgtgagttgtgcctactcaaatcaaccgctgatcgcaaagatacattaactatagtattaactatgtgtatgcacattctttctcaaaaaaatgaagatcaaacatgtgtgggttctcctcaaaaggaagaagaggacaaaaacaacaggagccatggctaaatgattgagtcaccgtcgtcatcaaccatcgatctccctccaaaagttcacgtggcgccgatcagttattcgataatcatgcatcaccgacaagcactgacagtgcatctgggctcatccaactattcaactccagatctctgcgccttaatcaaccaatgatgtgttagcttagctgcattgcagagccgcaggggcataaagcaccgggctgcaagcagcctcgtgctaattccaagatgtttaggttcgatccatcatctaccttgatctccatgtcgtcgccaagacagcacgacgtactgtgtagtacatacacctcgatcgatctctgattaatctggatcgcctcctgcctaatataatccgatattcctaaatgcatgatgatgcatcattagctttacgtcgacccaatcagaggacaatccatgtatatatgctctgtcaaccataagtactacctaccttcgccctactaaacaccaccaagcaacgtcatgccccacacctgaatcatctcatctctgtagaacattaatccatctctgtttagttagcttgtcctcgatcgaaacaggggggcaaaatccgtat

SEQ ID NO: 44814 - DNA, 2771 bp, Oryza sativa
  unsure (1)..(2771): unsure at all n locations
nnnnnnnnnnnnnnnnnnnnnnnnnnnnnnnnnnnnnnnnnnnnnnnnnnnnnnntaagtatctctagaatttaagtttttacacacatcatagttatttttagataacgattcaaatgtacaggagtctaaagcatttccagccaatcagatgtttaagaggaggattctaaccaatttgaaatctagctaagatggttgaatggaaatttccgttaatcaatctagagattctcataattaggaacaaagaggtacacagtttagcaccactagttaatcatggaggcgacagcaagtaaggcagccagtgccggatgcatggctccatgtccatgagggtgtgtagttaattatattagtacctaatccggggtctaattagtcgtcctagctacaattagtccctggaatcttgaccagttgtgtgtacctctgctctgtcctatgcattagcacgacggggacaccgtcaccatatgcgtgctgcaagcctgcagtatacggtccaagttgtgttcaaaccaagcaatctctgaactttttcaggaacaagctagctactactcctactagttgctaatgtgtacatgcagtgtgagctaagatggatggatggatagatccagcttggttagctgactaattattaatggcaactgctgtctggtggagcatgcactggatataatgatatctatatgatacgtatcacacaatgtagctaggaccagagtaatttagataaactaaagtgcttcggccattagtcctagccgacgagctggattagctagcttgacgtgtgccttgacctttatttgattccctcggagaggagttccattcttgtctcttgccctctcttcctaaattctaaagacttagaatagagtagaacgttgtgttggtcgtaagggtcgagttttggatgatcacacctatgttactttgttgacttagcaacggtcggtcacgcttagcggcggtcggtccagtgctaactttctcctgaatatgtgttggcgctgtcggtgtgtaggtagtgatatattttttcagttttcatggttacggccttccagggttataagcttatagtttgtaaaaaaaataattgatcccctcgtgctctagcttgatcgcgcggctacgcgaactacgtactgacgtacatatacagggtatatcaagctaattacgaggagtaggtgagaccacctaggtaacttgcatgtatagcttaaaaacgaaatgggctctctgtaaaaaaaaaatcaacaccgactgtaaacctactaaatatacatgtgtccaagtttataattaggattaaactttttatggaacaggatgtaatcccttgccatgccaaatttatattcttacggtaaaacttttctcataatctccgtctaaattcacatcaagactataagactaagtagctatataatctagaaaatgagctaatagactattttatattctcaaccactagatacttattagttgttgtcttagaatattgagctcccttaaacatgatcgcaatagaaagtgcgattggaaatattatggtgtcttaggttttttttacttctagaaaatcaagaatttttgtttaaatttctccaaaatcttgtgctaaaattatacgaacttgtatatctcaattagtactttactactaatttattttcctgaaatccgaaatcaataattaacaagttgtacttaactgcttagactcttcttttaattaatctaaccattataactaaaaaaagccatatatttacaatatgattaaaattataatatttataatagtttatacaacatagggattggtgactagtactccttctgagtccaactttaattgtccgtcttgtttgattttttttatgattagcatttatgttattagatgataattgataaaacatgaataatattttatacatgtcttatatttttttattttttttaaaaaaataaataatacggatgatcaaagataggcatagaaatttataaccccgcttacaaagggaccgagggagtaattagttcatgcaatacagggattgatgactagtaataatttattatcaaccgcgccagaacacatgtgaaatggcgattaattagtctagtaatgtagtatatatatatatatactccctccgtcccaaaataacttaacctatatattaacctatatagtgagatgtgacacatataagaacaataaatctggacaacacatcctagaacaacgattgtccatatttgttgtcctaggctaagtcctaggttgagttattttgggacggagggactagaccaatacaagtgactagctctctttgatgatatatacttcctccatcacataaaaaatcaacttaatagtattaagggcttgttcactttgctaccatttttaaccttatcttttttttggtaaagttaaaaaaaaaggaaaaagtatgaattacacccccgaactatcgtggttgtccgaattaccccctgaaccacaaaaccggacattcttcacccccaactatgcaaactggacgaattaccccccttggttcaatccacggtggttttggtctacgtggcgtacgcgtagcagtccagtcagcattgtatttataaaaaaaattgtgggacccacgtgtcatactcttcctccctctcttctctctctgtatgcctcacttttcctctctctctctctctctcacgggtgggtc

SEQ ID NO: 44815 - DNA, 7962 bp, Oryza sativa
  unsure (1)..(7962): unsure at all n locations
cccgccgcccgtcgccgacctcagcttctcgcccgctgtcgccgacccacccgtgaatgagagagaggaaaagtgaggcatagattgagagagagaagagagagaggaagagtatgacatgtgggtcccgcaatttttttttataaatacaatgctgactagactgccacgcgtacgccacgtagaccaaaaccaccatggattgaaccaggggggtaattcgtccggtttgcatagttaggggtgaagaatatccggttttgtggttcaggggggtaattcggacgaccgcgatagttcgagggtgtaattcgtactttttccaaaaaaaaaggctacatttagtttatttccaaattttagtaagcacatatgattgccaaattttttgacaaccttaccaaaatttggtaatgccaaaacttggtaaggttgaaaatggtagcaaaatgaacaagcactaagatgtgttagatccgatactagattaatttttttagggatggatggagtatactagtaggagtattccttctataaaaaaaaactcaatcttagaaagggatgtaacctcttctattaccacgaatctgaaggtactaaaatgatccttataggttgaggttttttttaatgaaagaagtaatgccgaaggttgaaagtttgaactcctgctattcgaagttcactttgcagattaaggtggtgtttggatttagggactaaattttagtacctatcacattgaatgtttgcacattaattagaagtattaaacatagactaataataaaactaattgcataaatgagagttaattcgcgagataaattttttaagcctaattaatccataactaacatatgtttactgtagcatcatataggctaatcatggactaattagactcaatagatttgtctcgcgaattagtccgggattatagaatgggttttatcattagtttaggtttaatacttctaatctatctatctatctattatatactaaaagttcattaaacttcctacaaacgctctcaagccgccacgtggcgctcctacaaatgctcctaggccgccatgtggcacaatataatctcaccgtcgattttcgcttaaattggtggactcattattttataccgttagattagatctttacccgccgttgattttcacttaaattggtggacccattattttataccaatgaattggatctaccttctcccgtacgtatgtatggtttgccggaaggattagtaactatggttatggttgttagaagttgagattaattagctgtcatattgtgttgctactaatcatatctatatttattatatgcacggcaatatatatatggaagctaggagattaacaagaagattatacatagctaattaaattagttattatacatgatttgtggaaggaaattaacggtaatataacatatacagctaattaaatcagtttatatggctttatcgtgatattacgtagctaattcgaaccaagcaatctccacttaaatcgtccagcttaaatcggtgtatctaagattacctttttaactcattatgatgactttaaaattaaaaaagattttctaaaaaacaaaatacatgataattggtttttgacctgaatgatttagaaaaaaatagaaaaacaaagtcccctccacctcaccctcaccattagatacgcacaacactttgtgccccctccacttctctctataatttttagtagctatgataaagagaaacaaccacagttattttaagctacacatattatatctaatctaactgttgctctatacataattaaaccaacaatttaagattcaaaataaattaaaatcgataatacatattaacgtcagaacaaaatcaatggtctttaaaatataactttttaccatataaaaatatattactccacaaatatgtgcaaatataaactagatctataatataaataaaaaatatcaaatcaattatctctaaatgttcatcttttaaattattttaaattatataatcaatttgtgatcctgtcgtatttctttaattaaataaaatatttgtgtcttataaattttatattgcggttctagatacatcaccacctcttgggaaaaatatataataattaatgttatgataattttaaataatttcatatcatattttaggatgtcaaatatcacttgataaatgtactacgtaattgcgaaaaaaataaaacaatttagttgtgttttttcaagtagatctgatttaattttaatttgtttgaattaagccaagtgacactctaaaatctatccattgatttttttttaaattggtgggtctaatatttttaactattagatcgaataaaaaaagtatgtgctcccaccttctccacaccctttcctggtacggacgtactctcctcatctcctctttcctttcctactctcttaggaaaaaaaatcttcaaattttctaaactattagatttatctcaaaatttaccaattaaatttgtaaacaataaataaattgcccgcgtaactgcgcgggctacctttctagttagtactaaatattcgatgtaataggggctaaaatttagtctctaatccaaacatggcctgaatgtcaggaaacagaacactccagctatttttttacggtcacaggactcagcaatcaaatgtgctaattaataccccaaatcaagaaagcaccaggttacacgccaagcaactcgaagtggtgagccccctcgcaatcgcagggacacacacctctccctctgtcctctcgctctctccctggtggcgccaccaatcctggccacctttcgctaccgaacccggccaatcatcgtatgattgccggcctcctcctgttcctgcccccacacgccaatcaaaaagagcgcggcacaggcgcacagcacgtaggcgtaccgtatagtggctgcccccttctccgtgcttaaaaccgggtgcggtcaccgtgattttcactacactcgctccaaaatatcactgcctagtacatgatcgaacacatccgttaagaattattgtattaggaagtgctaaatcacatatagaatagtaacatttcaaaacagatgttcttttttttaagtgtagtatgaacgtatcattaagcgagacaagctagcccaaaagcagcacgacgagacgagacgagacgaaacaaaacgagacaagaccaagacccgcgcgcgcgccgcgcccggccacgtctccactgaactatccacccccccgccgggaaacaaacaaacgcccctgcgcgaacacgggcgcgatacgctacggagaaaccaccttttccgccccccgcgtgcttgatcccccccccccccccgtgatttcctgcggttttgcggccgccgcgccgcgacgcgtcgcgtcgcgaaagccggtgaaagcaaacgccgcgagacagtggcacacaggcgcatcgatcggggggagaaggggtttagcacgcggcggccgcgcgagggcatgtcggtcgcggcgcgagcgcggagcggaaaacggtaaaagaaaactgccactccaccacgcgccgtccacccgtcgggtcggggaaaaaagtttaaaacgccgagaagaaggctgtgtctagttcaacgcaaagtttagattttggttgaaattagagatgatgtgagtaaaaagttatgtgtatatgacaggttgatgtgatggaaaaggactgaagtttactccctccgtcccaaaaaagacaaaccctggtttccgtgtccaacgtttaaccgtccgtcttatttgaaaaaattatgaaaaaaattaaaaagataagccacgcataaagtattaatcatgttttatcatctaacaacaatgaaaatactaattataaaaaaatttaaaaacccacagtttatcttttttttagaactgagggagtaaatccaaactttaaatctaaatacagccgaaggacgatagcgtaggcgggaggcagaggtcaaacgcacaaacggcgcctcgtggacggtcggtcgtctcgcctgcgggtcagggtctcggggacatgcaatgcaaccgggagttgtgtgcagggaacaacacagtgaccgggagcttaaacaaaagggccacctaactcgcccccctttggagcacatgcccccctgccccacatgtatcaatccatccatccatccatgtgtacttccaatcccaatcccaacgagatcagcaccgtcagctacaccgatcggacggccgacaccactgcgcatgcatgcacaggcgcgagcattcccagcgctgctctccctgtacccgatatggacaaaacgtatggcgcgtacaggcgctcccctagtccggcctacagcttccagccgaacccataaacaaagcacgcaacttgggagcgagcgaggggccgcacagctagccatcgatcgagtagccaggccaccacatcgccgtcctcgctagctggctgtgtcaactgcagcgacgacgaaacgaacgatcgatctcgccggctggctggctagctgctcctcctataaatccccggctcccagccgtccccctccgataccgtcatctcaccacacaaacgcaggcacacaaacacagagagcagcccaaaccgaccaaaatcactgcagagttcaggcacttcttcagatagttctccccctctgtttctttctctctttatttctttctcgagttcagtttgagagatggatttggcgtggtggttcgcggtggccgtggtggtgtgcggccttgtggggggcggcagcgccgggctgctggagaccaacccgggtttggcgtacaacttctaccagaagtcgtgccccaacgtggactccatcgtccgcagcgtcacctgggcgcaggtcgccgccaacccggcgctccccggccgcctcctccgcctccacttccatgactgcttcgtccaggtcagtgccagcaaaaatactcccgtttcttcgctgcttcagctctctccaagcccccatttcgccgtgtcggcgccgtgccgcgcgccggcctagctagccagccatggccggttttctttctccctgtctacatcctgagaggaattaactgcgagagccaccatttcgagctacctagctctagctacagtctagaggccttcactggtcctgcattctttgcatggcgtcgattggggacgaaacgaggctcaagtgaaccggggtttttaccgcggtggttcgtggcttttactctgattttcacagtggcgggaggaccagccgagaagatattatcttgcttttcgcctgtgcctgtacacatatacgtaagcattacggcaccttttccccggttcgcggcagcgcgaggcgaggggcgaggcggtcgcgacgcgccaaagcaacgagacaaacgggaaaaatactgcgtgcctagtacagggggggagcacgccgaatcttgtcgtatttttccccccattttttttccccgtgcggcccgtgcgttgcgttgccgtgcagctcacatgcggcgctgagccgatgcatcgcgcgcgacagctaagcttatcaaagctgccgcgccctgtacggcgcccatgcatgccatgcatgggccatggccacaccaccggccttggcccccttgctcccgcgattttttttcaaaccctgcaaagcgcagctgtttgtggccgcgtgtcaatggcgcctggctgaccggtcggttttcttctttttgtgtgtgtggttttgcgtgcaggggtgcgacgcgtcgatcttgctggacaacgccgggagcgagaagacggcggggccgaacctatcggtggggggatacgaggtgatcgacgccatcaagacgcagctggagcaggcgtgccccggggtggtgtcgtgcgcggacatcgtggcgctcgccgcgcgcgacgccgtgtcgtaccagttcaaggcgtcgctgtggcaggtggagaccgggaggcgcgacgggcccgtgtctctggcgtccaacaccggcgcgctgccgtcgccgttcgccgggttcagcacgctcctccagagcttcgccaaccgcgggctcaacctgaccgacctcgtcgcgctctccggcgcgcacaccatcggcaaggccagctgctccagcgtcacgccgcggctgtaccaggggaacaccacctccctcgacccgctgctcgactccgcctacgccaaggcgctcatgtcgtcgtgccccaacccgtcgccgtcgtcgtccaccatcgacctcgacgtcgccacgccgctcaagttcgacagcggttactacgccaacctgcagaagaagcagggcgcgctggcgtccgacgccgcgctcacccagaacgccgccgcggcgcagatggtggcagacctcaccaacccgatcaagttctacgccgcgttctccatgtccatgaagaagatgggacgcatcgacgtgctcaccggcagcaaagggaatatcaggaagcagtgccgctccgcctcctgaatcctgacgatcaccatacaaacatattttcttcttggtttcttgaatttttttttcttcttctcctctctcgtttcatcggcgctgatcaaaatatattgtgcgccatgatgattaattaaggtcccaagatctgtattaatttgttaagtgctcgattcgatcgttcaaggtgtgacattttgttcatcttggccttcgtcgcgcgatctaatcgaagaatgaaagaatgcagctcgttctttccactgctgcttcaaacaaacatgcagatactacgcacgtaggagtacaaatctactgctactcccactgttctttgtttaatccagctaagatgatggtgacacgagcataacaagaacatctttctctgcgatccaggattagtttatctgattctctgcgcccactagtgatcttgaagatgtgtgcgttggtgcaccactagccccagcgctaatcccatcgctaattgttgtcctactctgatcccaccacgttctgcctctgaaaatctgaacaccattggcacgatcagcaaggtgctccgttctctgtcccgtcactcccgccatgcgtttgcatattttgaatcatttgaatgacacttgattagggcaggcaaccaaagaacgtctgatttgacgacactcaacgtgctatcttgcgctatgcagaaatgggacaacagagaggctttgaagctgcatcgttcttgacttcttgtgctcgtgatgaacagtgaaagacacagcttttctgactggtctgatgagcactcattgacagttttttctgtatgtgggcgtctgtttcaaaagtactagagagattctttctctgccaaacttttcctataaacttttaactttttcatcacatcaaaacttttctaagcatataaacttttaatttttctgtcacattatttcaatcttagccaaacttccaattttagcgtaaactaaacacacccttagttccaaaataattcttcaaactttcaaattttttatcacatcaaaacttttctacacacataaactttcaatttttccgttacatcgttctaatttgaaccaaacttctaattttggtgtgaactaaacacagctaaaaaaataccgtttctcgcaaaatctttctgtaaataaactcatgtaaaatttgaacgagctcagatctcgaggaacgctgaattgctgaaacaaaaaaaaagggaaagaaaacaaaaaagggcaagtgagagaaaagataaaggacgccgttggcggcggggtatgcagcaggtccacgacgacggagtgagtgaagaactactgaaagcaaggggagnnnnnnnnnnnnnnnnnnnnnnnnnnnnnnnnnnnnnnnnnnnnnnnnnnnnnnnnn

SEQ ID NO: 44816 - DNA, 878 bp, Oryza sativa
  unsure (1)..(878): unsure at all n locations
actatagggcgaattcgagctcggtacctcccaccgtccaagcagggccggcgagatgtcctcccccgacgaggacccgccgacggagcccgagcggtggagggatctggacatgctcctctcccgccccggcaacctcgtccacgccgacttcaaccccagccccggggtcagccacctctctctctttgtctgtgtgtgtttcttgcgtttgtcctgagatgaagatcgttgtgccctgtgcgtcgcagctgcgggactcgctggggagcctcgtggaggtgctggtggtgggcgcgggcgggctggggtgcgagctcctcaaggacctggcgctctccggattcaagaacatccacgtcatcgacatggacaccatcgacgtctccaacctcaaccgccagttcctcttcaggttttttttactctccttccttccacacgcccacctaattgtgccccccctcccccccactgttgtgcgatgccatcagattgttgcgccgtgagggaaaaacatagggatagattgtcaggtttcgatgccgtgttcaaatgccaagagccgggcacctatgagcgtcgactgaaaagattcatttacattcactgggagtgcataatatccacggagaatgggcgaataggattaagagtgttatgcctatttgttcagttgaatgcaattgaggtggttttccctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 44817 - DNA, 1676 bp, Oryza sativa
  unsure (1)..(1676): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatcctcttaattaatgattcggcgagaccattctgagtgtggacgtgtggtacagaatgttccactttaattcccaaagccatgcaatattcattaaataccttagaggtaaactccccggcattgtccattgtaatggattgtatccggttatccgggaaactggctctcaaccggattatttgggaaataccggaatgatccagacatgggattaattggtccacatatgtttccctgtattcgttgcaagaatactggtgattctgcgttcacctttagattagagggtctaacgattaatttcgctgttgcacaatcagtgcaaacaaaatcttcttggtttgggaaatcgttagttcgtaaattatggccatttgaagttgagatgattcttgtcatcatccctagacctggatgtcctaacctatcatgccatattctgtatgactcaggatttttaaatattgttttcagtgcaacattttcgggttttatatgagtgtagtacaggccagatttcaaggaagggagtttttcaacaacagtcttacgatttccgtttaatttcgttatgagaagaaatttgagtttattctcatctttggtttctacatgataaccattagcacggatatctttaaagcttagtagagtacgactggactctggatataatagagcatcatttataatgatcttggtaccatgtgggagaactactgttgctcgtcccactccgacgatgtgtgcattgcttccggcaatagtagcaatttgaccagtctttttctttaaagtctggaaatacgtggtatctcaaaagatagtattggtggtacaacagtctaccagacacatctcctcttccattgccatagtacgtaacactattcttatcataaagcatttaaatataatcaattcatgaccatatagcaaaaattaacactttaagatagaaaaataaaaatctgggaaatatattaaactaaaagagttcactcaattattaagataaccattgctctgaaggagcttacagaaactatagttctgctaggaacacaaactaaatgcacacttgaaaaatcacctaactttagtctattacatagtctaaaatttaaagtaacttataatgtaggaagctaagatacaaattggaagacttaaatgtccccatataactgatcagagtccatgagatcatctgagagctttagctctgcgtctgctgcattctgttccatcttatcatcgatgtgcattgcaaccactgccttctcgtcgacctgcttgtcgatattcatggcagccatcttctcctctgagtgctggatctcaacagtgaagtgtgactcatgctccgacttcttcttcccatgcttctcttgataaagctcaatgagatgcttaggggtgcggcaaatgcgagaccagtgtcccctagtgccacacttgaagcatacctgatcttgttttccatattcaccactagtagagcc

SEQ ID NO: 44818 - DNA, 950 bp, Oryza sativa
attattaagataaccattgctctgaagaagcttacagaaactatagttctgctaggaacacaaactaaatgcacacttgaaaaatcacctaactttagtctattacatagtctaaaatttaaagtaacttataatgtaggaagctaagatacaaattggaagacttaaatgtccccatataactgatcagagtccatgagatcatctgagagctttagctctgcgtctgctgcattctgttccatcttatcatcgatgtgcattgcaaccactgccttctcgtcgacctgcttgtcgatattcatggcagccatcttctcctctgagtgctggatctcaacagtgaagtgtgactcatgctccgacttcttcttcccatgcttctcttgataaagctcaatgagatgcttaggggtgcggcaaatgcgagaccagtgtcccctagtgccacacttgaagcatacctgatcttgttttccatattcaccactagtagagcccttcttagacttactgttctgatttcctttcttcttgaaagacatcttgttaactttgccaccatttttccagaaattcttccctttgttctggttattctggttattctggtttttccccttcttaaaggagctagcatttgcttcgggtgctgctgaacttccagtggggcgagacgtatgattttcagcaagtgtctcatcttctccttgcgcttccatgagcacggagactagtttagaatacttctcgtatttatcctggcggtattgcctctgaatattcacatgattggcatggaaggtggacaaagttttgtctatcatgtcagcatcagtgattttctctccacatagcttaagacaagtgacaatgcggtgaagaactgagttatattgctccacatatttgtaatcctggaaacgtaagtgaagccactcacgttttgc

SEQ ID NO: 44819 - DNA, 6257 bp, Oryza sativa
tatatatatatatatatatatatatatatatatatatatatatatatatatatatatatatatatatatatatatgtcattctataaacattaagttaaaattcaaattttaccaagtaaaaataataaattacattacaactaattaacttacatttatagtcaaatttatttttttctttcaacatgtagaagttaaattttgccttgcatatttgtgtagtaatttatcacatattagtctaccttgttggtattttttaaaaaaaaacataattatttgagagtgacatgcaacaacgagagtacataccctcgggagtttatagaatagtggtgtgcaaaagattgtccacgatagaaattgcactgtagtttatattaactgaatgaaaataaattttctgctttgtcattatcatcaacgatggaagtgcatgcacggttacctttagcattagcggcccataataatgcaacttctctcttttaagtttttatttttcaagaggacatcctcttatttattgcacgcaacctaaatagtatagttattaaaaatttagaaaaaaaaagttttgatgaagcaaattagtatgaaacatatcactccacaaatataaaagtccaaattcaactttcacaagttgtaataaaaacaacaaatataattgtgaattcacgttaactaatttcaacttaatttgtacttttttcttataacttataaaagtcgaattgatcttgcatgtttgtgtcgtgatatattttatattaatatatcttaattatcattttttttattttttaataattatttacgtgatatgtaagaaaggcaagaatgttccatcaaagatgaaaatccatctccctagctttgacatacctatatatggtcatgatacaaagacacaagctgcaccttcatatttcagggggaaaaaaaagcgcaaatcgcatttttgtacgagaaacaagagcatatgaattggtataacaactcgtgtcaatgttcaaaaaaaaaaaactcgtgtcgacgtgtcgtgtggttgggcccgactacgactcaaaagacccatgcctgagccatggcggccgtgtaacagattataatagcaaatagctcgagttattttcgtggttttctcctgccgagcggtactgctcccggtaaaacgaaacgaagatgcatggcgatcccgtctacaccgaattgaagtctccaagccagtaggaagagagaagatgaatcaacagtcacagcagatgccggggagatgcatcatatcgccctctagcgagtagcgagacgcccaggcggctcgagttccgcaagcatccgcaaacgcggcctccgcaacaacactggcggggtgagccgcctcatgatacgcagctgcttcggcgtgtggtcggtcgtccacggccgctacatccggcggacacactatctccgctacatctggagttgaggacggcttgagcatggagtgcattgtgggcgtcgacatccagagcagggagtggcggcgcgggtagttggagaagaagccgggacgaggccgacagatagtcgggagagaagcgcccgcaatctccgggagcattggcggtgaagtcggggccgcagccaaagtggtttctgcgccgcgggagtgtcagacgcagccgtcgctggcagatgtttggagagagcatcacgcacggcggtcgatcgtgaggccgggagggggttggtacgaagcgcgaacaccatcgcccaccgccgtggcgactgcgttgaccggcgcgtcgtcgtgggatgggggaggagccggcggttgacatggtcagggttctaggagcggaagcggtggatcgaggagtctgataccttgtgagacgataggactcaacgcgataatcgaattgatactgatgaaccttcctgaattaagtcagccgatttatagaaatataaccggagagatgatttagagaaacgggagatcaggtgtggctaaaaggaaacacgatatacatgccaaatatacatgatcgatacgctaacatctatatatacgtattcgtcggtgttggtggtggaggctaggttttgcttgcaccttctcttcctctctacgccggcgcctacatccacccaccacgaatggcaaccaagggaggacgcggcggcaggggaggccagccgggcgagctcggccaaccgggcgagcccgggcaaccgggccggggcggcggcagggcaggacgaggcggcaggggaggacgcggcggcggcggcggcaggagaggacgcggcgggaggggaggaggacagccgggcgagcccggccaaccgggccagttcggcggccccggcggccgcggcggacccgcgctcggccctcacggcgacgacggcggcaccggcggcaccggcggctttctcggcgtcggaggcgacggaggccgcggcggcgacggcggcccaggaggcagcggaggccgcggcggcgacggaggtcaaggcggacctggccaacggggcggggacggcgggcccggcggggcaggcgggcccggcgggcacggcggcgacggtggggacggcgggccgagtggttccccgttgcgtaaacggcggcgtggtgggcggagcagaggctatctgcttagggaggaggaggaggaggaggagcttgatcagatatgaagatactttggatagtacaacaactgtcgatgccgctgtagttgcactccatctatatttgaatttagttagtagaagtactgttcgctctagtgttctatgtggtctaagagttttaaactcgtttatgctatgatttgtttttccatggaagcagcatcttgaaattttagaaattatgttggacgaacacatctgacagacgagttgagggggtggtttaacagctttgttgatcgcctgcgcttgagctactactgctgcacaatgcacatgtggcaatggagaaggtggagttgcacgtgagaggaggcggacggcgcgggtggagcggtacggcgatgctgctgcgcgcgccatctagctacaagctaggcggtctcgccggcggcgcggaagacaaacaggtgcaagcgcggcgcgcatgcagggcggacggatgaagcgtgcgctcatcttcgcattgccggccatggtgacggccgtacgtacgtgcttggccttacccttctcaagaacatgttcgtctcagctcggagtcgtatagcgcgcgtatggcgaaacctgtgcatgtgtgccttttgtacgtacgttgcatgggtctaagtgcctccgtttcatttgtatgtaggagaaacgaactttatactagtattaaccgttcatttttatgtatgagaaatgaactttatactagtattaaccgttcattgattccaaatatagcagcatatagagcatcaccaatacattagcaataatctatctctaaaatttgatttttgggttttctaaactaaaagtaattagcaataatctatctctaaaatttgatttttgggttttctaaactaaaagtaggaagtattccttaaaaactaaaagtgggccctttcactttttccttccgctcacgcacaaaaaatcacggtcacttgctcccaaaaataagttttgatcacccgcttccaaaataagttttcgcgcgggaaggagaggacaagcgcgggcaaggagtgagaaacggcgaacgaggagacactctctctcccttaaatccacatagcaaaatactccctccatcccaaaatgtttgacgcagttgatttttttaaacatgtttgaccattcgtcttattcaaaaaatttaagtaattattaattattttcctatcatttgattcattgttaaatatattttaatgtatatatatagttttacatattttacaaaagttttagaatgagacgaacagtcaaacatgttttaaaaagacaacggcatcaaacatttagggaaggagggagtacatagggatgggaactccaaaactatctcaaatacacgtagccaaatatatggaaatgggaactccaaaactagtgtagagcttttgggatttgttggatccgatttttttcgctaaaaaacctcaaaatcaattttggaaatgaaataggatgactgccggtgatgctcacatccttatcttttatctttacctattataaaagtttaagatgtttttgccaagtattttcgtacgtcgtcctagtataatgggcgcgtagtccgattccctccccgtacgcgaaacggacaacttgtttaccgtatagcttgattccgaggttgatacgatgtgattttgctctaattcttagaaagaacgaagatagaagaagataaggatcaaaactcttcaattaattttggattatctctgtggatgcggactgatttcacagaggtggcggtgttgggaaaggtgcagagtcggacggaggtaggggacgacactgtagcactgggacccacgcgatagtgagaggaggacaagggatgctaattagactttgtggttgcttgatgggtcggatgcacgcttgcaggctgaggtggaagggaggagaagtgaggttaacgggctgagccggctacgggctaatgaaagaatgggctgaaaatggccctgggagaaaggagggttttcatttagattttcatttaaataaatgctaaaatgatttttgtattattaaaattagtaatggagctttgaaaataccgaaaaaatttcacatagtataattaatcatggaaaattgaataaaaattaaatctagccatagtttatttgggaaattttattttccacatttaccttgatttttacgagcctttcttttctttaacatcgtatacatgcatagttgcgattttataatttaattaattacataatgtaagggcctattcactttgatgccaaaaaaaaccttaccaaattttggcattaccaaaattttggcatagttgccaaaattttagcaacttgccaacattttggcatgattttttatatagttaccaaaatttagcatcaaactaaatgtagccacttttttggcaactttaccaaaatttggtaaggttgaaaatggcatcaaagtgaacatgccctaaatctttcccaacctttccttaaagttctcatgttttttccgttgcaatgcacgagcatttttttcgactctagaggatcccaatacggaattactatacttcggtttgaattcaaactgagcttcgattgcagactagaggtcagaagaataacatcatctatctcatgttttctaaaacgtaaaaactagtggtacctatacatatgtatccataaaaaaagtatgtgcaagcgcacctacaatgtaaggagaaaccatctttgatcggtcgaccaaatttcacaatagtcctggttacaataaaaaccgaaactaaaaattatctttagtcctggttcaaaaggttagagctattttttttatctttagtcctggttgggaacaccaaccgggactaaagatcatttctagtcccggttcaaagaacaacagactatgtcacaccttctctattatctttagtcccggttagtctatttcttgtcctggttggtaacatcaaccgggaaaaaagatcggcatacgcggcggagaggacgagacatgtgcaagatcgaggaggaggaggcgggatcagttaataagttctatctcctccctcaccttatctcttcctcctcttcaccccatctcttcctcttcctcctcgtctcctcattctcttcctcccctctcctcccattcacaggcggcggtggctgcgccctcgcgcggcggcggccgcgcggaggcggaggcggcctcgtgcagcggcgaccgggcggcggcaagcagtggaggccggtgctactgcgtggattttttttcttttttccttaatgtgtgattcgatctgtattgaatgtgtgattcgatctgtgttgttattgtgaatgatttggggatgactattgagtgaatgatttggagatgaactattgtgtgaatgatttgggatgaaactattgcttgtgaatgatttgggatgaactattgctgtgaatgatttgggatgaactatattgctgtgaatgtttgatctaaaatgatttccgcaaataacaaaaaaacaatgaaaaagaaagagagaaaaaaaacctccagccgagac

SEQ ID NO: 44820 - DNA, 2269 bp, Oryza sativa
aaatgatttccgcaaataacaaaaaaacaatgaaaaagaaagagagaaaaaaaacctccagccgactccacattgggactaccgatcgatctttagtccccgagtatttgaaccgggactaaaaatagcgatatttagtctcgaattcttactcccggttggaaaaccaggactataaaggggttaccaaccgggagtaaaaaagatttctccaccagtggtatatatataacacatttgatctactatggtagtggcgtgcaaaagattgtccaagatagaaattgcactgtagtatggtctatattaactgaaggaaaagaaatttcctgctttgtcaattgtcattgtcatcgatgatggaagtgcagcacggttaaagcatagcagcaaatagtaaagcagcttctctcttttgacatgggaaagtgttattatttctggtggcgatatcctcttatagtcttatttattgcatgtcatctaaatttatatatctatatacctaacaaaaaaaatacataaggtttccggttatttgttttcgttagtcatcccacttgcgtgcactaaaatctgttttaatccgcttagccacgtcaggcctttttcaatctactccaaaaccagagtttagatagtattttccatgtctgcctacttggctaaggaaggatgttttcacgttgcccaccacccgtattattacttggaataaatctactttgtcctcatctcttgctgctaattgtatcgcaccctcaaccgtaaaacgggtataacacctccctcatcttcaaaaaccggtacaaatcaagttttttcatggtttggagaatggtttttactgacgtggcaggtgggatccatatgtagggactcctcttccccctctctctttcttcctctctcttctcgttttaatctctctcaatgacgttatgtctgagcacgaagactcaccaccatgagtcggcgtccgtggctcggcggtggtggcaatagcctaccgtagcgtcgaccacgcgtcgtcgtagcaggcggggacgaggtgctccggcacgaggcggttgtcgacagccgcaactcgctcatcatggaaaaccgctcgatcgagcgccgcgccattgcctcagcgtctttgtctccactgtcaagacgacggccaccgtgaaggaagcctcgtgcccaccgctagctgccgcacaagtggagaaggcgtgaccatgaaggagctggtgaggagatctacggtgggcggtatagatggccaaatgggccgcccagtccggcatgacccaggcatggtcgggcctaggccgagttcagttggaccggcacgactcgacctacacggcctggccatgccattccagcccacgggctacatacacggcccaggcacgacccaataagactcaggccatgccagcccgtcccgaagacacgatagcccatcgtgcttctccatacaataagtctatttgtcctccctcaactcttatggcgatctatagtggacggtgaccacgacggcactaacgatgggaggacacttgggccagaatggctgtacgttgcgcgaacattcctgcaacgaccattctgcaggatgcatgccatgacgtacggtaactgatccgttgctccaattaggtacgatgagccccctacctgacatccctgcaactaactggacggtgccacgacaacgtcgtggtcgctagccagctcgaagcacgtcgacttcgccttctgcgacataataattccgtggagcttcgtcaaccgctaccgccgccgcctgctctatgttcgacgtggtctccgccgcgatatggcagtgttgcacccgagctagccatccacggccacggcggaggtgtcaccgccgctcccgcgcccccgttcgtgttcacggccaacgtgcggaaccatgtcggagctaaggacgggtactatggcaaccgcatcacgcggcaggtggtggcctccacggccggcacgcggtggcgagcggcgacatcgtcgacgacctggctaggctcatcaacgacgatgccaaggagcggatgccggggctcctcccgaacaagcagcagcatctgatgttgctggcgcgcgctgtacgtgtcgagctagggaggcatcgtgctgtgtgccgtgcctgccatgctcgagaatggacagtgtgaacgcggtcgcgtggtgcgtcacggatgaacaccacgatggtgttccgctccgaactggacatactccagtgata

SEQ ID NO: 44821 - DNA, 2494 bp, Oryza sativa
  unsure (1)..(2494): unsure at all n locations
nnnnnnnnnnnnnnnnnnnnnnnnnnnnnnnnnnnnnnnnnnnnnnnnnnnnnnnnnagcagcgtgagggctaagcttcgcggcggattggagatgacgcagaagcagagccagttcaaggggcaggggaagaagaagaccatccctcccaaccgccatggcaaggcgccccacgtccgcaaaggtacccccgccgcaaagatctaccggcgcctccgtccgtccttccgtgccgttctctggtgctcttcgatgcttccctgtcgccctgcgtgttttgattggtcgctcgattcttgcagggaagagggccgtgaagccgaccaagttcaccaaggacatggacgccgataaggtagactcggtttactgaatgcttgctctattcatcaatcagcacctgctttctccctttcggacataagatgttatttggggcagcatttggagattgggggtctagccttctctgagctctgaagtaggcaagaaacaaacatgaattaaactagtgatacatgcaaaccaaatatgttctgtttttgagtgatataagatggaaagttgtgtgttcgttaatgtgctccaaaataacatagcaatattcttttactactccaaaagagagttacatgcctattgattacggattctctactagtaccaataagatcaaagttaatgattttgtcggaactaatatccagtgatagttcttttcaacataggttacatatgtagtaatatgtttcttcataagttgaggagccatggaaataataattgagaggtgtatggacatatggttagtatggttagaggggtaaaggtaaaggctaaattgctttgattagcagctgggatttgtcttttagcgcctgatttgtgttgcatttcaatatgggtgcccatattaggctaatacatgtaaatctcatgtggttgacttcaacattgttctggtgaggcccttttagggtaactgggtgctgaggtcatgctccatgattcatggcctatggctgggaactgtacaaaatgcaaaaactgatgttaatattaccgtataaatatatgaatttatgataagtttgactccagaggcaattgcagagagagtccgacagcattgctgattttttggctggctgttgctgaatatgtccgctaatgccattactgtcgttccatttacagtggttgatctgtttgtattggttgtttgggtgcttgccaatcatctaccgtatgttaaacctagggatggatttaaaatctatttttactggttgacagacacagcatcagtattcagtagtcctatagatatgccaagctgtagtttaatccatggtttttctgccagtacttgcaatgataggtctgtttagtatgatattaacagttttctatggctcggtaatatggtaactaaactggcatagctgtagcctgtagtcaacatgttatggccattgataagttacatcatacttgggactacgatacattctttgtagactatagttttctagctcggtatgtttttgtaatattccgaattgtgaggaatgctgcctcagttttctattccactttcttgttataacaagattggtaactcaattgcatgaccgtgtagttgttgttgatgttctacggtttgatctgaaaaaccagttttacattgcttcttgttgtattttgatttacaggataagttgtgtttgtgaactatgtagatgtttgggaaatatttggcaatgttttaccttgacttgcggtgtggtttttgcacgggcaatcgtgtccgaagttatcgaggatcaaattttattagactattttggtgttgcagatttcagtaggtttggcattctctatgatactaataaacgaccacttttggcgccatgtctgtttgtcaaatggtgacattagagtttggaataattgaaagcagactagaccttctgatcttattgttattaactttgtgattacgtttttttcttatttgagatatttaagatatttagtaaccagtgaactcatttgatgttctcttcttcccaggaactcacaaaattcatcaaccagtgcaacgagaagaaggctgcaagtcttgccagcaaagaaggcggcgacctcagtatactcaaggcggacgttgatccctccaattcaaactaggaatctgtggctacctctgcctacggctatgtgctatagaagatgagtgtgtggaatggatattatgttacattgcatacttgcattctagtatttccctgcagaaatgtagtaattctgtatttctctgaagaaggttatgcttactgctaaatgtttacaatcaatcaacggttaatactgtaaagttctcttctcatacatacaaataattaaggcgaaagcaatagacccatgcgannnnnnnnnnnnnnnnnnnnnnnnnnnnnnnnnnnnnnnnnnnnnnnnnnnnnnnnnnnnn

SEQ ID NO: 44822 - DNA, 3436 bp, Oryza sativa
tttggaataattgaaagcagactagaccttctgatcttattgttattaactttgtgattacgtttttttcttatttgagatatttaagatatttagtaaccagtgaactcatttgatgttctcttcttcccaggaactcacaaaattcatcaaccagtgcaacgagaagaaggctgcaagtcttgccagcaaagaaggcggcgacctcagtatactcaaggcggacgttgatccctccaattcaaactaggaatctgtggctacctctgcctacggctatgtgctatagaagatgagtgtgtggaatggatattatgttacattgcatacttgcattctagtatttccctgcagaaatgtagtaattctgtatttctctgaagaaggttatgcttactgctaaatgtttacaatcaatcaacggttaatactgtaaagttctcttctcatacatacaaataattaaggcgaaagcaatagacccatgcgacgtacgcgaggcacacgcacgggtttcgccacgcgccgtacaactccgaagatgcaagtagtgaagatgcatcctgtgagcaatggtcaggcttgtagagttgcatataccatttggggcttttgggatgcgtgtgtgcgagagagataatagcatatgtttattgagaagtaagagatggtcgaacatgtgaatggacgtgctccagacccacgatttaagtcaaagggcttaaattctttctgttgtgtgctacagtaagattatgtaatcatatggttagcaaaaaaatgtcaaccatcaccgtaggatcaaacatgcagtataaggatcgtacgggtcattttgctagtacgtactccctccgtttcaaattgtaagactttctagtattgctcatatatttagaagttaatgaatctagatacatatatatgcctagattcattaatatctatataaatatgggcaatgctagaaagtcttacattgtaaaacagagaaagtacgtacaaatgaaatggagaagcggaagcaacaaaccctcgaagtatgcgagccacacgcacaggttccgccacgcgttgtacacttgtacgaatccgacacgagcatgtccctgaggagggtgagcccaagcacaaccgtctccttggacgagcgcgtgcctcaccaacctcttcctccgcaggcgctgatccgtcgttgatgtaccgccgggagcttccagccctagcccggaccgttgcccctcgaacattgcctgcaaagagagccgaaagaaagaattgacacaatccgattttagaaacatgcaaaacgagagattttgcaatgcaaagtgaataaaacaggcaaaataaagaggcaataccagtagcaggcgctgatgaagctggagggagcaatggtgttggtgcacggggcaatagagccataggtggcaccgggagccacacgctggtggaagtgccaccacgaggtcctggagggggaggagatcaccggaagggaggaagaaatcagcggaagggtgtaggatgttggtgaataatgtcacgagaacggctgcggtgaaagccacgccgctagccacaacaaggaactagcatgctggcggaggcgcttcatagttggggtcgagggggagggcgaggtcatcgtcgtcgtcctcctccttgtcctgctcgtggtcatcgtcagcgacggccgggatatgctctgcgccggcgacctcgagttgctcctccgagggatcctctgacgacatagagctatagtaaagtgcattgggacctactgtgctccttgttgacgacggttaaataccaaatttaagccttcgatacctgcataaatttaaaaatataaaacatccaacatagtggtagggtttatttctaacaattttcataagtgttggtgtatatttgaatgaaggtgataaactaccaaagtgaaaagaaatatacataaggaagagagaattacgttcatatccaagactatggagtctcgggcccacaaactcatcgaaataccagaaaataggcccaaccatcataccaatgggctaaggactcctttgccaaggcccaggagaaaggcctaggccagggaggccaaccagggttcggccgaaccccaacccagctagcccagaaacttcacaagctagtagttatcacccaaggcagttgtgactgtttctacctgaagaaaccatcaaatgacacttggcacaaggaggtgaagcaagaaggaatatgctcattggatgcttgagcatctccacatttccaaggcacttcttggcctataaatacctctctcctccttcattcacaacacaccaagcataagctgaattataagaggctctattgtatcttttactccctccatcccaaaatataaggctcaaccactcataacacaaagaccaagaaaatatttaatcatattcttggtttggatcacctcgatgcatgaaagcaaggtgattgagaggtttgatggtataggatttaaaacaaatcaattctattgaaccaagaggtgctagttaatctatgcatgcatgcacatcttatattatgagacatggaagaaaagtggttgtgtcttatattttgggatggagggcgtatgtacattagaatatggagagggtaagggagaaagagttggaggaattagaatagggagagagtaagagataaagagtcggatgaattttggagttttctatattttccttttatcttttgtatcttgtcaactaatctgctttaatagataatatctttatcgagtaattgagatttactttgtaaggattatcttttagttcagctgcgcaggaatatgttccttttacctttttttatcttgtcaattaatctgctttaatagataatatctttatcgagtaattgagatttactttgtaaggattatcttttagttccactgcgcaggaagatgtgccccagcccgaaccgctgcccctcaaattcttcctgccccagcccaaaccgctgcccctaaaattcgagatttattaaggctaatctatttgttccactgcggaggaagacgtaccgccaccgccaccgcgaggaagtccggttgatgtgccgcgcgagcctccagccccagcccgaaccgctgtccctcagatagcttggttactgctgtaatgtgaattgctttctccaggatgtgagattgtcaattgctttgtgtgtgtgtgtatatatatatatatatatatatatatatataatgtcatttttctcttttttttagctaatttcatttaaacaaacagtcagttttgaatgtgtgtattttatctctaagcacttcttggttatccctgaatgtgaattgctttcttcagaatgtgagcgaaaattcttaggatcggtcaatcgggggagg

SEQ ID NO: 44823 - DNA, 3660 bp, Oryza sativa
  unsure (1)..(3660): unsure at all n locations
aaaatgtttcacctagtgtacttataatgtttcactatgtatggattaaatgttgcagtgaattgaaacattctctcgctatttgctgaaacattgtttttatataaggtgaaacatcgtccgatttaaacgattgaaatattgttgatttacttagtaaaacaatttcgatatacttggtagaatatcgtgcaacatttaaaaataattcaataataagctaaaaaaattcgtcggaatatatccatatgtgtcttgttttaaagatttaattgcaacgaatttaatggtgcaatcgaatcatgatttggataagtaatttaagagaaaaaaaatagtttaaagtggttttacacatatgcgtgacgctgacatcatgctgacgtcagcaccgatttgaccccctcccgggcacccaactgggagtcgcgtccggacttgtgaattgcttgtgagaatgtatacatgtcattttctctttttttagccaatttcatttaaacaaataaacagttttgaatgtggtgtgcattttatctctaagcacttcggtccccccggtacaattggttaattctcagttcttgaaagccatagctataaactagtatcaagaactctcatccattttcgaagattcctcgacgcccttgaaagtaacacgcagcttcctcagagaggatactttcttcccgttgttttctgccattccagttacatgcacagtcgtgcgtgcagctcctttgagtagctcaaacattgggacacccaggtttggtcgcgtcatctgctctaggacttcaggtgcctgcatgtagaggttatcgccttcgtgtgttacgctagccctcgacattagcagcttggggtgctcttcaagcatcttgatgaactgtttatcaggggaagtgttagaaatctacaagatacttaggattatacacgaaatgtaacaggtatgcagaatatgggcaaaaaaaaatgtttgtctttgcttgtccaaaacaggaaaaggaattcaacagtttagaaaagcacgatgtgaatgcaagcatagcatgctgtttaaactttgtaaacaacaactttagatgacaatggtttggagtctccatataagtgattgccatatgatggctgtattaatgcatatgtagacaggtcacaggtgagctagataatgattactataacagctctacctcagaggttcagactgccattaacagctgaagtacgtcacatactagtgtgattatgtggctaagctagcaaagtgagtctagcaaggaaacgtgttcatgacatcagaaattctcaacatagttacaaggtattgagtgtattactgacctctgagagggtagtcgatgtcccaagttcaataagggtaccaggtccacatacaaggcagtctttctctcttgcaaattcgcttacattaatgtgtgttccatcaaggccgttatacctgcagatagtcaaagaaaaataatgcacttcaaacagaaccatgttaagtgtttctaacctggtcaagaaatcaatcgcttcagatgtgcttgttaattatagttaaacaatcttggggataaataaatattccaagtcgaaaccaaaatttaaaataagactcagaaaagtagtgaactcacgtgagataattcgacacagttttgctgcacccagagataagcttaagagcttccaacgcacatgcagcagaaacaattgcatttgttgaagcaatggctgggatgatattcttgacaacaccctgtaattcatgaaaatacacagtggtacatatgtcacatcccatcaaattaacaaccatgactttccaataattacacggcatatcaactaatggtaagatgatcttagtcatccactcaaatcaagaagcagaaatggctggcataaatttcgatgaaaactgacaaaatggaccacaaccaaaattaataccccatttagcacaaggaccaaatattgaacatgcttttatttatttgtagtaagatcgaatcaccatgagagtcaacttgttgtgcagagagaatgctattcacatactgttgagtctaacattttctttaaccaatgttggatcgtttatcatctcagtcaatcttaaagaatttcccaaaaaaaaggttgaagttggtgtgattataggactcatgcattattaccagagtacagtttggctttaaatcactagcagagaaggcacaagattagagagacacctgggtaacgaaatatggtactccagaaataccaaaaaagtctgctctctttaaagcctgtattcaatgaggaaaagttttagagagaacccagagataaaatacattccttgtcatgaagtaaagcaaacctttaagtaaatccacggcatatgttctgcatcaccagcatcaaaaggtttcccgggatgaacctacaagagtgcctttaattattnnnnnnnnngggggggggggaggagttcaaagagcaattatacagaaactagaacagtacctcattccatttgatcaaatgagcatattcaatgcaatgagctgcagttctcggagtctcagcaagtgtacataagggaaatttgacctggggagggaaaagccatatgttgcattcaaaacaaggtgttgtcccaggtatgatgactctagcatgacctttgaaaccttcagtcccaccatcgaccataggtttaagcgtctcagggattggcttgtcatctgagtcatactctgcaattgcaattacatattagcactatagcactgcactgaatatactgagtttggtacagtacatagtgaataacaatatacctctgtttgggcatcaccattgtctctagatgcaattcagatcactaatttattttggaaaacccattaatctcttaaagtatactattgtgaaaatattttttgatacaaatctacatgtatgattttcatatgttcaatctaaatacttgagacaatattgatacccaaagttctaaaaactttactacatgcatgtccaaaacgaaatgtatttgagaccgaagggagtagtaagctatggacaattgagaatcagaaatataagcaaacttcatagacaatgatgagtaaaaattatctgcgcactaatttggatttatataaccatgacttttgtctgcacagtatcatatttacaaggttactccaattcgtcacgaatggtttttcatcggttttaatcctgaagctatctgtggcatgtgtgtaggttatcacatcactttataatttaatgtcaaaagttttatactgaaagaggagagatgaagatgttgtagaactcaagacgtatgctagattaaatgtctgtttccaattcccatgcaggagaaaagataaagaaagaacggctaaggaaatatgtacctaagaaaccacacgccacggaattgatatagcttcgagcttcaattgaatctagaccaagaacaattatcgagaattgactgtagaactctatctctttatcttcaatcctacagaaatgtggaacaatgttcactccactaactcgctccataaccctctttgcagcaacttcagccttggacttcccaacatcttgaaccctgtaagagagtacatg

SEQ ID NO: 44824 - DNA, 1098 bp, Oryza sativa
  unsure (1)..(1098): unsure at all n locations
nnnnnnnnnnnnnnnnnnnnnnnnnnnnnnnnnnnnnnnnnnnnnnnnnnnnnnnnatccaaagaagtcagttcggatccgtttgtgaaagagtagaaaaagaaagatagtgagaaaatgttagactcaacagtatgtgaatagcattctctctgcacaacaagttgactctcatggtgattcgatcttactacaaataaataaaagcatgttcaatatttggtccttgtgctaaatggggtattaattttggttgtggtccattttgtcagttttcatcgaaatttatgccagccatttctgcttcttgatttgagtggatgactaagatcatcttaccattagttgatatgccgtgtaattattggaaagtcatggttgttaatttgatgggatgtgacatatgtaccactgtgtattttcatgaattacagggtgttgtcaagaatatcatcccagccattgcttcaacaaatgcaattgtttctgctgcatgtgcgttggaagctcttaagcttatctctgggtgcagcaaaactgtgtcgaattatctcacgtgagttcactacttttctgagtcttattttaaattttggtttcgacttggaatatttatttatccccaagattgtttaactataattaacaagcacatctgaagcgattgatttcttgaccaggttagaaacacttaacatggttctgtttgaagtgcattatttttctttgactatctgcaggtataacggccttgatggaacacacattaatgtaagcgaatttgcaagagagaaagactgccttgtatgtggacctggtacccttattgaacttgggacatcgactaccctctcagaggtcagtaatacactcaataccttgtaactatgttgagaatttctgatgtcatgaacacgtttccttgctagactcactttgctagcttagccacataatcacactagtatgtgacgtacttcagctgttaatggcagtctgaacctctgaggtagagctgttatagtaatcattatctagctcacctgtgacctgtctacatatgcattaatacagccatcatatggcaatcacttatat

SEQ ID NO: 44825 - DNA, 798 bp, Oryza sativa
  unsure (1)..(798): unsure at all n locations
agacatcattcatcacaccttcggtgattctgttacgttaaaatgccgttggactcataaccgcagggacacttttccagcatacggtccaaggggcacttagcgatcagctgggtaacaatgttgaggcctacgtcgacgacatcgttgtcaaaaccaagacaggcgacttgttgattgacgatctacgggaaactttcgacaacctcagacgatatcgcctcatgctcaaccctgagaagtgcacgttcggggtaccgtcgggcaaactgctcggattcctcgtttctggcagaggaatagaagcaaatcccgagaagatcaaggcaatcgagaacatgaagtcgcccacaagactcaaggaagtacagaagctaaccggatgcatggcggcgctaagtaggttcgtcgctaggatgggagaacgaggacaacccttcttcgcactgctaaaaaagcaagacaaatttgtatggacacaggaagccgaagaggcgttcatcgcactcaaacgctacttgtcaaatccccctgtacttgttgctccccaacctaatgaagagttgttcctctatattgccgccacgccctactctgtgagtactgtcattgttgtcgaaagggaaaaggtgcagagaccagtctattatgtcagtgaggccctacacgacgcaaagacaaggtacccacagatccaaaaactgctctacgcagtaatcatgatgtcaagaaagctannnnnnnnnnnnnnnnnnnnnnnnnnnnnnnnnnnnnnnnnnnnnnnnnnnnnnnnnnnnn

SEQ ID NO: 44826 - DNA, 1426 bp, Oryza sativa
  unsure (1)..(1426): unsure at all n locations
nnnnnnnnnnnnnnnnnnnnnnnnnnnnnnnnnnnnnattcgtcgtgatccgtggtcgtcttcttcgtggagcagcgtgaatctcgcattggcgcgaagagctgctccaccaacgattccagcagagctcgaaggttgcagctccgggtcaccgtcacgaatgccctgtgctggatgccccgcaccgcggggctcttgtacaccatcgccgccagcgtcgtcttgcctaggccgccgaagccgacgatggacaccaccttccggcgggccgagccgtcgtcgtcgccgaccatgtccagcagcttgaggacggctctggtcttgctgcggacgccgacgagactcgtcgacgctgagtgccggaagacggcggtcgaggtcgtcgtagcagcggggcgcgtactcgccggagctcgacgccgcggcgggcggctccagcttgtaacgcagcctccgctcgctgaccatgagcgcgcgggccttgaggctctggacctccacggccagcttgtacatcgcccgcagcgtcgtcagcggccggagcaccgtcctgcgcagccagccggcgaggtcctcgtcgcggtaccggtcgccgccgacgtggtaccggaagctgtcgatgcagtcctccgcgtcgtacgccacctccctcacctgcttcatccacgtcctcgtctgcaaaaaaaaaaaagattcatcgtgtcaagaacacgaaagcgcacaaccgattgcgttgtataacaaaaactattttcgttataatatattaacgtgtaattctttttagtgttcgttaaaaagaaaaaaataaggggcgacgccacggcgaggggctgacctgctgggtctggtggtagtcgccggcggcggcgaggtcgcggaggcaggcgttcatgctctcgaggtcgtccttgagctcctggatctcgtggcggacgccgctgaggaggacgtacttgtcggagaggaattcgccgagcttgccgaggaggatgtgcaccacgccctcggtggagctcaccacggcggcctccatggcttcctagcgcagtgtaagtttggtcgatgagctcttggcttcttctggtaggaatttatacagacgatccgcgccgaattggttgagctcaaacactgaagtgataagactgatagatgctgttcaactgggatactgtacttcactaacaatttattcaaataattcgtgtcaaaaaaaatattcaaattattttacaggttcaattagtagtaatttttattggggttgttggatcagccatcatgtgataagttggggtaccaaggatgtaggagtatcaatcaatacattacactgtcattactcttaaaaatatgggaatgattggttcatggttagtactatttttcgccttataatacgagatctctcatgagagtgttg

SEQ ID NO: 44827 - DNA, 2665 bp, Oryza sativa
  unsure (1)..(2665): unsure at all n locations
ataatattttgaaatgttttactatatattttatcttttgtttatagtctccacgtctcttctaaattgtgcatcgatcatgcatataaagtctaaatttgcataagttaaccgcaaagtttaatttactttgcattttatttgctttgcatatgtgtgtgtacttttatgcttctctctaacccacctcataaaaagaattgccattgatgatagagattcaccaaattagaattgtttgaaggaaggtagaaggtacctaaaaccaacccactttgttattacaatgtgatccccacacctgggccacctctgttgttctgttattaatttgttgtgacaatgccaatgttcaatgggatcagtatctataatcctagcttaatttccgtgaagcatctaacacaagtctccttcggtagatatccatacgtggctacgtataatgaatctctggcaagtcattaagtcaagacacgcttgattgcttttcataccagaagaccaacagtttgtgtcctgatgacaatgggtattgagacagcacggttttgaccacacatatatttgggagcagttcgacacaccaagtgaattttatgtggaacaaatcctaccctggaaatttcataccaagtctaaggccaagtctactattttcacactaagtcagagctcaaattgttgttagagcaggcttaattacgcattgatcgaggccggtcagctgctcaggtgctgcatgggtaccacggagaagttttcgcactcacacatgacacatcaaacacccccaatgattactagtacaaaactatgcaaatgaactaagggcatgtttgattcaaccctgagataatactctatcttaaatgtgatctacatatcattgagatatcaccaaacttgctctccctccgatttttagtatttaacgccgttaaattttttatacttatcaatcttattattaataaaattacgaaacttaagagcttatagtatgtactataaggacatgccctcgagagcttggacctgttttgtagggctcttgctcttacttcacatccgcttgagttagagcttaatcaaacggtttcagatccatctaaaagaagtgtgacggatgagagtaatctgaaaaataaactagagaagtgaacatttaatattacactcatccctacatccaatagaagtgggcatttaatattacactcatccctacaccaatagttgctcacagtttccaggtataaaacataggacctatttagcatagctccagctccatcgagctagagctcaaccgaacaatttcagcttcacctaaaatgggagcgaaactgggtgtagctctctcacacaatgaactagagaggtggatctagatttaaccaactccacaactccattctagactaactactaaagctaaatttgtaagttggaactctaccaaacaggctcaaaatgttctcgtggcaggattattaagcggaactctcaaaagacatcatattttaaggcactctggaaatagtacttataatttataaaccaaggattcctatattatatttgtaagactgacagtagtattgtttgttgaaacttcctttggacaactaacttctcacatgatggctgatccaacaaccccgatgaatattagatattgtgatcgccatcacaaatactatatatgtttttttcggcactctttattcttaaacaggtgatactttaaatatgcatgaatagtcaaatctccaaatattttgctaacatattgaaaataatatagtttggtatgggagaaatgaaattgatagacttatcattaaaaattacttgtgtatagacatattttgataatttaaattaaataagaatatgagtacaaaaaataataataaatatgcatggtaagttatgttgatatcacataaagaggtaataaaagtaatattccagctgtatgaaactacagctatctcggtcaacatgattccatctgtaagaaacaaaacaaaattaaattaactcgagctggctagggagattattttaaaaactttagatatatgcacacacttcactcttcccttaaaatacatgccaccgcttggtgtcgatatttaaagggcatgtttgtgaacttaatgtttcgagaatataagaaggctgggtctactaacttctaacatttaatttattccatgagtccaataactatattttttagaatttggttaacaatagtctattgtttgaatgagctaaagatgctgaataaaactacagctactataagctgctcaaacagggtacatgaagcataatagacatatgaggtgccacaaccatatgtccatactaccatatagatgttactccctccgtcccttcgtcctaaaatgtagcaatctaaaatatgatgaggcctattctacaactttgtaacagctgcgataattgttctaactattactatatggttcacacaatcgcttaacctgtaaatgtctaagatgaaacttttacaccccggcgtcatgctcaaaaatcacgaagcctggcaggacatgtctcacccttcgcannnnnnnnnnnnnnnnnnnnnnnnnnnnnnnnnnnnnnnnnnnnnnnnnnnnnnnnn

SEQ ID NO: 44828 - DNA, 1151 bp, Oryza sativa
  unsure (1)..(1151): unsure at all n locations
tttattccatgagtccaataactatattttttagaatttggttaacaatagtctattgtttgaatgagctaaagatgctgaataaaactacagctactataagctgctcaaacagggtacatgaagcataatagacatatgaggtgccacaaccatatgtccatactaccatatagatgttactccctccgtcccttcgtcctaaaatgtagcaatctaaaatatgatgaggcctattctaaaataaaaaaaaatctggacataatatgagactcatcctagaacatccatcagattgctacattctgtctaaattcgtcatcctaggttgctaaattctaggacataggtagtaacaaagtacagattgcataagagcaagtataatatagggctataaaaaggctgaatgctgatgtggatgagagaggagaggagagatgataagcgagctgtaagtttgcagccggcttaggcacagaaaccaagaaaatttgtgagacagacaggtggaccatatatttatagtgaagagttaaccaccatatgagtgagctgagagataggctataaggatctgtacagtaagcagttggttgtattattagccttgctctaagagcaagtataatagtatagtcaattattggctttaaatcatctataatcaatttaatagccaatttatacaatagttacatatacacatatactacataattaacctttggtatcacctgtcatacacacatgtatcttgagttcatgttgcagctggctacagatctgtagcccgctattcttacatcttttcttttatcgttttaaaatatatttatagttggcttatagtctgctattgtaccaaactataagagcacccatcagtgtcagagtttagctgaagttgctcaggcgctgagcccaggaaaacggtatataaaattgtgattcgaagaggccagctgattgactctacactcgggttgcggtagctgcggcaattgaccatggaagccgccgtggtgagctcgaccgagggcgtggtgcgcatcctcctggccaagctcggcgaattcctctccgacaagtacgtcctcctcagcggcgtnnnnnnnnnnnnnnnnnnnnnnnnnnnnnnnnnnnnnnna

SEQ ID NO: 44829 - DNA, 742 bp, Oryza sativa
ggcttcttccccagcagcgctggttgcgtgaaaagagaagggaagggtgagagagagatgaggaagggagagaataggggaaagagagaggaggctgatgtgggccaagctgacatatgcaactcatgtgggtcccacgctgactcagcagccacgtaggataaaaccgaggtcaaaaccaccgagggaacttttgtgaccgattttgattagttaaggcatgtgggatatctggttttgtggtctgaggatgattttgtatctcgatgacaagttgagagaacttgggtgtactttttccaaaataaaacaatggccgcggtcctacgaatcttggatttgctttgcatcaaacgagttccattttccaagcatcttgaatgcgattaggtgccgacacgctgcggttctagggctcatgtcatgtcagggagttaaggtgcagatcgaccgggaattaatccgctttttatgcatccgcgtctccgggccggggcctgctgtaatgtgtgcgccatcgtgtgcttgggccgggctaggtcatcagcgttaggaataagttcaccggccgtgtctcaactttacgtcgagtctatttgaagtcccctaaccgcaataccagataagtgtacggtgtacccctaaactatgtaaaaccatcccaaaaaaggttccgagtcaatatagaggcctgggttcactgacgtggcttcttagtcgcaaaaataaataagattaatat

SEQ ID NO: 44830 - DNA, 792 bp, Oryza sativa
gagttaaccaccatatgcatgagctgacagatcgactataaggatctgtacagtaagcagttggttgtattattagccttgctctaagagcaagtataatagtatagtcaattattggctttaaatcatctataatcaatttaatagccaatttatacaatagttacatatacacatatactacataattaacctttggtatcacctgtcatacacacatgtatcttgagttcatgttgcagctggctacagatctgtagcccgctattcttacatcttttcttttatcgttttaaaatatatttatagttggcttatagtctgctattgtaccaaactataagagcacccatcagtgtcagagtttagctgaagttgctcaggcgctgagcccaggaaaacggtatataaaattgtgattcgaagaggccagctgattgactctacactcgggttgcggtagctgcggcaattgaccatggaagccgccgtggtgagctcgaccgagggcgtggtgcgcatcctcctggccaagctcggcgaattcctctccgacaagtacgtcctcctcagcggcgtccgccacgagatccaggagctcaaggacgacctcgagagcatgaacgcctgcctccgcgacctcgccgccgtcggcgactaccaccagtcccagcaggtcagcccctcgccgtggcgtcgcgccttgttttttctttttcgcgaacgctaaaaagtattgcacgtcaacatattagaaaaagaaaagagtttttttatacaacgcaattggtt

SEQ ID NO: 44831 - DNA, 957 bp, Oryza sativa
  unsure (1)..(957): unsure at all n locations
nnnnnnnnnnnnnnnnnnnnnnnnnnnnnnnnnnnnnnnnnncaggatgatggtgtcattctctaggcgaacgcggaacattccgttgggtagggcttccataactaaaccctcgaaagtaatttttgcttctctcgggttttttttttctctcctatttttcttttctgtcatatttttttttctcctatttttctttttttattttcaaataaaaaaacgttgtatttttgtttgaaaaataggaagttcaagatagaatttgggtactataactataggtggggcgattaccgctataggcggggcgattaccatatataacataagacttctcccccaattctgtttagtcgagcttctcgatctgtcattatacctcgagaagtagaaagaatagcaattcccattccgcccaaaaccttaggaattccttgatagttggcataaattcgtaagccaggtcggctgatacgctttaaaaaggttctagttctatatattccctttctagtctttctcttttgatgtcgcaaagttgaaaccaagaaatatctgttactttcctgatgtttccgaacactttcaataaaaccctctcgtagaagtattttaacaatgttttcggtaatatttgtagatactacccgaacagttccttttttattcatgtccgcgtttcttatagaggttagtaaatcagcaatagtgtccttgcccataagactctaattctaggttcctcctaatttttctataatcaacatgttctcttttttcttttcgttttggattctaaagcatatacgtgaaacacaatctactaattttttatttgatctatatcttgtctactagtatttataatacttcaggagctaatgaaactattttagtaaaattcaattctctcaattcctcggcgatcgcgccaaaaacgcgagttccttttggatt

SEQ ID NO: 44832 - DNA, 871 bp, Oryza sativa
cgaacgaaaaggattttccctgagatggtaaatgaaaacgattagccccatacgaggtttgggaataagtgatgagcaaggaatatacgtctttctgctaaagaggatctattaaactcataattcattagatccttgttatcaatgtcaactaggtatcataagtaaacggatcccggttgttcaatcctttgataaccaaggtcattctttgctaaagagaaatgatcactatgagtcagactcaatagaattggatccattccaaatagcgagaattaggattctggatccctctcaatctctctttcaattcgaggatccagagaggtgttttcatagtcatctccgaatatttgccatctccgaatattttcgatttcatttttctatgatatgtctttctatatgaaaattggttatttacgatgtacgatgatccctgttaagcatccatggctgaatggttaaagcgcccaactcataattggtaaatttgcgggttcaattcctgctggatgcacgcgaaccggaacgttccataagtctattggaactggctctctatccatggaatctcatccatcatccatacataacgaattggtatggtatattcataccataacataagaacaataagaactcgaattcttatcgatactggaactcagagcataggagggaaagtcgatttatggatggaatcaaatacgcagtatttacagaaaaaagtcttcgtttattgggaaagaatcaatatacttttaatgtcgaatcgggattcactaagacagaaataaagcattgggtcgaactcttctttggtgttaaggtagtagctgtgaatagccatcgactacccggaaag

SEQ ID NO: 44833 - DNA, 1583 bp, Oryza sativa
  unsure (1)..(1583): unsure at all n locations
tgagtatccgtttccctccttttcccgctaggatcggaaatcctgtattttccatatccataccatcaagtccttaggtttccgaaatagtgtaatggaaaaagaagtgcttcgaatcattgctatttgactcggacctgttctgannnnnnnnnnnnnnnnnnnnnnnnnnnnnnnnnnnnnnnnnacaaagtaagggaaaacccctgaaagaatttccatattgaccttggacatataagagttccgaatcgaatctctttagaaagaagatcttttgtctcatggtagcctgctccagtccccttacgaaactttcgttattgggttagccatacacttcacatgtttctagcgattcacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgactgcgtatttgcaatacagacgtggggatcagttggatctttgattgagtaatatttcttttttgattgccctcctctctggtctggaggaggtcaaattggaattgcaatttgttttgttaagttattttgccctgcttcgacataagatagatggaatcacgctctgtaggatttgaacctacgacatcgggttttggagacccgcgttctaccgaactgaactaagagcgctttcaaaaatcaaatccttttctactcctaatgtgtctcacgtacgtatagtatccacaaattcaagttatacccgctttaatcgacctcctcactactgcctataaagaagaaagaagtaataggtagggatgacaggatttgaacctgtgacattttgtacccaaaacaaacgcgctaccaagctgcgctacatcccttttccaaattgttgtacaatgtcattgtacacaattcctatcttgttttccacatcctaattttcttgtctttttctatctatagagaatcctcgtgtcatttcttctttttggtctcatataatcaaggaatggtatatatctaaatccaatctaatttcacctataaaagaaagattactattccttggtaatctataggaagggattgtctttttcgtttttagttcggaatttcgcctaaacaaaagaaatacaaatgatcttgggcaataatatctgatcatatacgtattccaataaggaaggaggattttcaatgcgggatataaaaacatatctctctgtagcacccgtgctaagtactctatggtttggggctttagcaggtttattgatagaaattaatcgtttatttccagatgctttgtcattcccctttttttcattctagttgttgctatgtgaggaatagagttcttcgtgacatgataaaaaattcccacttttcaatccctttttagtataggaaagaaaaagaaagaaaagatagattgggttggaccttagagtcatgaaaaatttggtaaatctcatttttgaaaaaagaaattcaattaaaagcag

SEQ ID NO: 44834 - DNA, 746 bp, Oryza sativa
  unsure (1)..(746): unsure at all n locations
aaattcttttattttagatagaagaaacttttcttctatctaaaataaaagaatgtacccttctatccaaatccaatttgcatcgataaaataaatccaaattccagtagtagatgaataattgcaaatttttgtgtgtacgagattagaataacttcaaaataactgacataattttttatttttcctgatcagaaaaatacatgaaaaagaaaggaggtagaaaaatttttggatttatggttaaagaagaaaaagaagaaaactggggttctgttgaatttcaagtattcagtttcaccaataagatacggagacttgcttcacatttggaattacacaaaaaagatttttcatcggaaagaggtctccgaagacttttgggaaaacgtcaacgtttgctggcttatttggcaaagaaaaatagagtacgttataagaaattaatcagtcagttggatattagggagcggtaatttcatcgttcgaattttttttcttattttattagtagtcttatagtagtcttagattttgcattttgatgagcctcgttttgaggaattcatggaataatccattttcatggaataatgaattaaggaagaaaggatatgagtctaccgcttacaagaaaagatctcatgatagtcaatatgggccctcagcacccaacaatgcatggtgttcttcgactgatcgttactctcgnnnnnnnnnnnnnnnnnnnnnnnnnnnnnnnnnnn

SEQ ID NO: 44835 - DNA, 849 bp, Oryza sativa
  unsure (1)..(849): unsure at all n locations
nnnnnnnnnnnnnnnnnnnnnnnnnnnnnnnnncttccatctcttggatagatagagagggagggcagaggcctttggtgtcccttccagtcaagaattggggcttcacaattactagccaatatttctctcatgcctttcctcgttcatggttcgatattctggtgtcctaggcgtagaggaaccacaccaatccatcccgaatttggtggttaaactctactgcggtgacgatactgtaggggaggtcctgcggcaaaatagctcgatgccagaatgataaaaagcttaacacctcttatttgactttttcactattttgaaatacgaaaaagatccaaatccaaaatgcaaaggtcgtcttattcaaaacctcaatcatcacatcccctctctcccacttcacacctcggaacgcactgttcttatagagagaaaggggctttcccatcttcttaacccgaaatgaaatggctgaggagagggaggttccttttggggggtacccccgggaagagatccagtggagacggggtgggcctgtagctcagaggattagagcacgtggctacgaaccacggtgtcgggggttcgaatccctcctcgcccacagccttccaaaggggaagggcctttactttccccctgagggtaggaaaaccatgatcgggatagcggacgtaaagctattgaacttgggtatgctctttccttttgtcgaagtggaatcgtagaacagaatgtgatacgatgagataaaatgcaatagaaacaaggatagcgaacgggttacctactctaagggtcaaagcaagccctttaattcaattctttattcttacattaaag

SEQ ID NO: 44836 - DNA, 1510 bp, Oryza sativa
  unsure (1)..(1510): unsure at all n locations
nnnnnnnnnnnnnnnnnnnnnnnnnnnnnnnnnnnnntttccattctttcccccgaccctgctatgaagaaagacgttcatttcttaaaatatcccatatatgtggggggaaaccgaggaaggggacagatctatcctgatggtagcaagagtaacaatacggtctataatgcaacgtcaacaggtgtagtaagaaaaatactgcgtaaagaaaaggggggatatgaaatatccatagtcgatgcatcggatggacgccaagtgattgatcttatacctcccggtccaaaacttcttgtttcagagggggaatcgatcaagcttgatcaaccattaacaagtaatcctaatgtgggagggtttggtcagggggatgcagaaatagtgcttcaggatccattacgcgttcaaggccttttgttcttcttcgcatccgttattttggcacaagtttttttggttctcaaaaagaaacagtttgaaaaggttcaattgtacgaaatgaatttttaggtcccgggatttcttaccatcaagttggtaaaaagccgcgatttattggcgattgctagaattctctatgatccattttggaaatcttttttttgtttagactattttttgtttgcgagatgtcttgtctgcaattccttatttctatcatctcatgcaaaacgaggagaatgcaaggcaagggcgagaacaataaaaggaacaaatccttttaggagggattgctggtcttcttaatcctctattgggcacaagaaaaaggcttttttgcctttttcttgtgtcgattcttcttgtatcgaaatatgaatcttttttcttcctattcggcaaagattactatttcttctttatttgggtctgtctcttgaacctcttttgcttaggttcaggcgatgtagtggacaaaaagagggaaagaaaatatggcgtgggacaaattttttgtgaccaaatagaattgcttgacttgttcaattaagttcaatttagaacttacagaaattttgcaaaaaaaacggatactcttccattgaaggctgttttttatttttaggctagttgagtagttttaattaaggttttattagtttattactctaaattaaatcaatgatttacaagagacttcctccggggaataaaatattggatcctcgattgatcctttctttctcctcgcttcataaaagtgaattaatttcattggcgagggggttataaatcaactgatggattacttcactaacattattaacaaacaaaattaacaaacaaaacgaataaatagagggattctgaccatcagagcaaaggctttctctttgttatttttacaaatcaaaataggaaacccgtttgtaggttatggaatagattaaaaaagtcgggttataagagtaagaattccgcgggtcctttccgctctaatcagataaaagggggtaaggacccgctaagttcctattttttcatgggtaccgagctcgaattcgcc

SEQ ID NO: 44837 - DNA, 783 bp, Oryza sativa
aaaaaatagtttttttatttattgcaacatgctcgttgattcctaccacttaatcttaatttattgtatcttcccggagttacctctccgggaattcttttttaattattcctgtatattacttttttatccctttaattgataatctttattttattggaaatcgtgtaaagattatttgaatttaatacagctacttgtgcaaggattttacgattaagaatcaattctttcttgtaaagattgtgtattaatttactataattatcgaatactttatgtatccgcgttgctgcgtttatccgactgatccacaaacgccgaaaatccctcttttgcctgactctatctcgatgagaggaaacaaacgctcttcttacctgttgagtaatcattcgattaagtcttaaatgagcccctctaaagtttgaggcaaatgaacgcatttttgcccgtcgtctccgagctatatatcctcgcggaactctggtcattgaatcaaattaaccttaatgaataactaatgatttctcttcttttagccatcctttttcccattaataacaaaacgaattattcccatatataaaatattagttccaatggcttttgctactataaccttcccaaccacaattttctcttctactcccttcagttatttcgcacgatactaaaaaatagtgggttccatcgtttctatggttcccttttaaacggcgaggccctctctatacaccggagccctttctttcatttcatcaaagggtattgtgaacttgt

SEQ ID NO: 44838 - DNA, 753 bp, Oryza sativa
cctattcattggtaccgatcatggatacttcaaaaattgtcttatttgtttgaacccatgatccgaacgagtcgcacatacaccctagcacatgttcctcgacgctgaggacatcccttaagcgcggccgattttctagcatctctagaggatccccttgcgtttctaataagttgtttaaccgttggcatgtcgtatgtatatagaaaaaatggattggtttagatcgatcttaacctgaatgattgatcattatgaagtatttccattaaattgcataaaacccgaatttagggttgaaataaatttacaagaaatctggccactaccaatccttaaacatttctggaaaccacactggatcagtatcgcagtgctcgtcaagcatttcatcccctacaatatcgacaagtccataagctttggcttcgtctgctgacataaaaacatccctttccatgtcttcggatacaacccaaaaaggcttgcctgttcttagtgcataaacccttgtgatcatttcgcgaactttgtgtaactcttccacttctagtaaaaattctggtgttcttgcccgataataagcactagcaggttggtgaagcataatcctcgcgtgggggaatgctatacgcttggtgggttctcctccaagcagaatgaaggacgccatggacgcggctattccgaggcatattgtatatatatctggtgtcaccgtttgcatcgtagggtaccgagctcgaattcgcc

SEQ ID NO: 44839 - DNA, 1178 bp, Oryza sativa
ggattattccatgattcctatttccaagaaagcctattttttaagggaaaaatgaaaaaaagtaacctcccttttcccactcgctctctattgcatgggtataagaacaaaaataggattctgaaaaaaagtaaagatattgaaaagaaaaattgactttcgaaatccatttttatgtgtagcggaaaggggttgcgatttcttcttattcctatagaacatctagtaacaagaatatgaaatagtaaatagcgagaaattcttgccttgcgtggtctaagtctaaggaaatacaaaaaaatccacttatacaatttcatctacatcgaatttatatatcagaatagcggatagaggcctcattcaaggagtcaggtccacttactttatctttctttccaattttatggggtgggttggtttgataagacccctttttgctttgttgataaataataaaaaaaagagtttttttctataacctgcttgttttattataacaagtcctatatggaaatgcctgctgaagagaaaatctatctgattgtcttttagccaatatccaattttagaattagaaagaaaaaagaagaattttcttcttttttttattaacattaagaaaaaagaatataactaaaatggaattggcaatataatttttttgaacttttgaaagaaaaaggaaggattttttgcaatcgttatttcttgcctctgtcatatcacggaaacctttcgatttggaacggggagagatggctgagtggactaaagcggcggattgctaatccgttgtacaatttttttgtaccgagggttcgaatccctctctttccgccccctcggatcgtttgggactttcgaattggaaggaattctgacccccggattttctcgtagataaatgtatgaaacaaatccaatttgtaagaaaaaattttggatttttactcgtcacgcccaggattacgtcctggatcattagataagaatccaaagataaagagggaaacaaagaatatcactactgtataaacaaaaagtttgagagtaagcattacataatctccaagatttttttttaaggaatagattacccgtttttccttaccacacaaatccactaggatgggttttgtttattttgacacctaaaaatgcaaaaatcaattttg

SEQ ID NO: 44840 - DNA, 1021 bp, Oryza sativa
  unsure (1)..(1021): unsure at all n locations
nnnnnnnnnnnnnnnnnnnnnnnnnnnnnnnnnnnnnnnnnnnnnnnnnnnnnnnnnttcgactactcaatcaattagtagtatccctagagtccactcctcccccatactactagtgaaagagaaaatgtaaagactaccattaaagcagcccaagcgagacttactatatccatgtaaattatgtctcctatttctatgaaggaattattctactattgatgaataatcatagtagaatcaagggtacagagtcaaaaaggggttctgacctaaggctatggatgaatcagttcaaagaatttactcttaacaaattcttagagtatttctggtagaattggggagcattaagtataaatatgatacatagccctttcttattaataaaagaataaggaaacgctatctcatccctattggtatcggtttgggccactactgctaaaacaaaccccagtttgaggaaagaacggtgggttctcaaaatccagtatcgccgagccttgttattctcttgccccaacttatgcggggtgcaaatttgtcgatttggatcagtactataagccatatttctagaaaaagtatctcatattttgcatttccattcccacaagcaaaaatactataattcacatttcgaacaggcatggatacagcatctataggataacttccatcttgagtgttctttctgacttccgtgtgatatccgcgatctctcttgatccgtaactcaatacggaaatccgtgggttctgtcaagttagctataggttgtgccgtatcaacgatttctacggaaggcggtaagataatatcttgggcagttatgtatctaggacctttgacgcaaattgatgcggttctaactccatagagattacttctcaatacaatttctttcaaatttagtaaaatttcttgtaccgattcttcaatacctgctattgtagaatattcgtgcggcacgctcccaaattttgcatgtgtgatacatgttccttctgtttctcca

SEQ ID NO: 44841 - DNA, 1040 bp, Oryza sativa
ttgtttaatcctaaaaaagaaaacgagtcctttagattagatactttcttctttttttagtaaattggtatttgcttctgcaattccaattatatcaatactttactcctaatttattactcccagagttttctatttatggggacagacaataccccaccccaggaatagctgatttgaggatgatcaatttagaggatatgttcgccgtcttgcttcccgccctttgtttagggcagtggaaagtatttttccttttattttaggaattttgggaacatttcaacaaaggaggtctttcacaggtcaaacgagatctaagacttaatctaaaagaaattactaaattgaatctatttctattaaaaaaaattgcattaaaaaaaccgatcaaaaagggcgagcgaagtaagtgatcgaaaaactttgttctttgttcgtcctatctataagaggagagcatatgaaaaatgtaacccattctttcgtttttttagctcactggccatccgctgggagtttcgggcttaataccgatattttagcaacaaatctaataaatctaactgtagtggttggtgtattgatttattttggaaagggagtgtgtgcgagttgtctatttcaagaatagattggatctatccggctgcactttagaatattttttagtatttttcgaataaataagaaaagggtgcacgatctcgacgaattacttctgaataaatgcagaaatcatatgaaagaaccatagcatttcgcgacctattggtaaatcaaatcaactttgattctctatagaccaataatatgagaccattaacacggttaaagctaaactgcttgaagtctaggcaaaagggggtactctttctacaactatattagtattagtaccaaatgctttaaacaggaaatagctaatgtagaatttatctgatatagaacactcatatcgataaaatggtttgaactatttactagaaggggcaccctgcccttttttatcgggtaccgagctcgaattcgccctatag

SEQ ID NO: 44842 - DNA, 775 bp, Oryza sativa
attttaatttaaaatcggatttattgcgtcagccgaggggaggggcgcgcggaccgggtccacgggagtggggcccacgcggcagcctcacggtccacggtggaccgggtgcacgcggcttgcgccggccggcgccgtgggtcccacgcgtcagccgcacccgagggcgcgggcggctgacggccgggccccacatggcagccacggggcgcgcccgaaggcggcctcgccggcacggccgatgggaggcggcgcacccgcgccccgatggtcgccgccggcgaccaccggcgcggcggagcggcgcccgagagaggggagggaagggggaagtgaaacggcggtccacggctcaccccgggtcgacggcgacgacgggaacggcgaccggagcggaaaaaggcggcggcgcggctcgggtcgacgaggacggcggcgttccggcggtcggcgaccgaaacggaggggtggacgaggtcggcaaggacgcggcgaagccgaaggaggcggcgccgaagcgggagaaggtccggggcgacgacggcggcggaccggagctcggcggcgacggcggagagagagagcgacggcgcgagctcgattccggcggagagagagggcggcgagcggcggaaacggtggagagaggcacggggagcgtttatatagtgttgggagtgagagagggcgaccggaggggaaggaaaccggcgcggcgatctcaggctccatcaatggcgccgacgaggtttgcgggagcatttccaaacgaatc

SEQ ID NO: 44843 - DNA, 4562 bp, Oryza sativa
agaccggtccttatacggccgaggtgctactatcaaaaccatgcaccccgagtccagcctaaaaccattttgaggattttgaatagagggggaggtgtgaatccaattccacaataatccatccattccatagtgtccaggtgatgagaatatcccaaagtctagagttgtaaaaccacctaatgttgcctaattaaccagcgaagcacctacctaaaatcatactagtggtaccatgagaagagtgtccactagttggggttctgtttattatagggtgaacaaggaaataataacaataacaataataaggtcataacaaaggtaaataggcatggctagataaaacagtgataacgcgggaatttaaataaagcgataatgcaataatttaaatcaacataattttataaactaggattcaatatgttcaaggatggtgtgacttgccttactcgctttcccaaacatcggcttcaacctccacgaagagcggatcttctgaagctgcagcgtctacacaaccaacggaaaagaaatgggcttttactctaataaactccatataacaagtaggaacaaagcacaaaaatgggttcttgacttcttaaggaaaaattagagacttgaacggtccaattccgagttcaaatggccaagttatggccatttgaagtttatatgctctttaaatgaatatttacgaatttcttcatttaaattctaatttaaaaaaaaatggatttattgcgtcagccggggagagggcgcgcggaccgggtccacgggagtgggacccacgcggcagtctcacggtccacggtggaccgggtgcacccggctcacaccggccggcgccgtgggccccacgcgtcagccgcacctgacggcgcgggcggctgacggccgggccccacgcggcagccgctaggcgtgcccggaggcggccacaccggtgcggccggcgggaggcggcacgcccgcgcccctatggtcgccggcggcggccataggaacggcggagcggcgcccgagagaggggagggaaagggggaaacgaagcggcggtccacggctcaccccgggtcgacggcgacgacggaaacggcgaccggagcggaggaaggcggcagcgcggctagggtggttggggtcgacggtgctccggcggtcggcgaccgaaacggagaggtggacgaggtcggcgaggatgcggcgaagccgaaggaggcggcgccgaggtgggaggtggtccggggcgacaacggcggcggaccggagctcggcggcgacggcggagagagagagtgacggcgcgagctcgattccggcggggagagagggcggctagtggcggaaacggtggtggggagctcggggagggtttatatagggttgggagtgagagagggcggccggaggagggggaaatgggcgcgggagacccggccgccattaatggcgccggcgaggttaggggaacggttttcaaaccaatccgagggagagagggagggaaaaatggggggaaagggagagggaatcacggggaataattccccccactttattgcgcgcggggacggcgggaggcggcgggattcgcggtggcggcggcgctaggcgcgggcgaggcggcgggagcggcgggaggaaggggatgacgggtgggccccacccgtcagcgagagtggcgggcgggcccgcccgtcagcggcgcgcgtgcggggagaggccggatgggccgcggggagaggagagggagggggagggagatgggccgagccggcccaagaaggagagggagggaaaggggactttttagagtttttgtttttataaaatcattttaactttgtttatttcttaataattattatttgtgctctgaaaattccactaaaatttatttacgcattttaggcttttaggaaatatacaaaaatcctctaagccttaattgacttttaactttgcacattttaattgttggaggctttcacacggtttttaattattctaggcatatcttagaggatgtattttagagtcgttttgagacgtgacagcagaagtggccgatgtgggaacaaagtcgtccattaatggtcaatgaaaacaccagtcggcggtgatgacggcagctggtagtgaaggtgtagatgcccaacaacggtggtgtgaccaaccaaccgtataggcgaggtcaccagtcggcggcgatggaggcaagccgacagtgaagtcgttgacgcccaacaacggcagcataataggccagccgtgtaggcggagataccagtcggcgatagatgagacggccggtcggtgaagacgtagacgcccatcaacggcagcataacaggccagccgtgtagacggagacaccagtcggcggcggcgaaggcaaccgcagccatcggcgaaggctgatcccggtgagatgtcctagctgactgccaacatgaataggcagccatgccgaatatatagatgaacatactgtagatagcttgatgtactgcattgttcctcagaaaattgcatggcatcgagtttggcccaattgatctgaacaaagatgaaaccaccaaagagggcgaaaactctgcctctgtgtgcacgtcgtcaaggccgtggtaagtgcagatcatcgtggcaaacaaaaactgcaaaaagtccggcagccgtgaccggcgctcggaaagctatgcatgtgtgattgttgattaagccttgcacgcacgtgagatggaggcgactggcggcgacttctgtggtgctgatgtggaggccccctggtcaactgaatgcatatatatatgcatcttagatagataaatcacttgactaatcaaattccttcctgattacttgatatgttacgtgcaattgctgatgacgtggcagctcgatagacaatgtcttcgagtattgctgatcagggaaatagcacggcgacgactgctctgattagttgcatccctgtgcaggctgactccgatttccgatcaaggaaagaaatctgcggcagctgagattggatccatcgaggtcaccgagattaatccttctgacaagattggatccgagatggagaagaaaagcttggcgaagtcatcggcaggcaagtccggggctcccaaagcggaaagcctatcctggagcgaagacgataccagcgacgtcgaagattggttccatcgcactcgtcgacggaaaactcggcgccacccctacctgacgcgccaactgtcaaaacatgaattcggcctaaaagtggatggatgcggagacaaaggatttagactggttcaggccctctcaataagaggtaataccctactcctatttggggatttgaatccgccgggtgtagtatagatctgacgatcatatgtgctcatgccccctagaggacctcctgcccaccttatataagatgggggacaggattacaagatagaaaccttaaccaatacggtatcgatttcctaaatctattttacaataatattaaattaggactttaggccgcttcataatataaaaggaaacgtaatacccaagtcatgatctgttacatattccatagatataagctaatcccctatgactagttggataaccatgccgtgtgggtatggggtacccataatctccacagataggttgaaggagaaaactgtcagtgagatagccccaaacttgataaactgatcaccaaaaagactatcaggtaatgtacagtggttcaagccttggacaatagaaaatggggcctttaacagtacaagtgattgttgagtatcttcgggtctgggacttggtcaagggggttgatgaggaactagatcctgatcttccgataggtattgataactcccgatttggtggaaacttaatgtcacgcccagaaatttagtcaaattttcggactattttgcgtataaattcttgtctaggaatcaagccagtgtacacaaaacgacaaattaatatatagatccaaatgtaaataaagcataaatacttactaaagtggtaccgaaaagaaagcagcagcaacggaaaaaggcgatgctagcggggcttttgctccactccgcaggcaaaactcagctagggtgtgagccttggtcctcgacaccttgctctatcctagaacacaacatgctcacaaaggttccatttttgcaaaaatatctcgattccgtaacaaatattagtcaccaccttctcaaacacaaagtataggcaccggacggagaaaacctcaaataggtcctgatgggttgccaaagtcagacttatcatggagtcaatctcggtctttacttgtcgtgcacggatgaaccaaaagtgcaaccgatccaatcgacacaactctcgtcctcttcctgcttccttacgtgcaatacaaaactgcaaaagcatatggcataaaccctagcaaccaagcaaatctaaatccgctcgatgaaaacttgtacaaaccataaaaacggaaactcgacgatgattagattcatttttcaaggtccccggcaacaaccaacgag

SEQ ID NO: 44844 - DNA, 11929 bp, Oryza sativa
  unsure (1)..(11929): unsure at all n locations
atccctttccttatcaaacctgcatgctaatcaaataagacaagcaataacaaggtagataacaactcaattgcataaaaatgattaaacactcgaattaggggttccacaaaccgaactagcgatgaaatttcaatggcagaaataatccaagcaaaacccaactctagactattatggctacataataaatatgattagggatgtcctagggttgccgcacacccccctaggtttagcctacgacacaattacaaggccaaaggcccaaatcagattcggactggatgaggtacatggcttgttttgtcgattccagacaacaaattaggaatattgacgtgtgaccaaaatcatataaaagtagactccattagctttccatcaagttatcatagaccccaaaattccttcctgaacggcagctaggtccgtttgaagttgatgctgtcaggaggctcaaattcaaatcccactagtacagatccttccatctgtgacggcccctaacaagactggaatttgggggccgtcacaagtaagtaatctcaatcgagccgaagtttcgcccgattgagatatggtcgcacagccatggtagatcggcataaaactaaagcccgtcacggatgacacttttctgtgatgggccatagttgaggcccgattgagatgagggttccatatctcaatcgggccctaaaagaagcccgtcacagatgacagtcatctgtgacgggcaccaactgtaacgccccgattttcgttcgggattaaaaatcatttaataatccatttcctagatattaaataaaagttagagaaatttaatcaagtaaattatagagggaattaaaaatttcctttaaaaatcgttggctgggaatattttgtaatattctttgtgccctaaaatactctctgaaatttcccgtgaattttcggagctcaagaagtaattttaatagcccaagccctcctctctccttggcctgtttccccctccctccttcctctcgggtaggcctctctccctcggcccgctcgtccttgaagtctaaataacccccggctccctctctctctcaggccgacaagtgggaccgcgggacccactgacgtagccgccatgccgcccatttgccgcccacgtcgctaccgattctggctcctcccgctcgcaccctcgcgcccaaactgcatgaaatcggttcccgtccacctcctctacactctccccacgtttcccccgaaaatcgcactgggatcgagctccacttcacccacgatgtcgcccacgtcgccggccgttgccgctccaaattctccactccccggcctccccgttgctccctcgcgctataaaaagccttcccgtgctctcctcttccgtttccccttcctccctgagctcctcgtgccctttcccgtgctccccatgcgagcccaagtgccgccgctcgccggggaccctccagccggccgctgccgccgtccccgcgccgggccgcttgcgccatcgcgttcgccgctctttgccacaccccggcagccactccatattccccaatagccaccggaaagccaccccaccgngccaccaacctcncgcgctcgccgtatcgttcagccgcccaccaccgccattctcgtcgccgccgtgctgtgccgtttccaccgatggcttcgccgcatcaagctccaccccgacctccacttcgaacccacaaaaccaccgccaaacgccattccaccgtgcatccgagccaccaccgcctcccgtcgcgtccagccggccaccactactaccctaatggccgctgcgctgcgccgccgccgccgtcagcatcgccatgccgagctccaccccggcagccgctcgtcttccttcaaccaccaccgaaaaaccacccccaccaccaacctgaggccgccgccgcatttgccgcctcctgttgctgtcccagaccacctcgcgatgcgccgtcgcctccttcggctctgcaatgacgaggagtcccttggctgcctcctcaccatcgccatcccccaccggaacgccatctgccccgcgcgaggtgagctccgtcgccgtgcttgttgcctccggctgcccaccccgcgctcgcctaacccatccatcaccttcctcaggtcacggcgccccttggccgcccctctgttggcgccgcccgtcgccggagcgccgccgccccctctccgcccgagctctgtcgtaccgtcaccggcgccactcggtgaggaccccctccgtctcctctccctttcccctctttccgccgctgcgtcgcgccaccgccgccggtggccgtccggccttgtgccaccgacgcctggcaagccagctccctccgttgccgattttgggcgctgcctgtggaccgcccgtgctcttggtccacggcgccgcctaggccgcggtggacttggtccaccgtgtgccctccccttggagccgctgacgtgcggggcccgcgtgtcggcgccggcttcccctgctcacatcagcggcagcccttttcctttgcgaaaatatttaattaatgcgtcataaaccgataataattataaaaattcatttaatggctcaacaacttctaaaattcatatctaattcattcgaactccaaatagggcgattcaacttgcaaaattcatctaaaattgagctgtacgtgtttgtttactttttatgtactgttttcttggtttttattagagtttttcctcgttttgcatgctagagtgtagtttctgccgttttggaagtccgctgttgtgaggaaaggagtttagaagatcaaagtgaagaagtaaggcaagtcacacattccccttgagcattttgatcctactttacaaatgttttaccgtttggaaataaaattgcatgtcttgctaatacatgggatcagggtttacctatcttctcgcttgtgccatgtttacttgatatctatcctttgtcaacattgggtaataaattgactagctcatgttacttttgtgacctagctagaactatatgcttaaccatgcttaattaccactagcctagttgatgggataattgcagtattagaccttgttagtatcagaacgagctgcgtgctcgagacacccggacatgtttaattggtcataattatccaactaaaatgcgactgaatggtgggctgtggatgcatggttttgtgagtcgcacccatggcaattaaggaccggttcacgggaaaccctggaagacttacagtgctaccacaagcaggagtggataattgcttgatctgaagtatagctcgaccctttcctaggcaccagtggcgagggtgggcgtaatggagttgggtcggccggggtgtccggttgtccagctgccggattcaccgtggcgcatgaggggactgcccgctgacttgcgaggagtgggggtgaaaccttagcgtggtgtggatggttatgggagagttatatgaagggtcttgtcacaatcactcgacgtggtgacgtgttcgtcatgggcacatgatggcacggtgacatgccagtggattgtgtcttgtgggtatagttgtgcacctctggctagagtaaaactatttgaatagccgtgcccacggttatgggcgatcgaccagattcaccgtgattagtcccacacttaataaatcgacccaatgcactgtagttcaggtgggttggttgggcctgttcaacatggtgtagcgttgatcagtggagattcaatattactataattactcaactgttttaccagtttgctcaataaaatgttttacaactacctttatgcaaatagccacaagccattcttgaataaaatccccttgcacgtctgcatcagtttgctcaataaaatccccttgcacgtctgcatcattggtgtggcttgctgagtacggtggttgtactcagccttgcttttattccccccttttcagaagtgtagtgcttctgagctggagatgaagttagaagaccaaggctccgaccccagttgagttttgcctatggagtggagctaaagtcccgctaggatcacctttttccactgctgctgctttcttttcgatgtgaggactaagagcctcttctgtaagtatttacgctttatttacatttggaactgtttattacttgtcattttgtgtaccctggctgattcctggacagggatttaatacacaaaatagtctggaaatttgggctaaatttcggggcgtgacaaactagaggcccgattgagatatctaatgcccatcacagatgacactcttctttgacgggcttttattaaggcccgatagatattacttgtatgcccgtcacggttgattgttttagggccgttacagatatttgatgcacggtataaataccccccaccacctagtgtaactgtatcccactgttcactattttggtgggaggatgtagggggcgattttttgtcttttttccaaggaaaacacaaaatttccaaaagtgatcaaaatggagcaatcaagttagtaatattaatcattaattgagcaatttcatcatgtcttgcttttgcaatactgatcttataagatgtgcctctaatttatttttttttattttgtaattgatcacgtcttacttttacaattgatcgaagttggatgtatgcgaaaaatttgaaacatcattctacggagtacagaaagggcgtaataatttttatgaacgccgcggaggaggatcggaaaagaagaaacagtgattacatgtgctcatgtgcagattgcaagaatgagaatatgtttgatagcggagaggattcatgaagggctatacatgttgggttaaggatggagagcaagaatcaggaagtggagcagtagcagacagaagtggtgcgcataatcaggaagatgaagatgagcatgacatgtttataccttgtccattgggcggtgaaatggttgatgtggatcacgatctgctgcaagacatattacgtgacgttgaggacctagcccagaatgagagagattccatgaagttcagcacattggtcagtgattccgagacgtctctgtacactggatgcaaagcaaaacacactaagttgtcagttacgttggacctaatgaagctgaaggcaagtagtggatggacagacaagagtttcactgatcttttaggaattttgaaggctatgcttcctgctgagaacacattgcccgagacgacatacgaagcaaagcaggttctgtgtccactgggcttagaggtccgtagaattcacgcttgtccaaacgactgcatattgtaccacaagcaatatgcggacttggatgcttgtcctgtctgcaaggcttctcgatacaagcgaaagaaaagtgctgacgaaggaaagaagtcaaagaggggtggtccggcaaaggttgtgtggtatctacctatcattgatcgtttcaagagaactttgccaacttgaacgaagcgaacttagtacgttggcacgccacggagagaaggaatgacggtatgcttagacacccagctgattcgattgaatggaggaatatcgatcgaaaacacaaagactttgctgccgaccctagaaacatgaggatatgtctgtgtacggatggcatgaatccttttggtgacatgagtagtactcacagcacttggctagttcttattgcgaactataacctcccgccatggttatgctttaaacggaaatatattatgttgtgcttattaatccaaggtccgaggcaactcgacaatgatatcgatgtattcctggagcctgttatcgacgatcttgagattctttggaaagaaagtatggaaacttgggatgcatattgttcaagctaagagttctattgttctgcaccattaatgactaccctgcactcggtgatctttccagacaaactataaaaggaaagaaggcatgctccgattgcaaggaacatacacaaagccagtagctgaagaaatcacgaaagatggtatacatgagtcatcggaggtgggtcccgctacgtcacgcatttagaagaaagaagaaatattttaacggtaagagagaacttcagcctactcccaaagatttgttcggagatgaggtccacaatatggtcaaggacataagcaatgagtgtgggaagaaaagaaaacgtaacaacacaaaggagaagggtatgtggaagaaaaaatccatattttggcggctaccttactggaaagatcctgatgtccatcattgcattgatcttatgcatatagaaaagaatgtgtgtgagagtttggttggcctgatgttgaatattctcgggaagacaaaggatgggttgaacacgcgccttgatctacaggacatgaatattcgcagtgaactccagcccatatgagatgcagagacaggtagagtgtacctccctccagcctgccacacattgtcgaaagatgagaaaatcgcaatgttatcatgcttgaaggatattaaagttccatcgggctattaagcgaggataagtaagtatgttaaattggacgatctaaaacttgttggaatgaagtctcacgattgccacgtgctaatcacacaaatcttgccagttcctatcagaggcattctaccaccgaaagtgcgtcgcacgatccaatgtctgtgcgccttcttcaatgcaattggacagaaggttatagatccaaaagatctagatgggttgcagaccgatattgtgaataccctctgtcacctggagatgtttttacccctgtctttctttgatatataatggttcatctccctgttcatctggtgaagcaaacaaaactatgtggcccggcttttctaagggaaatgtggccgcttggaaggtacatgggagttctgaagtcgtacgttcgtaacagagctaaacgcaaggggagcatcattgaaggttacacgaccgaggaggctattgagttctgcgtcaattacctgtccgatgccgatcctatcggagttcctgcgtctcatcacgagggaaggttgtcaggtgttggcacaatcggaaggaaaagaattaggcctgatcaagtgtcctatgcgcaggctcattacgctgtgatccaacatatggcggaagttggcccatactttgaggagcacttagcgaaaatccgagatgagaacttggggcgatctgatgaatggattaactgataacataattctcggttcaacgaatggttcaagaatcgtgtgacaatgtccatggatgtcccaaatgtgacaatgtccatgtgtcttggaccgtagacacatggcaaggatatgatataaatggatacacattttacaccgtcaaacaagatgacaaaaacacagtgcaaaacagcggcgtccgtatatccattccaggatcaagttgggtcaaacacatacactacggccgcattgaggagatctaggagctaaacttcgtcaagttcaaggttcctttgttccgttgccgttgggtgaatctacgcgctggtgtcaaagccgacaaggaaggtttcactttagttgatctatcaaaggtgggatacgaaatttcatactaatgcccgattgagatgaaaatcaggcccgtcagggatcactcatctgtgacgggccatcagtaatactcgattgagatagattaatctctatcgggctataactaagcccgtcaccgatgactatttttccatttgaagtatttgtatctatgagtgcaaaatatatagctgttgtgtaataattcattttattagtcataatatatttttggatagtaaaagatttcaaatggaaatatggtcaacaacaaagttgtagagcctttcaagatctacaagttttattttggtcatttttctatataacatttttcccaacagtttgaaattgaatttgaatatatgacaaaactaaatagcaattgtaaatactaaatgatttcaaatggaaatattgtcaacaacaacgttgattctctcatcaagatctacaacttttattttggtctttttctaaataactatggtcaatcacatttctctcatctggtttataaacatcaacacaaatatgtcaattttgtaaacattggtactatcactttgttggatgaagaagtgaccaaaataaaagttgtagaccttgataagttgtacaacttttctttttatggcttttccatttgaaatcatttagtatttacaaatgttgtttaaatttgtcatatattcaaattcaatttcaggttgatgggaacaaagttatatagaaaagtgaccaaaaaaaaagttgtagatcttgttgttgactttttcatttgaaatcatttactatttacaaatgctgtttaaattagtcatattgtgaaaatcaatttcaagctgttgggaacaaagttatctagacaaatgaccaaaataaaagttgtagatcttgataacctctacaattttgttgttgaccatatttcgatttgaaatcatttactatccgaaaatgtattatgactaataaaatgaattattatatagctgctatatattttgtactaacaaatataaagacttgattggaaaaatgcaaaaaaagtcatcggtgacgggccttagttaaagcccgatagagattaatctatctctatcgggcattatcttagagcccgtcacagatgacttatctgtgacgggcctgaatgtcatctcaatcaagcattagtatggagcccgtcaccaatgagtcatctgtgacgggccctacggcaatgcccgattgagatgacttatcactctactataacaagggtttctcatatcggatcgaaaaattttctaagtcctgctacagtttcccgcctccttagaaccctagcgccgccgccttcgtcctccctcgccaccaccgccaccgagcccgccgcttccaccgagcctctacaccgaccagcgtcggccttcctcgtcgtggtcgcctgcctcttcaccgacgcgaatagctgacccccaccgagcccggcgacgtccttcctcatcgtcgtcgcctactcctcaccgacgcccgacgccgacctgcccgaccggcgccgccctccaccgagcccagagctaccgccgcgaactccttcgccgagcccggcaccaccgccaccgagcccagcgccgcctccaccaaccggcgacgccctccaccgaacccggcgccaccaccaccgagcccctcccccccccccccggccgtcctcaggtgagtcctccatcgcgccgccctctgctacctgtggtgaatgatgaaatgtggatgttgggatgaatttagtgatagatgattttagtgattgatgacatgttgatgaatagatgaaatgtggtgcattaatgaatttagttatagatgattttagtgattgatgatatgtggtgaacgaatgattttttttattgatgacatgttgatgaatagatgaaatgtggtgcattaataaatttagtgatagatgcatgatatgtggatgaatagatgatatgaggtgaatttatgattttaggatttgatgatatgtttatgtcgcgtcccaaaacgactctaaaatacatcctctaaattatgcctagaataattaaaatccatgtgaaagcctccaacaattaaaatgtgcaaagttaaaagtcaaataaggcttggaggatttttctatatttcctaaaagcctaaaatgcgtaaataaattttagtggaattttcagagcacaaataataattattaagaaataaacaaagttaaaatgattttataaaaagaaaaactctaaaaagaccccttcccctccctctccctcttgggccagctcggcccatctccctccccctccctctcctctccccgcggcccatccggcctctccccgcacgcgcgccgctgacgggcgggcccgcccgccaccctcgctgacgggtggggcccacccgtcatccccttcctcccgccgctcccgccgcctcgcccgcgccctagcgctgccgccgccgcgaatcccgccgccctcgtcctccccgcgtgcaatcaataggggggaattattccctgtgattccctccccctttcccccaattttccctccctctctcccttggattcatttggaaaccctcccctaatcccgccggccccattgatggagcccgagagcgccgcgccggtttccttcccctccggccgccctctcccccttccaatcctatataaaccctccccgcacctcctccgttcatttccgcctctcgccgcccttcctcctcgccggaatcgagctcgcgccgtcgctctctctctccgccgtcaccgccgagctccggtccgccgccgtcgtcgccccggaccacctcccacctcggcgccgcctccttcggctttcgccgcatcctcgccgacctcgtccacccctccgtttcgctcgtcgaccgccggagcgcccggtccccgtgacccgagccgcgccgccgccttcctccactccggccgccttttggtcgtcgctgtcgacctagggtgagccgtggaccgccgcctcgtttccccctttccctcccttctctcggccgccgctccgccgtgcctatggtcgccgccggcgaccataggagcgcgggcgcgccgcctcccgccggccgcgccgcagtggccgccttcgggcgcaccgagcggctgcctagtggggcccggctgtcagccgcccgcgccgtcgggtgcagctgacgcgtggggcccacggcgccggccggtgtgagccctggtgcacccggtccaccgtggaccgtgaggctgccgcgtgggtcccacccccatggacccgctcggcgcgcccccttcccttggctgacgcaataaacttttttttaaattaaaatttaaatgaggaaattcgcaaatattcatttaaagagcatataaacttcaaatggccataacttggctatttgaactcggaattggaccattcaagtctctaatttttccttaagaagtcaagaacccatttttgtgctttgttcctgcttgttatatggagtttattagagtaaaagccttttcttttccgttggtcgtgtagacgctgcagcttcgcaagatccgcttttcgtggaagttgaagccgacgtttgggaaagcgagcaaggcaagtcgcatcatccttgaacatatagaatcccagtttataaaattatgttgatttaaattattgcaatatcgctttatttaaattctcgcgttatcactgttttatcttgccatgcctatttacatttgttatgaccttattattgttattgttattatttccttgttcacctgagagtaatcaaaaccccaactagtggatactctactcatggtaccactagtatgattttaggtagatgcttcaccgcttaattaggcaacattaggtggttttacaactctagactttgggatactcttatcacctagacactatggaatggttggactattgtggaattagattcacacctccccctctattcaaaatcctcaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatgaacatctctagggcaaatgaaggctacacgggctgcggcccggtagtcgagatgtcatggcacagggccggtgtcctgctgctaggggctcagtcctgcctacctgtccccgag

SEQ ID NO: 44845 - DNA, 2124 bp, Oryza sativa
agtatgaattagggtagatgcttcgctgattaatagaacaacattaggtggtttaataactttagactttgggaattctcatatcatttggacattatggaattgttggattatggtggaattggacatacccctctcttcctctctcaaaacccctaaaacctgttttccggtggggtttgggtgcatgccagttgtgggaagtagcaccccggccaatataaggattaagctcgggcctctgttgcaaagcactaccgtacttccacatgtctagtggataaggcttagtttgtggctcagtctggttataaacagaagtacacggatggagatggacgaagtcgggggtcgatggacatctctaggacaaatgaaggctacacgagctgcggcccggtagtcgagatgtcatggcacagggctggtgtcctgctgctgggggctcattcctgcctacctgtcccggaggttccggccgtaggtggggttgggtcggtactcttgtttatggctaagatgggttgggaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgtttaattcttaaaatttgcttaacaactaaaatgtggaatggttggcctgggttggcttgggacgagctgggacctagggtcgggttgccagttcggtctgaatcatcgtaggccttgggttaaggcaggttcgtgtgggttcacggccttgtttaataatatggtatagcgctaggaccgtatttacaaaatagctttgagcaactaagtgtcttttaatgctgtttactgcaaaccctaaccctttatattataacccccttgtactcccttgcatttattctgcacttgtgggtgtgtcttgttgagtatggtggttgtactcagtcttgctcaattttttcccaaacccagaagaggagttcctggaagatgaaggctttggtgtctagctcgtgcctgccgtcaagtgcctgtggtagctcgtgcctgccgtcaagtgcctgtggtcgtcgccctagtcttccgctgtttcccgtttgtctttgtgtgtgctgggccttcgccgcccatgtaataaattaactatttacgcttccgcttgttaaactctgagctatatcaacttttggtgttccttgcctcctgggacaaggaataatgcacgcacgtaaggaacgcccgttgggttatttccggtcgtgacaagttggtatcagagcccccccttgaccctaggacgagccgtagatcccaagccttagcaatattttcaaaataaaaatcctttcttatttgtgaaaatcctctagtctctctctgtcctgcttcatttatcgtcaaaatctgacctttaaaatgttgcttttctcttttgtttttgtttgtagatggccggcagcatcaaccgtcgtggtctggacctgactggcttcgttttggagctgcggggcatccgcatggagtggattactgtcgcgaccgagaaaattgcattttcccgaacgctagtgtattaatccccgtcccaggaaaagccggggtacaccatacaaacatgatataaaagacacatctttattatatcgataatatttacattattacaaaggcacttaaggcctgacaatcaaaaataaacagcagcggactagcgggcctacggctccatcttcacaggcgctcaactggggtataagccaggactccacctaagacttcttctccaaagcttctcttactgaaggggggagaaaggtagagcaagaatgagtacaaccacagtactcagcaagtcacaccggcagatgcatgattaatgtaagggggtacaaggggataataatataggggttaagttttgcagtaaacagcatttaaaagtcacttagttgcccaaagccatttataaagacgatcctagagctacacagtattattaaacaaggccgtgaaccctcacgaacctgccttaacccaaggcct

SEQ ID NO: 44846 - DNA, 7045 bp, Oryza sativa
cacttgtcggcaaaatgacccattccttgacaattgaagcaacagatatcttcccggactcggcattttcttttctcattttgattcctctgtcctggcactggagttaggctgaaactgtaatcttggcgaggatttgtgttgccttgatgcttctctccgttggaactggcgggttggttggccatcttcttcgtcagcagaaaactgaattgacaatcttttggtacatgatcagttccttcacaaaagaaacaagtgatcctgctcgttggacacctatcgggtggatggtcttcctcgcaatgaacgcatgtagtggcacacgagctggcaacatgaccgatttctccacaacgagagcatgccttacgttccattttattctggttgaaaccttggggagacttctcatcttcatcatctgaggagacttgatctgaatcttcactatcagacactctacctccattagctaaaagatgctctgtcaactgtggtgcacctcggaaggtatttcttctctgacgtttggtcattcctggtggaggccattctgtgctggtaatgatcatcttacggacttcatcttcggttcgcattggtgtttttcttttctgctagggacagttccttgcatagtgcccttgctcatcacacataaaacaaatgatacttgcttcttttgagtcaacatgtggcacgccaccatgggtcttttgggatgctggcggcatgctgacttgtggtgtgagtgattggactgcctccaactgcacttgaggttgtatctgactcaggttcagaattggcgtctgatgctgctgtagtatctctataagcaatcggttctggttaattaggtgttggaccagtgtcacacaactgttgtctggtgcttcattcactcgggagcttgaggtaccaatgtcctgacttctgaccttattgcctttctcattgtcagccatctgttgcaaaggtttggagagggagagagggaaaacaaaggggagagacagattagaaactaaggataggaccttaacagatctaagtcttttgctgttatgatgtatgttaggcttattctgcaagttgattaagcaaacaacctagcatggttacatcacaccccactgatgcaaaccacgcgctacacacacaagcaaggaaacacacgactaacgactctaccctagagggtggcttaggttcggtgacgggttctcaagatcttcactcctgcttcacagctggcttcactgcttccttcgcttcgctagcggatcctgcagtcttccggagcttcggcaaacaactgacgacatcttcttcttcgcaaaactgaccatctagtactagttgaaattcgaagaaggaagaagggagtaaaccttttgcaaatagcattaggggaaggagaaaaaaggaactttcgcaaatagttttatttataaaacatgtccttaggtttatccacttggcttatcctacagtcgagatggctctgataccagcttgtcgcgaccgagaaaattgcattttcccgaacgctagtgtattaatccccgtcccaggaaaagccgggatacaccatacaaacatgatataaaagacacatctttattatatcgataatatttacattattacaaaggcacttaaggcctgacaatcaaaaataaacagcagcggactagtgggcctacggctccatcttcacaggcgctcagctggggtataagccaggactccacctaagacttcttctccaaagcttctcttactgaaggggggagaaaggtagagcaagaatgagtacaaccacagtactcagcaagtcacaccggcagatgcatgattaatgtaagggggtacaaggggataataatataggggttaagttttgcagtaaacagcatttaaaagtcacttagttgcccaaagccatttataaagacgatcctagagctacacagtattattaaacaaggccgtgaaccctcacgaacctgccttaacccaaggcctacgatgattcagaccgaaatggcaacccgaccctgggtcccagctcgtcccaagccaacccaggccaaccattccacattttagttgttaagcaaattttaagaattaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagttcccaacccatcctagccataaacaagagtaccgacccaaccccacctacggccggaacccccgggacaggtaggcaggactgagcccccagcagcaggacaccggccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgagcttaatccttatattggccggggtgctacttcccacaactggcatgcacccaaaccccaccggaaaacaggttttaggggttttgaaagaggaagagaggggtatgtccaattccaccataatccaacaattccataatgtccaaatgatatgagaattcccaaagtctaaagttataaaaccacctaatgttgtcctattaatcagcgaagcatctaccctaattcatactagtggaaccatgaatagagtacccactagttggggttttattttcctagggtgaacaaggtaataataacaatagcaataataatgtcttaacaaaggtaaataggcatggctaaataaaacagtgataacgcgggaaattaaataaagcgataatgcaataatttaaatcaaaataattttataaactgggattcaatatgttcaaggatgatgtgacttgccttgctcgctttcccaaacgtcggcttcaacctccacgaagagcggatcttccgaagctgcagcgtctacacgaccaacggaaaagaaaaggcttttactctaataaactccatataacaagcaggaacaaagcacaaaaatgggttcttgacttcttaaggaaaaattagagacttgaacggtccaattccgagttcaaatggccaagatatggccatttgaagtttatatgctctttaaatggatatttgcgaatttcttcatttaaattttaatttaaaatcggatttattgcgtcagccgaggggaggggcgcgcggaccgggtccacgggagtggggcccacgcggcagcctcacgatccacggtggaccgggtgcacgcggcttgcgccggccggcgccgtgggtcccacgcgtcagccgcacccgagggcgcgggcggctgacggccgggccccacatggcagccacggggcgcgcccgaaggcggcctcgccggcacggccgacgggaggcggcgcaccgagagaggggagggaagggggaagtgaaacggcggtccacggctcaccccgggtcgacggcgacgacgggaacggcgaccggagcggaaaaaggcggcggcgcggctcgggtcgacgaggacggcggcgttccggcggtcggcgaccgaaacggaggggtggacgaggtcggcgaggacgcggcgaagccgaaggaggcggcgccgaagcgggagaaggtccggggcgacggcggcggcggaccggagctcggcggcgacggcggagagagagagcgacggcgcgagctcgattccggcggagagagagggcggcgagcggcggaaacggtggagtgaggcacggggagcgtttatatagtgttgggagtgagagagggcgaccggaggggaaggaaaccggcgcggcgatctcgggctgcatcaatggcgccggcgaggtttgcgggagtatttccaaacgaatccgaggaagagagagagggaaaagtggggggaaagggagagggaatcacggggagtgatttccccctctttattgcgcgcgggggcggcgggatgcggcggaatccgcggcggcggcggcgctggggcacgggcgaggcggcgggtgcggcgcgaggtaggggatgacgggtgggccccacccgtcagcgagggtggcgggcgggcccgcccgtcagcggcgcgcgcgcgggggaaggccggatgggccgcgggggagaggagagagagggagggagctgggccgagccggcccaagaggagaaggggggaaaaaggacttttagggtttttctttttataaaacctttttaactttgtttatttcttaacaattattatttgtgctctgaaaattccactaaaatttgagggctcctttttgaccaaggagaatttaacaaaaattctccgggccacatttgaatttttcttgtacgtattttaatgtttgccaatttcttttcgaattttaattaattctattattccttttagaaaatgatttttatttcgggatgaatttatcaggacgtgacaaatccaccccccttacaagaatctcgtccccgagattcgaggaggctagcaagaagataggttgggcggtcttttcttcttgcctgacttcttccgctccgtcttctataacaaacttgcctagcacaacttctccactctggactgcttcgctcgatctcctgttgcagatggaatcttcttttcacctgacttgaaccagggtgcaccttttagctgacgctgactcggttgcggtagtttaatgatgcttccgttccagaacttctcacgattcatatcttcggcgtcaacctcacacaagttatcaacttcgtgtcatgtgtcgtaacctgcttgtctttactaggataccatgcttgtcatcatgagaataccatgctttgcgtttccttccagcttaccaccatatgctttaaactatgatatcccgcttactaaggataccatgattgacaacttgccattaactgtctcatattagctttcctggtctccggcgctaggtacttctgctattcgctgcaagggtcaaccattctaactatacattatgcttcccaagagaaccaacttatcccacttgacatgctttgacgtcttcccgaatgactttgctgctggacttgttattgtctgatcgtgatcctgccagatttgaagcttcgttgttagatgtgattttgatctgacctctatagattatcttcaaacatatcacttgttccataactgggaatagctctcacggacaagcaactcggattcactttctttacatttggttcacttcccactattctcttcatgttgtcctcagttagcattcaacgtattcctttacacctttgaccttgatgtgttctttcccgatttctcttatcaatcacctttcgacctacttctttgcctggtaataaacatctttttcgatatcttctatcaatcaccttttgacctttgtcaactaagtactcttcactccgagagttgtggatgcttctggtgacgatgtggtacttgagcctgctgcctttcagagaaaccttcaagtggttcgtcaaaagctagactggcggttgttgcctttgatccaaagaggacacatctgaaactctcagtccaaacaaaagtctctttgactttttaatccaacacagtttaattggttttcttttccatcaacaggttggttattaactcgagattagtatatgattcctctgaaatgagaccctaggtctcctttatcagtgagcaattatacacataatcacatatccgcatcttccaaaagaatcctagtagaacttgtctgtattacacatttctcccttattacatgaatactaagcactgcctaaaaggaaaggtgcttgacattggtacattgtttctgctatgggttctgattaacacgaggcctcacgggtacggcgcttgctccagtgaccacaatatgattgggaggtctgcttcgtgtaaattggcagtaatgtggaggtcgactttgccttggttgcaggcagtccctcgagtaatgccctggttctttgcaattgtagcaaatcaacgtcttctttgctgagctatccgtctggggacgatcattctgacttggagttggaattggtggctggaaatccttgctaacattggcatcagtggtaccatagttgctatcaccatcggagtctttctcagagtcacaattgctagggttgtcattttgggtgccatcattgatactatcgtcgacatcttagtgaatgatgttgacattgcacgcttgattcgagtggtcactaatggggcaagaagcatggttgttggtggtatcatcatcatcattagtattgctaatgttgttgtctgcattgtgtccatcttcttggggcggaaactcttgatgcgcaacagaagatccggtgatctgaagtggctcagtgcgctgtctttggttaccacatggaaatactgggattctgacaatccttctcttacagttcttcatccgattatgctcactttcgagttgtatggctttgtccacaagtttctcaaaatcttcataatcctctaggagtagttgcactgcaagctcatcttttaacccctggagaaacttctcttgtgtgtcttcatccgtctccacatcttctggtgcatagtgagccaaacgatagaactcgtgcaggtactctgtgacggtcaaatctccttgcttcaggtagcgaaactctcgttttctcagtgtgatcattcctgcgggaacatgtgatctcttgaatacagatgaaaactcgtcccaggtgatggtatgtccttctggccgtgatgcttcatagctatcccaccactctgaagccggcccaaccagctgaggagttgcgaagccaacccgctcctg

SEQ ID NO: 44847 - DNA, 3119 bp, Oryza sativa
agggaatcacggggagtgatttccccctctttattgcgcgcggggtcggcggaatgcgtcggaatctgcggcggcggcggcgctggggcacgggtgagacgtcgggtccggcgcgaggtaggggatgacgggtgggccccacccgtcagcgagggtggcgggcgggcccgcccgtcagcggcgcgcgcgcgggggaaggccggatgggccgcgggggagaggagagagagggagggagctgggccgagccggcccaagaggagaaggggggggaaaaggacttgtagggtttttctttttataaaacctttttaactttgtttatttcttaacaattattatttgtgctctgaaaattccactaaaatttgagggctcctttttgaccaaggagaatttaacaaaaattctccgggccacatttgaatttttcttgtacgtattttaatgtttgccaatttcttttcgaattttaattaattctattattccttttagaaaatgatttttatttcgggatgaatttatcaggacgtgacaattaccagggcaagcagctcccggagcaggagggtgacgatgcagagccccacgctgcttgggaggttactgcagtgatcctcactggctcacccgagaggacgtcgttggcggtcaccgcgggtggagattccttctccgccgcttgccagaacgccgcactcctcgccatcggcactcttcaccagcgctacccggacgagttgcagcactcgccctactgctaccaccctcgtcgtggaggagcccgcgactacgccaccttccgggatgctagctcgaaggatgacgctaccatcatgcacctggcgcgcatggtggaggcgtacgacgcggcccgtatcgacttccatcagatggtgcgtcgcgggttggtcgagaacagcatgaagatcctggagctgcgtcaggagaatctgcagctgaagaaggacctagacgcagtggaggcgcagctgcgacagcttaagatcgcccagggagaggtctgtcgccccaagcgtcaccgcgtctgccgcagcctgaagatcaccgcccgcaagagtacctccgggcccgagcttgttcgtcagtccctggtgtcgaaactagatttcggcaataataaaagggggtggctatcaagctggaaaagtgtatgggtttggagacaaaggatttatacaggttcaggccttcttattcaagaagtaataccctactcctgtccggggatgaatccgccgagtgtcttattgattgtataatttggagaaaatcaacaactgcccctagaggcacccggatcccccttatatatgggaaggagtccgtgttacaaaagataatctatatccctaacggaatatgcagatacagataaaatacagtcgtaaccgactaagtctcaaggtaattccttgacgtacaagttgagaaacaaacccgaaatacaaataagatattctatccatattcggtatcctatattcagcccaaatatcatcaccgtgtagatatgggatatccataatctccacagtagcccccgagacctttgcagtcaaccatcatagccttctcaaagataataatccgagtgcttcaaacttttcatgccaaggcctgccgagtagcgaagacgaagactgtaaagggcgaaaagataaagaatatggtgcatcgaatagatgcacctaattaggtgtagcccccaactatgtgattagttaacaaactaaacatatagttgaagacaaaataatagcacaatcgtgcatcatatgacaaaagcatacgcggcacctaaagaggtattatagccgactgctttttagccataataaaaggaatccgagtggttaacactctaaaaggttcacgaatgaacatacttgacaggcatccgaataaaaaactccaaagattacccaccaaatattataaaaattatagtaatgaataagtctaatagcctaggctatgactatttaccataatgaaaacaggcatataacataccaaagaaatgactatggtaaaaacaagtcatttcaagttaacccagacagcttttgtagcctaaaaaagcttacaaaaacagcataacacctttctgtcgggcaccttttaatttgcattgcaataattccaaagaattatatgaccgcgtaaaaaggattttatcagcattgggcaacactattgtgcgcataaattgccaaagcaaaaaatgcctaagtccctaaggagcacaatgggccacgctgttaaaagtactgggctgaggtactgttcaggcctaagcccatttgcacctccgatacccttaacaataaattccgagatccaagcgtcacttcgtcttccccgccggaactctcgccattttccccaatccctgctacagtacagagctgcgccaacaaactagggttcatcattccactcgaatccaccttcgaaaagttcagcaaaatccttcccgtgatccaccgccgcaatccctcacctctccctagccatccctcgaatcaaatcagcgcattcgggtaaaatcgatggcggaagagaaagaaagctttgaaggccaatgggcaccatccgacgtaacggaggagaacctgaaggagatggtggcgcacggcgttctccctgccaaggagatcatcgggtggcggccagcatgcggtgaggcttttccgtcccccgatacacacgaggttgtagtcttttcccatttcttctatggcggcttcgctcttccgacctcaaaatttttccgcgggatattaagcttctatggaatcagcttgcatcacctaaatccaaattccatagtccacatcgccaatttcatccatgtttgtgaagccttcttgggaattaaaccccacttcgctctatttcgccgaatcttctttctcaaaccccaaccgaacaagagtaagccatgtgtagtcggaggggccggatttcagctgaggggaactctgagccagaagtacttctcgatgcccttcaagacttcaaacaaaggatggcatgcgaactggttttatgttcagaaccctgagcctgctcttcccgagtactcttgt

SEQ ID NO: 44848 - DNA, 11416 bp, Oryza sativa
  unsure (1)..(11416): unsure at all n locations
aaagaaaaagaaaaaggaaaaaggattttccctggaataaaatattgcttgctcaattttaattggttgaaattatttctagagctctgaaaattccactaaaaatcctgttaatgaattttgacatgtagaactcaagaaaaattccacatgtcaagtccgattgttatttgcattactttcttaaggttttctcctgatttcacctgcattttcttggggtcatttgaaaattacaattttggcttgggaggaaaacttcggggtgtgacaaacctaccccccttaaacggaatctcggccccgagattcggaggagctggtgaagagatgcggatgggcggctttcaactcatcttccctttcccaggttgcttcctcttccgaatgatgactccactgaactcggcaaaaccgggtaaccttgtttctggttctcctttcgctggtatcaagtatgcgaaccggcttctccacataagttaggtcctcctggatattaatgtgttccgaatcagcctgttcttcaggtacccttaaacacttctttaattgggacacgtggaacacgtcatggatgccgatcatgttggatggaagttctagctgataagcaacttctccccttcgttccaagattttgtatggtcccacgaagcgtggtgccaacttgcctttcgtctgaaaacgatgtactccccggagcggagtgacacgaagatacacataatcccctgcttcgaaagtaagctctcttcggcggttatcagcataactcttttgccgagactgggcgattcgcagtcttttcctgacggtcctgactttctcctctgcttcggttaacacttctgtcccaaacagttggcgctcacctgtttgatcccagaaaagtggtgtgcggcactttcgtccgtacaatgcttcaaacggtgccatttgcaaactggactgttagctgttgttgtaagagaattccgcatacggtagacttttatcccaggctccaccaaagtcaagtgcacaagctctcaacatatcttccaagatttgatttactcgctcggtctgaccatctgtttgtggatgataagccgtgctgaaattcaaacgagtccccaattcttcttgcagtttctgccaaaactttgaagtgaattgacttcctcgatcagatacaatcttcttaggtaccccatgcaaacacatgattcttgaaagataaagctctgccaaccttttcccagtataggtagtgtgtactggaataaaatgagcaactttggtgagtcgatccacgaccacccagattgaatcgtgccccgacgatgttctgggcaaacctgttatgaaatccattccgatttcttcccatttccattccgggatctgaaggggttgtagcagtcctgcgggcctctgatgttctgctttgactcgctgacaaacatcgcagagtgcgacgaattcggctatctctcttctcatgctgacccaccagaatttctctttgaggtcctggtacattttagtactgccgggatgaattgaatactgagtttgatgagcttctgtgagtatgagatccttcagttctttgtcgtcaggcacacacaatctttctcccaaccagattgtgccatgctcatcctcatggaaatctcgggcttttccgaccctcatatttttttttagctcagctatttcaggatcatttacctgagctgctctgacttgatccacgagcgtaggccgggcctctagggcagctacgtatccgtgttctacgatgcccaaatttaggtgctcaagatcttgctgcaatttgtcacacatgccttcggtacatactgcattgcaatagctctttctgctcagagcatctgctaccacatttgctttgcctggatgatagtgtatccccatgtcataatctttaatcaactccagccatcttcgttgccggagatttaagtcgggctgggtgaagatgtacttcaggctcttatgatcagtgtaaacttcacagcggttgccaataagatagtgccgccagattttcagagcatgaaccactgctgccaactcaaggtcatgagtgggataattggcctcatgtggacgcaactgtcgcgaagcatatgcaaccactctgccttcttgcatcaacacacatcccaatccttggcgagatgcatcacagtagacctggaagtctttcgtctgatctggcagaattagaactggtgcggagactaacttcttcttgagttcttcaaaactttggttgcactcagctgaccatttgaatttttcatctttctttagcaactgtgtcatgggcctggcaatcttagagaaattttcgatgaaccgacggtaatagcccgcaagtccaagaaaactccggatctgagaaactgtctttggtggggtccactttgtaactgactccacatttgatggatccactgccacgccttgagcagaaatgatgtgacccagaaatttgacctccgataaccagaagtcacacttgctaaacttggcatatagctggtgctccttcaaaatctcgagtaccaggcggagatgctgctcatgttcctcttctgattttgaataaataagtatgtcgtcaatgaataccacgacaaacttgtcaagaaactccataaacactttgttcatcaagttcatgaagaaagccggtgcattggtgagtccaaaggacataaccgtgcactcaaacaacccataccgagtggtgaaggctgtcttgggaatatcctcttcccgaattctcaactgatgatagcctgatcgtaggtctatcttggaaaacaccttagctccttttagctgatcaaacaggtcatcaattcttggcaacggatatttgttcttgattgtgacctcattaagggcgtgataatccacgcacatcctcttggtcttgtctttcttctccacaaagataaccggagcaccccaaggtgaagtactcggtcggatgtaccctttctgcagctgttcgtcaacctgcttcttgacctctgctagctcattagctgccattctgtacggcctcttgtaaattggagcagtcccgggtgccaaatcgatccggaactcgatttctctcttcggtggcattgtagtgaggtcttctgggaacacctcaggatactcttgtactataggaatatcctccaacttcctgggacttttctccactgtttctgtctgaccctcaatagcagcctgattcagactcgctacggacttctgcgacgctggggaacggaaggtgatcttctcccctttgtcgttggttagggtgatggtgcggcttgcgcagtcaatcactcccttgtttctggtcaaccaatccattccaagaatgacatccaggtctttagattcgagaaggatgaggttggatagaaacggtgatcttttgatctctatagtcaccgaggggcagtagtgtgctgtcctcatatcatttccaggggtatgaacctgcatcggtattttaagttccactaccgataatccatgtgtcccagcaaatcttttggaaatgaaagaatgcgaggcacctgaatcaaagagaactgttgctggatatgagttcactggaaacgtgcccaacacgacctctggtgctgcctgtgcttcctctgcagacacatgattggcgcgggcctggatgaacctgggtccagtgcgattcagcttcggacacttgccagcaaagtggccgtgcttgccacagttgaagcagggtcctggctttcctacagcccccttcttgggttgttctaactgaactgacacagctggcggatctgactgagctggtgccattagtgggggtggagtcgagttgtggttgtgctgcttactgttgttgtgactgccaccattgtaatcgttgttgaagttactcgggcgatagggacggtgctgacagacgatcagggtggaaggcccacctagctgtcccgtcatgaaacgaggcttctgattgttcccctgaggaaagctgatctgagctgtctttctttttcggtctattttgttgcgttgctcttcctggcggatagccttgtccacaagcttctcaaagtcctcatagactccggagattagttggttggtcaattcatcatcgagcccaaacaaaaacttctcctgcttctcagcatcggtgcgcacgtcctcgggagcgtagcgcgcgaggcggttgaactcgtgcaggtactctgtaaccgttctggttccttgttgcaatgcacggaactctctcttctgttgtgccataatcccttcgggaatctgtgccttcctgaagctttgacaaaactctgcccaagtaacctccgttgcatctggacgggtcaccacgtagtgatcccaccaagcagaagcaggaccttgcaactgatgtgtagcaaaagcaaccttctctcggtcgttacattgcagaaggatcagcttcttctcaatagcacgaagccagtcgttggcctccattgggttggtggtgcttgagaaagtgggtggctggatacgaagaaagtctaacagtttggacacgtgtgatggtggaggaccaaactgctggttctgttgcgcctgctgcaacatctgatggtaatgttgctgcatctgttgcatcatcattgtcatcatttgagtgactgttgggttttcgggcggtggagatgatctgctgccagatgcaccactgacatgagctccatcggtctgctcttcgctgccactggcgtcgttggagtcacggggatcgtcccttgtcttcaccatctggaggaggataggtagaaataagagaaaggaagaaaacagacggctcggaaactaatctttcttataagattaagtgcaatcatcttaatcttgattaaaacactgaaaaagaggcacacaactcctaataaaggctgtcataccactcacacatgatatcgactgccgactaacccacaagcaacaaacctaaacacaaaaactagcacgcaaacagactaagaagacgataaagctaagggtggcgactctgaagcttggagcggcgcttgcgatcggagaataggtctgacatctaaagagtacagagggataggaatcaatgcatgctcaaatccaaatttaaataaagcaataaaagactcaaataagggaaacgaataaaagcgaaattttatgcatagatcattttgcatgagagcgaataaataagacagactcacataatgacaaaataatgagaaattagatacatattaataataacaaacgaagcataaacaccttgcaacccatgttatagagctaggacctaatgcatttcacccatcaaaccccaactgtctgacgaataaatcccaataattttactaaaaccctagactgacttgttttgaaaaaccccacttaaacgagcgaccaagatttttcccttgaaccacaagaacagatcccaattttcccggaacaaatccaattgcaaagaacatatgcaatgaaaaggattcagagggctcttaggtttttccatttggcttgtcctacggtcaaggtcggctctgataccaacttgtcacgcccagaaattcacgaaccagaatttctaagctgaatgtgcattaaacccctgtccaggaccagccagggtacacaaacgacaattgttgacatacagatccacgtcttacaaaaatataaaagattacaaatgcagcggaaaaagataaaagcgagctaagcctgaagacttgactcctgcagcgggcgactccattccacaggcaatccttgacggcagcgacgaaaccaacctcttcgagacatcttcaactgggaaggacttcaactctggtgtgggggaaaagagagcaagactgagtactacccactgtactcagcaagtcacaccggaagaggaggtatgatgcaagatatatccaagggaggctaaaggttcttttgcataaagccggcatttcaaagcagtagttgaaagcagtaaaacagttgtagtaattaatccatattaaccaatcactgtccaacgttacaccacgttgcaacaggcccaaaccaccacctgaactaaccagttccaaaagctaactagggtgaaactaatcacggtgaatctggtcgaccgcccataaccgcgggcgcggctattcgaatagttttactctgatcagaggtgtacaactgtacccacaagacacagccccacgacacgtttccgtgcgccggcatgccaccacgacataccggaaagaggccgtgacaggacccttcgtataaccccctctaaccgatcgcaccacaccttagggttcgcccccgtccccagcaggcaacgggcagcccccctttcgtgccgcggtgaatccggcagccgatcaaccggacaccccggccgacccaactccatcacgcccaccctcgcctgggtacgtcggctagagaaaagctacactacaagcccagccgttgcccacgctggcttgtggtaagtacgataaattcttccagggcatcccgcgaaccggtccttaatcgccatgggcacgtctagcaaaaccatgcacccacagcccaccatgtagtgtattttaattagccaacaccattgcggtggcactaatccagagctattgccaataatcaagtctatgctttaatgtggtccccttttatgcactagttgaactaagcatggctaagcatctcctaaaccaacatctagtcattttaatacccaagttatcaatggcataaggaaaacaacatatagctgagtaataggacccatcccacatgatattgtaaaacaatgcaatatttaatagaaatgcgggacatttgtaaattaggtacaatatgatcaattgtattgcatgacttgccttgctctcgcaatgatggaaccacagcaacgtcttcgagaaaccacggatcgacgaaacggccgaaatctacgcgacaaacaaagcacacaagcaaaacatgctataagactactgaaacagataacaaagccatttttaatggattctacacatttttatgaatttactgagacttgaatggacttaatcggagctcggatgaattagttatgaattttagaagattcactgtgtttttactaataaagaaaaagtccttaattaattattgcgcaatatattccagggctgacgtcagcacaggcggctcggcgccgacatgcggggcccaccggtcagcgacacgggagatggaaggggcggcggctccacgtggcggccgaaccgacggccccgatctacccaagggtagatcggacggcggtgggagctcgcggccggggcgcgcgggcacggcgcaagccgaaccggcgaccatggcgccggcggcgcagcgctcacgcggcggcggtgcgcatgcggcagcggcgcaaggcgacggccgacggcgaccgaccggcggcggagagcggcggctagaggaggagcggcggctacgcagctaggcggcgacgcggcggctaaacggtgcgggagagagaaaacgaggaggagggcctcaccgacaacggtcgacgacggcgggcgacggaggacgatggcgacggcgggacgagctccggaacctcctaacgaacaaaaggagagggattagagggagagggaagagcgcgagagagcgagagcgccggccgaaggcggcggccatggcgtcactcaccggcgcacgacggggatgggtctccggcggcgaacctcaacggggaaggggcggacgaggtagatctcgaccccgcgaatctaacggcggcgacggcgcaagacggcggcgagcctagcggcggctagcggcgcccggagagcggaaaaaggcggcggcaaggggttgcacggcgcgggagcgatggggagctcgggagaggtcggcgaaatggggaaaaagcgagagggggtgccggcgatgcttaaatagggggagagggaaccggacgtggccgggagcggcgggaatcgccggccgacgcgggggagtggggaggagagagaggcgggattcggttttcgaatcccggccatctcgggcgcgggcgcgagcgggagagagaggggaatgggcgcgggagacgcggcgcacgcgcgggcgtggtcgacgtggcccgaggaaggcggagacgtgggcgcggcgacggttgcgggcgcggcggcgcgagcgggagaggcgggaggtgggagacgggtccgacaggtgggtcccacctgtcggcgaccccgggagggagggaggcgggcggccggctgccggctgggcctcggcctgcggccggcccaacagagaggagggggaggaaaaggagaaatgggccgacggcccatttgacaaaaaggaggaaaaagagaggaaaaagaaaaagaaaaaggaaaaaggattttccctggaataaaatattgcttgctcaattttaattggttgaaattatttctagagctctgaaaattccactaaaaatcctgttaatgaattttgacatgtagaactcaagaaaaattccacatgtcaagtccgattattatttgcattactttcttagggttttctcctgatttcacctgcattttcttggggtcatttgaaaattacaattttggcttgggaggaaaacttcggggtgtgacagctgcccaagccttggagttgatggatcgcatgctaaaactcaaagaacaaggcttacaaggagagcagattactcggcattttatcaaatgccgattggcaccaattaaagaaagatcccgtacggcattcgagtttgacggcaagcatgatcctaatcgtgaagaaccagactctctggattttaaaatcttgaaggagagaatgtataaaatcttctcaaacgctattgtcgtcagctactcacatcagctgccagttgtgccatataacgcattcaatccgcctccgcaggtatgtatccgaaatcttcaacccatgaccaaaacataatcttgtcttcatgttgagttaactaaccgtagaggtatcttattcaggaatatgtattgatgaagtctgaccccccaatcactcagcgccggtctcctcgccaacacaccgttcagggaggtggagggccaacaatcagatcagatccgcaacctcaaacctccaatccgactggacagacaggttctcgcaagagaaagctggtgcttaacgacgacgaaggcgacgacggcaacaaatctgggaacaaagacttgcccaaaaaactcccaaagcataccactcccaggaaaaaactggctggccgcccaatgccaaagattagaacatcttccaggtataaacctctcggtaccatttccctttgacatgcttctctcatagaaataatactgaatattgaaaggacactttgcaggaaaccatccgacatagatccaactggaaaagatcttgatccggctgtgacagagccaagttcatccaaggattctgagccgactgccgagagccagccgactggcgcccatacttcaggtgataaagccaatccgagtgaccagcctccaactggaaaccagtcggcagcaactgaaactacgacaactcaagagcccccgactggaaaccagtcggatgtaggtccagatcaagaaattcccgaagttgaagcgcagacgacgacttctcaaggacctgaggctggtaacgactcgatgattgggtctccaaataaagaacaaggatcacctcacgctcagctaggaacaccctcaggtaactcatcttctcaagtgatgccagtttgaacaactcttacttattcgcctaacgtcttggaaatacatcaggaccaccaggcgatgacgaagaagaaattccccgcataaaggcggctgacgactctcgccctcctatcttactcaaatggtgggacgagaactcacaagctgccggcatcgtcataaatcgtcaaaaagaagatgaggaagtgtgccagctgaagaaggcgcttggagaagccactcgtattgtgaatgtaaatcttccaggcgactgcctttgatgactttgttttctctttagcagaactaaaccatgaaccatcatgcagagaatccatcttcgcaatgaggccaagaccgcaactttagaaaagctggttcctcatttgggaactcttgaagcagttagggaccagctacatgaggccaaggagcttgccaaaaagacagagaaggaattaagggaccgaattgctcagctccaggattcaaacttcgagctgagtggttcatcaaaaggtaatctctagatctgtcccattaagttacgctgtcagaactatatcctcaaccgttcggattgcaaacagcgcaagccaccaggatggctcaaatggagaaacaaattgaagccttgaaaagagacaaagtagaactggctgcgcaaagggactcggccttgaaggaggttgaaggtaccgccagctgacaatctaaacttctctctttttaatgcagtagatttttaccataaatgtgttttgtagaccgcaaaatcaaatctcaagctcaatttgacgtcctggttggtaagatcaagaggcttgaaggagcaagagatgaagttgctaatgtcgctacaccacttgtccaagctatgttcctcaataacagtggtccgagtgcactcgacgcaaccgaaatcttcgacaagctgagagttgctccggatgtatatttcaagaatatcaagaaagctggaagtatgggagctagcatggcattggcgatgaccaaatccttgtacccaaggattgaaattgacgccattgatggctttgcagacgggacaagcgaagaagctgctcttgatcttatcagcaatgctcaaaacgcggctgacaagattgcaaatgacgttgtagaacaattccgcaataccgaccttcagccgagtagtaacaattctgatgatgaaaagactgattctgactgagtataaatgtaacaaatggaggctcaacttgtacaatactggtgtatttatgctgtgcttgataattctggccaagtcgttgatttcttaaaagcttttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 44849 - DNA, 40885 bp, Oryza sativa
tacaagactacttgatccagggaaatggtactgtttacacgaatgattcctattataaaaacgggggtccacacctggactataggaatctcttccaaagtcatttggttcagacttgaccttaaagactcagaagacaatgcatgaacagttacaactcgaccatcattgctggtgagaattacttttctgttggcgcagtctatcacacctttatatctggctaaccagtccatccctaggataacatcaaggtctttggcttctaacagaataagattggcaagaaatggtactccttgaatttctattctgacagaggggctatgttgcaaagagagtgcttgattactcggggtactaaccatcaaaggacgtctaagatcttctacttccatcccatgatttcccgcaaaactcatagataagaatgaatgtgtagcaccagaatcgaaaagcactgttgcaggaactgagttaacaaggaacgtacccaaaatcacatctggagcaccttgagcttctgcagcagcaacatgattgacacgagcctttgatgctggtgcggtagagttgctttgggcagggacaaccttcacgcgtcggggctttggacgcttgtcagagtaatggcctggttcaccacagttgaagcacaccccgggcttgctgccttgctccctcttggcaggctgttgctgtgtcaaagctgcaacaaggcgtggagcttgattgcggatgttgttgcccgtgttgttgttgaagaactgacgctggggacgaacaacagacgaagaacctccctgtgacattgactgaggtcccaaagtaagatgcggcctctgactattcccctgttgtgccttgaagtgagcaatccggcatttcttctgctccatgcggttgtacttgtcctcctggtgaatagccttatccactaacttctggaaatcatgataatccccagtcatgagtgggtaagaaagctcatcattaagtccttccaagaacctctcctggcgctcttcatcagtgcgcacatcttccggagcataacgagcctgacgattgatctcgtgcagatactcggtgaccgtgcgagatccctggatgagcgacctgaattccttcttcttgagagacaccactcccgatggagatgcatctttcggaaagcagcggtgaaatcaagccaagtgataggttcagcaatagtcctgttaaggcggaagtgatcccaccactcagaggcagggccatgcagttggtgtgatgcaaatgagaccttctcctgatcagtgcactggagcaaatccaacttcttctctatggcatccagccaatcaccagcttcaacaggattagtggtgctagagaaagtgggcggcctcacacgaagaaattctgctaacttgttctggggaggtgcatggttatttccctggttctgctggttctggagttgctgcatcatcatgttcataagctgtgcctgttgagctaggacttgggcaagcgtgggattctctccattgttgttgttgttgatgatgttgggaccattcccgttgctgcgagtgagcaccatctggcatgggcaggatcacaagaagagaaaccgaggaaaaactacttaggacagagaattaatctttctactaacttaacttttattgatcttaactgagtttcattattacagaactgaagactctcacaccactaaactcaccaactacctaacactcgaaagcaaacaaacacatgcgcttacatcccaccactgatgtaaatcacatgcgagacacacacaaccaaacttaaaacaagcaaactaacacaacgatcaaagacaatggcttgacaaggcattctaggtcttccgggcatcggagttgattgaaggctcgttcggttcgtctccatcatcttgagttgctccccactcgatcttggaatgggtgcgcttggattcttctttatcatcattacttacattgacgaccggaggatccgctagggctggggtaacttctttctccaccacacgaacctttggcgccaattggtagcgagggacgaatagagctctcttccttgcggtaagacgaaccctggccttctgcggtggtgcttctcccttcaacgcggctagttccttctccaaatgatccaccttgtcctctagcttgcaaatcttaccacgattctggtcttcacgatcttgagctgctaacacagtctccgcgcgggtctcatccatagctcacagcatctcaaccaaatgccttgtggtagcatcattctcaatccccacagtctcaaggtaactgccacggtcacttccctggggttggcgaggatggtagcgatactcagtgtcggccaactgatcactgtagcgatcgcggagctctcctatggccatccttgccacctcctgacatgcatgaatgtagtttcctcctccagcttcgaacatcactgatgggatatcttcactattactgttcatggtgactttgactcggcacttctcttcatcacgatcatgaggaatctgggcatacaaaggggcagtcccaaatcctatggcaaaggacatcgtatgcaactcctggacaaatccctcaacaccaaacaagtactcaggcttgaagcgcggcatcaaaagacaagtgaaaggagggagttaagacattttatccaattaatagcacaagtttttggattaatttgaataaagttagaaaatcaaagtaaaaggtaagtaaataaagtaaaccaagcttgcaagataagttgaaacagttggaaacaagatcacaaattttgcacttttgaacaacaggcttcaaaagaaataaaataaaagaaagttataaaatcaacacgctaagtttatttcattgcagcaagattaaataaaacaatgttgtaaaacttttgctggtaaatgagccattagtacagtaatagatgtacagtactaataacattggaataaattttgaatgagaaccactaaaagagattatgaaatgcatgtgctattagtttggtttaattaaaagagaaagggaggagaacagttctacttttccaatatttttagagggcttctatgggtaaccatttggcataacctagggtcaaggaggctctgataccaacttgtcacgcccggaatttctatccaaaattccaaacgcttacatgtgtgtgaaccatcgtccaggaatcagccgaggcacacaataacaaattgataatagagtacaattactactctaattaataagtgaataaaatgtcattacagaggtagatagttcctctcaatcaataaagatctaagcagcggaaaaataagataaacggcgcagacgactccactccacaggcagcttgaccagggctacacctaatcctccacaccatcagcatccctgtagaactcctcctctgatgaatgattgcaaggtgagtatatgacatactcagcaagccacgcagcaaatatgcaagtgcacaggataacaaaggatggcatagtagggtttcatttgcataaacagcatttaataaacatttcagaatttaataaaacagttaagtaataattaaacaatattaacccaacgctttacaacataccctgttgcataggcccaaccattctgaacaaccatcccggctgcacagttctatctccaaactaggaattaaccattccaaaccaggagctaatcaaattattaccagttatagcatcttttattatgatgagaagtgtgagactaatcacgaaagacattgttagacccgcccttaaccgcaggcacggctattcgaatagttttactctggccagacgtgtaccactgtacccacaagacacagccccacaacatgtcaccatgtgcctcaataccagcacggtacctcggaaaggagctgtgacagtacccctcgcacaacacaatccaccacagtgcaccgttcctggatcataatcacccccttataaccaaggcatggactccccagcgacccccgtgggcttatctccgccacttctcagtctagtgctccgcaatgaaccatgctatacaaaaggtaaagccattgcccacgctggcttgtggttggcatggttaatgtttcacaaccgaaactcgtgaaccggtccttaattatcatgagcacgaccatcaaaaccatgtgctcacaacccaccattatcaagttttagttggcaatttaattaattaaccaatcacgattgaccatcgtgagctatcattaagccatcattaaataatagtgaattataagttatcccaatagtgtgctaaagtttctaagcatggctaagcaatcatatctaatatcaagctgaaccaatatataaagctcaactagtcacatgctaatttattttaaaatgattaaaataaatatattgtgctaacacatgctaatttattgtgtaaatagatacatacacacacacatatatatatatatatatatatatatatttatctattagtttattatattaaagaggtgaacatgcaatataaactatacacagtcaagctcggccaggctcggtagaagctcgagctcggctcggtaaagctcgcaagcttttgcttaggcttgggttcagctcgtttggtgctcgggccaagctcaaatcgagcctaggatgagccaagctcgagctgctcgcgagcctcgagcttttctgatagccctaattctgattgtatctgttgtgttattagttgaatctgagatggtatctattattaggtttgaatctgagatggtatgaaaaattggattgaatttggtgggctcaaatttaatgggcccgtttagtgggctttgaactgatagttcgttaaaaatatgggccagttttgaattgggcctagttctaaaatgaacctattttaaaatgggctagttctaaaaaataatgggccgctgttaaataattaatggaccaatgtaaaaaattaatgggctgttaaaaaattaatgggtcgtcaaaaaaataatgggacgtttgaaaatatttgctgacgttagctgctacgtcatcagtgacacgtcatcacacatgtgtcaacgaccacgtcacctgccatgttggccgccacgtggcaaccatatgtgacgtaaggtcgggcctggctggactacacgagcccaaaaacgttttatgacggttaaaaaacgtcatagattgtactaatccgtgacaatttcggagaaaacatcggcagatttaatctgtgacgctcaatagatgatggtaagtagaattgtcacagacaaatttctgtgacgaattttcagtgatccatgatgaatttttttgtcatagataaaatagattcttgaagtgaaaaataacgattcgaaaaccggcatgtttagactttatcaagccctagatcgattgattgatacaggtaacaatctggatctttattgcatacagttgaacaaggctccaaaggggatttctttacataaaataataggggaatttacaagcttgtggctaactaatccaactgaagctatagagggactcaacatgaatgttttacttagacttaaaccatctaactaatctagacttgagaactaggttgaaatgagactaacttatatgattgaactcccggcttcggcaagaatatcaaattgactctgaaaaggaggggttgaagcaagagttgtactcagcaagctattatattgagtaatgaatgcatgaaataatagtaattgagtagggctatattaagttgtagaaagcagagaatgtagaagaagaaagcctgtgatgtttgaaatgtgtcagtatttaataaaatcttgaattaggtttctaaccaagatgccatagtgagtcccaatgcccgataacaacgagcacggctattcgaatagttttagggatactcatactgcagtagatgtgcgcttgccaaacacattagccttgtcatgacaaagcttttcggtttctaacatcagtggtacctgttccatgtactctagtgtaacgccccgatttttgttcaggattaaaaatcattaaataatgcattttttaggaattaaatcaaagttaaagcaatttaatcatgtgacattattgagggaattaaaaattttcctttaaaaatcatggccgaggatattttgtaacattctttgtgccctgatatattctctggaatttccctctaatttttggatttcatttaatcaattaaataaaaagaaaacaaataaaatttcccctctttgtctttgggccactcccggcccaatccccctccttttcccctttttccacttcagccatgcctccctcctcccttctcctcttgggccggcccctctccctcgtcccgctcggcctccttcccctagagtcttttttgcctccgtctcccgtctcctctctctttccctcgccgacaggtggacccgtggccccacctgtcagccccatccccaacctccagccgccatggcatccaccccacatcgccaccaatcccgcgccaccctacccacctcctccacttcgcgcggccgcacccgaccgtgggacctcgtcgcccactttccgtcctctcctcccccactccttcccgcaaaatcggcgccgaagcaccgccacttcgccgaagtcagtgcttcaccccgtcgccggtgccccgcctctccccaccactgtcgtgccctccccgaccctataaatgccgccctcgacctcctccctcctttttcccctatttcccgagctcaccatgcccctactgtggtccccacgctgaactgagtgccgccgctctccggagccctccaaccatgtgccgccaccgctcccgccgtcgccgtgctgcgccactgccaccgctagcttcaccgcgtggtgccgcaccccggcctcagctccgtttccctattccatcaccagaaccaccaccccattgccaacccgaaccaccaccgtaattcgccgcctccagccgcccaccaccaccgcttcaaccgacgccgcggctcgccgcttgcgccattggcttcgcggttgcaagagcaaggccggccgccacctcgtttgcccagtctactgacggaaacacctctttcgccatcgaccgaaggccgccgccgcgtttgtcgcctccggcagcactgtgtcgcctctccggtcgactccgcaccatgtcgccgcctccttcggcttcacgggagcgagggccagctcggcgtccacctcttttagccagaaacctgctagagctccctcaccctctctcgtcggtaagctccgccactcttcaccgtccttggcattgtttcctcgctgctccgatcatccatttccctccctaatgcctccaatcgattccccaggtcctgtcagctctcggccgcccctcctccttcaccaagagcctcctaatcgccgttgtcgtcatcttgctctgcaccggccgccacttctggtgaggactcctactccctcctccttttcctcttcgctggccgtgccgcgccgccgctttcccgcgtgcgctgccgccgctcgtgagcaccgccgccctctagccgctcgccgccgtcctgcgtcgccggctgccaccgccgcatcgccgtttggtcagcccgggcggcgagccggcctctgcttcgctgtggcctcctgatccccttcaggctgatccgggccatccacgtggcgtccgccgtggccgcccgtggccccgccgcgtcggcaccacatcggcgccacctcgtcttgccttgccaccgtggccgccatgtggccgtccacgtggtgcgcccacgtctatgttgcggtggaccgagtccaccgtgggttgcgcttcttgcgcagctgactcgtggggcccgcccgtcagcaccaccctttgatgatgtcaacaacgacccttttcctttgtaaaaataattattaattgcgtcataattcggatttaattatagaaattaatttaaatggctcaaaacttaaaaaattcataactaattcataagaactccaaattgagccattcaagttgcaaaattaatctaaaattgagctctacatgtttgtttactatttatgtattgtttacttggtttttattagagtttttcctcattttgcgtggcagcgtgtagtttcattcgtttcggaagatcgcggtcggaaggatcagagttcagaagattgttttgaagaagcaaggcaagtcacacatccccccttgaacatattgagcctactctacaaacgttttaccgtttgtaaataaatatgcatgttttgctaattacatgggaatagggtttacctatctactcgcttgtgccatattacttgatatctgtcctttgcgaaccttggatgataaatcgactagcttgtgttatttgtgttaacccaggtagaattatttatgcttagccatgcttaattaccactaaaattaagtggccatgtttcattggtcgtaattatccaattaaaatgcgactgagtggtgccttgtggatgcatggttttactagtcgcacccatggcaattaatgactggttcgcgggatgcagtggaagatttaccgcgcttaccacaagcgggaatgggtaactgcttgatttgaagtatagctttcctctggttgacgtaccctggctagggtgggcgtgatggagtttggatgggccctgcgacggcctttgcggcttccggatcgaccgtggtacgaggggggctgcccgttgcctgctggggacgggggcgaaacctgtggtttggtgcgattggttagaggtggttatatgaagggtcttgtcacaatcactcgacatggtgacgtgtccggccaggcgcggtgacatgccggtggattgtgtcttgtgggtacagttgtgcacctctagccagagtaaaacaattcgaatagccatgcctgcggttttgggcaatcgaccagaatcaccgtgattaatctcaccaaataaatcgatccaatgcactgtgtggttcaggtgggatggttgggcctgtacaacgtgctgtagcgttgttcagtagagatttaatattatcttaattaaccaactgctttactgttttgctcaataaaatgctttacaacttcctttatgcaaattgccacaaacctctctttgtatccccttgcacaagtgcatcatttgtgtggcttgctgagtacggtagttgtactcagccttgctatttctcccttttttagaagtgtagtacttctgagctgaagtcgaagttagtagaccaaggcttagaccccagttgagttttgcctgtggagtggagctaaagtcccgctaggatcgccttttccgcggctgtcgttctctttcggtgtgaggactaagcgcctcttatgtaagtatatatgctttatttacgtatctatctgtatattaatttatcattttgtgtgccctggctgattcctggacagggatttaattcctcgaggacgagctgctcaaaaagaggggagtaatgtcatgggctttaggccgggcgtcctaggcccattggataggcttagggtttgttaggattagattaagtggccctccatctatagaaggagggatcctatcgtaggtcaattaggcattagatcaagatttaatttagtgcccatcggcctgccttctcagtgcgacggagagcgtcccgccgtttaggtttacgactgttccttgtcatttcatctactataatccaatctatccccactcatcacgattcttctccacataatccttgctcgtgacatgttcctttctttttttatttaattatttagtctaagtaagttatatttccatctttgcaggttcattgtttagtatttatactaagtgctctagtactaggactccggatagagaaggaagttcttgcgcaagtattagagtagtaattaataacttaggcgtggtgtctaggttagagattacctgtgtttgttgtgtatcccacggatttgtcagaggtaggcggcaggtggtgacagccctgaattccgtcctagtaatcctccactgtcacgtcctgataaattcatcccgaaataaaaatcattccctaaaaggaataatagaattaattaaaattcgaaaagaaattgacaaacactaaaatacgtgccagaaaaattcgaatgtggtccggagaatttttgttaaattctccttggtctaaaaggagcccttaaattttacttgaattttcagagcaccgaaaatatttattaaacaacaacaacaattaacaaagtttattaaaaagaaaaagctaaaaataatccccctcctctctttgggccaagtctggcccaaagtctccctctctccccctcggcccgcagtccaagtccctctcccctccctttgtttttctctctttcctcccgggcagcccactccctcctcctccttcctcccggcctgcctcggcccagcagcccggcccaagccaggccgagccgagccagccgcgtgcacgcgcgccgcgcgtgcgctgattgcgcgcgctgaccgcgtggggcccacgcgccggtcgtcttcctcctcccacacggcctcctctctctcccgtgaaaaccctagttcgttcctccctcgaatccacgggattctagcgttggattccaaaattaattggggggaataatcccctttccttcctctcccttttccccctaatctcccctttaatcgtgcactattttgaccggaacggctgccgttccccgctcctcccgtgctcggctcgcttccctccgctacaaaacggaaccccctcgctccgttctctcgttttagccccctcccgcgccctccccgtggctgcaccacctctccccgcctcctccttctctttcctcagtgccggccaccctccagccgcccctaccgccttgcccgagcgccggtcggccgtgccggtgccttctccagcgtcgcagccgcctcctctgcaccggcctgccctctgttgcccatggagacctccggaagtgcatccccgccggcaacagtggcgttaccgccactgttctgtcttcggccggctactgttcatcaccaatacgccgaccgacgtcgccatctcctccgtcgacgtcgcagccgcctcctctcccccggtcagccctccgtttcgcggggaaaccaccggagacacgtcctcgccggtaaaacagtggcgttgccgccactgtaccgcctccagccgcctgtgccgccttgccggtgcagcggctgtcgtcatcgccatcctccctcgacgtcgccgcgtcgccctccaccctggcctgccctcggtttcgccggaacgccgtcgcccgcgtcggtctcgccctccgcctcgccggagttccttcggcaaccccttccgccgtgcctgtgcgccggccgacgtcgccatctcctcctccggcatcgcagcgtcaaggttgccctcggcctcgcctcccctccatctgaaccccgccggtgttcgttatcgtcgtctccgttcgtcctcgttgacgactcctccggtcggtcgttcgtcctcgccggatcgtcgtctcgctgcgctgccaccctcgtcatcatcgtagcggcgtgttccgcgccgtcctcatctccgtgcaagctgctgccggctgccctcatcgcctcctcgccggttcctgtcgtcgtcctctcgtcgttcccggtcatcgtggcgttcgtccctccgtcaagccgttctcatccgtcgtccgcgtccgtcaagtgtgccgctgcagccccgtcgtcgtcttcgtcctcgcctccgcgtcgccaagcattgcaccggccgcgtctcaccttcgtccaaggatcgccgccgaagtcgtcccctcgcctttcgtctccgtcattcccggccgtctccgccgcgcccgttcatcgttgtcgttccctcgcctcgtcgtgtggtggtaaggatctctccttcgctgccccgtcctcgtcctttcggtgtcgcctgtgcccgttgtgcggttgtcgaccccggtacccagctcatcagaagggatcaataataatggggtacacaactgaggaggtggctggttgaatgctgtatagattacgtgaaggacgccacacccattgttataacccccgttgtacatgagggtcggttacttgggaagtggaccgtaggcaagaaaaggttctatgataacgactacaaagctgtagcggaagcttttagcagcgtgccgcaacaactagccatcctcgagccatacattgagggacacatgaacgagataagagcatgcaaccctagaagaccggcgacttggatctcaaaggaacataagcgcaaatttcctgaatggttgaaggaaaaaacatgtcgttcggtgaatcgcttgcacaggttggcaactggcccaagtagcctcatgaactcatggcaatggtacgacatcggcggatatacgttttatatgataggcaagaacaagaaaagcgcagctcataatagtggagttcgtgtggaggtgttggacgcaataggcgagaagaagtcatactatggatagagaaaatcccttatatacccctgaaattttacctaatcccttctatacccctgaattttgcttacttccttgtatacccccaaaatttgattttgatcccttgcatacccctcccatcagttgaccgttagttgaccgtctattttccataaaaatgaccattttacccttggatgaacaaagaaattcatgaattacattattaaaaatataaaagcttctcgcatgagactattatagttatgagtttgttgtgcgatgcattatttatcccaaaaatatttttagatcatgaaataaaaaacacgtatttatttttttaaaaaaagtcataaaaatgaggagcattcatataaagataggactaccaatgttcacaacattttttttatgaatgttcccgataaaaaaatccattgtcctattaaaatttgaaataaaaattttaatttattacatttattttattttcaaaatttatgtcaaaattttctgcactaattatttagtttcattagtcttataaaatgcacatactgtgcacccaaacaaaattttttcaattgttttttaagcttatatttaaacctaaagcatctagggcaaaaaggatatttgcaaccaaacgtaacagtgaaatgatggaaaatgtaacggtaggggcatggaagggatcaaattgaattttcaggggtatagaagggattgggtaaatttcaggggtatgaaagggattgagtgagttttcaggggtacacagggaatttactcctatggataatagaagacatttgggagcttgactatggcattaacatgcaggtcccggtgctatgatgccagtgagtcaaagacacaacaggcgtatccatcgattactacacccttacggttgtggaacgtagtaaactaagccacaaggatgatccatgcgttctcgctgaatatgttggacaggttttctatgtgaaggacccatccaacgagcggatggacattactgtagtgggaaagcaacacattattggcatcgataacactaaagacgtgtcagattacaaccaatatgacgacgtcccattattcacagatattcctaaccagatcaagcgaattgagacaacccttgacgaagagaagttttcgtctgtgcggaaggatggtgctgcgaaaattgtgaaacattagtatatatatatatatatatatatatatgttgttgtgtacaacctgttttgaaaacgattaatgtatccaacttatagccccttcaaacgattaatgtataaaacttatggttccatgtttatctgtactatatgtcgttctcaatttatatggttgaataattaagatgtggtttgatcaatatacaagtgatttaattagatgcgattgaaattcatttgtggttaaataattatatttctatggttgaataatttgttggcattaatcatatggatgaataattatattgattaattaattaagttgtggtttattaactataaccctatttagttatagttaaagaattatagttaaacaatttatgggtttaattaactataactatatttaatttgtggttgaataattatattgattaattaactatatttagatgggatttattaatttatctgcatttatttttgcgtgcgggtggcttaagccgcccgcacggaataatatcatcccgtgcaggctacttaaaccgcccgcacaggaatatcgatttcccgcaggcgataatatggttacataagcaccgggcgggcgggcgaaattaccaccgacgctgcccagttgtttgccgccgccgccgccgcctcctcgcggagccccaaacgccgccggtggcctcctcgcctcaccagcctccacctctgccgccggctcctctcctcctcgcccttcatgctggcgacgtcctctccggccaccgccgctgcctcctcctctactcctctcctcctccatcaagatctgggccgctgccgcctcctctcctcctcgccctcacgccggcctccccgacctccgccgcggccgtcgtcctcccgaaacaaccagcctccccgacctctgccgccgccgacctcctccccaagccgctggccttaccgacctctgccgccggccacctccttcccaagcagccggcttccccaaaatccgccgccggccacctccaccccaagccgctagcggtaagcgtgttttaggttttttgtgaaaatttgtgatatgtgcaatttgtgatatgtgaaatttgggacttagggtgatatttgtgaaatgacaatttgtcaattttgtgcgatgtcaatttttattaaaaaatgtagatgcaatttttttatatgtcaattttgtgatttttgggacttaggatatgtggtatatatgtattttttttttataattattcatttatatatggatttagttcctaggttattaaatcatcacagaatatgaggtgctctaggtgccatattggtttcgtcgagttagtgcattgacggagccaaccaagacaccttgggacgccgaggatcatattatgtcttttataggaaatatatatgtttacggttttttaggggtttagtgcaagtatgaaattgggctcgaataatttatatgtaactttacaattctaaaacacacacaaaaaaagggttaaagtgcgtagatatttctaaacggctagcatgattaattgagttacaattattacaaagatagaaatagatttatctaatatttttaaacaacttctatataaaaaatttcacattaagtattttaaaattttgttaacataaatcggggtaaaaccaaagagtggggcagcggtcgttacatgggctacaacgactagtacaatgcagaactattagttgctacttccttactagctagacctcacttcaccatgtttgttctgacaataggtataggtgcaactgtacaagctagtgcaataagcatggtccgcatgcctgcatgtccctgcattatatccatctacataatccaaggaagcaaatttgtataggtgataatatatatgcacgagatatgcatacacatattatattatcatcgatcagagagctagcacttagatatttttatactggaatttaattagtttattctttacatcactcagctgatagtacatatccgatcacaatcacatgcggcgagatcactctacgtaccattcgaatattgacctatcacgtgccgaccgactgataaactaatgaaccgaattgtacgcttagtacaccattagtcgattaccccacaaaattagtctatcatccatctaataaatacctataaaaatgaaaaatccttggctcaaatttattatccatacacaacaataaactagcataccttcaattgaatgcatataaattaatttatgcatatattcatgcattcgtttttcaacttaaaatttttaataacacctatatatctgaaaaattctaagagctagaagcacattacatacaagaaccaatacaagcctaaaatcccacattgggaggcctaaaatttggggaaaaaaaaagaagtttttagggttactctccaatctctaaatttgaccaattaaatcgaaaaaaaagaggaatggtgtagtatatactgctcttcaacttccatgagaggatttgaggaggagaggtataggtgctacttccttactagctagatcacctcacttcaccatgcttgttctgacaataggtataggtgcaactgtacaagctagtgcaataagcatggtccgaatgcctgaatgtttctgcattatatccatccaaggaagcaaatttgtataggttataatatttatgcacgagatatgcatacacagattatattatcatctatcagagagctagcacttagatatttttataatataatttaattagtctattctttacatcactcagctgatagtacttatccgatcacaatcacatgcagcgagatcactctacgtaccattcgatcattgacctatcacgtgccgaccgactctgataaactgacgaacctaattgtatggtttgtacaccattagtgtatcatcccacaaaattagtctatcatccatataataaatacctatgaaaatgaaaaatccatggctcaaatctattatcaatacacaccaataaactaacacataccttcaattgaatgcctataaattaatttatgcatatattcatgcattcatttttcaacttaaaattttgaataacacctatatatctgaaaaattctaagagcttgaagcaagttacatacaagaaccaatacaagcctaaaatcccacattgggaggcctaaaatttggggggaaaacaaagtttttagggttactctctgatctctaaatacaagagaggaagggcgccaatcaggttgatgccaaaaagggtctattccagcaattattttatggaggggtctacttaattatcctctacctcaactctggtcatcactgaccagctcatgagctatactgtattctggcttctcaagtccttgccagtaattttcgcatgtggtcctctttagaccttgccagtaatttaacatttttttgctggcgaggacttaagacgttcgccagtaaatataggagcggcttaaaaaaattggatcacaaccaacgagcgcaccttgcccctcccacaccctaactgctcgacctctcagcccctcacccgtctcagctctctccctcaccttttccacttccctttccaccacagcccctccactctcttcctagtctggccgaaggggcggaagctggcggcggctgcacttcctttccctccctgtccttgatctagttggagggaaggagggtgtcagtggcatcgactagatgcagctaattaggtgtaacctcaactatgtgattagatgaacaaactaaacatatagtcaaagagcaaataaatcaaccagccgagtggttttattaaaaaaaattaaagcatatgtgatgtcaaatctgacttaacaatactcatagtcactcatacaaaatatcaaataggtgttgccactataggtaacggaagtgattaaaccggtacctatagtgcttttcccaccttcataaaatgaaaaaaaaaaaactaacacctttaaacgaagataggtgacagttttacagaaaaactggcacctatattttaggtgtcggttcacctataattaattataagtgccggtttttaaaaaaaccgaaaccgataaaatcgagccgaaccagccaggggagatatttttcctccagatggggcccacacccacactggcaggagataaggccgagcccttctcccgccttctcctctctctctctctgcagcagcggtgggagaggtagcgacgcttcttctctctctgtgtctctctctctctgcggcagcggcgggagaggtagcgacgccctcccgtcaactagatcggggggaggggaggtgcagcggcggcggacgacatggaggcggcggcccggaccccccctccccccgccagatcgagcgagagaagaggtgtagcggtggtggcgggttggacctcgcctccgccagatccggtggcgtggaggcagcaagtttacactaacttcactcagacaatcacacaatagcatcatatatgaatagaaaccatctagaagtcatatccataaagcactgtagaaatcccacgaaaataatccgaaactaactcctacctggagtctgctaatctgaccgttgggcaacccggttagaccagtccaacaccactggtctgaccggcagtccccgcctagtctgaccagccaccaagagccgactaccgaaaacactattcaccgtattttcacaaagcactcacttttgacaattgttcatcaccacgattaaatcatcacatgattctacacatatctagagagaggaggcaagagaaggcaataatatatgttggtaaggacatagctacagtgacagaaagtgatgctgaactccatcggtatcgttagatttgtgctgatgtatatgtttcttttttcacaacagcttagtgccgttttcttttgatatgtcctccacgtgtgttgttgctgtcaagtggccatcgacttaaatttgctagtgtatgaaataatcactgctagtatacaacattaactggcagcagtactattatcgattggatacatccgattctaaaatttgggtgttgtaaacagctatacccataggttagcctaatgtgtagtagtgacattttttttagtaaaatttttaacagccacctagctaccaggccagtactactagctatagatgctactaaggcagaagatgtcatgtgattaagcttctatttctcatcacgttcaccacatgggcagcaaaagttttgcatgaaatgggatcagttgcagtcaacagaacacggtacacactcggtcttctatatttcgctggacgatagcaggtaagtatgtaccaagccatctatatacatgtgtcatgcaataaagtagcttggtctctaaacaaacaaatatagagaacatatcatcaatataactattgtgaattaaaataacataatcatctctatcatgcgggtgcagcttgggcatgatgttggcttcaactataaatagacgcgtcgcactctccaatcagatgcacaaccacaagaccaaggaagcagtagcctttcagccctcttgctttagtttgttgatccccgactaaatctcattggaaaacaagctagaaaacatggaaggagtgaagagtttgatcatgtgtatgctagtgctaggcttagtcctgcaacaagagaagatccaggtggaagcaaagagttgttgcccatccaccacagcaagaaacgtctataactcatgccgtttcgcgggtggctcaagagacacctgtgctaaactttctggctgcaaaattgttgatgggaattgcaagcctccttacgttcaccatacccttcaccctgaagctggtaaattagaaacattaactctccttatctatatttctatcttgcattcaccacgcccttcaccccagctaacctaggcaaattaaaacatattaactctctttgtgtaaacttttgggctattaattttgtaatatctattggtacaagcatttattcatgcatatacatgattttgcagaggaatcggaggtacttgacttctgcaagctgggatgtgcttcgtctgtgtgcagcaccatgagcactcgtaagcaagaaaaaacatcatattaaattaccattgattttcaaccaaaaaaataaagattctttgttgtatatagctaatgtatagattgaatcatttgttttccttttcagtttctagcaatgaagaagcgaattatgccgtcgatcgttgcaacgatgcatgccaccgcttctgtaccaaggaagctgagactgtcaccgttgtttcctaagcaagtgcaacatgcaagcataagggcttcacacatcgaagcccatggaaggctatgccactctggagtactcattaataaaacggatatcatgatatccaagccagtgtgccatcgatcgatctatcttgatttctgtcactctttattttcaataagctatgataatcacgatctaccatcatatattatcttttcttgaggatgggagcatacgtagagtgatgatatcattgcctaataaataaatctttatcccttttgttaaaattttataatgcatgctacatatatcggaactgaggtggcaatgaatatacatgatcaattgagctggatagtccattacaggttttatacacatatacatggtgaagaaaataaattattttccttccttaattaaaaggatacttgaccaaaacacaatgaatgattaattattataaattgacctcatgaacagatggttaaacacacagttaataacgcataatgacttacttctcatctcttctatatgcttgaggaccatccaaaatattcaaatgttttcttggcgacaacacaatgagctcaacaattaccaggtaaccatatttatattcgccatcagaacttacagattcaacctggcaacctcttgtttattatatgcctaaggcctccttgggcattataaaactattacacctacaaacctgcaatgaacttacacctgtatttagatatacacctaatgttgctcagtacaagccaagttgatggaagtactgatgcttattaccttgaagaacaatatatacagtcattgtttaattgttttttgtactgcttgtttgggtaagcgcttatcaatcgtggtgggcagctggtaggtattttgctataacctcaaaattaggaattagggatggggtcgatgtatattcagcctgactgacttcgtcccgactccgagcaacactataacaagatgatggcagggatgtgactgccatcgagctacacgaaagatgagcagaaactactatgagagatgttggggtggggggctttgcagaaaaaaaaaagaaacaggccggaacttcatgcgaacaaagatgaagaattttaaaatcctcattaaaagactattgaagctaaaaattgagcaaattgtcaaaccaaatatcgttggtcttgcttttgggctgttaacaaatatgcaaaagaggtttgttattcctattatatgttttgatgaagagctagctgcaagtaattgctaactccctgccttgtgaggtgaaggacttcccttgatcttatttggttctccctttgacagtaaagaagccttctaaagcggactttctatcccttactgacagagttgctgatgaactccctttgtggaaggcctcactcataaacagtgccagtcgcttagttacggtgaaagcagtgctctcaactatacaagaggtaaccaaacctatagacaagagaaggagcttcttatgctcagagcaagagaaggccaatggtggcaattgtttggtcgattggaatagagtgtgccgactgtttacacccaaatttgacacctatggacaaaatagaggaaaattgccaatgtttggaaagtgctgggtttcctttacagggccggtcagaccatgggtatatgggctgtctgaccgactagtagggccggtctgaccgcaggtatgtgtgcagtcaaaccgtcatggtccaagtctgagtctgttttcgttgggcctcgggtttccttgctcgggaagactatgtttcgtgtttcctttggtcactatcccgagttgaacgtggagaagggcctgtacagggcaagaccaactcctatttaagggacaaggccggttcattgtaaacccccgaatacaatatatttgaatttttcttttaccatgttttctattttaacctaggtttagtccatctttgtcgatttgcgtcgtaaatcatccgccaccgctgcgacagtgcgacacctctatgtaggtttgtcctgaaaaccttccgttttgcccacgagatgggcagttatccccatatcgatctaaatcggcctagaggctgattttgatctctaaatcgaccccgctagtcggtttagctgtttttcgacaaaacccatcttgatttggctgtttgactagatcgaggtggttgacgactccatatcaccaggcgtttaggtgttgcaatcgtgcttgtcgacttatcacaaaaagttgccaacgcgatttttggtgactccattggagaacgatctaatcggccatatcacggtcgaatttcgtttaatctagtaatttctgtttcgtcaaatcgagagtttcggctaaacagccgaaatcaatctatctatctactgccactgtacatatctattgatcattgtgttgattgattcagatcggtgacattgttcttgtactaccgatctggccgcttattttgccggtctaaccgacatatttagtccggtcagaccggagaagtggagcagtagcatggccggcagcttctcagctgtacacggccaagagatcagaaacttaatccaattcggtttgtacgtgttaaaaaaaatcaggctatacaaagtcgatttaatcaataggcaaaactgaattggtttctgttagtacatacattagcacatctaccgaggaaaattacaaaaaatcaaagccgattcatattcggctgttctgtcaaaaattccaaatatttgctaggcctacacggttgattaccaaatagatcaaatatttttgataagtacagtaccatatcaagaaaaatcacgatcgtatattaatttattcggtcaaatatttcggttatgagctatgtggcccaaattaatcaaggaatttcttcatcaaccatggcgagcgggaacgagatcgacatggtcacattggacgatcttgatgagggagcacgcaaggccatataggaacatctcaaggcgtatagccaggagatattgatgaagacgtgcactaggacccgtcaaggtgtggttctcaagcctggttctctttacaaacccgtatttgacgataaggtaacctccaattcgcctgatccatgtcttgccattctaaaacatattgatcattgtatagatgcatcttttagtgcttattttgataaaaatatggtagaagatgcttgtaaaacttattctagtaagaaaattggctctaaaatagccagttgtcaacaatatcatgctacttctacttttgcgtctacacaacatattcataatactatggatggatcagcgggtgttcacacagccgattccacaggaatcggttatacgaaaagcttagccaacagttagaccgcgcatcacgctggtcagatagcaatctttgccggtcagaccgcgccaaccatagctggtcaaaccgtaccttatcttggccagatcgtgcctcctgtggccggtctgaccgcatcattgaccaccggtcagactgggccattggccggtcagaccgggttatccatagccggtcagaccggcaccctgggacctcttccagagttttgtcctatgactaaaagcactgatttaaattgttatttgcctcatgttagtactattagtcatgctattctacatacacatgctatttgcactgataatatagcatgtatagccgaaccaagcaatgatttggattgtgttaataatttgtgcaatgatgccgtaacgagtatagccgaactaagtgttggtttggattgtgttactagtttagacaatgatggaatagccgaaccaagtgatggttcgaattgtgttgctagtttagacaatgacaccattgagagtataaccgaactaaatgacggtttggattgtattacaagcaaaagtgaaatagcattgtcacctaagaccgaatcacaaattggtcatgtggatattggaaaagatgaggacaatgtcttgcgggatagtagtgaaatagaatccaaagaagctatgcatacatattaaaagccgtatcctgaacatgtagattcggtcctatacccgcaaggatttgaggtgcccaacttcacgaaattgacaggtgaggatgctagaacaataatggagcatatcggccaatttattgaacaatatggtaagcccggtactgacgatttgcttaagttaaaattgtttcctcttactttgtcaaactttgcatctacatggtatagtttacttgctcctaattcaatttctacatgatcacaaatggaccatgagtttcatgattatttcaaagatgcaagcttgatggaacaaagaccgattgatacttcatcggtcacttgtgaaactattagttgtactgatttagacaacgaaaaagtagtgattcggcctagtcaagccgaatccacaaaaggaaaaagtgttattattggggatcctcggcttgacacaattaggatcaataatgcaaaggccgaagatcgtaaggttacaaaggatgaattatctagttccataaagaccaaaaagccgaagctcacttttgagatgcctatggctaagtataagaaaggattagccagtcaacgatttcataatcgaactaatgattcaaaaagaccaagatcatcttgtaggaagagatttggtcaaacaccaaaccaatcggagccatcaactataccaactccatacaaacctccggttgcgatgccatggtatccatatccaatgtcaccgtttggttatccttttatgtattacatgccatggatgcctcaattctctacgccatttcatcaaggatggaaggaatcaactaggtcagtaccaaatcattcatctaattcaagacaacactgtttcctactaaagaatcggtccggtggatcaaaggtgaaaaaggtgaagaaggtgtgggtgaggaaagaagccaaagcaccagaggtcgttgctatcaaggaggactctcaagatgttcatgtacctatcatgcaagcaaaggagatcgaagccgacaccgtaattgtcaaaagcggaggtctgaccgaggcattcggcaggtctgactgccaacctgtggccggtctaaccgatcctcctgggcggtctgaccgacggcttgcggctggtctgaccggggggcattggagaagagtgagaaaattgagagcaacacaggagcttccacctcgaccaaaaatatcaagaatcatttcttagctcctggaaaacaaccacagccgaagtggataccttctagcttatctcactctcaaaagtggaagctacagcatcttcgagccataggtcaaaaagaaaaagaagccgaagatgtagggaacaaaacatgtaataatttaaagcctcgaacgacacctaagcgagtgtggagacctaaagaagtaaaagttaagagttcggtgatttcttggagtagtgatggattcaatttgatgagagaagaatcatcggtcattagagataagtctcctccacatgattctatggaagttagtacggtattcatcttgccttcgaaattgtgcaatcaagaaagccgattctgctcgggggacaagacattaatatgctcatgaagagatcaagagtgatgaacggtgatggatagaatatcacatctttgagccgccatttgttggatgctaaggcacggtatgggtttattgtgtttaccattatattatatgcctatgccatgttagaacattgcttgctatctagcacatgtgtgttcttgcttatcaaattgatattattcatacatgttgcaaatgccagttctaagtagtggaattggtaaattggcatataatttgtttaaagtatgatttggctcatgagtctttgatatttattgaaagccaaatcatatgtgtttttatggatcaccatataatttgtagatttcatatttattgcaccatgaaagttttgcttattagtaattcggctaacgtcaatggtcaatgtgatgatttgttctagatttgttttctttaggaacattggcattgttaatattttgcatacatgctcaagccgattacttacatttgtagattattggaatctatgcatgtgacacatatgactttggtgattcattattaatcatacttcaattggctaagtgttttgatgctatgatgattattgtttcaaaagccacttgaattagtattcatctagacatattagttgaatattataatttttcatatatctagagagaaggaattttggaccaacaatttgatacaccaagcatctggctattatgtgaagaaaatttatatagtaaaagctgatgcttgatttccaaagtttggatgaaattggcagaataacagaccaggggtggtctgaccggcattgcatggccggtataaccggtggcgaccggtggtctgaccggctctacatggccgtctgaccgagcagacggggcggtctaaccggcattacgtggccggtctgaccgatcccaggcagagagctgggggccacattataattgattcaaaggccgaattatttgtgaattcgggcatttgtgcccaggagttagaagaaaattggagaatccctttgatagaatatttgaaagatcctggttttagggttgatcggaaaattcggcagcgagcattcaaatatactttgcttgatggagagttatatcgctgaaatatagatggagtgcttttgatgtgtttagacaatggtcaatctaaagttgctaggggagatgtgcgtgaagggatttgtggaattcatcaatcagcccataagatgaattggttgcttaggagagtgggattctaggccgaaagtgattgatgattgtttcaagtactatagaggatgtagagtttgtcaacggatcggcagtgttcaattagtgcctactgctgtattgaatcctatcattaaaccatggccgttccgaggttgggctttggatttcattggtcaaatttatccttcgtcatcaaaggggcatcggttcgtgctaattgcgacgaattgcttcaccaagtgggccgaagccgagccgttcatgaatattacttacacgtaggtaattgactttgttttgaagcatattattcatagattcggtattccttaaactttgatcaaggagcttattttatgttcaaagaggtgagaagttttgccgaatcttatgatattaagttgttgagttcttctctttactacgctcaggctaatggataagccgagtcgagtaataaaacattattgaaattagtcaaaaagaggattgaagaacactcaaagaagtgacatgaggtgctttcggaggatatctaaacaagatgctactaaagtcactccttttgagttggtttatggacaaaaatgttgttttgccagttgaggtaaatgttggctctcttcggtatttcaagcaagacgacttgtcaattgaagattacaagaccttgttaagaggcaattttgaagacgtcatcgacaagcgtttgaagactttgaaagagatggagacacttcaacacggtgttttcagagatgtaacgtcccgccttcccccaggccgggcccgcttacatgtgatagctttcataggtcatagactgccctcacagaccaacacatgtcttttctgcacactttgtcctcactcgtgtgcacccgggaagaatttcccggtcggtcacccatcctaaattgctccaggccaagcacgcttaaccctggagttctttggagattggcttccggaaaagaagttgcaacttgttgatatgagtattctattaatcctattaagccctaggccgggatgttacaccctcacccccttaagagagatcgacgcccccgtcgatcaaccctaggccaggaacgtcctctcttggccacgtccatgtgtccagtgccagcgcatgtgccatgctatgtaaccactcccggtctacaccagccatgcgcaccatgcctgcgcaactgcgacacacgcgccctgaaaccgcgagagtcggctctgataccattttgtaacgtcccgccttcccccaggccgggcccgcttacatgtgatagctttcataggtcatagactgccctcacagaccaacacatgtcttttctgcacactttgtcctcactcgtgtgcacccgggaagaatttcccggtcagtcacccatcctaaattgctccaggccaagcacgcttaaccctggagttctttggagattggcttccggaaaagaagttgcaacttgttgatatgagtattctattaatcctattaagccctaggccgggatgttacaccctcacccccttaagagagatcgacgcccccgtcgatcaaccctaggccaggaacgtcctctcttggccacgtccatgtgtccagtgccagcgcatgtgccatgctatgtaaccactcccggtctacaccagccatgcgcaccatgcctgcgcaactgcgacacacgcgcccgtgaaaccgcgagagtcggctctgataccattttgtaacgtcccgccttcccccaggccgggcccgcttacatgtgatagctttcataggtcatagactgccctcacagaccaacacatgtcttttctgcacactttgtcctcactcgtgtgcacccgggaagaatttcccggtcagtcacccatcctaaattgctccaggccaagcacgcttaaccctggagttctttggagattggcttccggaaaagaagttgcaacttgttgatatgagtattttattaatcctattaagccctaggccgggatgttacaagagagcaatcaatgggaaatatttgaagaaatacttccttagcgtttggcaagatgcttaggaggtcccatggccagtaattggattattggcctaagacaatatgttctatgctattagattcacgacgttcatcaaaaaggctgggggcatgcgtttacacctaaatttggcacctatggacgaaatagaggaaaattgccaaagtttggaatgtgccaggtttccttcacagggccggtcagaccgcatgtatgtgggcggtcagactgtcatggtccgagtccgagtctgttttcgtcgggtctcggttttcgttgctagggaaggctatatttcgtgtttccttgtgtctctgtcctgaattggacgtggactaggcctgtagagggcaagaccaacccctatttaaaggacaaggccggttcattgtaaacccccgaatacaatctatttgaatcgttcttttaccatgttttctatattagcctagttttagtccatctttgtcgatttgtgccgtaaatcgtctgccgccgcagcgagagtgcgacacctctttgtagatttgtcctgaaaaccttctgttttgcccacgagatgggcagttatcctcatatcaatctaaattggcctagaggctgattttgatctctaaattggctccgctagccaatttagctgtttttctacaaaacccatcttgatttggccgtttggctagatcgaggtggttggcgactacatatcactgcaaggcgtttaggtgttgcgattgtgcttgtcgagttgtcacaaaaagttgccaacaccaaccccttgcttatggtaggttaggagttcttaatttagagtatataggttgggctcttcggattcgttggctctggttgtagaagacaaacaatacatggacttcgcatggattacaggaacaagtgtctgcgcattgcgtgagttattcaatatagcagtagagacatgtatcggggatggacaacctaatttggtttgaacggatagtgtcgaaacatgaatttggcaataataaaagggggtagcgcacgagacctaaaagtggatggatgcggagacaaaggatttagacagattcaggccctctcaatgagaggtaataccctactcctgtttggggatttgaatccgtcgggtgtagtatagatctgacgatcatatgtgctcatgccccctagaggacctcctgcccaccttatataagatgggggacaggattacaagatagaaaccttaaccaatacggtattggtttcctaaatctattttacaatattattaaatcagaactttaggccgctccataatataaaaggaaacataatacccaagtcatgatctgttacatattccatagatataagctatcccctatgactagttggataaccatgccgtgtgggtatggggtacctataatctccacagtagcccctgagaccttcacagtcaaaaagataatcttctctcgaactagattacaccaaagccgaatgcttcaatcatctttgccatggtctcccgagtacttttaccaaatctgaagactgtagagggctgaaaaataaagtcaggtacatcgactagatgcacctaataggtgtagcccccaactatgtggttaattgaacaaactaagcatatagtcaaggaataaataatccaaccaactgagtggtttttgataattatagtcaaccaagtaacttgatatcaatatatagcatatgcggtgtgaatccccgaataacatgatcccagtgatatatcgactgctttgtaaaatatgatgcgtgcaacctaaagttgactacatcattgaaaattcacatagcaaaacagctataaaatgacttgaatgctgtgaataaagagatttccaaagtattagacacacaccaggcgcatactgctttaacagatgtgcttaaatccctaaaagacacatggtttcgccacacctggaaatatgacatatgtggtgtaaaatccgagtaaatgaactcataaggatttaccaaccgcctggaaaatgaccataatatacaatcagcctaagccataatattggtcaataaaaatgcacacttacgtggcaaaaagcaacgatattgtatccaatcaattgcttaaaaacccaaacagcaccttgacttatataaaaaagtcagcggggtagctatataaagatttactgtttgacaccttttaagatgcatattgtaccaactcctaaaaagttgagtaactgcggtataaaaggatttttaggtattgggcacttgatcacgcacactttggcctaagcaaaaagtgcgtaagtccctaaaagaacgtgataggccacacttgaaaatgtgggctgcagacatattaggcctaggccaaaaaatatgccttcgacaccctttaaaggatgacgcatgtaaaatgctcccgagtaataaatctcccgggtgatatagaccaagtgtagctcatatgaatagcttctgatatgagtgattatcccttatgggatactccaaaatagatataacaattgaatcccgactggcacaagtattcggttgataacccttacgggtaataataaatagtctagtctttgagcatagaaaatagacccatatcatgaattcatgttgcatgtatccggaacaagtctaaattgaaggtatgatacttgtgtttgagctagtaagcccctgagcatatagcttgtccttctgtcgtagtcacaattgtccattgatggtagctgacgcagttgtcatagagataagatggtagtgaagatagtgataccaatcaaaattgacgaagttgcaagccgtggaagcgaagaaaccagtcggcagcagtcaggtcagccagcaatgaatatgaaggcgaccagcaataaagttgggtagccatggcagcgaaataattagtcggtgacaacgaggttgctggtgaagaagatgaagatgcccattagtggcgacataataagccatccgtgaaggcgaaataacaagctggcaatgatggaagcaaccggaggcgaagatgtagtcatccattagcaacggcacagatgtcagggccgatgaagtagaggtgctggtgatgaagtcagtgacaataatccatcaaactgttgagaagatatcaaagctcaagtaattttcttgatgtgtgcataaggaagattgatgcaacaccccttgatttgtaaagatggtagtagaacttgatgttatagctgttgcagatactccacttggaggaaagtaaatgttgttgcccaactcatcgaaactgagctgattggttgataactctaaactcccggacatgtagatagaatctcaaacttgatatttgagaaatttggagtagattgtgacggcatggagaagccaaaattgccggtgaaataattggagttgctgaagtaaaatgtcggctttgaagcgaagacgaaaataataactcccagagttgactcgttggttgattaattgattgattcggtttgtcaaattttgagtcttgtatctgtgtagcccccgactctttggttagttgagaaacaactgaacatagagtcaagaactgtagcttcttgtcgtcgagtagccatcacttgagtgaagatcgagatgtcgaggctcttggagacgtcgtagttggtgaagtagcaaagcttacaaagtagaggcaatagagtttgccggtgccgaagacaatgaagatgaagtagctccaccatggtgacaaagttgcataaccgtgatgacgttagcaagagtcggcggcaacagaagcaaaccggtggccaagacatgtagttcatcgtcggctactgtggagataaaaacaccagtcggtgacggaagaagtagaatgatgacgaaaatgaagacgtccttgaacgacgtcagaataggccagccgtgaaagtgaagacgccatttgcggcggcaaaggcgaaccggcaatgacgatgacgccagtcaatgatgacgaagacgcgcagccatggaggcgaacaaaccagtcggcgtcagacaaggcggccggcaatgaagacgatgacgtccatcagtagtggtagcggcataaaccagccgtagaggcaagggcactagccagcaacagacgagatgaccgacggtgaagacgaaaaggccaatcaacactggcagaatcatgcagccatggaggtgaagaaaccagtcggtagtagacgcagacagcttgcgttgaagatgatgacgcctattagcggtggtggcgacgtggccagccgtgaagacgatagcaccagttggcagcggcgaaggcaagccggtcggtgaagacgaagacgcccaacaatggcggcagaataggccagccgtgcaggcggagacaccagtcggcgacagcaaaggcaagcctgtcggtgaagacatagacgcccaacaacggcggcataacaggccagccgacggtgaagacgtagatgcccaacaacggcggcataataggccagccggcggtgaagacgtagtcgcccaacaacagcggcacaataggccagcgtgcaggcgaagacaccattcggtggcggcgaaggcaagccggtcgatgaaaacgaagacgcataacaacggcggcataataggccagccgtgtaggcggagacaccagtcggcggcggcgaaggcaagccggtcggtgaagacgaagacgcccaacgacggtggcataataggccagccgtgcaggcagagataccagtcggcggcggcgaaggcaagccggtggtgatgttctgactgatccattcatgaagcgtaggatgtaagcttaaagcaatgaatcccttttatgcatatctggatctggatcctacagaacaaacatatatgggatgagtagtatttaatgtatatataatactcgagaaaaattcaagtattttaaaatattaataaatatgtatttctcctctagtcaatcttgatttcctcgagcagatgattccgtacgtttaaacactctgtctgactagtcatagcccccaaccatcgggagtcagcctaggcacttcccaaacatgcatatgagtgacatgagttcgtcattaatggaacaaagtttcacgaatcagaatttactactcgggtacttttgcaattgtaaagagcagaaaataaatttatcttatctctatgcttttgatttattccgaatagtacttatgtcacgtcctgataaattcatcccgaaataaaaatcattccctaaaaggaataatagaattaattaaaattcgaaaagaaattgacaaacactaaaatacgtgtcagaaaaattcgaatgtggtccggagaatttttattaaattctctttggtctaaaaggagccctcaaattttacttgaattttcagagcaccgaaaatatttattaaagaacaacaacaattaacaaagtttattaaaaagaaaaagctaaaaataatccccctcctccctttgggccaagtctggcccaaagtctacctctctccccctcggcccgcagtcccagtccctctcccctccctttgtttttctctctttcatcccgggcagcccactccctcctcctccttcctcccggcctgcctcggcccagcagcccggcccaagccaggccgagccgagccagccgcgtgcacgcgcgccgcgcgtgcgctgactgcgcgcgctgaccgcgtggggcccacgcgccggtcgtcttcctcctcccgcacggcctcctctctctcccgtgaaaaccctagttcgttcctccctcgaatccgcgcgatttaagcgttggattccaaaattaattggggggaattaatcccctttccttcctctcccttttccccctaatctccccttcaatcatgcactattttgaccggaacggctgcgccattcatggccgccttccatggccgccgggcgccttttccgccgccgttccctgctcctcccatgctcggctcgcttccctccgctataaaacggaacccccttgctccattctctcgttttagccccctcctgcgccctccccgtggctgcaccacctctccccgcctcctccttctctttcctcggtgccggccaccctccagccgcccctaccgccttgcccgagcgccggtcggccatgccggcgcctcctccagcgtcgcagccgcctcctctgcgccggcctgccctctgttgcccgtggagacctccggaagtgcatccccgccggcaacagtggcgttaccgccactgttccgtcttcggccagctgctgttcatcgctggtacgccgaccgacgtcgccatctcctccgtcgacgtcgcagccgcctcctctcccccggtcagccctccgtttcgcggggaaaccaccggagacgtgtcctcgccggcaaaacagtggcgttgccgccactgtaccgcctccagccgcctgtgccgccttgccggtgcagcgactgtcgtcatcgccatcttccctcgacgtcgccgcgtcgccctccaccccggcctgccctcggtttcgccggaacgccgtcgcccgcatcggtcttgccctccgcctcgccggagttccttcggcaaccccttccgccgtgcctgtgcgccggccgacgtcgccatctcctcctccggcatcgcagcgtcaaggttgccctcggcctcgcctcccctccatccaaaccccgccggtgttcgttatcgtcggctccgttcgtcctcgttgacgactcctccggtcggtcgttcgtcctcgccggatcatcgtctcgctgcgccgccaccctcgtcgtcatcgtagcggagtgttccacgccgtcctcgtctccgtgcagctgctgccggctgcctcatcacctccttgccggttcttgtcgtcgtcctctcgtcgttcccggtcgtcgtggcgttcgtccctctgtcaagccgttctcgtccgtcgtccgcgtccgtcaagtgtgccgctgcagccccgtcgtcgtcttcgtcctcgcctccgcttctccaagcattgcgccggctacgtctcgccttcgtccagggatcgccgccgaagtcgtcccctcgcctttcgtctccgtcattcccggccatctccgccgcgcccgttcgttgttgtcgttccctcgcctcgtcacgtggtggtaaggatctctccttcgctgccccgtcctcgtcctttcggtgtcgcccgtgcccgttgtgcggttgtcgaccccggtacccgtgtaccggtgtcggtagtcgttcgcttgtgcgtgtggtgaccgtgttagtgtgcccgctcggtagccgcgtggtttccacgtgtgcagcccgtgtggtgtctagtggagtccgtttgtcggccactcgcctcggttgacacacgggatctgcttccgtcgacccgtggaccgtctctgtgtactcggtctaccgcggtcctttaggttgacatgtggggtccgcatgtcaacggcgcaaccttcctgtcttttctaggctagcgcttacacatgttttatagttgcaaaacctaattataataatccgcaaatctccatgtaacagcattaaacttcgaatgatcatatcttggtcatacgagctccgaattgatccgttgaagtctcctaatgtttgttataacctaaagaaccctgtgctttctttttatgtattgttattgcttctttataggcttgtagctttgcttgtgtgcttcgcgtagtcttcatcattccggaggttcccgaagcgtggtttgcggtcgtcgccgaaggtttggaaggccgttatctctgagcaaggcaagtcacatcatccttgagaatattgaatcccagtttataaaattattttgatttaaattaatgcattatcgctttatttaaattcctgcgttatcactgttttatttagccatgcctatttacctttgttatgaccttattattattgctattgttattattaccttgttcaccctaggataaacaaaaccccaactcgtgggtactctattcatggttccactagtatgaatttaggtagatgcttcactgattaattaggcaacattaggtggttttataactttagactttgggaattctcatatcatttggacactatggaatggttggcttatgttggaattggacacacacctccccctctattcaaaactcccaaaatggttttaggctgggctcgaggtgcgtggttgggttttgttagtcgtacctcgggtactgtaaggattaagctcgggcctctgttgcaaagcactaccgtacttccacatatctagtgggtaaggcttagtttgtggctcagtctagttataaacaaaagtacacggatggagatggacgaagtcgggggtcgatggacatctctaggacaaatgaaggctacacgagctgcggcccggtagttgagatgtcatggcacagggctggtgtcctgctgctaggggctcaatcctgccagcctgtcccggaggttccgggcgtaggtggggttggctcggtactcttgtttatggctaggatgggttggtaactatgtcacgtcttccgtccgtataccgtggtggcatgtggcacgtggttacacgtgaggaagatgtgtcttatgggtaaagatgtacacctctgatcagagtataacctattcgaatagccgcaccctcggttatgggcaagcctagcaatgtacccaagttagtgttttaattcttaaaatttgcttaacaactaaaatgtggaatggttggcctgggttggcttgggacgagctgggacccagggtcgggttgccagttcggtctgaatcatcgtaggccttgggttaaggcaggttcgtgagggttcacgtccttgattaataacactgtgtaactctaggatcgtctttataaaatggctttgggcaactaagtgacttttaaatgctgttttctgcaaaacttaacccctatattattaccccttgtacccccttgcattaatcatgcatctgccggtgtggcttgctgagtactgtggttgtactcattcttgctgaatctttcccccccttcaataagagaagctttggagaagaagtcttaggtggagtcctggcttatacgccagttgagcgcctatgaagatggagccgtaggtccgctagtctgctgctgtttatttttgattgtcaggcattaagtgcctttgtaataatgtaaatattatcgatataataaagatgtgtcttttatatcatgtttgtgtggtgtaccccggcttttcctgggacggggattaatacactagcgttcgggaaaatgtatttttctcggtcgcgacaacttagcaccttgcgttactcggtccatccaacgagcccccgggtgctaggaatcggcccaaaggcaactatccatcgacaaaccaaacggaaagcataggaagatagaactccataactcgataggcacttttgtactcagattatgtcgcaagcaatcaagataaatattatgaaaattgtttaaaaaatatgatataacatctgtagcccccgactcactagtcaacggtgaaccagttgatgtagtgagctaggcagaggaaaaggaaaatgtcatataaagaagaaaattaatgatgacttagctttttggtctttcccttggtgacggcagatgtcacgaccggaattaacccaacgggcgttccttacgtgcgtgtattaatccttgtcccaggaggcaaggtacaccaaaagttgatacaattcagagtttaacaagcggaagcgtaaatagttaattattacatgggcggcgaaggcccagcacacacaaaaacaaacgggaaacagcggaagactagggcgacgaccacaggcgcttgacggcaggcacgagctagacaccaaagccttcatcttccaggggctcctcttctggctttgggaaaaaattgagcaagactgagtacaaccaccgtactcaacaagacacacccacaagtgcaggataaatgcaagggagtacaagggggttataacataaagggttagggtttgcaataaacagcattaaaagacacttagttgctcaaagctattttgtatacacgattccagagctatacaatattattaatcaaggccatgaacccacacgaacctgccttaacccaaggcctatgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaacagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaaccccacctacggccggaacctccgggacaggtaggcaggactgagcccctagcagcaggacaccggccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgaagaccggtcattatacggccgaggtgctactatcaaaaccatgcaccccgagcccagcctaaaaccattttgaggattttgaatagagggggaggtgtgaatccaattccacaataatccatccattccatagtgtccaggtgatgagaatatcccaaagtctagagttgtaaaaccacctaatgttgcctaattaaccagcgaagcatctacctaaaatcatactagtggtaccatgagtagagtgtccactagttggggttttgtttattctagggtgaacaaggaaataataacaataacaataataaggtcataacaaaggtaaataggcatggctagataaaacagtgataacgcgggaatttaaataaagcgataatgcaataatttaaatcaacataattttataaactgggattcaatatgttcaaggatgatgtgacttgccttgctcgctttcccaaacgtcggcttcaacctccacgaagagcggatcttctaataaactccatataacaagcaggaacaaagtacaaaaatgggttcttgacttcttaaggaaaaattagagacttgaacggtccaattccgagttcaaatggccaagttatggccatttgaagtttatatgctctttaaatgaatatttacgaatttcttcatttaaattttaatttaaaaaaaaatggatttattgcgttagccggggagagggcgcgcggaccgggtccacgggagtgggacccacgcggcagtctcacggtccacggtggaccgagtgcacctggctcacaccggccggcgccgtgggccccacgcgtcagccgcacccgagggcgcgggcggctgacggccgggccccacgcggcagccgctatgtcacgtcctgataaattcatcccgaaat

SEQ ID NO: 44850 - DNA, 7456 bp, Oryza sativa
aatccgtgtgattcgctcatgggattccaaaattaaagtaggggaaattaatccccattgaatcctcttcaatcccccccaatttcccccttgaatggtgcccccaatcgccgggaacgcccgcgtcttcctcggccgccctccattgccgccggccgtggttcccgccgccgttcccgctcctcccgtggccggctctctcccccatcctataaaatgggatcctcatcccccgttcactcgttttagccccctcccgagcctccccgtggtccctctccacctccccgtcgccctcctctctctcccacgctgccggccgcctccagccgcctgtgccgcctcgaccgtgcgccggccggccgcgccgtcgcctcctccagcgtcgccgccacctcctccaccccggcttgccctccgtttcccgcggagacccccggagctgcctccccgccgtcgcccttctcgtttctccgcgccggccgcctccagtcgcctctcccgcctcgcccgtgcgccgtccggtcgcgccgtcttctccctcggcctcgcagccacctcctctccctcggtcagccctccgtttcgcggggaaagcaccggagacgcgtcctcgccggtgtccagtggcgtcgccaccacctctccgtctccggccggctgctgttcgtcgccggtacgccgaccgacgtcgccgtctcctccgttgacgtcgcagcgtcgccctccaccccggctgctcctcggtttcgccggaacaccgtcgcccgcgccggcttctccttcctcctcggcggcatctcctccggctgcccctttcgccatgcccgtgcgtcagccggcgctgccgtcccctccctcggcacggtgacgtagccctccacctcgtccacccctcggtttcgcccggaagccgccgcacatcgccgcgaatctctccatccgcctcgccggagttgttcggccgcccgttcctcctctcccgtgcaccggtcggccacacctccaccacctccggcatcgcagcggcaaagccgtcctcggcatcgtttcccctccatccaaacccctccgcggtccatcatcgtcgtctccgatcgttctcgtcgtcgacgtcccgtcggtcgcccggctcgtcgtctcgcggcgccgcctccgtcatcgtcatcgcagcggcgtgttccacgccgtcctcgtctccgtgcagccgctgccggctgccctcgtcgcctcctcgccggccccggtcgtcgccgtcgtcgtcctctcgtcgttcccggtcgtcgtggcgttcgtccctccgtcaagccgttcttgtccgtcgtccgcgtccgtcaagtgtgtcgctgcagcccccgtcctcgtcttcgtcctcgcctccgcgtcgtcaagccccgtgccggccgcgtctcgccttcgtccaaggatcgccgccgaagtcgttccctcgccgtccgtctccgccgcgccagttcgtcgttgtcgttccctcgcctcgtcgcgtggtggtaaggttccctctccctcgctgccccgtcctcgtcctttcggtgtcgcccgtgcccgttgtgcggttgtcggccccggtacccgtgtatcggtgtcggcagtcgttcgcttgtgcgtgtggtgaccgtgttagtgtgtccgctcggtagccgcgtggtttccacgtgtgcaacccgtgtggtgtctagtggagtccgtttgtcggccactcgcctcggttgacacacggggtccgcttccgtcgacccgtggaccgtctctgtgtacccggtctaccgcggtcctttaggttgacatgtggggtccgcatgtcaacggcgcagccttcctgtctttccaggctagcgcttacgcatgttttataattgcaaagcttaattataataatccgcaaatctctatataacagcattaaacttcggatgatcatatcttggtcatacgagctccgaatcgacccgttcaagtctcttaatgtttgttataacctaaagaactgtgtgctttctttttatgtgttgttattgcttctttataggcttgtagctttgcttgtgtgcttcgcgtagctttcgtcgttccggaggttccagaagcatggttcgcggtcgtcgccaaaggttcggaaggccgttctctctgagcaaggcaagtcacatcatcgttgagcatattgaatcccagtttataaaattattttgatttaaattaatgcattaccgctttatttaaattcccgcgttatcactgttttatttagccatgcctatttacctttgttaagacattattattgctattgttattattaccttgttcaccctagaataaataaaaccccaactagtgggtactctattcatggttccactagtatgaatttaggtagatgcttcgctgattaattaggcaacattaggtggttttataactttagactttgggaattctcatatcatttggacattatggaattgttggattatggtggaattggacatacccctctcttcctctttcaaagcccctaaaacctgtttttcggtggggtttgggtgcatgccagttgtgggaagtagcaccccggccactataaggtttaagctcgggcctctgttgcaaagcactaccgtacttccacatgtctagtgggtaaggcgtagtttgtggctcagtctggttataaacaaaagtacacggattagagatggacgaagtcgggggtcgatggacatctctaggacaaatgaaggctacacgagctgcggcccggtagtcgagatgtcatggcacagggccggtgtcctgctgctgggggctcagtcctgcctacctgtcccgggggttccggccgtaggtggggttgggtcggtactcttgtttatggctaggatgggttgggaactatgtcacgtcttccgtccgtataccgtggtggtatgcggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgggggttcacggccttgattaataatactgtgtagctctaggatcgtctttataaaatggctttgggcaactaagtgacttttaaatgctgtttactgcaaaacttaatccctacattatgatccccttgcactcccttgcattaattgtgcatttccggtgtggcttgctgagtactgtgattgtactcattcttgctcaatctttcccctcttcagtaagagaagctttggagaagatgtcttaggtggagtcctggcttataccccagttgagcgcctgtgaagatggagccgtaggcccgctagtccgctgctgtttatttttgattgtcaggcctgaagcgcctttgtaataatgtaaatattatcgatataataaagatgtgtcttttatatcatgtttgtatggtgtaccccggcttttcctgggacggggattaatacactagcgttcgggaaaatgcaattttctcggtagcgacaagctggtatcagagccatctcgactgtaggataagccaagtggataaaacctaaggacatattttataaataaaactatttgcgaaagttccttttttctccttcccctaatgctatttgcaaaaggtttactcccttcttccttcttcggatttcaactagtactagatggtcaggtcagtgaagaagaagacatcgtcagttgtttgccgaagctccggaagactgcaagatccgctagcgaagtggaggaagcagtgaagccagctgtgaagcagtgaagatcttggagaacccgtcgcagaacctaagccaccctctagggtagagtcgttagtcgtgtgttccttgcttgtgtgtgtagtgcgtggtttgcatcggtgggttgtgatgtgaccatgctaggttgtttgtttaatcaacttgcagaataagtgaaacaaacaacacatcagcaagaagagttagttcctttaaggtcctgtccctagttctggtctattcttccctggcttgtttcctctctcacctcaatccctgtgacagatgtttaacagagaaaaaggaaagaatgtcagcaggtatgcctccagtaactcaagttttcaactcaatccaccactggcctcaagagagttaacaagggcacacccttggtccattccaagcatgctgctgagttcacagctaccattggttggaagtccagaccaaaatcagtatgtgtttgatcgagcatttgccacccaggtcgatgagcttccaatgccagaagaggatgtccccttttgtcacgattgtagagagcaaggacactatgccctgaattgtccatgggtatatgccaaagaagccccttcctttggtttagcagggcagacatcgctaaaccagcctcctcgcaccaagtcaagcttgcagcctagtgtacaaaggagagagcctaatggagagaatccattgaatcccgggaattgctctcctcctagcttttcgtaccacgtggggtcacatactaagcaagccaaaggccagaagagtaagaatcagaagagaaaagcaccgatgcgaactgaagaagaagtacgtaagatgactattaccagcaccgaatggcctccagcaaggataactatccctacacgtcaaagaggaaatgcctttcgaggtgcccgtcagttgacccagcaccttctaatccatggtggcagagtatctgatagtgaagggtcagatcaggtctcctcgcatgatgaagatgagtctccccgacatgtctgagaggaagagacggaatcaaaggcatgcccccgatgtggagaaattggacacgttgctagcatgtgtatcacactttgcactcattgtgaagaagaccatccaccaggggagtgtcccacccgcaaggtcacatgttttctatgcgaaggtacaaaccatgtgcccaaggattgccaactcagtgtgttgttgaccaagaccgcagaaatccaacgaacaaccctacgattgtctcatcagctagtcagctccaacagcaatatcgacgatatcatccacagcaccaatgctcctcctgctgcacttgactctgcaataaatcatagcaataataccttcagcaccaaccattctcggcaccgacagcctcagcaatgaattgtcgtcgatggaagaagttgtttctctccccgacctactccaggccgagcgaagggaaatcaacctcaggagggtgataccaagcagaagaccgttatccacttcaaccagcaatcagaaggaatttttctcctgtgaatgatagcaatatgcagtcctatcacatcatcacagaaccaatcaaggatgatgcagtaactagaacaatgccatctatatctctccagaatcagaatgagtaaccatgtttgtgattttcagttcgctacttatcactgtaatcgaaagtttgcagcaatcatgtaataaataaatatattcatgtctataaacagtgagcttgctatgtttatggatgattcatgttgaggatgcaatgtaccgatgttaagcaccttccctttttgtttaaggtagggccttgtattcatgtaataagggagaaatgtgtaataaaaacaagttctatgaggactctttcggaagatgctgatatgggattatgtgtataattgtttactgtcaaaggagacctagggtctcattttagaggaactatgttctaacctcgagttaataaccaacctgaggatggaaaagaaaatcaagtgattaaccaaagagacatttgtttggactaagagtttcagatgtgtctttttcggatcaaaggcaaagacggtcagtacagcttttggcgaaacactccaaggtttcactgaaaggcagcagacaaaaggaccacatcgtcaccagaagcatccacaactctcggagtgaagagtacttggttgacaaagttcaaaaggtgattgatagaagataccagcaaaggtgtttattatcgggcaaagaagtaggtcgaaaggtgattgatacgagaaatctgaaaagaatacatcagggttgaatgtgtaaaggaatactttgaatgctaaatgatgacaacatgaagagaatagtgggaagtaaactgaatgtaaagaaagtgaatccgagctgtctgttcgtgggagctattcccagttatgaaccaagtgatatgttcgaagatagtctgtagaggtcagattaaaatcacatctaacaacgaagcttcagatttggcaggatcacgatcagaccataacaagtccagcagtaaagtcatttggggagacgtcaaagcatgtcaagtgggataagttggttctttttagaaacataattcaaaggcaaagttaccgacccttgcatcgaatagcagaagtagctagcacccggagaccaggaaagctaatatgaggcagttaggggcaagttgccaaacatgatatcctagtaatgacaagctgatatcgacgcataacgtgaagtgggtaacttgtatgaggttgacgccaaagatatgaattatgagaagttctggaactgaagtcccatcttcaagtgccacaatccaatcgaagtcagctagaggtgcaaccagggaaaagtcaggtgaagagaagattccatctgcaacaggagattgagccaagcagtccagagtggagaagttttgctaggcaagtttgttataaaagatgcgacggaagaagtcggacaagaagagaagaccgcccaacctatcttcttgctagcctcctcgaatctcggggacgagattcctgtaaggggggtggatttgtcacgtcctgataaattcatcccgaaataaaaatcattcgctaaaaggaataatagaattaattaaaatgcgaaaagaaattggcaaacactaaaatacgtgcaagaaaaattcaaaggtggcccggagaatttttgttaaattctccttggtctaaaatgagccctcaaattttacttgaattttcagagcaccagaaatatttattaaacaacaacaacaattaacaaagtttattaaaaagaaaaaacctaaaaataatctctcttcctcctttgggccaagcccagcccgaagtctccctttcctccctctctttctctccctctccttctctccctccttctcttgggcccctcttcccctcccggcccactgcctccccctcctctctctcccgggccgtttcctccccccctcctct

SEQ ID NO: 44851 - DNA, 4071 bp, Oryza sativa
atgatataaaagaacacatctttattatatcgataatatttacattattacaaaggcgcttcaggcctggcaatcaaaaataaacagcagcggactagcgggcctacggctccatcttcacaggcgctcaactggggtataagccaggactccacctaagacttcttctccaaagcttctcttactgaagaggggaaagattgagcaagaatgagtacaaccacagtactcagcaagccacaccggagatgcataattaatgcaagggggtacaaggggataataatatagggattaagttttgcagaaaacagcattcaaaagccacttagttgcccaagccattttataaagacgatcctagagttacacagtgttattaaacaaggccgtgaaccgtcacgaacctgccttaacccaaggcctacgatgattcagaccgaactggcaacccgaccctgggtcccagctcgtcccaagccaacccaggccaaccattccacattttagttgttgagcagattttaagaattaaaacactaacttgggtacattgctcggcttgcccataaccgagggcgcggctattcgaataggttatactctgatcagaggtgtacatctttacccacaagacacatcttcctcacgtgtaaccacgtgccacataccaccacggcatatggacggaagacatgacatagtttccaacccatcctagccatagacaagagtaccgacccaaccccacctacggccggaacctccgggacaggtaggcaggattgagcccctagcagcaggacaccagccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgagcttaatccttatattggccggggtgctacttcccacaactggcatgcacccaaaccccaccggaaaacaggttttaggggttttgaaagaggaagagaggggtatgtccaattccaccataatccaacaattccataatgtccaaatgatatgagaattcccaatgtctaaagttataaaaccacctaatgttgtcctattaatcagcgaagcatctaccctaattcatactagtggaaccatgaatagagtacccactagttggggttttattttcctagggtgaacaaggtaataataacaatagcaataataatgtcttaacaaaggtaaataggcatggctaaataaaacagtgataacgcgggtatttaaataaagcggtactgcattaatttaaatcaaaataattttataaactgggattcaatatgctcaaggatgatgtgacttgccttgctcagagagaacggccttccgaaccttcggcgacgaccacgaaccacgcttcgggaacctccggaacgacgaaagctacgcgaagcacacaagcaaagctaccagcctataaagaagcaataacaatacataaaaaggaagcacacagttctttaggttataacaaacattaggagacttgaacgggtcgattcagagttcgtatgaccaagatatgatcatccgaagtttaatgctgttatatggagatttgcggattattgtaattaagctttgcaactataaaacaggtggaagcgctagcctggaaaagacaggaaggctgcgctgttgacatgcggaccccacatgtcaacctaaaggaccgcggtagaccaggtacacagagacggtccacgggtcgacagaagcggaccccgtgtgtcaaccgaggcgagtggccgacaaacggactccactagacaccacacgggcagcacacgtggaaaccacgcggctaccgagcgggcacactaacacggtcaccacacgcacacaaggacgactaccgacaccggtacacgggtaccggggccgacaaccgcacaacgagcacgggcgacaccgaaaggacgaggacggggcagcgagggagagggatccttaccaccacgcgacgaggcgtgggaacgacaacgatgaacgggcgcggcggaggcggccgggaactacggagacgaacggcgaggggacgacttcggcggcgatccttggacgaaggcgagacgcggccggcacgaggcttgacgacgcggagccgaggacgaagacgacgacggggctgcagcgacctagacgaaacaccgaggacggacgagggcggctcgacggagggacgaacgccacaacgaccgggaacgacgagaggacgacgacggcgacgaccggggccggcgaggaggcgacgagggcagccggcagcggcagcacggagacgaggacggcgtggaacacgccgctgcgatgacgatgacggcggcggcgccgcgagacgacgagccggcgaggatgaacggtgaaggcgacgacggacaccggcggtgttcggtcggaggggaggcgaggccgaggacgacgttgcggctgcgatgccgaagatggtggaggtgtggccgaccggtgcacgggcgaggagggacgggcggccgaacaactccggcgaggcggatggagaggctcgcggcgatgtgcggcggcttccgggcgaatccgaggggtggacgaggtggagggctacgtcaccgtgccgaggggggggggacggcagcgccggctgatgcacgggcgcggcggaagggggctgccggaggagacgtcgacgaggaggaaggagaggccggcgcgggcgacggtgttccggcgaaattcgggcgaggaggaggtgatgccggggatgagggcggtgtcgcggagccgagggaggtggtggcgacgtcgatcggcgctcaggcagggagacagaggcggctggaggcggccggcgtggaggaaagggaagggcgacggcgggaacgcagctccgggggtctccgcgggaaacggagggcaagccggggaaggggaggcagctgcgatgctggaggaggcgacggcgcgaccggaccacgctccggcgaggagggagaggcggctggaggcggccggcggcacgggagagagaggaggacggcggggagagggctagggaccacaggagatcgcgggagggggctaaaacgatagaacggagcgagggggttgcattttatagcggagggaagcgagccgagcacgggagagggcggaacggcgacgggaatggcggccggcggccatggttggtggccgggaaaagcgcggccgttcccgacgattgggggcgccattcaagggggaaattggggggaattgaagaggattcaatggggattaaaaccccccaattaatttggaaagaacggttggattcggggcggatttgggggagcaatggcgctaggtttcccggagagggagaggaggctgagcgggaggaggaagaagacgacggccggcctggcacgtgggccccacgcggggcgcgcggcgtcagcgcgcgtgcgacgcgcgtgcacgcgagaaggaggggcggctcgggcagggggcggcttgggcctggcggccggcccaggaagagaggagggagaggcggcccgggggagagagggaggaggagggagtgggccgggagggggaggagaggcccgggagagagaggggaaagagagggaggagagggagacttcgggctgggcttggcccaaaggaggaagaggatttatttttaagtttttctttttaataaactttgataattgtttttgttgtttaataattatttccggtgctctgaaaattcaagtaaaatttgagggctctttttagaccaaggagaatttaacaaaaattctccgggccacattcgaatttttcttgtacgtattttagtgtttgccaatttcttttcgaattttaattaattctattattcctttttagaaaatgatttttactttgggatgaatttatccggacgtgacaataggcacggc

SEQ ID NO: 44852 - DNA, 5175 bp, Oryza sativa
gctccggcggtcggcgaccgaaacggagaggtggacgaggtcggcgagaatgcggtgaagccgaagaagtcggcgccgaggtgggaggtggtccggggcgacaacggcggtggaccggagctcggcggcgacagcggagagagagagcgacggcgcgagctcgactccggcggggagagagggcggcgagtggcggaaacggtggtggggagctcggggagggtttatatagggttgggagtgagagagggcggccggaggagggggaaatgggcgcgggagacccggccgccattaatggcgccggcgaggttaggggaacggtttccaaacgaatccgagggagagagggagggaaaaatggggggaaagggagagggaatcacggggaataattccccccactttattgcgcgcggggacggcgggacgcggcgggattcgcagtggcggcggcgctaggcgcgggcgaggcggcgggagcggcgggaggaaggggatgacgggtaggccccacccgtcagcgagtgtggcgggcgggcccgcccgtcagcggcgcgcgcgcggggagaggctttcacacggtttttaattattctaggcatatcttagaggatgtattttagagtcgttttgggacgtgacaaacctaccccccttaaacggaatctcgaccccgagattcggaagaactggcaaaaagatcgggatgggctgccttcagctcgtcttcacgctcccaagtagcttcttcctcagcgtggttgctctattggaccttgcaaaaacggattactcggttcctggtcctgcgctccatggtgtccaggattttcactggcctctccatgtaggtcaagtcttcgcgaacttcaatttgctctgggtcggcctgctcggacggcactcgaagacatttcttgagttgcgacacatgaaacacatcatgcacgttgcccaaggaagcgggcagctccaactggtaagcaacttctccgcgtcgagcaatgatacggaaaggacccacaaaccgaggtgcgagcttccctttcgtctgaaacctgtgtacacaaaatcgtccactgcgaattccagattacggcgtcggttatctgcataactcttctgccaggactgtgccacctttagattatccgaatggttctaaccttcgcttcagcttctctcaagatatcggtcccgaacacttggctttccccaacttggtcccacaatagcggtgtccgacatttgcgtccatacaacgcttcatagggtgccatttgtatgctggcttggtagctgttattgtaggagaactcggcgtaagggagactcttatcccaggtcttcccgaaatctaggacacatgcgcgaagcatatcttctaggatccgatttagacgctcagtctgcccatctgtctgcgggtgatatgcggtgctgaaatttaatcgggttcccaactcttcttggagtttcttccagaaatgagaggtgaactggcttccccgatcagatacaattttcttggggacgccatgcagacttacgatcctagcgaagtagagtttagctagtttgttccccccgtatgtggtctttactggaatgaaccgggctaccttggttagtcgatccacgactacccatatagaatcatatccgccttgggtttttggaagtccggtgataaaatccatcccaatttcatcccatttccattctggcacttgtagaggttggaggagtccggccggtcgttggtgcttggctttgatgcactggcacacatcacaaagggccactaactctgcaatttcccgtttcatactaacccaccaatatttctctttcaagtccaagtacatcttcgtgctgccagggtggatggaatagggactttcatgagcttcctgaagtatcaactgttttagttccctatcatctggaacgcagacccgatttccgttccatagggttccgtgttcatcctctgtgaaaccagcggctttaccctgtttcatgttcttgaggagcccatgcatatccggatcattcttctgagcctcgcggatttgatcgagcaaggtaggcttggcttccaacgtagccaagaatccacgaccaactatgcttagattcagggcttccatctgttgattaagttccggtggaatgccacggacgccaagagtgttgcaatggcttttttgacttagagcgtcggcgaccacgttggccttaccaggatgatagtgaattcccacatcgtaatccttgatgagttctaaccatcttctctgccgaagattcagatccgactgagtgaagatgtatttcaaactcttatgatcagtatatatttcacagcgattcccaatgagatagtgccgccagatttttagagcatgaaccacagcggctaactccaaatcatgggtagggtaattgccttcatggggccgtagctggcgtgaggcataagctaccacatgaccttcctgcatgagcacgcaccccaatccttggcgcgaagcgtcacaatacaccatgaaatccttgcgagtatccggtaagattaacaccggcgaggaaactagcttttctttgagagtttggaacgctttctcgcattgcgggctccacacaaatttctcttctttcttcaacaactgtgtcatgggtcgagcgattttggagaagttctcgatgaacctccggtagtatcctgccaaacccaagaaactgcgaatttgagtgactgtcttgggttgcttccaatcagtgacggcggtcactgtttcggggtccacagcgactcctttggcagatatcacgtgccctaagaacttgacttcggacaaccagaactcacacttgctaagcttggcatacaattgatgttcccgcagttttcccaacaccagacagagatgcttctgatggtcttcctctgattgtgagtacaccaggatgtcgtcaatgaagaccacaacgaacttatccaagtattccatgaacactttgttcattaagttcatgaagaaggcaggagcattggtcagaccgaacgacatcaccgtgaattcatacagtccataacgcgtggtgaacgcggtcttcgggatatcttcttcacgaatacgcaattggtgatatccggagcgaagatcaatcttggagaatacagtggcacctttaagctgatcgaacagatcatcgatccggggaagagggtacttgtttttgatggtaacttcattgagagctctgtagtcaacgcacatcctcttcgtcttgtctttcttctccacaaaaatcataggagcaccccagggggaagtactcggccgtatataccccttttctttcaactcttccaactgtttcttgacttcggccagttcatttgatgccatacggtagggtcgcttgtactggggagtggttcctggagcaagatctatccggaactcaatctctcgcttgggcggcataccgggtagttcttccggaaacacgtctctgaactctctggcgatggggatttccgacagtcctatctgatgaagttctgaactaccaacagaggttgggggtgcaaagaaaacaaccggttgttccggccctcggtacagagtgacagtgcgtcttgcacaatccactactccttggaattgagccaaccaatttatcccaaggatcacatccaagttcttggtgtctagaagaatcagatccgagggaaatggaattccctgaatttctataggaacggcagggctataataattcgttgtcataacccctccaggggtggtgatgagtagagggttcctaagcctttctacccccaactgatttctccccacgaatggcacagatataaatgagtgggaagctccagagtcgaacaaaatggtagcagggatggaatgaatgaggaacgtaccaacgatgacgtctggagttgtcagcacgtcctcggccgtcacgtggttcacacgaccccgaatgacatccttaccaccgttgctggagcggggaggcgcttggccttgctggcgcctcagctttgggcatttatccgcaaagtgcccaggctcgaagcagttgaagcacagacgctgctgaccttgaacgtccctgcggccttggccaggctgcacggctggcgtagggggacggggcgcacgagtcccttgctgactctgctgttgctgcgtctgtgggacgcgcaccacgaattgaggtcggggcgcggagcgaggttgctgctgctgttgctgctacgaggaggatcccctggatagggattggtgtagcggaccctttggttagccccctgttggttgccgaaattcgccaagcgacgcttgtgcgactctagttccttgtgcttggcttccaagcggatgctcttgtccaccagacgttggaaatccggatagtccccggagaccagacgcacagacagctcagggtccattcctgccaagaacttctcttgcatctcctcatcttcccgtacctcctccggggcgtaccgggccaggttgttaaactcatgcaaatactccatcacggagcggttgccttgcttcaactctcagaattcccttttcttaagggccatgactccggcaggcacatgggttctccggaaagcggcggtgaagtgggcccaagtaataggctgcccctctggctgcgtagcctggaaatggtcccaccatagagatgcgggcccctgcagttggtgggcggcgaagatgactttctcctcattgctgcactgcacggtgtctaactttttccccacggcatgcaaccaatccaacgcatccacggggttattggagctagagaaggtgggcggacggatgcggaggaactcggcgagtttagagtgttgtgggggtggtggtggagcattatgttgtggcggattttggatgtggtggaggaaagcagccatcatgttggtctgctgggcgaggatttgggtaaggatggcgttggtgtctggtggtggtggtggaggcggaggaggaggtggaggtgggctgccatggttgttgtggttgctaccttcgggttggttgccatcaccggtattagcattcctcctggttgtcaccatctgaaataccccaaaacaaaccagccaac

SEQ ID NO: 44853 - DNA, 737 bp, Oryza sativa
aagcacaatataccagcactgaccgccatcggctcagttgggtgaaacagaattaccttcgtgcagaaacgctggtcagcgccaatgcccgcctggttgattttcagtccacactggagcttgctggtcgttgggaaggtggagaagtggcatcagctgacggcatgcgctttgtcacaccagtgaagaccatcaactcaggatctaacagaaaatattttggttctggacgaggcatcacctggtataacttcgtatctgatcagtactctgggttccatggcattgtggtacccggtacattacgggattcgatttttgtactggaaggacttcttgagcagcagacagggctgaatccagttgaaatcatgacagacactgcgggtagcagcgatattattttcggtctgttctggctactggggtatcagttttccccccggcttgccgatgcaggtgaggcggtgttctggcgggtgaataaatcggcaaactacggagtactggataagttggcccgaggatatgcagatctgtcaaaagcggagagtcagtgggatgagatgatgcgaaccgctggttcgctgaagttgggtacaattcatgcgtcagaactcattcgctctttactgaaaagctcgcgcccatcaggactggcacaggcaattatggaagtagggcgtgtaaacaaaacgctatatctcctcaattatattgatgatgaagattatcgt

SEQ ID NO: 44854 - DNA, 1629 bp, Oryza sativa
attataacttgactagttgagctttatatattggttcagctagatattagatatgattgcttagccatgcttagaaacattagcacactattgggataacttatgactcattgtttaatgatggtttaatcgtagctcacgatggttaatcgtgttatgataattaattgataactaaaacttgacaatggtgggttgtgagcacatggttttgaaggtcgtgctcatgacaattaaggaccggttcacgagctactgttatgaaacattaaccgtaccaaccacaagccagcatgggcaacggctttaccttctgtatagcatgattcattgcggggcaccagactgagaagcggcgagaagtccgtgggggtcgctggggagtccatgcctctagttatatttatagagggggtgattatgatccaggaatggtgcactgtggtgagttgtgttgtgcaaagggtattgtcacagcctctattcgggtactttccagtatcgcgacgcatggtagacatgatgaggaggctgtgtcttgtgggtacagtggtacacctctggctagagtaaaactattcgaatagccgtgcccgcggttatgggcgggttgagcaatgtttttcgtgattagtctcacacctctcacaataattatggatgttatatctggtaataatttgcttagctcctggtttggagttagatctgtacagccgggtatggttgttcaggatggttgggcctgtgcagcatgggtgtgctgttcagtgttgattaaaatttctgattaattactccactgttttacttctcttaaatgttttgctaaatgctgcttttgcaaatgagcctatattatgccatcctttggtatccttgtgcacttgcatatttgctgtgtggcttgttgagtatgtcatatgctcattcttgcaataatcaatcaacctcagttgaagaaaaaggttgcgaaggagaagacgtttggcttataccccagttgagctgcctgtgggagtggagccggagctgcgctagattttattttccgctgcagttttcttcttggtgaggactaagtgcctcttaagtaagtacttatcgttttagttaatttgatgaatctgtatattaaattgtcagtttgtgtacctcggctgattcctggacgaggattttatgcacaaataagtttggaaattacttgtgaatttccgagcgtgacaaccgatcagagcggaatacatcccacagcagaaatagataaagcagcggcatgccattgccacaggcaacgaccgtaactaagacctattgagcgccatcgtctgcatcaccctcctggtaataggcatagggatcctccgaagcttcatctccggcctctgattaagtttatatttgcaagggtgagtaccaaccgtactcagcaaaccaccacatcaacaatgcacatgataggggtatttcaaaggatagctatggttcttttgcgcaaagcaaattttctaattctttcacaagcctaagacctagcattgactgatcaaattttagtactagagtttatatttaaacaaccatggctctgcccaccatccattgagatcccaaagatagcttccc

SEQ ID NO: 44855 - DNA, 1628 bp, Oryza sativa
cgcggggcagagtgggaggggggttagggctagtgacctcaatcgaacacctttggggcaatgaacagtgacttttcctatttttccaacttggttgtttttcctattcaaatcttgtcccaatatttctaatttttgctcaaatcaagtttacacaatatttgtgttgctctaacctagattatcactacccatattttatttttatttttatttttaatttattcgaatttaattagggttaattcttattccatcgcacctaaatttaattgttaccaatatggccgcgataatattttatttatttccaacctcacctaatctatattttaattagttattttgccaatttaattttagtgtttattcctaattaattattccttattcgcgatcggtaaactttgaaaccaaattccaataaaataggcaaataaaatcagcatgatgcaatttattaaaaagtttttgaaggcccatatttttagagttttgattttcgttggttgaattttcaggatgttacaaacctaccccccttaaataaatctcgttccgagatttcttaccggtcttcgaacagatgcgggtattctgtcttcaagaattcttcactttcccaagtggctttatcctcagtgtgattactcaattgtacctgtacatatgccacactttggccctagtcctcttttctacttcatccagtatccgaactggatgctctgggtacgtgagatcattgctaatatgaatttcctccaacggagcttgctcctccggcactcgcaagcacttctttaattgggacacatggaagactggatgcacatcggcgatgttttctggtagctgtagctgatatgcaacttctcctcgtctagccgtgatttgaaagggtcccacatatcttggcgctagttttcctttgaccttaaaccttttcgttcccctcatcggagaaacctttagataaacataatctccttctttaaattccaggtttcttcttcaggtgtcggcgtaactcttctgtcgtgattgagccacttttagacggtctcgaatcaggcgaaccttctcttcggcctctttgataatgtcgggtccaaataccgcacgttcacctgtctcggaccacattagtggagttcgacatcgttgaccaaacaatgcctcattgggtgacatctttaggcttgcttgaaagctgttgttgtaggagaattcggcgtagggcaaacatctctcccattctttgctaaaatccaatgcacaagctctcagcatgtcttccaggacctggtttgtcctttccgtttggccatccatctgcggatgataagctgtgctaaaagcaagataacttcctagggcttcatgtactttttcccagaaatgcgaggtaaactgtgtgcctcgatcagatataatccttttaggcacaccatgaagacacactatcctggtcatgtacaactcggcgagtttagcactattatagtttgtcttgacgggaatgaatcttgccgtcttggtgagtcgatccacaatcacccagatggaatcataccctgttgtggtcttgggcaacccaactatgaaatccatacctatctcatccc

SEQ ID NO: 44856 - DNA, 1521 bp, Oryza sativa
atttgctaaattttgcatataacttatgctttcgaagtttctcgagtaccaatcgcaagtgctccacatgctcttcctcatccttggagtagattaaaatatcatcgatgaatactaccacaaatttgtccaagtaatccatgaacactttgttcataagattcataaagtatgccggggcgttggttaatccaaatgacattactgtgaactcatacaatccatagcgcgttgagaacgtggtcttgggtatatccccggtcctaattttcagttggtgatatcctgatcggaggtcgatcttagagaacaccttagctcctttaagttgatcgaagagatcatcaatccgtggtagtggatacttattcttgatagttacttcgttcagtgaacggtagtctacacacatcctaatgcaacatctttcttcttaacgaatagcactggggctccccaaggtgacgaactggggcgtacaaatcctttttcttgcaactctctgatttgcttcttaagttcctccaactcattgactggcatccgatatggtctcttggatatgggagcagttccgggtatcaggtcaataataaactctatgtcacgatctggtggcatcccaggtaaatcctctggaaacccatcaggaaatcgttgcactacaggcattcctttcatgggtagcatggtgaatatgcctccggcatgttcggccagtctaggatcttgatccatagttgttctcatatccgatccccaggggtggtcaaggtaacttttctacgcctacagtcgattacccctctgttctttgttaaccaatccatacccaatatgacatccagggtctgaggtatcaaaaccataaggttggagggaaacacaacatccctaaggcgaatatgtacgtctatgcaagcatgactcacagttatctcgccctcaggtgagtgtaatatcataggctttctaagtcccactagggttaagttgtgcttttgactagccttcagagatatgaatgaatgcgatgcaccagaatcgaagagaactttaaccggggtagaattgatagaaaacatacccattagtatgccctgatcttcctgggcctcttcagctcggacatggttcacttgtccgcgcccaaatctggtagcggtcctgttagtttgcggagtcttgaatagacctcgtccggcaatagggatagtagtcccacgaacagtcattgcattagcgctagtacggacaggagttttgcgtggatgagggcagttgttggcgtagtgcccatactcctcgcattgaagcagtccacattcttcttggctccaggggcagccagagttggtgtaggggtgcggttctgaattgcaaccggcctgttgaaattgctaggtgcggcggggcggttggtcgccacaatagggggtttccacccagacgaagtggctcccttgagtcgctgaggcactcctaggtgggcgattcatagcaagcctcctctggggctgc

SEQ ID NO: 44857 - DNA, 1618 bp, Oryza sativa
tatgcccgttgggtacaggttttgacctaataaaaaacccatgggtactaaatggagaataaacctaattctattagggtttttacccatgggtaaataggcaaacatgtcaaattgccatccctaattgcattggctacaatgcgtagggcaatttggtggatacctggctacaaacctcacccgagcagcccttatccagatgagcgacaagtggttgaggaagggatcctatggtgcgactgcacggctccaattgcgtgaagagacggacagctagccgcatgcacgatctccacgcgtggaagcgcggctcggctccgctttgctcgttgctggggatgcggactacgcggctagaagcagaagcgacgcatgtcatcaccgcgtctgtttagggtgcttaagattacgggaagtagttggttggtggtcaatttctgagaatgtgaaaaagctaagtttcccagcgtttgattaatttctagtttattttctatattaaataactacagttttttagaatcaaagctatattatttaggggaccttttaattatgagagaaactatatcagctagaagcttcccgaacagactcatttattgccgctttgctcatacttgaccttcgtgcgccagattgccgccaaatcatcgacaaccacagctgccatggcagggaaatcgagggacgcagtagctgccatgcatggcaggaggaggctaggagaaggacctagcctctacagcctctatgcctagttctttgattgtcatgtatattcatcaatttcatttgatttatcgttcatgatgcgtgctgtgacggaggtagtataaccaatataagtctacctttacttaaataaagtaatctattagctacgttttaatgaaaaatatttttcattactataataaatccataaagtcattgatagcatacaagaaaaattgttagtaaaattttggaaactgatatgctagatattttaaaaaaatcacacatagtacaaatagatataaaccaactccattattatgacacattttttttaataattttagtatggagtttatatgttgcaagggtaatcagaagaaaatcataactaatgtccaaactacttcgttattaaccaatacatgtttacaaggagtaaaaaaatacttcaacaatataatatcatccttaacattcataataaaaatgaaagctacattaaacaaggtgcccttcctagttaactatataagtgccatatatatactagacaaagacgataaaagaagtcattatcaacggaggaagtaaggagaagctgtgtgccttcgaattttggctcggagcaactccttgttagcaccaggaatcttgtcaatcttctccccatccttgacgaagaaaaatgttggcactatcccttcgatgtcataccagtccgtaacactctccagctcatcgctgtcgacattgaccttaatgaaaaccgcaccagcgaactccttcgcatactcggtgaaagctggcgcgatgtagcgtgaagcagggcaccgggaagtagtgaactggatgactacgagcttgtgggattgcttggcttggctcatgtgga

SEQ ID NO: 44858 - DNA, 7374 bp, Oryza sativa
cagagaaagaaagaagctcaataatccttgtaagttgtaacctgggaatagaatgaaaaatccatacccgtgatcatcttgttgtgccaaatcttcatccaagtctctccctccagcaccaaagatccaatccacccattgtatatcaaccataagagtgctcggcgtcggatgcttgcgaattgcagtcctcaaggcagactccacttcagttttgtttgattcatcatcatcagtgcccccaattcttgcagagatctctgcaagggcgaccaagtgttccaaccctgtctccttagagtcatactgcttgaactcgttggcattgaaccttagatttaatctttgcacactcggcattgctccttccacaaaagtcatgcatggtgctgtacagacaaacatgaagtacttagagacccgaacccctcattcgcagcgacgattctttgcgcaggcgctgttcgaacaagcagcgaaagagcagtgagagatcccagtcctttgagagtgtcaaggtcatcctgggaaatttgcatgactgcaatgtttaaaatgcggagattgttgagctttccagtccatttggggatgctggtgaagatgtacctgtgacagtgagggagcagatcaagtagtacaagacgaaggtgcaacaaacactgtgtatgaacaatatccaataggacagcagttgctcttgcatctgcttccagtgtctgcaagtgttgtagtcttggatcttctctggaggtttaactgtgatattacctgttatcttcagatatctcagttgtaacagttcaggaatgcttgtgaggtcatagcttgttttctcttgatcagcccaaaagcaaagaatcagaactcgaagaagcctataatctgcaatggaaggcatacacttgacttgtccgaaaaatgccatcgatcgaacttgtgagagtctcaaacctgctagtggtgttgtatcatgtgcattgctgaagtgaagcgagagtcggcgaaccttgtcagcatgtcttactgtcgtctgagaatgatccaatgtaatgctgaaattctcctctattgacttacacctgatgaaatttaataccatgtggtgcactacacatgacaatacctcatttttgcagttaacatctactggttggaccaggcccctaccaacaagttcatcaaaatagttccctgcaacttcttccatgactttattttctatggaattgatgaaaccttcagccatccattgcctcaccaagttggccttcctaattatgtagtcctctttgtagatgctaaggtataacagacatgctttcaaacaatgaggaagattattgtaaataaggttgagtacttgcctcatcccctgcaaagtaggatttttcttcaaattggaagtagtcaatgatttttgtatgtgattccattgctgcattccatctaacagctggcttttaaaatgtctggctgttatagttattgctagtggcaagccaccacatttttttatcatgtcatgagaaacttcagtaagatgtccaggaaattcatttccttggccaacaactccactgaaaaacaattgacttgagacatcatcacccagtggatcaatcttaataatgtgctctgagttatatccacagcatgccaaagctacaggttcaatttctgttgttattagtattctactgcaactattattatcaggcaaaccacggctaacaatatcccacattgatgaagcccataaatcttcaattatgatgaagtacctgcagaacatttagtacttcgtaaacattaaacttctaatgtacgaaaaaataaatcatatttaaaaagctatacgtgggatagcatgctgaatttaaaaagttgagtgcaatttcattttatcaactttgcaaacatggtgaagacatgttctatatcttgtaaatttcagaaattaaatttaaccacatatctaagagcaagtttaatagtatagccgactactagctccaaatcatctagagccaaatagccaattcatacaatagttgcttactatactattaatacttggtcctacctgtcatacacacattacgtcttagagtccgtgctgcagctggctacagatctgtaggctgctgctcttctctctcttcctatatctctttaaaatatgtttatagctagcttataacctgctattgtacctgttcttagacatggaaaaagacacgtactcctaagcaaatactctctcttgtttttaatgtttgatgtcaaacttttggacatatatatgttagatcatccatcttattaaaaatataattatcatttttttaaatttattttatcattaaaagtaatttaagcatatattatatttttcatatttgtaaaaaatttgaataaaataaatggccaaacatatatacaaaatcaacattgtcagacattaaaacaagaggcagcagttaaattgcaccatttttatcactgtttcgttttagttatattttaaattttgtttatgtacaaatacgattgagtttagtctaattcttttttgaccgaacaagggaggcccttacgactattttttattaagtaaaaaaaagttcttgtaacaactgagaaaatgaaaagaaaataaattacaacttactgctataagttaacatgccattgtggtagtttagtctaaaaaattataacaagggtatgaagcatgtactttcatttacatttagtaattaaaaatacaaacaactttgtagttgttctactagtagtagaaataatgtactagtagtttagtcgcctaaaaaaaataacaagggtatgaaacatatactttcatttacatttaataattaaaaatacaaacaactttgtagttcttctactagtagtagaaataatgtaaacactttacctttattttttcatgcaatagaccatatctatttatattaacaactcaattgctgttagtagaatgaggtgggtataataattgtttagattaccagtataattcatggctcgatcgaatcgtatctactaatagagggcactataaaagtaatttaaaatattattggcattgtcgagtaaattaaattcatatgtatagttactaacttaattactatatgaaggataaaaaaggggaaatttgagaaaatagtttgtaaattcatgaaaaaaatactagagatagatgtagacatgaattaccttttatcttgcaaatgcgtccggatagtttcaaggagtcgatcaacctcccaaacatccgaagactgatgctgatgttgtggccgcagctgtgacagcatgtcggtgaggatcttcgtcatgtcaggcttccggggcgtccgcacgaaagcccggcagtcgaacggcgcatccaaccgccggccatgcagacgatagaattctgtggccagcgtcgtcttgccaacacctccggatccaacaatggaagccaccttgagcttcggctcgccgtcggccagccaccggacgagcttttgcatcgaaatatccctaccaacgagctggccgtgcacagcagcgtcgtccatcccgaacgtcagcgacagaaaccggcggcgttcgttgccggcggagtcctcgcgatcgtcgtcgtcgacttcttctctcggcctcgagctcgaggtgcgcctgccaagatggtagctctcctggcggcgaatggcctccttcacgcgggcgctgaacagggtgacctcgtcggcgatccaccgccgccggttaagctcccctcgaagccgggcgatcatgctgctgatcatcttcttggcaccagcagtgctactgccatcgccgccgccgcggtggtggaagagctgggtcgttagctcgtcgaggaagtcgtcgacgtcgtaggagagctcgcgaacctccttagcccagcacgccgccgtcgagtctggcggtggcgcggtgtctgacggcggctccacgaggaggtagtagtcatctagcaggtgtcggagatcgcctctgaggaggaggatcttcttcctctcccccttccgcagcgacgacggttgcgcaggcggcggcggctccggcggctgcagcagcagcgagtcgagcttgctcgtcagggaccgcatgatgacaccctgcgatgcactgaccgccggcgccatggatggagacctctgcagctcgccggcgctagctgaagatcagatcagagctagtgatcgagattatgcctcgttagttgctgatttgacagcatggatcgcccaagagtacaagaaattaactcttgaaacttatcctatctagtaagaaatcatgcagagaggctgcgctgcaaatgtagctctgccatagccttcaaaggttgatgtggaaagaagtaggcaatccctcgtctctttcgtcatagggagatactccatccaaatccaaatgtattaagcatatttcattgttttgattatttttttccaaatgagatgagcttattcatatagtctccatgcatccgagccttaaatgaagagagtctcttttcgttttactgtgtatgattaaattgttgaccgaaacttgagctgccatgcattctccaacccttttgcatgcatatgaaaaagtttgttacatgggagtacaaatcgaatgagttaattttttttcttggtctcgatgataaaataaatatgcttacgatctttgcatggaccgagtagctaattaatggaataacttttcctactttggaactatgacgacttggttctcgcttgagagtaacgttgtacgatggtaactatataattagatgttaggttaggccaaactccaaagaggataaagttggaagaaaattctacagaggagagcccattggggattaaaaaagaaagcataactaagggcatttgccctggaagcaactcttgattgtagccttttggataaaagcatgccactgagttgagagtactaatcctacagtacttatcttcatagtagtagctttgggttagcaacacttccattaatgccctctcccttgttcccatggtcaccgatggtgctgtctccctcgtcatcaccggcctatgttgttaattcttggctgccactacctctcgagtagatgccatctactcgagaggtagtggtaaccaggatcaaggtgctaactaccacattgaattcaggcacaaattcacagtttgaccattttgtagctgttatagaggtagtcttctttgctacgatgtctcaatagcattagagttacgtctcgggaacaatgtcttccttacaataacggcatcaacattttccatccccgacacttgaggtgccactatctctttctctgtatggaccacaccctctcttcatgcggaattggcgacttgcaaaatgtcctccgaatccaaagctacacgagataccccttcccctatggtgggatccaagcctacacaaaaatgtattattgtgagttctctaaaggagatgggggtttgtgcgccatgggagaggggaggggggacgggttagctttgacaggtgggcctggcgactttttaatatttcctgtacttagtgttttggccatattgattccatgcaggctgtatgctgcctatgatttctacatagcatgtgagataagtggttactcattcctatttcttgtcccgtgttttataaacctttcgaaattgttacaatatctcccaccagccttatccacgcggtatgggtataacataaagtcaagaaaaaatttctcttttttaaaaaaactgtagcactggctaccaaaactcagccaaatttatgaattttctttctattctttcaaaattctaatttgaaatttaaattctcaaaaaaaagataaaacacaaaaaaattgctgaaagaagtgaaaattcaaaagtggtatttcgcaacctgctagctatgtgctgacaagttagcaatcattctttcatcgctttagcaaagacgatcatccattggcctgtaatgtgacgataatatatactccctccgtcccataatataagggattttttgaccactcgtcttattcaatttttttttgaaattattatttattttatttgtgacttactttattatctacagtactttaagcacaaatttttgttttttatatttgcaaaaaaaaattgaataagacgagtggtcaaacgttacaaagcaaaaactcaaaatccattgtattatgggacggagggagtagcagctagtggatgctaacaaggaaagtagcaagatgcggatacccttgataaaactggtataatagaatactacaaaggttgatgtaacctgcgaacctgcttttaattgcaggcaatgagtcagtcaagcactatgaaaggtcttcttaaaaaaaaaaccactatatggaaggatgcctgtgaagattatggatacatgatacccacattatctatatatgtatccaactgctaatagaaggtgtgctatatttgtacataacttggttgctagggtttccttgccggttaaggcaggaccgtacacttcgattgggtttatctcttgtaatactaaagggaacttaggccgaatccgactgggtttcatacttgtaacctctgcccctaacctatataaggagagccagtaacaccctcgaaggacaacatacaacataagtcaccacaacaagatcgtcagatcaatacaacacccgacggattcaatccctcaacaggagtagggtattacttctcattaaaaggatctgaacctgtctaaacctttgactccacatccatccacttttggacttcgtaccactatgcaggatcaggtcatttctgacagccctaaaccctcacctctgacgggttcaaccttggtcaaagataagtggtcactgatgacgttgagtcacctgtgacgggtaaaggcccgtcagaggtaagagtcacctctaatggtccccaactaaaacccatcacagatgagggtcacctctgactggtcccaacaaaaacctatcatagatgagagtcacctctgatgggtatatattttaacatgtcactgaccgtaattacgatccatcactggtgtgaaaaatgggaaaaaaaagtaataccgtcctcctaggttaccatcacattcatttggacggtcatagatcgcatctggcattcacaaataaaataaatcatcaaaattcctcttgttcccatggcattcatcccaacaaaaccacatgaatgtcaattaccagaatcaccacatgaattggaatcatccatcatagaaccaagaatgtgaacaaca

SEQ ID NO: 44859 - DNA, 1583 bp, Oryza sativa
actgtctgtggccgtcacccgggaggagccacgccggcacctgctgggaggaaggagtgaagggggagagggggatggagggggaggtctaaggaggagtgaggccttttttgcagccggatgtctttacattccacctgcaaaaattaattttcacatgcgtggtcttaagacgcccgcatataaaaataacccttattttgtaggcataccttttaaaaccatgtatgtgaaaatcgattttcgcagacaggactagttctattcaacctttagctatttttgtaaatggtgatttttgtagtccgtctggaaaaataaaatcatgatgttgggaaaaatagtttttctagtggtgtgattttggtttcacctgtgtggtaaatgcatgattaacatcttctagtcccacaagtcaaaaacccatgcagtgcacgagctagctactcctgaaccattgatctcatttgatcaagtgtttagatctatttatactaccacgctagttagcagtagcagaaacatggaggaacattactttttaaaaaaaggtgcggaggtgtcatgcccagaaattcgctaactcgaatttcaagtagaatgtgtattaaaatccctgtccaggaccagccagagtacacaaatgacaatttaataaacagatccacgtcttacaaaaacaataaaataaatcttacaaacgcaacggaaaaaacaaataaattagacttaatcttcacgaccaaaagcatagcttcctccataaaccacaagcaatcctcgacgttcggaacaagctcaatcctcgaagaactcaccatctaaaccaatctctgcctcggggggggggataaagcaagactatgtaccaatcaccgtactcaacaagtcataccagcaggaaggtatgatgcaagatattctcaaaggaatggctcattggatatttgcaataaaagcagcatttataaatcatattttaaataagtaaaacaatatatataattaagtagtattaaatcatcactgtcgaacgctaaagccacattgtgacaggcccaaccaaatcacctgaactacaccagttttacaagtcatattattatagtgagactaatcacggtgagctagttgaccgcctaataaccgcgggcacggctattcgaatagttttccacaagactcattccacacatgttaccatgcctcgaagtactgccacgatactgcaaagggggaaatcatgacaaaacccttcatataaccctccctaatcgaacatacccacctcaggtttcaccccctccttgtgccaagtcgtgcagtcccctctcatgcctaggtaaatccggaaacaacaaagattaatatccaggcccgaactacaccattgcctctacccttgccatggtatgtcagctaggttaagttatactctagatttagcctaaagcccatgctggttatcatcatataattaaggactaaattataatgaatcccattgtgaactagttgatctaagcatggctaagcattcctaaacatatcatctagtcaattataacccaagttatcaatag

SEQ ID NO: 44860 - DNA, 2336 bp, Oryza sativa
aggaaaaggaactttcgcaaatagtttcatttataaaatatgtccttaggttttatccacttggcttatcctacagtcgagacggctctgataccatcttgtcgcgaccgagaaaattgcattttcccgaacgctagtgtattaatccccgtcccaggaaaagccggggtacaccatacaaacatgatataaaatacacatctttattatatcgataatatttacattattacaaaggcacttaaggcctgacaatcaaaaataaacagcagcggattagcgggcctacggctccatcttcacaggcgctcaactggggtgtaagccaagactccacctaagacatcttctccaaagcttctcttactgaaggggggagaaagatagagcaagaatgagtacaaccacagtactcagcaagccacaccggcggatgcacgattaatgcaagggggtacaaggggtaatgatataggggttaagttttgcagaaaacggcatttaaaaatcacttagttgcccaaagccattttaaaaagacgatcctagagctacacagtattattaatcaaggtcgtgaacccgcacgaacctgccttaacccaaggcctacgatgattcagaccgaactggcaacccgaccctgggtcccagctcgtcccaagccaacccaggccaaccattccacattttagctgttaagcaaattttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagttcccaacccatcctagccataaacaagagtaccgacccaaccccacctacggccggaacctccgggacaggtaggcaggattgagcccctagcagcaggacaccagccctgtaccatgacatctcgactaccgggccacatctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgagcttaatccttatagtacccgaggtacgactagcaaaacccaaccacgcacctcgagcccagcctaaaaccattttgggggttttgaatagagggggaggtgtgtgtccaattccaacaaaagccaaccattccaaagtatccaagtgatatgaatattcccaaagtctaaagttataaaaccacctaatgttgcctaattaatcagcgaagcatctacctaaattcatactagtggaaccatgaatagagtacccactagttggggttttgtttaatctagggtgaacaaggtaataatatcaatagcaataatattaaggtcataacaaaggtaaataggcatggccaaataaaacagtgataacgcgggaatttaaataaagcgataatgcaataatttaaatcaaaataattttataaactgggattcaatatgttcaaggatgatgtgacttgccttgctccgggagaacggccttccgaaccttcggcgacgaccacgaaccacgcttcgggaacctccggaacgacgaaagctacgcgaagcacacaagcaaagctacaagcctataaagaagcaataacaatacataaaaagaaagcacacggttctttaggttataacaaacattaggagacttgaacgggtcgattcagagttcgtatgaccaagatatgatcatccgaagtttaatgctgttacatggagatttgcggattattgtaatgaggttttgcaactataaaacatgtggaagcgctagcctggaaaagacaggaaggctgcgttgttgacatgcggaccccacatgtcaacctaaaggaccacggtagaccgagtacacagagacggtccacgggtcgacggaagcggaccccatgtgtcaaccgaggcgagtggccaacaaacggactccactagacaccacacgggctgcacatgtggaaaccatgctgctactgagcggacacactaacacggacaccacacggtcaccacccgcacacgtgaacgactaccgacaccggtacacgggtaccggggtcgacaaccgcacaacgggtacggggcgacaccgaaaggacgagggcggtgcagcaagaggagagaccttaccaccacgcgacgaggcgtgagaacgacaac

SEQ ID NO: 44861 - DNA, 3935 bp, Oryza sativa
  unsure (1)..(3935): unsure at all n locations
cgacgggaggacgacgacgactacgaccgggaccggcgaggagacgacgagggcagccggcagcggctgcacggaggcgaggacggcgtggaacacgccgcagcgatgcccacgacggaggcggcgccgcgagacgacgaaccgggcgaggatgaacggtgaagactgacgacggataccggcggtgttcggccgaaggggaagcgatgccgaggacgacgtcgcggctgcgatgccgaagatggtggaggtgtggccgaccggtgcacgggcgaggagggacgggcggccgaacaactccggcgaggcggatggagaggttcgcggcgatgtgcggcggcttccgggcgaaaccgaggggtggacgaggtggagggctacgtcaccgtgccgagggagggacggcagcgccggctgatgcacgggcgcggcggaagggggctgccggaggagacgtcgacgaggaggaaggagaggccggcgcgggcgacggcgttccggcgaaattcgggcgacgccgtggcctggccgggaaagaggacggcactccggtgccgggagaggtggtggcgacgtcggccggcgcacaggggacgcggcagaggcgggcggaggcggaatcgtggcggcaacaccacggttgccggcggggaggcacttccggaggtctccgcggaaaacagagggtaggccggcgaagaggaggcggctgcgatgctggaggaggcgacggcgcgaccggacggcgctccggcgaggagggagaggcggctggaggcggccggaggcacgggagagagaggaggactgcggggagaggtgatacgaccacggggagactcgggatgaggttaaaacgatagaacggaggatggggattccattttatgggatgggggagggagccggccacgggaggagcgggaacggcggcgggaaacacggccggcggcaatggaaggcggccgggaatggcgcggccgttcccggcgattgggggcgccattcaaggggaaattaagggggaaagagagatgagggaaaggggattaattccccccaattaattttggaatccaacgcttaaatcgcgcggattcgaggaaggaacgaagctagggttcacgggagaagagagagnagaccgggcggaaggaagaagacgaccggcctggcgcgtgggccccacgcggtcgggcgctcggtcagcgcacgcncggcgtgcgtgcgcgggaggggagcggctcaggcaggggcacggcgtgggccgggcggccggcccaggaggagaggaggggaggggtggcccggggagagagggaggaggagggagtgggccggggaaggagggagggaaggagagggagagaaaaagagggaggagagagggacttcgggctgggcttggcccaaaggaggaagaggatttatttttaggtttttctttttaataaactttgataattgtttttgttgcttaataattatttccggtgttctgaaaattcaagtaaaatttgagggctcattttagaccaaggagaatttaacaaaaattctccgggccacatttgaatttttcttgtacgtattttagtgtttgccaatttcttttcgaattttaattaattctattattccttttggaaaatgatttttatttcgggatgaatttatcaggacgtgacattggggaatcaatatcctgaatgagaaaagaagggaaaagaaaactcttcagggaaaattggaggagctagataggaaagctttagaagatgacttatcccctgaagaatggaattagagatatgaggtggaaagggatctagaacacacttataagatggaagagttgtactagcataaaagatgtggagaacaatggatcttggagggggataggaacactgagttttttcatagggttgctaatggcaggaaaagaaagtgctcaataatctctttgatggatggagatacagagctgactagtaaagaagatataaaaaaaatcatattgtctcttattacaaaacccttttttagagctgatgttttaactatacccacttggctcgagatatctggagtggcggtctgaacctttctgctgacaacaaagagagtttgattagacccttcaagattgaggagttagataaggcgcttcaggaggcaaaattgaacactgctcctagtccagatggttttagcatccttttttgcagagcttttggcctcaagtgagaaatgatttgtttgagatgttgcttatgtttcataatgaggagttagatctcaagagactgaactttggggtgatttctttgattcccaaaaacaattagcccacagacattagacaatacaggcccatctgtgtgctgaatgattgcttcaaatttctcagtaaagtggtgaataacagactctcagaggtagctaatgatgtgatttctcctacccaaacaaccttcattcctaggagattcattcttgagggctgtgtgacaatccatgaggtgttacatgaaatgaggactaaaaatagagaagggattattttaaaaattgattttgaaaaagcatatgatagggtcaaatgggagttcttgatagaggttatggaaagaaaaggtttccctcccaaatggattaattggattaagtcttgtgtgataggggccgggggagggtctgcattaacattaatggggataggactgagttttttagaacctttagaggccttaggcaaggggatcccctttctcctctccttttcaatctggtcaatgatgctttagctgcaatgttggataatgctaagagaaatggagttattagtggcttggttcttgagattgttcaaggggattacccatttacaatatggtgatgatactgctcttttcattgctaatgatgtctctcagattactggcacaaagtttatcctttattgctttgaagagatggctggtctaaaaattaattaccacaagagtgaggttttcactatagggttagaggaatctgatactattggagcttctcaaatgcttaattgtcctataggtcactttcctatgaaatacttgggcttgccaattagccctgagaaggttataaatcctgattttgatttcttaggtcagaaactagagaagagattgggaaattggggaccttgtagtctttctcatgctgggagagctgagcagatcaatgcttgtatgtcctctattccttcttatgctatggggttctatcttcttcctgaaggggtgcatcagaggtttgacaagataagagggaggtattactgggctggtaacaaattgaaaggtaaatatcacatggtcaaatgggaagacatggcttttcctaaggactttggggggcttggttttactgaaacaaggaggatgaatgcagctctgctggccaagtggattattaagttggaatccaatgatcagagtttatgccttcaggtgctgaggggaaagtatatgtaggaaggtggtatgtttcagtgtaaatctgggaatggttctcaattttgaaagggtttgttgaatattagaaagtgagtgcagcttggtgctgaatgggttttgggatgtgggaatcatatctatttctaggaggatttctggttacacaattgtcccttgtgagttatgtatccaaatattttcaaaatttgtaatcaacagaaggtgctggttgcacaggtcattcagagaggtgtggagtgtctcactttaggaggtcctttggccctatagaaagtgtagaatgggacaacctgaaaaatgacatagagaatgtgaatttgagtaatgagcctgacaagccgatttggggtttagcctctaacagaagattctctaccagatcactatatagagctttaacttttagag

SEQ ID NO: 44862 - DNA, 7037 bp, Oryza sativa
  unsure (1)..(7037): unsure at all n locations
ccacccctccgtttccaccgaggatcgccggagcatcgccgtcgtcgtcaagccgatcgtcgccgccgcttcatcctcgtcgccgtcgtcgtccggttgtcgtccgccgccgttcgtttctcggtaaggttcgccgcgtcgcccactacccgttggtgtcctccgtttgcgccgctgcgccgtcgttcgccggcgagcatgcaaggctgagccgccgccggtgatgacgtcaccgctgacgtcatcgacgccgtccgccgtagaccacggtagaccgagttgatctcggccgtccgttttggataggatagatctcggccgcccgttccgtagaccatcgccgtgcactcggtccaccgtgagccgagcccactgacgcaataattcccttttccgtttcaaaaataattctttattgcgtcataattcaattaaaatccatataaatgttttaatccggtttaatctttaaaaattcataactaattcatattagctcggttttagttggttcaagtctctaaagttgtataaaataaagatctacatattaaaattatccataaattgaattaaatttatttaatcctttttaaataggctttaattagattaaatcttgtaaaattcgtaattatttcatatgaagtcagaatgagcccgttcaagtctcataattcatctaaaatcatgatctacacatttgtttactttatatgtattgtttatttggagtttcttagtctttttccttgttttgcgttttagcttgtcgtttccgtcgtttcgaaggttcgcgagtgcgccggaagtattcaagaagattaattgaagacccgttattgcaaggcaagtcacacagatcccaaacacagttcctttgagcatgctgatcctatatttaaattctctatttatttcaactgtgcatttattttttaatgtcatcgggctctgtagacccccgtttttataacaggaatcaatcgtgtaaacagtaccatttccctggatcaagtagtctggtacacacgagttcatagccgagataccaaatgcacatacacgagagtctagtgcgaattattacaacataagtctgcaggcgtagtcttaaatcatcagaccgatgtcacatcctgattttttcgttttaggatttataaattatttaataaattattaatagaatttatattaaatgttctttaatttacaagaaaagttaaatgtgggaaataaaatttcctaaatataaagcatggatggatttaatttttattaaattctccatgattaagtcaactctctgaaattttctcggatttttcggagctcaattcctaaatgatacaaagaacagttcagtaattatttgatcattaatgatctaattatttttgttaagagcttttcttgtttaaaaatgcttaaattataaattgttgtttaaaaggaattgttagaaatgattttaaaagcctaaaagagaagatctaattttaatttgttaaatctcaatataaaattgggctagataaaattttgttaaatactttgcttaattctataattcctagatttttctgggatttatttgagctaaggaagtatttttaataaatggaattgcatttcatgaataatttaaattgaaaaaggtttttaaaagtctcttttggctttgggccgaaagtcggcccaagtcggcccagtccgccgagccgccgctctcctctctctctcagccgctgacaggtgggtcccacttgtcagggtcgtcgtcctcctcgcgccgccgccgccgcccgaaaccctagcgcgagccgccgccgtctccttccaaattcggccgatcctttccttctccggccgaatctttagagggaaaatgatccttgagatctcctcttccttttctcttttggaatcatcggctaaaatcgtttggaaattcgtggattcgagttcgattcggatcggcctctttcctccgaatccccgatctttccatcccgccgccggtcgccgtgggccttcgccgtcgccttccaacccctttaaaaggacccccggtgtctcctctacccgccgcctctctcgccttcgcctaccgtcgtgtgtagcaccctagcctcgtgagcttttgcgccgccgtcgtcgccgctgctccagccgtgtgccgccgccgtttcagctatcgccgtcgctcgggaaggtcgtcatcgtggtcgccgtcgggatcgccaagtcgtcgccgtcctcgtccgcccctttgccgccgccggagaccgctggagcaccgtcgccgccgtcgacccgatcttctccgccgctttgacctcgtcgccgtcgccgtccgttggtcttccgccgctcctttggtcaccggtgagttcgtcgtgccgtccgcttcgtcccggtgccttccgttcacgccgtcgcgccgtcgttcgccggcgagcgtgcgccgtccgagctgccgagccgcccgagccgccgccgccggtggtgacgtcatcgctgacgtcatcgtcgctgtctcccgtgagccgccgtggacccgatcgatctcggccgtccgttttggatagggttgatctcggccgtccgttcccgtgaaccgtcgtcgtgcacccggtccaccgcaaaccctagccgctgacgcaataatcctccttttccttttcaaaaataattcattattgcgtcataattcaattaaaatccatataagtgttttaatccgatttaatctttaaaaattcataactaattcatttgaactcagtttaatgtggttcaagttgcaaaaattatataaaataaagatctacatattaaaattatccataaattgaattaaatttatttaattctttttaaatgggctttaattagatttaattttgtaaaattcataataaattcatttgaagtcagaatgaggccgttcaagtctcataattcatctaaaattatgatctacatgtttgtttactttttatgtattatttctttggtttttattagtctttttcttcattttgcgtgatagttagtcgtttccatcgttgcgaaggttcgcgagtgcgccggaagtattcaagaagattaattgaagaccgattattgcaaggcaagtcacacagatcctaaacacaatcctttgagcatgttgatcctatgtttaaattctctatttatttcaactgtgcatttattttggaatgtcattgggtggaattaacctattctttgttatggcccttttgttcttgattactttattccttgataccttgggatattataacttgactagttgagctttatatattggttcagctagatattagctatgattgcttagccatgcttagaaacattagcacactattgggataacttatgactcattatttaatgatggcttaatgatagttcacgatggtcaatcgtgattggttaattaattacttgccaactaaaacttgataatggtgggttgtgagcacatggttttgagagtcgtgctcatgacaattaaggaccggttcgcgagctactattgtgaaacattaatcgtgcaaccacaagccagcgtgggcaacggctttacctttgtataacatgattcattgcggagcaccagactgagaagtgcgggaataagcccacgggggtcgctgggagtnccatgcttgtttataaagggggtgattatgatcaaggaatggtgcactgtggtgagttgtgttgtacaaagggtattgtcacagcctctattcgggtactttccagtatcgcgacgcatggtagacatgatgttgagnctgtgtcttgtgggtacagtggtacacctctggccagagtanaactattcgaatagccgtgcccgcggttatggacgagttgagcaatgtttttcgtgattagtctcacacctctcacaataattatggatgttataactggtaataatttgcttagctccggtttggaatggataattcctggtttggagattagatctgtacagccgggtatggttgttcaggatggttgggcctgtgcagcatgggtgtgctgttcagtgttgattaaaatttctgattaattactccactgttttacttctcttaaatgttttgttaaatgctgcttttgcaaatgagcctatattatgccatcctttggtatccttgtgcacttgcatatttgctgtgtggcttgttgagtatgtcatatgctcattcttgtaataatcaatcaacctcagttgaagacaagttgcgaaggagaagacgtttggcttataccccagttgagctgcctgtgggagtggagccggagctgcgctagattttattttccgctgcagttttcttcttggtgaggactaagtgcctcttaagtaagtacttatcgttttagttaatttgatgaatctgtatattaaattgtcagtttgtgtacctcggctgattcctggacgaggattttatgcacaaataagtttggaaattacttgtgaatttccgggcgtgacaagttggtatcagagccatctcgactgtaggataagccaaatggtcaaaccttaaggactaattttccgaaaacatgatttgtgaaagtttctcctttcttccttatctagaattctttgcaaattgtttcattgtctacttccctctctctttcaacttgagtagttctgaaactagttgttgaaacttgaagacgccaatgtggtctacttatggaggttaagtcaagtggatcgatgaataagaaggtgatggtcgatctgaagtgcccagatgtcaagatggaatgaagtttggatcctaccttagaacctatgccgccaatctatccttgaagaatagttagtagggaagagcgtttgttgtttgctttgtttgtaggtatggttgcattcccatcattggagtagttcattgatgagtgtgtaactatactaggttgcttgcttaatcaacttgaacaatataatggtctacgcacaccagatcagtggtaacctggttaaggtcttgtctttagtgtaacctctctccttctatcttctctaatatgcaatagatggtgaacactcgcgccagtggaagtggaaacaataacaatgaagggaacccaactcttgctcaagtcctggctcaacagactcagttaatgaacatgatgatacagcagatgcagaaccagctcaaccaagggaacaacaatgctccaccgccgcagaacaagttaactgattttcttcgtgtaaggccacctaccttttctagcactaccaacccagtagaagcaggtgattggctacacgctgttgagaagaagttggaactgctccagtgtacggatcaggagaaagttgttttcgcttcacatcagttgcaaggacctgcatcagaatggtgggatcatttccggatgaacagagcagaaggacaaccaatcacttgggaagagtttactgaaggattcaagaagacacacatacctgtaggagttgttgctttgaagaagcgtgagtttagggccttgaagcaaaaggatcataccgtggcagagtatcttcatgaattcaatggcacgttatgctccagaagatgtgcgtactgacgaggaaaggcaggagaagttcttggaaggcttaaaggatgaactgtcagttacgttaatctcccatgactatgttgattttcagcagctggttgacaaagcaattcgacttgaagacaagaagaacaggatggataaccgtaaaaggaaaatgattgtattccaggaggcacaaggtagtagccagaggcagcgtatcaagccactccaaattggtgaatcttcttccgctggtcaaggacagtcgcaacagttgaatatcgctggtgagatcaaatcagagactaatgaaagcaatgaagttaacatcgagcaaataaatcagccgatgccagttcagcaggatcagtctcgggagaataacagtagtagaagggagcagcaggtatgtttcaactgttacaagccaggccactttgcaagagagtgtccgaagccgaagcatcagcagccgcaaggtcaggtcaacaacattgtcgtcacaggagccaatgcagtaccagttgtgtcttcaagagttgcatcttcaagtgttacagctcagccactagtttcaaagcggcagtagttttctataaagccttagaataattatcggagttatggaataagatagactgcagtttacctatgcctttttctttctagccgttccgaatctcgggacgagattctttgtaaggggggtagatctgtcacatcctgattttttcgttttaggatttataaattatttaataaattattaatagaatttatattaaatgttctttaatttacaagaaaagttaaatgtgggaaataaaatttcctaaatataaagcatggatggatttaatttttattaaattctccatgattaattatactctctgaaattttctcggatttttcggagctcaattcctaaatgatacaaaggacagttcagtaattagttaatcaataatcattaatgatttaattataattatgttaagtgcttttcttgtttaaaaatccttaaattacaaattgttgtttaattggaattagtagaaatgatcttaaaagcttaaaagaaaagatctaattttaatttgttaaattctaagataaaagtgggctagataaaatttcattaaatactttacttgattctatagttcctaaatttttctgggatttatttgagccaaggaagtatttttaataaatggaattgcatttcatgaataatttaaattgaaaaaggttttaaaatctccctttttgttttgggccgaaagtcggcccaaaagccctctctctctccccggcccaagttagcccaccagccgagccgccgctcgcgcgcgcgctctcgctcgctgacaggtggggcccacctgtcaggaccttct

SEQ ID NO: 44863 - DNA, 4309 bp, Oryza sativa
tggcatgagaagtttgacaccacgcttacagctgcaggctttgttgtgaacgaagctgacaaatgtgtatactatcgctatggtgggggagaaggggtgatcttgtgcttgtatgtcgatgacatactgatctttgggaccagtcttaatgtgattgaggaggtcaaagactatctgtccaagagttttgaaatgaaggatttgggagaggctgatgttattcttaacatcaaattacaaagaggagatgagggtgggattacacttgtgcaatcccactacgtggacaaggttttgagtcgctttggatatagtgactgcaagccagctcctactccttatgatcccagcgtgctattaaggaaaaatcgaagaatagcaagggatcaactgagatactctcaaatcattggttcattgatgtacttggctagcgcaacgaggcctgacatctcatttgctgtaagcaagctgagctggtttgtctcaaatccgggagatgatcattggcaggctctggaaagagtaatgcgctatctaaagggcactatgagctatggaattcactataccgggtatccaaaagtactagaagggtatagtgactcaaactggatatctgatgctgatgagataaaagccacaagtggatatgtgttcacacttggaggtggcgctgtttcctggaagtcttgcaagcagaccatcttaacgaggtcaacaatggaagcagaacttacagcactagatactgcgacagttgaggccgagtggcttcgtgaactcctgatggatttgccggtggttgaaaaaccagtgccagctatcctaatgaactgcgataatcaaacagtgattattaaagtgaacagttcaaaggacaacatgaagtcatctagacacatcaagagaagactgaaatctgtcagaaagcagaaaaactccggagtgatagcattggactatgtccaaacggctagaaatctggcagaccagtttaccaaggggctaccacgtaatgtgatagacagtgcatcgagggaaatgggcttgatacccacctaaggttgcataatagtggaaacctgtccattgtgatcggagatcccgtgaatttggatggtgaaacaaactattgtgtgactgagagaagagacccttgaaaagggctcatttccatgatgtgcttctcttctttcctgcatggtaggatggcttatgtcttaatgtgatccgagtggcttttccaagcagagatgttgacctgcagaacatctcagaaggaacacacctatatgagtttgactgctagtcacagtctatgaggtttgggcaatctctagatactcatgaaaggcctggagtttgacttatatgctccaaacagaggggatgcgaacggcagcccagtaccagtcaaggttctgagtgaaacctgatcacacaaaacttacaattcaaggcatagtccattgttcagttgtggtctgatgtagctcatttcctaggtggaagttcaacttaacagtctccaccaaaaccctggtatatcaaacaggcacaacattgagaacatttcttatgagccttgaaatttggtggggattgttagaataattgggctaggcccaatttataataattaaatctcaaaggcccataataaatgttgaggataataataccacctcaggatttaagcgagaaatatctcaacctaaatagggagttattagaggctccctgttgaccagttgaggtaggggtcggaatgccacacgcgcgcgcgcgcgccgggccgggccgtgggcgtgggcgatggcgagggcaaggcgaggcgtggcgtggctggctggcggtgtgcgtgcgtcacgtcacaatccttttgcagccactaacccacgttcccacgattccctccgcaacagcgcgtccacgttctttctcctgatagataaggaggccgcgagtccgatccgacttcttagcttttttcccggtgttagtttctccttctccgcgcctgagttgctctcgcttccccgcttctgatctcttgcgcgcacgagagattggaagaagcagtgcctccgaaaccacacctttgcctgagatctgcaccgggtaggcgggagatcaggtttttggggagtgcctcctgcacgactgctcatcgccatgtctggagttgctgctgccgccgctaccggtggaggtggtacgccgccgccgacaggagctggtgcgccgccgccgacaggagctggtgcgccaggaggaggtgccgtgaacgactacaacaacggaggcaattctgcctcaccatccagcggagggccattctcggggtataatcttctcctcctgctactgctgttagcgctattcctgttcccattgttagcgctatactgtgtgcgctatgttcttgttcctgttctacatgatgcctctagcatgttatcgcgttactggtatgttcctgtttctgacattcatgatgcgcatagtatgctactggttatgttaagatcaccctacactgcttatgccatgatcattgtttcaatttcttggattaaaatatgccgaataatgactatatttccaacacaacctagttcatctgcataccgcttcgcttcttctttctcccatgtgtcctgttcatcttcttcccagcgccgagcacatgtcgccatgaactccaagacgccggctgatgcttgaggatacctagttgatattttttttgcaaaaattggaggataggctagagcctgatggagcctacctgctagaatcgccactggccgtcacctttagggtttgggttttgcttattctgtcaagaacagtttcgccgctagatcggtttgtaaggcccgaacttgtgagcttaatcattcatctgcaattttggttgtattcttctttgttcctatttgtgttctttgattcgcaaatagggattagccttctcggcaaggtcgtccgcgtttcaacacgggtgataaccagaggagacatggtgctgcgattgcagggctcaagagcgtgttcgttcaagaagccgaatcgatttgtgtcgcgactccacccaaatcattgattatcagaaccttccgaaagatcgaaccctagtccacgtcactttccacgcaaatagaacaattgtgctattggaatagcgatagcagaactacaatccgcatagttcagaaattcaagtgcataaggaaagatgtaatctcaccatttgtgagcacatagttagaaaataaaacttttcttgctttacccgcatgcaggccagtcatttgttatcagaatagaatgcatcaagaattcgacatacataacatgtataagaataagtgattaatagcctgtaacatgaaatatacgatgatacccagttgcccattgcagataccaaaacacataccccatggcagcttgtttaatataactgatttccaacgagacagacaaacacaagaaaatctttgttagcaatactaatggacgtgcagtgaaatagagggatttgcagtcttcaagcaggtaagagtgtggggtgcagtttgcttcaatccacattatgctacttgcaagattgcctaagaagaattcagactacatgctgaaaataataactcactgattcatcaggtcaatacattaaaatactgatggatcattaagtctacataactagctaataaataaaaatatgtgggcactgtctataattagattcatcacattgacccgcatgattagataccttcagtctcaacagtcatgcatacgcagggattacctaatctgcataataataagacctctcatcaggtactggggcaaaccgcgcattgaggaattctaagggttacaggactgggccgcaccggtgtcatgccatgcggcagggagcagaatacagtgtcttgctagttgctagttactagcttctcgccggtcatccattgttagaagtgcagaagctctgaaatcttacgaaatgaacttggttgatgctaagaagatcactttccctttccttgatccaaaatctcccttttttggttctctgcaagttgcacaagaatcaatcaccgagttgaatctgagcaaacaacgaatcaaatagcccgaagcacatgcccaggcatctagggccaacgccattcgtagatgaagctccagacgttgagcatgacggagagatgaaggtgatgcctatctagagaaagacatacctcggcccggccagcacactgagctcatttgatgttgggaggcc

SEQ ID NO: 44864 - DNA, 740 bp, Oryza sativa
gatggtttgggctagcccagcacacatgcatgacgtcatcaatggcggcagcccaacatctacagtacagcctaatactgttggagcccatgcggagagttcgagagctattgggaaacctgacttttccccaagtttatcccctcggtagagcagtggatttgggtgaagcaaggagaggtgcaaccaaagctagggttccctgcgagaggtgaggaagtccggtgatttggtagtggtgctcgccggatctggagagttccagagcgcaagcgcgaccatcgttcatacacagaggtggtgatggacaagcgccctccaaattcggccggagtggcaagtcaacaagcgaagggtgacggatccgattagaggtggagattaggggaaccgtgatgcgcgcgaagaggatgagcttcgacgccaacttctcgctcaaaatccaacggggaatctaggtgcaagatctcaagggcgtcaaggtggcgaggcagatcgtggtgcgagagcggcggatcgaggtgaggataaaatgcttcgagtgtgggcgtgaaggtcaccatcaggcaacgtgccctaaccctcacctctactactcctgtcacaatactggccatatctcttctcactgtccattgcttttgggaaagaagggtattaagctgtgtgggtttgggttccctgggcaaggtttttacagcctgcaagttgagatttctgatatagagtcggctagagct

SEQ ID NO: 44865 - DNA, 899 bp, Oryza sativa
cttgttttataagggggtgattatgatccaggaatggtgcactgtggtgagttgtgttgtacaaagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatggacgagttgagcaatgtttttcgtgattagtctcacacctctcacaataattatggatgttataactggtaataatttgcttagctccggtttggaatggataattcctggtttggagattagatctgtacagccgggtatggttgtttcagaatggttgggcctgagcagcataggcatgttgttcagtgttgattaaaatttttgattaattactccactgttttacttctcttaaatgttttgttaaatgctgcttttgcaaatgagcctatattatgccatcctttggtatccttgtgcacttgcatatttgctgtgtggcttgttgagtatgtcatatgctcattcttgcaataatcaatcaacctcagttgaagacaagttgcgaaggagaagacgtttggctcataccccagttgagctgcctgtgggagtggagccggagcttcgctagattttattttccgctgcagttttcttcttggtgaggacttagtgcctcttaagtaagtacttatcgttttagttaatttgatgaatctgtatattaaattgtcagtttgtgtacctcggctgattcctggacgaggattttatgcacaaataagtttggaaatcacttgtgaatttccgggcgtgacatgtaccccggctggtcctggacggggaatttaatgcacattctgcttg

SEQ ID NO: 44866 - DNA, 12682 bp, Oryza sativa
  unsure (1)..(12682): unsure at all n locations
agcccatccatcccaagaatgacatctaggtctttggattcgagaagaatgaggttggctagaaatggtgatctttgaatttctattgttatagaagggctgaattgaaccgaagtggagctattccctggggtatgaacccgcatcggtgtgctaagttcctctcttattaacccatgcatcccaacaaacttctttgaaatgaacgaatgcgttgcaccagaatcaaaaagtactgttgcagggattgagttaatagaaaacgtacccagtacaacctctggtgctgcttgtgcctcctccgcagatgcgtggttgacacgagcctggataaaccttggcccggcacgcctaggcttcgggcatttgtcagcgaagtggccaagctcaccacagttgaagcaggaccctggttttgctccagtctccttcttggcttgcgcgggcgggcctgactgtgccggtgccattggtgggcgtggagctgcaccgcggttggactgacctccatggtggttctgactgccactggcgccctggggaaagttgctagggttgaacgggcggtgctgacgaacgatcatggtggtaggtccaccctgctgcctgggagcgaagcgcggcctctggtgacttccctgaggtgccctgaactgtgcggctttcctcttcctgtccatcttgttgcgttgatcctcctgacggattgccttgtcaaccagcctctcaacgtcagcgtagtccccagatatcagttggttggtcagctcgtcatccagacccgccatgaacttttcctgcttctcggcgtcggtgcggacatcctctggtgcatatcgcgcgaggcgattgaactcgtggaggtactctgtcacagtcctgttgccctgatggagtgcccggaattccctcttcttttgtgccacaaccccatctggcacctgcgccttcctgaagctacggcagaactctacccaagtgacttcagtacctggtgggcgggtggccatgtgattgtcccaccaagctgacgcgggaccttgaagctggtgtgtggcgaaagcaaccttctcctgatcattgcattgcaggagattcagcttcttctctatggcatggagccagtcattcgcctccatagggttggtggtgctggagaaggtgggtggcctgacacgtagaaactctggcaacttggactgagggggagggggaccaaactgttgatgctgctgttcggcgtgctgcagcatccgctggtgcatctgctggtgctggtgctgcatcatggctgccatcatctgggtctgatgtgccattacttggactagcgtcggattctcgggaagtggtggcggaccattgccggaatcgctgtggggatgcgccccatcagtgcgctcttcgccgttgctgccctcgcctgttgcgcggctaccattcctggtgtagaccatctggagggagaagcagacggggaaaagaagaaaaacagaagctcagaaactaagctttattacaaaggaatttaaactgcaattgttctgatctgaattaaaacacttaaaaaaaacaagcgaaaatccttattaagacagccatatcataggcacatgatatcgaccgtcgactgaccccaagcaagcaacctaaacacacaaactaacaagcagaagctagacagtcgattaactaatggaaaacgagcctaatgctcggaacggctcctgcggtcggtggagtcgaaggcgtcctcctgctcgtcaccaggtccctctgagcgactcctggagcctggcagataagtctcgccgctgcccgactctgagccactggagctgctgctgctgagatcgcggctgccactgggagtagcagacaaccaacctccgttgccactggctggacccctggcggctgatgctggagcgaaggagagagcggacgcgggagctggagctggagctgcaggaactgcgggcggaactggaggtgctgcgggagctgctgatggaggtgggttcctgggcgcaagctggatgcgcacgggtgccgtcgtcgtcttgcggggtgtggtgcggatccggactcctcctggcgcgggaagaccctttaactgagcattctccctcttcaggcgcgctatctcgtccatcagagcgacgatcctcatgagcttcccatcgttcaaggccttggtcgccttgtgcaggtccgagtgcatcctatccaatccactcatcacagcacacatgtgaccaaaggtggtgtcgttctggccggttgtcggacggaaggtgctgacatcatcaccactggctcgacgagggtgaaaacggtatgccatgtcatggaagatgtagttgtggcgctcccgtagtctggccatcatcaggtatgctgcctcctgacaggcgtgatctgctgtgcctccggacgcctcaaccaccatgttagctaggcaggtacccacgtagccatggacctccaagcgaacacggtgaggaagctcgccactgagcggtggaaccgtcgtctactctggcgcgttggggtagcccaccaccagcgtcatgcgtgccaactctgccacaaaatcaatcatgccttctccgcggtggttgggtgggtgtccggccatctagagaagacaaaggagtaggatcaatgcatgctcaaatccaaatttaaataaagcaataaaagactcaaataagagaatcgaataagagcgaaattttatgcatagatcattttgcatgagtgcgaataaataagacagactcacataacgataaaataatggggaaattagatacatactaataataacaataagagctgaaataccttgcaacccatgttcctgagctaggacctaatgcatttcacccatcaaatcccaactgactaacgaataaatctcaagagttttactaaaactctagattgactcgttttgacaaatctcacttaaacgagcgaccaagatttttcccttgaaccacaagaacggatcccaattttcccggaacaaatccaattgccaagaacatatgcaatgaaaaggattcagagggcttttaggtttttccatttggcttgtcctacggtcaaggtcggctctaataccaacttgtcacgcccagaaattcccgaatagaatttcaagcagaatgtgcattaaattccccgtccaggaccagccggggtacatgtcacgcccggaaattcacaagtgatttccaaacttatttgtgcataaaatcctcgtccaggaatcagccgaggtacacaaactgacaatttaatatacagattcatcaaattaactaaaacgataagtacttacttaagaggcactaagtcctcaccaagaagaaaactgcagcggaaaataaaatctagcgaagctccggctccactcccacaggcagctcaactggggtatgagccaaacgtcttctccttcgcaacttgtcttcaactgaggttgattgattattgcaagaatgagcatatgacatactcaacaagccacacagcaaatatgcaagtgcacaaggataccaaaggatggcataatataggctcatttgcaaaagcagcatttaacaaaacatttaagagaagtaaaacagtggagtaattaatcagaaattttaatcaacactgaacagcacacccatgctgcacaggcccaaccatcctgaacaaccatacccggctgtacagatctaactccaaaccaggagctaagcaaattattaccagttataatatccataaattattgtgagaggtgtgagactaatcacgaaaaacattgctcaactcgcccataaccgcgggcacggctattcgaatagtttttactctggccggaggtgtaccactgtacccacaagacacagcctcaacatcatgtctaccatgcgtcgcgatactggaaagtacccgaatagaggctgtgacaataccctttgtacaacacaactcaccacagtgcaccattcctggatcataatcacccccttataaaacaaggcatggactccccagcgacccccgtgggcttatctccgccacttctcagtctggtgctccgcaatgaatcatgctatacaaaaggtaaagccgttgcccacgctggcttgtggttggcacgattaatgtttcacaatagtagctcgcgaaccggtccttaattgtcatgagcacgactctcaaaaccatgtgctcacaacccaccattatcaagttttagttggcaagtaattaattaaccaatcacgattgaccatcgtgaactatcattaagccatcattaaataatgagtcataagttatcccaatagtgtgctaatgtttctaagcatggctaagcaattatatctaatatctagttgaaccaatatatataaagctcaactagtccaattataatcacccaaggtatcaaggaataaagtaatcaatgaaaacaggccataacaaaggaataggttcacaccacccagtgacattcgaaaataaatgcacagttgaaataaatagagaatttaaatataggatcaacatgctcaaaggattgtgtttaggatctgtgtgacttgccttgcaataatcggtcttcaattaatcttcttgaatacttccggcgcactcacgaaccttcgcaacaacggaaacgacaagctatcacgcaaaacgaggaaaaagactaataaaaaccaattaaacaatacataaaaaataaacaaacatgtcgatcataattttagatgaattatgagacttgaacggcctcattctgacttcaaatgaatttattacgaattttacaagattaaatctatttaaagcccatttaaaaagaattaaataaatttaattcaatttatggacaattttaatatgtagatctttattttatataatttttgcaacttgaaccacattaaactgagttcaaatgaattagttatgaatttttaaagattaaatcggattaaaacacttatatggattttaattgaattatgacgcaataatgaattatttttgaaaaggaaaaaggatttattgcatcaacggctagggtttgcggtggaccgggtgcacggcgacggttcacgggaacggacggtcgagatcaaccctattcaaaacggaaggccgagatcaaacggtccacgaccggctcacggggaacggcaacgatgacgtcagcaccggcggcgggtcgggagcgcaagctcgccggcgaacgacggcgcgacaacgagaacggagggcaccaggacgtagagcgcggcgcggcgaacttaccggtgaccaaagaagcggcggaggaacaacggacggcgacggcgacgaggaagaagcggcggcggagatcgggtcgacggcggcgacggtgctccggcgatcttcggcgacggcgaagcggcggacggggacggcgacgacttggcgatcccgacggtggccttcccgagtgacgacgacgaccgtagcgacggcggcgcacggctggacgaacggcggcgacggcggcgcaaaagctcacgaggctagggcgctacacacgacggcgggcgaaggcgagagaggcggcgggtagcggagacaccgggggtccttttaaaggggcaaggaggcggcagtgaaggcccacggctgccggcgacgagaaggaaaggtcggggttagaggagagagatgaatccgaatccaactcaaatccaccggtttccaaagaaaattagccgatgtttccaaaagagaaaaggaagaggagatctcaaggatcaattgccctcaatcaattcggccggagaaggaaaggcgcggccgaatttggaaggagacggcggcggcttgcgctagggtttcgggcggcggcgacggcgcgaggaagacgaacctgacaggtgggacccacctgtcagcgacaccgagagagaaaaggaaggagcgcgggctgactgggccgactgggccggggagggagagagaaagagagaggggttttgggccgactttcggcccaaagccaaaataagacttttaaaaacctttttcaatttaaattattcatgaaatgcaattccatttattaaaaatacttccttagctcaaataaatcccagaagaatctaggaattatagaattaagcaaagtatttaataaaattttatctagcccaattttatattgagatttagcaaattaaaattagatcttctcttttaggcttttaaaatcatttctaataattccttttaaacaacaatttataatttaaggatttttaaaccagaaaagctcttaacaattataattagatcattaatgatcaaataattactgaactgttctttgtatcatttaggaattgagctctgaaaaatccgagaaaatttcagagagttgacttaatcatggagaatttaataaaaattaaatccatccatgctttatatttaggaaattttatttcccacatttaacttcccttgtaaattaaagatcatttaatataaattctattaataatttattaaataatttataaatcctgaaacaaaaatcaggatgtgacagtacacaaacgacaatgttgacattcagatccacgtcttacaaacatcataaaagtcttacataaatgcagcggaagaaaagaaagacaacaggagctaagccttgactaaactgcagcgggaacaccactccacaggcatcctcgacggcacggacgaagcctactcctcagagaaaccttcatctgacccaaactcgaactctgggttgggaaaagtagagcaagactgagtactacccactgtactcagcaagtcataccggaataggggtatgatgcagggaattatcaaagaagagctagagcagttcatttgcataaagcgagcatttataaacagaagttgaaagattaaaccgttgtaataattaattaatatcaactatccactgcccaacgctaacccacgttgcgacaggcccaaccatccacctaaactatccaatttcaaaagattacactagggtgagactaatcacggtgaatctggttgaccgcccataaccgcgggcacggctattcgaatagttttactctgatcagaggtgtacaactgtacccacaagacacagccccacgacacgtttccatgcgccgacatgccaccacgacatatcagaaagaggccgtgacaggacccttcgcataaccccctctagccaagcacaccacacctcaggtttcacccccgtccccagcgggcaacgggcagtcccctctcgtgcctaggtgaatccggaaacgacagaggccgtcgcagggcccgccccgctccatcacgcccacccttgcctggatgcgtcgactagatgagagctacactacaagcccagccgttgcccacgctggcttgtggtaagtacgataagttctttcagggcatcccgcgaaccggtccttaactgccatgggtgcgaccagcaaaaccatgcacccacagcccaccatgtgatttattttaattaaccaacaccaaagcggtggcactaatccaacaaaaccattagaaccaacagtctaaacattaataggattttccccattgtgaactagttgaactaagcatggctaagcaattcctagtccaaactctaatcatgttgtaaccccaagctaacaaaggagcatggtatccaaaaagcatagctgtaacaataggtaaccatcccatagtaatattataaaacaatgcaatatttgaaagaaaacaatagagcatttgcaatataggatcaacatgttcaagtgacaagcatgacttgccttgctctgctgctggaggaacctcggcgactatttcgaagtacaccggagcgtcggaggagtcggaatctagcgacatacaaagcaaacaatgcaaacaggctataagactactgaaacagggaacaaaaccatttttaatggattctacacattactcttgatttactgagacttgaatgggcttaaacggagctcggatgaattagttatgaattttagaagattcactgtgtttattactataacaaaaattcttaaataatttattgcgcaatattttccagggctgacatcagcacggggaagcggcgccgacatgcggggcccaccagtcagcggctcgggagagagaggaagggcgccggcacgcggggcccactggtcagcggcggggggaaagaaaaggggcggcggcacccggctcggcttggctcaaggccggccgaccggccgcggcgacggcgcgcgcgcgaacgcgttgccggcggcgcatccggcggcggggcgacggcgcaaaacgacgcggaaacggcggcaacggatggcggcagcgaccgaaggcgacggcgagcgcgggcgacggcgacgcacgggggatcgggggaaggaaaggaaaggggtgggagtcctcaccgaaggggacggcggcgaccggcgacgacgagccacgggaggacgacgtcggcgggcggacgagctccgagatgccctaagaaaggaaaagagagagattagagggagaggggtggtccacggcgggcggaaaccatggccgaaggcggcggtagagatggtgctcaccagagtgcgagggggtgagggctccggcgacgaacctcgacggaggaggggtgaacggggtggacctcggctgcgcgaacccaacggcggcgacggcgcggtgcggcggctagaggcggccggagtagcgggagaggcggcggcggatgggcgcacggcgcgggagcaatggagggcacgggagagagcggtggaaaaagaaaaaaggtggaggggagtgcgggcatgctttataggggctcgggagagacggatgtggccgaggcgctcccgatttcgtcggcgacgtgggaggttgaaggtgggggagagagagagagagagagcggcgggattcaaatttgaatcccggccatctcggttgaggcncgcngaaaaaaaagggggagtgggtgcgnaaggcncggcgcacgcacgggcgtggccgatgtggaccgaagaaggcggggtgcggcgnatggcnnacgtgggcgagtggccgtaggttggggaagggcccgacaggtgggccccacctgtcggcgaccccggggagaggagggaggcggccggcctggctgggcctcggcctgcggccggcccagcagggaggagggggaggaaggagagaatgggccggcggcccattcgaaaaaaggaggaaaaaaaaagggaggaaaaagaaaaagaagaaggaaaaaggattttccctggaattaaaatattgcttgctcaattttaattggttaaaattatttctagagctctgaaaattccactaaaaatcctgttaatgaatttcgacatgtagaactcaagaaaaattccacatgtcaaatccgattattatttgcattactttcttagggttttctcttgatttgcacctgcattttcttggggggtcgtttataaattaaattttaggcctgggaggagaacttcggggtgtgacaaacctaccccccttaaacggaatctcggccccgagattcggaggagctggtgaagaggtgcggatgggcggctttcaactcatcctccctttcccaggttgcttcctcttctgaatgatgactccactgaactcggcaaaacctgttgaccttgtttctggttcttctttcgctggtatcaagtatacgaatcggcttctccacgtatgttaggtcctcctggatatcaatgtgtttcgaatcagcctgttcttcaggtacccttaagcacttctttaattgggacacgtggaacacgtcatggataccgatcatattggatggaagttctaactgataagcaacttctccccttcgttccaagattttgtatggtcccacgaagcgtggtgccaacttgcctttcgtctgaaaacggtgtactccccggagcggagtgacacgaagatacacgtaatctcctgcctcaaaagtgagctcccttcggcggttatccgcgtagctcttctgtcgagactgggcaatcctcaacctttccctgatgattctgactttctcttctgcttccgctaatacctctgtcccgaacagttgacgctcgcctgtctgatcccagaagagaggtgtgcggcacttccggccgtataaagcttcaaacggtgccatctgtagactggcctggtagctgttgttgtacgagaattccgcatatggcaagcttttgtcccaagctccaccaaaatcgagagcgcaagctctcaacatatcttccaagatttgattgactcgctcggtctgaccatcagtttgcgggtgataggccgtgctgaaatttaaacgggtccccaattcttcctgcagcttctgccagaattttgaggtgaactgactccctcggtcagatacaatctttttgggtactccatgtaggcacatgattctcgaaaggtaaagctccgccaaccttttgcccgtatacgtggtatgtactggtatgaagtgagcaaccttagtgagtcgatccacgactacccagatcgagtcgtgacccgacgatgtccggggcagtcccgttataaagtccatcccaatctcctcccatttccattccaggatttgaagaggttggagtaaacctgctggtctttggtgctctgccttcactcgttggcaaacatcgcagagtgcgacgaattcagctatttctctcctcatgctgacccaccaaaacttttctttgaggtcttgatacattttagtgctgcctggatgaatggagtactgggtctgatgagcctcggtgagtatcagatccttcagttccttgtcgtcaggtacacacaatctttctcccaaccagattgtgccatgctcatcttcgtggaaatcccgggcttttccgaccctcatgttctttttcagctctgctatttcagaatcatttacttgagctgctctgacttgatccacgagcgtaggccgtgcctccagagcggctacaaacccgtgttcaacaattcccacgttgagatgctcaaactcctgccacaattcctcacacatgccctcgatgcatagggcagtgcagtaacttttccggcttaatgcgtctgccaccacattggctttacccgggtggtagtgaatactcatgtcatagtctttgattagttccaaccatcttcgttgtcggagatttaggtccggttgggtgaagatgtatttcagactcttatggtccgtatatacttcgcagcggttgccaatcagatagtgcctccagatcttcaaagcatgaaccactgctgccaattccaggtcatgagttggataattcccttcgtgtggacgtaactgccgcgaggcatacgcaaccactatgccctcttgcattaggacacatccaagtccgtgacgggatgcatcgcaatagacttggaagtctttcatctggtcgggcagaatcaaaactggtgcggatactaatttctttttgagctcctcaaaactcttatcgcactcagttgtccatttaaacttctcatctttcttaagcaactgagtcatgggtcgggcgattctggagaagttttcgatgaatcggcggtaataacctgcaagtccaagaaaacttcgaatctgcgacacggtcttcggcggggtccatttggtaactgactccacgtttgatggatcaactgccacaccctgagctgtaatgacatggcccagaaatttgacttccgtcaaccagaagtcacacttgctgaacttggcgtatagctggtgctcctttaacttctcgagtactagacggagatgttgttcatgttcttcttcggacgttgaatagataagaatgtcgtcgatgaacaccacaacaaacttgtccagaaattccattaacactttgttcatcagattcatgaagaatgcgggtgcgttggtaagtccgaacgacataaccgtgcactcatatagcccgtaccgagtggtgaaggccgtcttcggaatatcctcctcccgaattctcaactggtggtagcctgatcgcaggtctatcttagaaaacactttagctcctttcagttgatcaaacaaatcatcgattcgcggcaaaggatatttgttcttgatggtgacctcgttgagtgcgcgataatcaacgcacatcctcttcgtcttatcctttttctctacaaaaatgaccggagcaccccaaggtgaagtacttggtcgaatgtaccctttctgcagctgctcatcaacctgcttcttgacctcggtaattcgttggccgccattctgtacggtctcttgtaaattggggcggttcccggtgccaagtcaatccggaatcaatctctctcttgggtggcatggtagtgaggtcttcgaggaacacttccggatactcgcagactatgggtatatcttccaatttcctcaaattcttctccacggtgtccactgggatttctgcttcaatctgattcaaagagaccccttgctttggtgagactagtgatttgtacaccacggtttctcccttctcgttggtcaaggtga

SEQ ID NO: 44867 - DNA, 1895 bp, Oryza sativa
  unsure (1)..(1895): unsure at all n locations
tgggcctcggcctccgnccggcccagcagggaggagggggaggaaggagagaatgggccgccggcccattcgaaaaaaggaggaaaaaaaaagggaggaaaaagaaaaagaagaaggaaaaaggattttccctggaattaaaatattgcttgctcaattttaattggttaaaattatttctagagctctgaaaattccactaaaaatcctgttaatgaatttcgacatgtagaactcaagaaaaattccacatgtcaaatccgattattatttgcattactttcttagggttttctcttgatttgcacctgcattttcttggggggtcgtttataaattaaattttaggcctgggaggagaacttcagggtgtgacatacgggcacgagcatgggtagtgacccatgcccgcttcgcccgtttacccgcaaaaaccaactgacatgtgggctctcagtcaaattagtataaatgccaccgtctaggattgataaacttgtaatgcttgtattgtagaacttggtacaactgtaccctatctttaaactgtgataatatctctctgcttgtagagatttgtggttgaaggattgaactgtaagcctgtgatgggtaaacggatatgcccgcgagcacatggcgcccgcgggcgatgggcatagacaatgttccttccacgtcatgtagtaacgggcatgcccgcgggcacgagcatgggtagtcactacccgtgcccgtcgtgcctgccatccctaaatgcaatgataatgaaggggtggatcggacgctcaatgttcaaacttgagagcccagaaaataatttatattgcggcgaagcccagaagcttgtctatttttgaaaatgaataagtccacttgccgtccctcatctttatgtcgagtttaattaacatcccaaaactgcaataccataaatcttcacctccccccaaaaaaaaaataaaactttacaaaaccgttcaagtgaggtcccttggcagtatggatatttgttttggatgacgtggcatcttagtcatcggaaaaaaaagttaaaaagaacatatggggccggcccacatgtaagtgccatatcaccttcctctgccttctctcccctctctcttcaccaacggctagcacgcagtgggaatgggcttcagctccatgctgttatccatgcttgcctctgtcacgacgaactcccaacggaaatcggcttcggctccatgatgttggagctcatcagcgcggattccatcggctccgacaccggcacaaccatcgtgcgcaacttcttcggcatggcggctctacgtctcgctaatttttagagaaaaggtcagagacctggcttttacttgaaagccacatcggcggtgtcttttaacagctggggatgccagcgaaccatacaagagcaaaacaagactagtaagcttaaccacagcaaggagcttaggagcagaccaaaagctgaacaaacacttgacaacaacctctaaagccaacacaccaacagctaacgctaaccaactaacccacacctaatctcggatgccgtaggcctgtcatcacctttatttcttctgtcatagcttctagcttgatctcatcgttaggtttgaagagcctcctccactgcaaaagattagagataatttgaaagggcaaagttagtgtcacgcccagaaatttactagtaatttccgaactagtttgttgtcacgctcagaaattcactagtaatttccgaacttatttgtgcataaaatcctcgtccaggaatcagccgaggtacacaaactgacaatttaatatacagaatcatcaataatagtgttacatactttcaaaagaaaagaaaactgcaacggaattacggtctagcgaag

SEQ ID NO: 44868 - DNA, 2705 bp, Oryza sativa
actttggaggacaagaacacgtagaggacgacgagacgaacccaacggtacccaccctcgaaccaaacgacgaacgacgacggccggcgacgaggtctagcggcggcgcggcttcggtcgacggcggcgacggggctgcggtggtcggcggcttcggggagatagcggccgggcttctccaccctcccgcgcacctaacggtggtgacggagaccggcggcgacggcggaggcggcggcgcgacgcggatggagctcggccggcgactacggcggggtggagcacgtggcggcggcgctacgaggcacgggagaccacgggagagggggcaaacgaaagaggaggactagggggtcctatttatagccttggattgaagagatcggactcctcccgcaagaaatcgatccgggaaatcaaaaactcggttttggagataaactcgaaaacgagttcgattcggataagatactcaacgattagctccgatttttggggataaagatagaggaggataagaggaatatttcccctcaactaattttagaaaaacacaaggggaaaggtcagatttggaggagaaaaaccgagccaaatcggtctcagttcggctgctagaggtagaagataaacagtgtggagggaggcaaattagacttttcgtcttgggctggctgaaaacaaagcaaagaaagaaagagaagggggaagctcggctgggccgacttgggctgcacggccgtgcagacaaaagagggagatgggctggaaagggcccaagactaggaagaggattattattacttttccaattaaattaatcaatgaaatgatctttgaattgttaaaaataattcctatgctcaaataattccaagaaaaatcttgaacatacttggagacccaaagtatttaacaatattaaaaacagaccatttaatgattaatttaatatgtgggtaattactgaaatgctctttgtatgattaaaagttaagaattgagctccgaaacatctgagaaaatttcagagagtgtaattaatcatggagaatttaatcaaaattaaatccatccatgctttatatttaggaaattttatttcccacatttaacttcacttgtaaattaatgaacatttaatataaattctaataataatttattaaataatttataaatcctgaaacaaaaatcaggatgtgacatttgtgcataaaatcctcgtccagaaatcagctaaggtacacaaactgacaatttaatatacagattcatcaaattaactaaaacgataaatacttacttaagaggcacttagtcctcaccatgaagaaaactgcagcggaaaataaaatctagcgaagctccagctccactcccataggtagctcaactgggtataagccaaacgtcttctccttcgcaacttgtcttcaactgaggtttgattgattattgcaaggtgagcatatgacatactcagcaagccacacagcaaatatgcaagtgcacaaggataccaaagaatggcataatacagggctcatttgcaaaagcagcatttagcaaacatttgagaattgtaaaacaatagagtaattaatcatcaatattaatcaacactgaacagcacacccatgctgcacaggcccaaccatcctgaacaaccatacccggctgcacagatctatctccaaaccaggaatgtaccattccaaactaggagctaaattaattaccatcaattaccacattattattaatgagtagtgtgggactaatcacgaaagacattgttcgacccgcccataaccgcgggcacggctattcgaatagttttactctggccagaggtgtactactgtacccacaagacacatctccacaatatgtcaccatatcatcatgtgcccatgctgaacatgtcaccatttgtgtagttgtgacaagacccctcgcataacttaacccaaagcagtgcaccgttcctggattgtagtcaccccctcaaaaaccagaggcatggactccccagcgacccccgtgggcttatctccgccacttctcagtctggtgctccgcaatgagccttgttatacaaagtgtccagctgttgcccattctggcttgtggttggcacggttaatgtttcacaaccgaaactcgtgaaccggtccttaattgtcatgagcacgaccatcaaaaccatgtgctcacaacacaccattatcaagttttagttggcacattaattaattaaccaatcacgattgatcatcgtgagctatcattaaatatccatcattaagtaatagtgaaacattagttatcccaattgtgtgctaatgtttctaagcatggctaagtaattatgtctaacatctagctgaacaaatatataaagctcaactagtcaaattataataacccaaggtatcaaggaatagagtaatcaatgcaaacagaccataacaaaggaataagttcacaccacccgattgtaacactagaaatatgggccttcaaaaactttttaataaattgcatcatgccgattttatttgcctattttattggaatttggtttcaaagtttaccgatcgcgaataaggaataattaattaggaataaacactaaaattaaattggcaaaataactaattaaaataaagattaggtgagtttggaaataaataaaatat

SEQ ID NO: 44869 - DNA, 3226 bp, Oryza sativa
  unsure (1)..(3226): unsure at all n locations
attacctttgggaaggtaattgagatgcggcatgtggaaacatgagcgccacattgccatgatatgatgacatgaattgtgaaaatagaaatgaaattaaacacttgttttagactggcaccgacggtaagattgggtggtatctgggaaaggctagtaccgtccccggtcaattaaagaccgagccatgaagttaagcatgaaacgaccccatacaatcacacttctcgcatggggatagacctagcggagtaaatagctgagcgaaggcagtatccatgcatagtggtttcttgatgcgtaaggcaagggctctacagtggtgttgccattggtaggactaccatgtgttaatttaaacataattataacttaatgcatgtgtgtgagtcttcccttcccggatacgccagaactcctctcactactagaaactgtgtacgcctagagtgcatgaggatgaaaagttcatggagcgggtactgtcaatgtgaggttatcgaaaagctttgccgtgatacgtctcatgtgttgggacgaggctcatgtgttgggcagtcgcggagtgtgggtaaagtgtacatccactgcagtgtgagtaaaacgaatctattcgaatagccgtgctcgcggttattgagcaccgggacatgtattacacttggctagactctaaattcttaacttgtgtgggaagggttattgcatgatgaattttatgctgttggagccacttcctgagaagggggaaggtggacgttctcagaaaactatgacgactcaatggcgggaagctatccttgggatcacaatggatgatggacagaaccgtcgttgtttaaatataaacactggtactaaaatttgatcagtcaatgctaggtcttaggcttgtgaaaagaattacaaaacttgctttgcgcaaaagaaccatagccatcctttgaaatacccctatcatgtgcattgttgatgtggtggcttgctgagtacggttggtactcacccttgcaaatataaacttaatcagaggccggagatgaagcttcggaggatccctatgcctattaccaggagggtgatgaagacgatgacgctcaataggtcttagttacggtcattgcctatggcaatggcatgccgctgccttaattccgctgccttatctatttctgcttttgggatgtattccggaccgctcggtccgatgatttaagactacgcctgcgggcttatgttgtaataatttgcactagactctcgtgtatgtgcgtttggtatctcggctatgaactcgtgtgtaccagactacttgatccaaggaaatggtactgtttacacgattgattcctgttataaaaacgggggtctacagagctggtatcagagccatacgactgtaggaaaagaccaaaaggcgccccacccccttttctaagttggccaagggagaaattcccatttagtaatactttcaaaaataaaaatgctatgttcacaaaactctatacgattttcatcttactcttaactattttcttcacaaaacaagttttactctcagctgactttgggtttttcttaaacttagatggcagatcaggattcacccgctacctggatgatgggcgtaccccgctcagagggatacgtcattgagctgcatcggttgatgaggcgtctacggtaccccagatttccgatctaccgagtgagacagtgtggatccgtttgggaggcccgagtcgaggttcacacacgagttccttcagagtcagactatagctttccgacatgccaccgtcgtgacttaccagagaccgcgatgtaggatgcagcccgggaggcctttctccgacttagctctatccaccgagctgagttggcgagtactgagtttgctcaccacccgtttcgagaggagagtaactccgtctgcacagttcaggacacaccttgctgctacaacccgatagtgactcgactgtcacgatgggctgaggcagtagacgacttctacgaggaggctctgttagagatcgacgactagcagaggcctgtgggagagttggagaccgaggtgactgacctcacagtgcaacagcttcagctaggggaggtgcaccaggcttggggcagtgagatagtctcactgaaggcacagctncaggtncacggcgaccagntccagcagttatctcatcagtacaacaatcgccgcgggatgatgaatacactngaggagcagctgagagagagtcangagcacgtcagccagctgggagagcagcttcgagcagccacggtcagcacccaggagcttccacttccacagcagtagggcgtgaccgctacttcttcctcaccccggcatatccacccgcattccacactcttttgggagagattggcatgctagctactaagtcagcaccctacctagtggacacgacagtgacacagccacctgcaccagagattgtgcacaccccactggtccctacnccgtcaccacagctgggttccagtatggagactccgatccaggtcgactccgagacagaggggaccgacaccgagccagagatcgagccagacatcactgatccttcagaggatgagacccctgttccccgcatcaccttcatcggaggccctcacaccctcagcattgcccgcaagagcacccgatccccgggcaagaagcccaagccagatccagaggccactacctccaagccgtggggactcaggtttgcccgtgccagcaaccaccctctacctgccccaggatcctgcggatggttggatgactagactggaggactatttgcagcttcgatctcgcttcatatggtttttggatagcatgcgagacacccccccttacctagatcgacgagtagtttgatgattagttcaatgtatcttttggatgaaccttatttggactgcgtatgtgtgcagtcgattgcatcacgatttatgtactatttgtggaactctgtgatgttatttatgatattattgctgttgtgttgtaaatgagtttattccaccatgcttgcaaaacaaagttcacatcaagacaattcccttaaagagataaaaccataagagccagttaggagattaggatacttactcaatcgacctacacagatggcaagccgacgtcgggcgtcaaccagcaatgatgaaacccagacacctgacctaaccaccc

SEQ ID NO: 44870 - DNA, 2563 bp, Oryza sativa
  unsure (1)..(2563): unsure at all n locations
agaagagaagagctactagagccatacccgaactctcctgaaggcttccggactccgatttctactctattcctattccactagcttaagaatactaaactaacttgaggtgtgtaagtgaagtgagaaggtgagctccttaaataggcaggtaatgacggttatggtggctggaaaggtcggtaataccctccaaccgccatagggaggaaatccacaccgtccatcgccaaccctgcatctagcggctacacggcgggtcggccgaaccaggggacgacccaatccagcccaatttcggctggcggcctcctcttctgttgctcacttcagacttgtgaattttggcaaaattcatcgtgtcatttctgagttcttggcccattcatacataagtccgatcctcgacatcgtccgattgatttatcgtctgatttgatgtcgattctccttcactttataggtattctctgtaaaaggttagtgaaccagatactagtggaatattattattctaacatgtatatgcattgcaagataactagttcttctctattttggtaatattgacggtcaaaacntgatcgctaacgacaatcaacaacaggtccgacccctaagcaaagagggggcagccgccactccaccccaggccggacccttcttggggaagtgccacgtgggtttgggggcggcctcctccctctaaacatgataccgccgggcccatatcacagacgcagtcagacttatataggtgtgttccttctaaaatgttatgtaggccaacatgtctactttatggtaaacattaaggtatgcaccaacttgccatatagatgaggagagaagtacatcaaagaaatgagcctctcctcctagctacccaatagcttatttcaacatcctaattcacgccatctctaaccatatacgataggttactactattgtgtaactcaaaagggtcttaaacccatctcactcgatgcactgcctatcacattttgcgatagtccctcaatgaactgatctgctagatttttagcaatctggacatatggctgcgttcgaatctccaacaaaagttggatgaaaactttgatattcatatcatgcttttcaaaatattaaatggtgtgtttcatgcgaaaacattctatgtggaagttgctctaaaatatcatataaatctattttctaagtttgtaataattaaaacttaattaatcgtacgttaataccacattgttatgcgtaaaacacttcatcttcatttacatgagtttcaaacacatagtctaattctatcactccgaagtattttaggattctcatagacttcaatcttctttttatatgtctgtatgactttatgttgtcctttaaactgttcaccttaataatcgtcatttgattatcacggttcataagtcactggtttttcaaccacggttaatccatcggaggcccatgaagtactcgatctcaatagtggcagtgctacgtcaaattattttgatttaatgactgaccctcaatcgttcgcaagttgttatacgttgcacacgtgtataccgtgagcgcaacttatccattttttttgtttaaccacattttaattttctctctttaattaggtatctaattgttcttgacgacatcagcatggagcagtggaatgccatagaatcgatatttgagaacaatggtagaggcagcagggtaatcgtgacgacggccatcctctcggtcgccaacagttgcacggcctacaagtccggagccaacggcggatgctgcatccgtcgccatggctgcgtctacaagatgcagactctcggagaagcgcacgccaaggagctcgccctcggcggcggcagcgatcagcgaccgccggagctggagcacggctcggcgacgcttatggcgaagtgcgacggcctcccgctcgccctcgtcagcgtcgccaaccacctgcggtgcctgggcaatctcacggggcggcactggccgacctgtgccacctcctcggctccctcctgctcgacgagcgcaacgtcccgaggctcgccgggacggccgccgccgccgacagcttcgcgaggctccgccgggttctgatggacagctacgcgggcctccctgactacgccgccaggacctgcctgctgtacctggccgtcttccccaacgacggccgccgcctcaagaggagcgtgctcgtccggcggtggctggccgaagggtacgcgcgcggcggcgaggacgtgcttggcaacagcaccgacgtggacgtcgccgacggccacttcaggtcgttcgtcgaccagagcatcatcgtcgcccaccctgccgacgacgacgacgacgacgaccaccgcacgaggaggtgcaggactcacggcatcgtgcacgagttcgtcctgcacaagtccatcgccgagagcttcatcttctcctcccgtgctcctccgaggcgcaagagagtccgccacctctccatccaaggcggcggcgggaacaccacgacggcggcgctgagcacgacggacctgtcttg

SEQ ID NO: 44871 - DNA, 6829 bp, Oryza sativa
ggcacatgaggaagctgatcaaggtcaagatatggtgcgagttcggaggagaagaatccgacagtgtctcgacgacggcgacggatcacctcgccgacgctatcaggagctacatcgaggcacccaaggttgaagagaccgacgcacgctcgctgtcaatcgacatggagcaatgctcgaagcagctgatcaggtcatgtcatggagagagtaagctcctgcactccctgaagcctccatgccgcagctacctcacctcgctgaagcttcatggcgacctgttccggctgcacgggctcatctccatgctcaagaacctctacgagctctgcctctcgtcgacgacgacgaccctgaccagggatctcgtatcagccatcggcggattgcctcttcttcttcgcctcaagctggtggcgaatcacatcgagcatttcgccataggagccggggagttcagaagcttgcaacacctgctcctcgtggtgcatcgtcagaatcccatcctgctgccaaagatcgaggagggagcactgcctcagctcgtctctctcgagctgctctgcaagcatctgcgcggcctctccgggatccagatcagacacctccagcgtctcaaggaggtcgcactcgattctcgagtgagcgagggcacgaagcgagagtgggaggcagaggccaggaggcatccgaacaggcccagcatcttgctcctgaagaacagttacagtactgtcctgcctgacgacactgacagattggatgatcagatggacggggagcttgctcgggagaaatctgcacctgatgatgatgctggcaaccaggagcagattgcggaggtggaatcagaaagcagtgcatttcaattggcgaattccactatgaataattcagtcgctggaaaggaatcaacagctgatgatgctgatgaagaaggattgggaagcactaatgcagtgcccatggagcagataaattctactggctccatcaatgagaccgaggtctccaatagagggaaattcacaatgtcatattttgaggactgctgtccctaccatgaggtaataaactataaatttggcacatattatgtgaattcaactgcatttgagatattatttaattaaggttagagtttcaagatttgatcaaactttttacataacacaacttttaaaactaatgacggaaaaaatgttcaaacaactcgttagaattataataccatacaaaatatttctcaaaacacgtgattatgcaagtttataaaatatgatttccctcctaaaagcttgggttaattggatccatgccattataaattcttctgttttgaaatataccattaatatttacctatttgaagtcatgccattataactttataggtatttgaaatatgccactatataccctttcaacacacttaacaaaaactttagaccaaattgcccttatcttctttctttttcttctcccagctttcctgttcatcttcttctccctttcttccccttctgcatctggcagcttgacttcttccttcccatctctctcattttctactggtgaaccttggccaagggcactctccaacttcactctgacgccatcctccgaacccagtgagaaggaaataaacaggcattgagggccggatcggggcagtatcatggctcggcgtgggcgctgtgaagcgcgacgaggcatgggcatagtgctggcgttgcagcggctcgcatgggaagagtggttggtgcagacttaccgtggctgaggagatcagtggacagtgggtgggtaggcatgggctttggtctatccatggcagcagagatgaacatgagagattgggagaagaaaagaaagaagatgagggcaatttggtctaaagtttttgtcaagtgtgttgaaaggtatatagtggtatatttcaaatacttataaagttataatgtcatgacttcaaataggtaaatattaatggtatatttcaaaacatgaaaatttataatggcatgaatccaattcaatttcttatatgaccctcgttctctcttctctgaatgatatatacatgggtctagagcccatatgtgtgtcattgagacaacatggacaaattaagattagtttgagattgacaggagcaaataagaatgatcaatatataatatgtttgatttttaatgatttttgatgtcccacttaaccatatttgtttattataataaatttataaagtataatatatttatgatcagattatggacgtaccttttgagctagaaatatgcatacagtttctatgctatgatcagattatgaaagtaccttttgagctagaaatatgcatacaatttttatgttttcaaatgaagtattttgtattcataggtatagtcaatatttgaaaagcttgactagatatcgttcaaacttcaaaacatcatatatttatgaccataggagttgcatagatcaaataaaaatatttgaacggttctgatattaaaatattttaagctttacatgaaacgtgatcaaaacaacgtggttttgtgtctggagggacacgtggtaatgtaatgtgggctaattgtggtctgttgctacttgcaggactagagacttgtagtacctaaatgctacaaagaatactacagtttcgtgacacaacggaatgctactgtagtacctccgaatatttgacgccattgacttttttaaatatatttgaccattcatcttattcaaaaacttttgtgaaatatgtaaaactatatatatatacataaaaatatatttaacaataaatcaaatgatagaaaaaaattaataattacttatattttttttaataagacgaacggtcagcatatttaaaaaagtcaactacgtcaaatattttgggacggaaggagtattatggtgtgggtttcagactttttagttgtttctcaagatatgcatcattccatactgcggctatatgcatggtttgagttttagctattccttcaagtattctatttaccctggtcatgtgttaataaggctacatatgttactcacgatttgtaaattaaacaggtttagtccttcctcagtataatatccatgcatattccattgttcttcaaattgcatgcgaatacaatgcaatgcatgctctgagaacatctagaaggacaaaatgctctgagaagaagttctccctgactcccccgggtgaataacgaaatcgtacgccccaacctgctcagtgaaatgcgcgtgagcaaccgcagttgtggaatgtcacattgcagcatactcgcctaaagcttactcccccacatctgtacaacacaatactgtagattaaaccctagggggaggcgaagacctcgcccaaaaaacgaaacccaaaccgcgggccgccgctcacttggacacaaatgacactgctggagaaaggctcattactacaggttgacaaccctttttagtcccggttataccactcacacacacagacacaaacacaagttgttcccatgtttctatcgtaaacactaagggagaaataaacttacgtaagatttatattatagaataaatgagatatatatataaatttggacatatacctaccagaaagttcgtcctcacagacagtttttccttgaatttcccgcggacgtttttatggaatcatgcctgcatttccaaactacaactaatgaagcttgatgcacatagtagcaatagaatcaaccataatgacaatgggatggatgacattacctattaatcatttcaatgattgagttgaaagtttccctgggtttctgcatagagtctaggatatagatcatgctctagaatgtgcatattgcgtgaaacaattaacatatcattgtatgaatacgagaaagaaattagtacagaaggcggtaaaaactcactttgtgttgtatgtaaagagtatgaatctctactacttaaaaagttcgtagtggtggtcttgattcctgatacaacaaacatatatgacagacacgcgtaatctcaaccatccgattggccatatccaacggcgtcaatctcctccccatcacgcgattgctcttccctcgatcgatctcctccccacgcccactcctccttcccccacgccgcgtccttcgccctcctccctgcgtcgcctcctcgctctgccgccgcgtcttccctcccactactcgcgccaccaccggcccctcagccccgctgccgctccttcccttccgctcctttccctcccctcaccaccagcgctgccaccgatccccgccgttggaaaccctcccgtcgataggtcgccgccgacgccgatctctcccgccaccgtcgcccaccgtctccctactccgcaggtctccgacgcgccgcagacggatttccacgccgaccggtcaccaccgacgccgtcttctccctacttcaccgcaggtagttccattgcttccgctcccaccttcctcttctctgatttttatgtggtagtggtagctaggtcttttatctacacttcccctgcttttttttgttcttgctgctagatgagcggattgatcagaacgcaccgatccatcatctcgtgatttttcttaacctttccgtgacctgcaccgttgtggcagcaggacctccactgtgcgtccgccgtggcagcagccaattcctctggacgctcttcttctggcccgccgtcccgaccagctcaggcatgtatacaacagcccagacctgctcacggagcccgccgtcgggaaaggccacgtctcggcgtaagacacaggggtgtaggtcgtgcgatggtggcatggcggccggggaccggttcccgaccctatgcggcgtcttcccggatgtcttcaggcttcagcaacaggttatgtgacacgtcactgccgccgcccttacaccgacagtttcctcaccgtcggcgcctacgagcttgtaacggggcgtgtccaatcgtcgtcggcgcggtgggctccttcctgaggctctgctccatcgtgtactgcctcctcattggcttctgcagctacgagatgtgtacagctccggctagctcaacatcgccaggcgccagcaacaacggcggcggtggcatctctacaggaactttcttttgcatgacgtctgaaggtgagcactccaatgaccaatcacatgaagtctgatgcactaaattaaaattacgacatatacatttcattaacagtctgtaacagattcccaggggcactgatctatgaacaaatttacattttcagtttcaggtgaagcacaaagaaagctgctcttcatttggtttaaagatatacatttctcttgtagtgatccaacacaaattcagcagttccctaccttggttaacctgaatgcttcactcttgagagatgtatatgttgctaaaatatgcctgataaaaagaagtcagtaaacttacccccattctcatgcatataccatcattaaaaaatattaccgtagcgttagcacgggcacattactagtgtcttataacgttgttgcgctaggaatctgtaaatgttatccactgtttcccttgcactgttccatgcagtcatctcattaattatataggggtccatatgaacccaaccatgaaatagccatgctttgggcaattttgaatcttcattgaacaacgcaaaaaaagaagacgtgagttatctgcactcggcgaatattcaatgttacatacgacgggctaaggaatgaaataaaattaggcctaaaagattccgggtagaagctaaaagcgactaggttcattatatctaagtcacgatcaacttctaacggatcttggaaaactttaaacaatggccatttacattaaagatgttaccttcgtcgtctcgcagcgtgacggctccatgtgatgaaacatcgacgacggtatatggatccattcatttactttgaagtttcctatgtccgaaaagcttcacccgtgagttgaacaacagcacctcgtcccctgccttgaactccttgtgcttgatccgcttatcatgccatcttttggttatatctttatagatcttggcattattgtggtaggccttgtccctccattccttcagctcagagagctgcatcttcctgtgctatcggctccctttaagtccatgttccaagtccggatagcccagtgcgccctgtgttccaactctaccggaaggtgagaagtcttcccgtagacaagttggttgctaacatgccagggtgtcttataagcagccctatatgcccaaagtgcatcaggtagcttgttcttccatgccttcccatctcattaacagtcttctgcagaatattcttgatctgtttgttcactactacaaaaaccttcataggtaccggccttataggtgccggttcatttaaaaccgacacctataggccctttcccacgtccgcaagatgaaaaaaataaagaaccgacacctttacgaagtataggtgccggttcattagttaaaatcggtaccaatactataggtattggttttttaaatagaaccggcacctataatatattataggtaccggttctgtataaaaccggcacctatacaaatcgagccgacctgggcgagccgagccaatcgatctgacagtgcgtcgtcgctatccttatccttatccacgcagaccacgcgctctcctccagacctccaccgcgccttcccctcgccccctctgttcttttgcgcgccctcccgctctccctctcctccgccgcgccctccccctc

SEQ ID NO: 44872 - DNA, 3882 bp, Oryza sativa
atttgtgaattgtaatggagattattgttgttcatatatgtgattggtgatggattggatttgggactgcttgaattgggattattgttgttcatctgcttgattcgtgatttgtgaaagcatgcttgaatagggattattgatgtgcatcggctcggcttggagccgacttccttttttttttgaattcggtagagcacaaaggtgtcggttctatgaccggcaccaataacctagtgtcattggtgccggctggcaaaccggcaccaattgccggttgggaaccgacaccaataggggttttttacttgtggttgcttgtttatgcctattcacttgtctggggatgatacggagtgggaatgttgtgctgagccctaagttcttgcaaaaagtttcggaaggtcttatcgatgaaatgagaccctccgtcacttatcaccatccgcggagttccaaaacaagggaagataatctcatggaacatccggcaggcgtgcttggcctctgtggccctgcatggcattccttctacccacttcgacacatagtcaacggccatcaggatatactcgcagtcataggactttgggaaaggtccaatgaagtcgatgccccatacatcaaatagcttgacttgcaggttgtatgtcagtggcatcgtatcccaagcagtgatccctccatgcttctggtaccttgtgcatcttcgaacgaattcctttgtgtcatcacacattgttggccaaaagaatccattctgccagatctttgcgtgtgtcctgaatgctccatagtgacctccatatggggtagcatgacacacttctcaatgatcttcatgccttcatctactggaacgcatctccgtagtagaccgtctgaacagactttgtaaaggtaaggtgcatcccacaagtgcctgcggctcttgtagatcaacctcttcttattctctcccggtggcacatgcccccgaccatggagttgatgatgattgcataccacgggtcagaatctgtgactttcaacagcatgtcatctcacagatagtcatttatcggtagctcctgcatgttagtgatttgcatacgcgacaaatgatctgcaacaaaattctctaccccttttcatccttaatttgtatgtcaaattcttggagtagaagaatccacctaattagccgaggttttgcatctttttagtgagtaggtattttagtgcaacatggttagtacaaactattaccttagctcccactaaatatgacctaaatttatcaatggcaaacactatggctaggagctctttttccgttgtggcataattaagctgagctctagtaaaaattttactagcatatgtgatagcaaggtgctttttatccttagtttgcccaagaacagcgctgacagcaaaatcactagcatcacacatgatttcaatcggcagcaaccaatcagggggttggatgattggtgctgagatgagtgattttaaaggattttagacactcatcatcaaagtcaaacggggcatccttagctagcaaggtagttaggggtctagtgattttagagaaatcttttatgaaacgcctatagaaccccgcaagactcaagaagctatggactcccttgacattggcaggaggtggtaactatcgaattactacgatttttgctctgtccacctgaactccccttacggagatttgatatcctagtactattccttcacgaaccatgaagtgtcactttttccaattaagtaccaagtcgttttcctgacatctttgcaagaccctatctaagttctccagacaatgatcgaaagttttatcatagtaaaatcgtcgatcatgtcaaagaaaatagacaacatgcatctttgaaatgacgctggtgcactacacaacccaaacgacattcttcggtatgcatacattctgtatgggcacgtgaacgtgatcttactttgatcatcgggatggatggggatttggtgataaccagaatacccatcaaggaaacaaaagaaggaatggttcgctagccgctcaagcattacatcaattaaaggcagcgggaagtgatctttcttagtagccttgttgagtttcctatagtcaatacacatcctccatcacgtgacggtttgttgtgggcaactcgttgttcgagttttcaagaccatcatgcctcccttcttaggcactacttggacagggctaactgttggtatttcttacgatcacaaatagaatccgcaagcgcacggatatactgatgtagtacttcccctacggagtattccaagggtaccgaatcgaagggaacatgtgtgattaatttttcctctggttcatccaaggacaccaagcaaatgataggctaagatagagaggatttactggtgagaaatagtgtctagggaaatcttaactttaatcctagcacgatacttcaggcattggcaacccgctattcctagatgtcgctctactacgtacccggacagggacgacataagtgctcttgagggctgtcaccacctctacacctacctcaaatgtactgtgggatacacagcaattactggataaaattacctaaacaccacgtctaagcaattaatatatactttagtgtttataactcaccaaagcaatcactatattttagttgattatagtgaacaataatcccgtgtgataattaggaactaaccaagagataattctcacaaaataagtctaaattactcaggaagataattctattgatattagagtaatgaacagaagaaaagaaacaagagaagattatcgacagctccggaattcttccgacttcttctactctactctcttcgtaattctagtatacaaatagtacaatagagccttttataattcagctcaagcttgtaagcgtgtgaagaagtgaaggagtgaagctcttaaataggcaggtatgacggttgtaactactgcgaaatatctgaagtaccccacaactgctatcaggagaagatctggagtgttccagcacaacaagggattggcttttcaatgatgacaaaaatcatcactataactatatttttatcaaagttgctaccttgtgacgaacttatgattcgttgctatgtcatcactgaaattggcgtcacaaataacatagtgatgattttttttcaccacaaatactaattgtatttgtgaccaaaagtcttgtaactaatgatcataacaatagtgatagttaaatacgagatgtactagtgaccgcaacgacatcacaggtgtactcactccttccaaaactctaaaacctatttcattctttggtttttccaaaagtctaagtcctatttgtagtcattatgtgctaaattaaattgttgataggaacccaagaagccattttaatgcttattggtttggtcacatggtgaaagaattaattgctttttggtcttggtgcaaaaagaaataggactcacatttttggaaggagggagtacaagattgtgatggattatttcctcacgttttgttagtaattagtgagaatcatggtcacagttgtatgattcaataatgataaattttcatcacatattattgatatactgaaaacaatttctcacaagttaatttgttatagtgacgagattatataacgctatgaggaaattttaacttcaacaatacatctattgtgaggaaactgcattttattgtggcaatcttttcaccagataatattagcatattgcattagttttttggcaaaatttgctacaggacacttgaaaaacgtgtaattagctgagagacaccgcaaaaacgagacacggctgatgaacactacaaaa

SEQ ID NO: 44873 - DNA, 2918 bp, Oryza sativa
atctttaaatgctctttactgcaaccctaaccctttatagtataactcctttgtactcccttgcatttactctgcacttgtgggtgtgtcttgttgagtacggtggctgtactcagtcttgctcaatttttcccaaaccccacgaagaggagtttctagatgatgaaggctttggtgtctagctcgtgcctgccgtcaagcgcctgtggtcgtcgccctagtcttccgctgcttctcgtttgtctttgtgtgtgctggaccttcgtcgcctatgtaataaattaactatttacgcttccgcttgttaaactctgaattgtatcaacttttggtgtaccttgcctcctgggacaaggattaatgcacgcacgtcaggaacgcccgttgggttatttccggtcgtgacaggtttaaaatcaagcaccgactcttctaataccagaaataatcccttcttcacattatagcaagatgcttgttgtgacaaatcatttgctctagaattatcatgcctagcaatatatctaatagcaaaattatcaaaattggcaataatatccaagcatgagtcaagatacctatttagtgatccgtcctagcatttgtagactctggcaacttgttgcaccaccaattctgaatcaccaaaaacttccacgtgcttatctccaaccaactccatcacttgtaagccgaataataaagcatcgtattcgggttgattatttgtacaataatacttcaaacggaccgatgcctcataacacatgccattaggtgaaaacaaaactacccctatgccttaaccatctttgcaagaagaaccatcaaaataaatctttcaaggtataacttcaactaagcaaacctcctcctcataagcaatatccacatgatggtctactaaaaaatcacatacaatttggcctctcatagattttaatggttcataagccaaatcatattcaatcaaagcatatgcccacttgccaattctcccacttagaattggcctttgtaacatgtgtttaataacatcggcttgacaagcaactatgcatgcactagataacaaataatgcctcaatttggtacaagcatagtataagcataaataaaatctctttataaagacataccttgtttcggcatccaaaagacggcggctcaaatatgtaatgatatattccttgccatcttcctcttgcgtcaaaacggcaccaatgactttgtctttggaggcaatacataaccgaaaaggctttacggttttaggcgcccgcacaacgggtgaagtagacaaatacttcttcaaccctttaaatgcctcttgttgttttgccccccaagtaaaatcggcttattttttcaagcgaagtatagggacaaaagcatcgattttacccgctaggttagaaataaatcttctcaaataattcgccttacctagcaacttttgaacttccttcttgcgtgtcagtgctttgaaatcacgaatcttctctatcttcttaggatcaatctcgactcatctctcatgcaccatgatcctaagaacctcaccgccgacacaccaaaagcacatttaagtgggttcatcttcaaaccagaccggcgcatcctttcaaaagctaacctcaaatcggctatatgtccctccataccattcgatttgacaacaatatcatcaatatagatttctaagataatacctaacaaatcatggaagatcaaattcattgccctttgatatgttgcaccgacgttcttcgatccaaaagtcatgacaacccactcaagcaaaccaacaaatcctgggcacctaaaagccgtcttgtacatatcctcctccgccataaagatttgattgtagccggcattaccatccaaaaagctaatcaccttatgacccgagacaccattgatcatcatgtcggctataggcataggatattcatctttgggagtagctttatttaaatctctaaagtctttgcaaactctaatcttacaactcccctttttctccaccgggactatgctagaaacccattccgcataacaacgtggcctaataaacccatccttcaacaaccgatcaatctcctctttgactcggtcatatagcaaaggattaaaacgacgaggtggttgtttataaggcctaaaacctggtttgattggaagccgatgctcaacaagctcacggctaagacccgggatctcatgatactcccatgcaaagcaatccacatactccttaagtagctcgattattttaaccttataatcggctctcaaatttttatttataaatgtcggccttggcttaattccatcacctatgtctacttcctccaatggattggccgatgtaaaccctttaccaagcttctccacttcatcaaaatcttcaatagtttcaccaatatcgttctttgtagaccgatattcttgcaccctcttttgcaacaactctaaattagcttctttactcattatacaaattgatatggcctagccgtgctatacaagccggctttacagagatgcaagaatagctagagagatccatccccgacaagcattgaatattcccatgacgccactcaaaagtagcatcggtcattgcaacctcggccgatgtatccgcttgaacaatctcaacatcattgtcgtctcattgaattaaacattgatgcaaggtagaaggaacacaacaattggcatggatccaacaacgacccaaaataacattgtagttacctttcacatcaacaatgaagaaagcggttggtagcgtcttgtttcccacggtaaactccgccgaaaagatacccttcgcctccgttggttcaccattgaagccattgagaatcatgttagtcttcttcaactcatcatcttcacgccccaac

SEQ ID NO: 44874 - DNA, 3105 bp, Oryza sativa
cggagcgttcttcaggtatgtccttctcatcttaggattaaacatgttttatatgctattatggtttttagatactattgtttctattagcatattcatgtttatcaccatgctagaatcattctctattgggcatgtcatgtttatgttaaatttctagattaaaatttgcgtattatgactagatttccatcgggagaatttacatttttttccatcctcccaatatataacataaatattttcatgtgtacgtcattctcccaaattttcatgcccatttgccacccaagcccacatatgtcagcctcatcctccatttggaaaaatgggatgttggaccgtgatggatgaggctgacatgtaggcccaaatggtaaatatgcatgaaaatttgtgagttgtatcagggcatgagtattttggaaggatggtaaatactagtgtaaattctctcgatttggaacatacgtaccgcttgttcttgagacggtttcgaagattctcctcgtgagattcgctaacatcatattctccgaggcacacctgccggactatgtcggcgagaaggtcgccgacgtccgtccacctggacgcgtcgacccatgcgcgctcgcggaactggcggccggaccgactgtacaccgcccgtgcgagggtggtcttccccgatcctcggaacccgacgatggcgatcacccgcagctgctgcggcccgccgccggcaccggcctcatctagcagctggacgagatgctcgataggcttctccatgcccaccgggttcggctccacgtgaccgccgcggggagctgccgccgccagcgccggcgtggcagaggaatggccaccgccgccggcggcggcagcggcctcgacggcgttcctcaggcgtttggtctcatcttccaggcgcgtcttcagcttccggatctcggcggcgaaccggaggcgggtgcggagcgtggccacccaccgcgcggcgcggcggggccagctgggcgcgccggcgccgccgtggtcgtcgcgcggcgcgacgcggtggaggaagcgctcgatggagtcctccatgtcgtgcgtcagctcgcgcatgagctcggtgtacgccctcagcacggcggtcggcctctccgccgccggcgatgacgacgaccgccggagctggtcgtccatgaacgccgcgaggaggaggaggtcgttctgcatggaggcgctctcgtggcttaggtccctgagcatcttgtacctcgtgtcgagcacctccaggagcttccccacgacgcacttggtgaaggcggtcgccgccgattgctccatcgctggaagtgtggaacgtactacaactggtaagctatttcttactagcagtactatatagcatatactactatgaagtttgtattccttcgtttccccagttattgcactgttttcttttttacactaaaaagattccaactttatgaaaaaaaataaggtttttttccattgttcgagagctttatatatacctacccatattgtttgaaaggtaaaaacataaaaccggtttaactaattacattattagaagacaagtctataattaacaatagcgagacatttttaatctaggaggaatagagagctatatatattaatatatctcagaatgttagttacaaggtactcgctccgtcgcaaaatataacaatttttagtaggatgtgacatatactagtagtatgaatctggatagtctgttcagatgcgtcctatccactcaaaaaattactatattttaggacggagagagtatatatatgtacactacaccatgtaagtaaggtagcaggaggtaaaaacaatactgccgacttctatttatgtacacgaacgctgcaaatagatcgttaaaagtttatctcaggttgattgaaacttgtacttactgttatggctaagtaatatagatcgaatattataatacatatagtatacttcatatatatagaaatgaacgatgctctggtgctctctatcgatggtataatactaccaatagtattaagggtaaatcaaaaatttactaataaagtgattagggtaacattggcatttatgttttttcccggctatatcaatatgtggtcatccattacaatccattacactgacatcgatcatattccatcgaaagagacaaaaaagaaggaaaaaaatggttttttcactactaaatgacgattatacccctcctatcacacctggagtttccccttttccgtagattctaattcaccaataaattgactatagaaattactttggataactaggagaaaaccctaattaacaatgtatttaataatcggaaatgttagggagatttttttcgaattctcttgctccaaaatcattaacaggacttaaagcggaatattcagagcaacagaattgatgttgttaatttaaattatcaagatttgaattaataataaattttctccttgcctttggtcgtgaatcatgcctgattcactcctctcttcgtccgtggtttcgttttgcatgacgagccaagtccaatttcgtttccggtaccgtttcctttcctttccttaaacgtcgtcgttgcgtcgccggtactccattctccctctttattgatgtgttttccgccgcaaacatcaattcatctatttaatctattcagttgtttctcatctagcgtcgccgtcgatcacgtgtgttgccgccggaaccgccgccgccgccgtcatcatccctctccgggttccgttctccggtgaggttttcttctcgttttagggttaagctttttcgtgtgtcgccgtgtcgtgtgtagccactgccatgcgcgccgttgccctagtcactgctgagccgcagccgcccaaccgcgccgccgtcgccttgcccctgccacgcgccgagccgctgctgcagccgtcgctgccgcccctgagccgagccgagccgccaccacctagccgtgccgctgccgcggtcccgcgtcgtcgttgtggttttctcgctgcccatacctaccggcctatcgtttgctgtaccgagtcgttgccgctaatagtgcttagttgccgc

SEQ ID NO: 44875 - DNA, 1668 bp, Oryza sativa
atgttgaggaagcaatgtaccgatgttaagcaccttccctttttgtttaaggtagtgcctcgtattcatgtaatatgggagaaatgtgtaataaaaacaagttctatgaggactctttcaaaagatgctgatatgggattatgtgtataattgtttactgtcaaaggagacctagggtctcatttcagaggaactatgttctaacctcgagttaataaccaacctgatgatggaaaagaaaatcaagcgattaaccaaagagacatttgtttggactaagagtttcacacgtgtctttttcggatcaaaggcaatgacagtcagtatagcttttggcgaaaacacttcaaggtttcactgaaaggcagcagaccaaaggaccccatcgccaccagaagtgtccgcaacccacattaaagagtaccacctgttagagataggccgaaagatgattgataaaagaggttggccaagatgttctctagcaggaaagacgtaggccgaaaggtgattgataaaggataatcagaaacatgctctgcatcacacaaggaagactcctgacagtaatcgccctgcaacagtcaccttgtcattgagagaaaaaaaaataaatctgtgagtaagcaagatgacctaggtaaaagtgtttctatgaaggcaaggagtgaaatcttcaactcggtatcagatgctacacggagtgaaaagtgcaggcaccggttaccaggcaatgccatgtcttgggagatgatccaatgggaaggaactcatcaaggtcgaaggtgtaaaggaatacgttgaatgctaaatgatgacaacatgaagagaatagtggaaagtaaactaaacataaagaaagtgaatccgagttgcttgttcgtgggagctattcccagttatgaaccaagtgatatgttcgaagatagtctacagaggtcagattaaaatcacatctaacaacgaagcttcagatttggtaggataacgatcataccataacaggtccagtagtaaagtcatttggggagacgtcaaagcatgtcaagtgggataagttggttctttttagaaacataattcaaaggcaaagttaccgacccttgcatcgaatagcagaagtagctagcacccggagagcaggaaagctaatatgaggcagttggtggcaagttagaagtaaatgacaagcatggtattctcatgatgacaagcatggtatcctagtaatgacgagctgatctcgacgcatgacatgaagtgggtaacttgtatgaggttgactccaaagatatgaactatgcgaagttctggaactgaagccccatcttcaagtgccgcaacccagtcgaagtcagctaaaggttcaaccagggacaagtcaggtgaagagaagattccatctacaacaagggatcgagccaagcagcctagagtggagaagttttgctaggcaagtttgttataaaagacgcgacggaagaagtcagacaagaagagaataccgcccaacctatcttcatgctagcctcctcgaatctcggggatgagattcttgtaaggggggtggatttgtcacgtcctgataaattcatcccgaaataaaaatcattttccaaaaggaatactggaataaattaaaattcgaaaagaaattgggcaacacta

SEQ ID NO: 44876 - DNA, 1291 bp, Oryza sativa
ctcaaagctattttgtaaacacgattctagaactatgcaatgttttcagcccagcccaagaaggaaacaggcccgcaggtatctttccagggtataaaagtgcaaattcccctccggaaaccctaatccattcatttttctccttcctccccctttgtggcggctggtagactgagctgcgacgtgcaagcagccggcgccggcgcatgggagcagcatgaccccgtcgtcctctgctttcccaacacgatcttctccctccatcttctcccttagtccccaattcgcattccctttcccttgctgatggtctcgtgcaatcaaatctgcagtggacggtggccgtgtgcggaacaatggcgccggtgctaaaaggtaacaaagccggcagccggatcatggataggggcaacacaactgcctagtccccagatgcacccattaacattggttatgccatgctcaacggtgcaatgcatttgttcttcgctgatgcttggatagttggatgtgccaatattgtattctccttgtgtgttgatcctcgtatgattgcctattcatttttttctgttttatctattggttgttaacaaattgcctcaaattttctaatgatggttcaaattttgcaacaaattcggccaaattttgtccgaaaattccgaaatttccgaatttcgcccatttcggtaaggcccgaaattttctgcaattgaatcccagaaccttggtggaggcggcaatgaaccgcaagaacgtgtaggcgctcccgcaggaggagacggtggagggcgggcccggagtacgcgtgggtgcccgaccatgagaccggcgtgttcgtccccgccgacgagggcgccatctccggcaccgaaaaccacgaccactcggataacctgttctttgatgaatcttgttgtgtttttatcggatggaatttgctgggattgcttcgaattcgttgacgacgccgtcgatctcgatgaggctgcagccggggaccttgtcgatctcgttcctcctcatctgcctcctcaccttcaccgcctcgccgtgccggccattcgacgcgtaagtgttcgacatcagcacgtagtcgccggcgtccgcatcggcgtcggtggtgcgccgccgcatcacccgctcggcgcgctcaactttgccatgcgcgcggcatgcggcgagcagcgagccccagatgagcgcgtcagggtgtattggcattgccgcgacgagctcctctgcctcgtctagtctcccggcgcggctgagcatgtcgacgacgcag

SEQ ID NO: 44877 - DNA, 15655 bp, Oryza sativa
  unsure (1)..(15655): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtatgcacgatgactgaactggagtggtgaaccgaatccgaatccgaattgatcgagatcgattgaaccgtgtaccgatattgttgtgctgctctgtatgtccatcggctttattctttctcttattttttttggggttataaaatttcttgttgatttgtatttgtaatttatgtgatatacttactagagtgtactttttttttcccattggattctaccgcatgaatcatttcaaaattttcgatctggatctggggcatgtgtcacggctcacaataacgacatccactgatgcttagaaaaagtacgagtaggtgtgggtggccgctgccgctactgctgccagatccaaaacacgagagaggttggtagtggcagcagcctgagcagcacgtcgatcggtgcaatgcacagtagtagatgacacagtagatctcagcaattgttgcatgcattccagcgatgtttcgctgtccgtctcgtggcgaagaagatctactgggtgcaatgcaaacgcaagcgatcgttttcgctgccagaagcgacaccgcaccaaacgacgatcgatactgcctagtagtactacactgtgtttgcacaatcaccacccatctctttgtacttgcaaaaaccaaagagaaaaaagaaccaaaacactccaattccatagaaaataaacttaatatgaaatgtgacacattctatcatattgttacgaatttggatagaaatccgttcagtacattgaaaacatatactcagatttttggcatacccatatattggagatgaacatctgggaatggaatctgtcacagaagtaattgatcaagctgatttttcgtgtacgcagtggaggagctgagcagagcggcgtataaagtattttcaggtactatacagcggatgggaggaacagagcatctgatccggctttgcctcacatggaacctacctacctactactaccagctctggatccgggcttgagcttccggttcttgtttgtgccgtgccggtgataaagtaatcggtggtggctacctcggtcttgcccatacatgtgatcctagtaatgaaccaaattaattttctacggatctctctctgggcaggttaacgttgtgcgcttttgagagtagtttggttcggtatccgttggattttacgttcgtagaagaatttaagtgcatttgaaattgagcatgctctcgtgtagccattcctgtggataaattaagtggtggaggttatatgcttatcaatttatgcccccggaaaataataatacaattttcgttcagcttagtctatgtacgtacaagttaatacgttggacatcttaggacagaatttacatcctactctcaaactgcattttctttttgttccagctgaatgggcaccaaatgttagaatatactccctcctacactaaatatttgacaccattaatttttttaaacatgtttaaccgttcgtcttattcaaaaacttttataaaatatgtaaaactatatgtatatataaaagtatatttaacaataaatcaaatgatagaaaaagaattaataattacttaatttttttaataagacgaacggtcaatcatttttaaaaaagtcaacggtgtcaaacattttgggatggagggagtatgtctaatatactagttttatttggttatacttgcactcttagagactaggtactactccctccgtattttaatgtatgactccgttgactttttaaccaatgtttgaccatttgttttatttaaaaaatttatgttattatcatttattttactgtgacttgattaatcatcaaatgttctttaagcatgatataaatatttttatatttacacaaaaaatttgaataagacgaatggtcaaacgttgattaaaaagtcaacgacatcatacattaaaatacggagggagtactatattgattgggaatgagtgtctttaatcagagctccgaaaatgtaggtttcagctgaattttgttaagagcaagtttaatagtatagccaactactagctccaattcatctatagccaatctaatagctcattcatataatagttaaatactacactattaatatctggtcccacctgccatacacacactgtgtcttggagtccgtgttacagctggctacaaatctgtagcccgctgctcttctctctccttattcatcttcttaaaatatgtttgcagctggcttatagcttgctattgtacctgctctaacaatagcacgtgtttatgtatcgttatatggcgtctcttaggctattaatgactaacatcgtttcgccatatgactaaattttataacattaaattacacgcctgcatacacttaaaaagagagagggataaagttgagttttgggctacacttaaaaaagcgggccacacgcctctctaagctggcccatagaaaaggaaaggctcacattagctatctctcattgggcccctgccaaaccgagcccacttaacacttgctcctgaaggcccaaatatcggcccataataatatccccggtaatggatgggcctaaattctgaacagggttggctaagctgccgccgccggtcttgccctctcgcggagcgatgcatcgataggcatggaatggccgtgttcagcagagaagaagctttcttgtccaatcggttcggccggtgacgcaagagacttgacgtgtacgtgtgtttgtgtgtgcagtacacgaatccatgcgtgcgtggtcgagcgcgttgggacaacgtggctcacgaacaccaagggctatacatcccggtgaggtacggtggcagttgtcaggcatgcagcagctgacgccgcccggaagcctgatctgatctgccgacgacaaggcgaaggcgagatttgagtttagaactactagcatcatcatttcgtacaagttttatgcgtaaattattttttataagcataagtatatgttaaatgatgggctataatgctagagtgacgtatatatatctcatggctcgtttggatctaaggggctccctgaaaattcttatcatttaagagtatttaataaagtttatgtataaaactacttggagaacctcttagctaatttgcaagacgaatctgtcagggttacgggttagatataccctttgcccttcgatatacgttacatatcgatatggcatacccacgcgcatgcggatatttcctgtatattctaaggaaacctttcacggaatctatagatgaaaagaatcctactcggacagaactgggtcgttgacgtatcgtatagggtctgatacctccgagttctatgaggagacctccacatctgctatataaaagaggcccccgggggggtttagacatcgaatctcagagccaacacaacctccacagcctacgaagccggagcttacgaggagccaagtcatcgagagctagtcgaatcaactcgactacaatctcgccggatccgacaagttcccttgttctctttgtaacctttgttttctaccatataatcccatatcaactggattagggctattacctatcaaggggcctgaaccagtataattcttgtcttttgtttgcttgatgtcgtactacgtagatccttgtaccaacgtactccaataccctctatatccggtctacgggtatcacccgtcaacagtggcgcgccaggtaggggtccttggtactcaaggttctactactatgtcatccaacttcgtcgacaacaacgtcagcaccagcctcagccaagtactccctgcttcaacaatgctggtatggactcaagtcggcgaaatcgtcttcccggtttacaccacgacgccgatctcaaccagtcctccaatgaccgtagacgagaacgcagtggctacgaaccaaggcgattccatgtcgaaaaatcctcccgtcgagacggagaacagaatatcgacgacatccaagctcaagaaggattctgatacggccaaaccttgtccttccgacatgaaccacgagccgacaaagatgacttccgaagccacaaggtcttggtgtcctatccacaaaaccaagaaacacaccctgcaagattgctgggttttccttaacgtccgtgctgaaattcgcgcctgcaaagaacgtggaattcagcgtacttctccaactcgggatgtctattgtcctattcacaagacaaagaatcacgacctctcgagctgcaaagtctttctcggcgccatgaaagctcagtctcctaagtcatatatccccatcagggataacggcaaggaacaaggagcgactccaacttcagatcgattcgttggggtaatcgatatcgatcctcacgaaccatcggtcttacatctcctcgaggactatgggtcatcgacaacgagcgcgccgcgggaggtattggctatcgatgacgttggcacgtcagcgcacgccaacacagtagcggggaatcaatcgactactccagcccagcacatcagggccgttcaagcgatactgagggaaactccctacgatcccgttctgaacgttgacctcgagcgttggacagaacgactacgggaatcggtgactaacctcagcaacgcgtttgaagaagccgctaccgcagcacaccaggagcagccaccaactagcgaggccaatggtgaagatccggaatggagggaatcacctcaacaagctacccctccacctcgcggcactggcgatcttcgagatcaaatcaacggccgctgggaagcacgacgcacacgagacaacgtgaatcgctctcggcgtcatgtctcttcacggcgccatgataacagaaatcgaggaaatcgctcaaacgaggaccgggaccacggcaatcaccacgatcacaacgatcgagaacgacgggggccagataatactggtcatggccgccgccgtatcgacgacgacgatggagatcggcaccgagacaacagtgcaagacgacgacaggattcccgagatccaggccgtcatcctcgtaatcgtacgccggaaccaagtgtaggatcaaggaggccgactagagggggggtgaataggcggttttaaaacttaatggcacttaaacaaaactaatctaagttgctaggcaaggtgaggtgcaaggttaactaagcaactaagttaagttttgcaaacctaggtgatatgggctcaaatatgtctctatgaatgtaaattgcacaaatgtaaatgcaacaaataaatgagacaagagacaaggaatttttcaccgaggttcggaaactcgccggtttcctaatcctcgttgaggcgagcccaactccactgctcaaccacgaagccaccgcacgcccccttcatcaaggggtgggcaaggtgggagccggcccacggagaggactacccaagcctcgatcactagggtagttcttccttcactccgaaggtggtgaactctaaaccactcacaaacagcgccgggcctcctccacaatctcctcggagaggtcaccgggcaacacctccacaagccgtctaggaggcggcaacctccaagagtaacaagtctaggatgcttgccgaggatgatcaagtgccacactagctataacaatgaagcaatgcacttggattggcttaactcactctctaacacctcactagataaactaagtgcacaagggtgtgagagctcttgcaagggttcaagataatgcaatggagtgccaaaaccttacccttactactggggagtgggtatatatacccccaaccaccaaaactagccgttggagtcgaaatactcaactctgtgctccgccggtcagaccgccatagagtggccggtcagaccggactactatgtaacggctagttacagggcaatcattgagcccactcaacctggccggtctgaccgcagtgtagcggccggtcagaccgtccacggctcggtcagaccgtcatcggctcggtctgaccggttgcagctctggcggctctgtatcgccaccaaaaaacagaccagtgcaacagaccagtggggccggtcagaccggccttaccaggtcggtcagaccggctaacagctccggtcagaccgacctaaggcccacggtcagaccgcaggtcacttttcagcacaaccaaccgttagtaaaacgacgatatctcttgactcgagtctcggaatttgacgttcttggactctatggaaagcttattcaaagggctatccaacccatgaaaaatccatccaagaaacataacttaagtcaaggataaagggctcacactccaaaggatatccaccggacatagccacaagatgtcactcactcctattggacatgcccacttctctcttggtttaggacttgagaaaactcatcacacttggttagacaagccccaaaaatgcacctacatgcatatgaactaatatggcacaagatcatccacaagctcgcttcatagactcctcttgatagtacggcgtctatctagcaaatccggtctacaccaaacaccaagaccgggaaaagactaagaaaacattcttagctacattatacctttgccttgcgccatccatcttggggtcaagcttgagccgagatcaacacttgtgaccatccggttgaaccatgtttatgccgaggtcttgtccatactttgtcaagactttattctcatcacaagcttgacttcattcttgccaacatgacgatgcatttggcttggcgaccactaacccatggtgtcattcattagcctcatcgtagtgggacctattccttttcacacctcaaaggagaacattagtctcaacaaatcagttgtcatccttcacttgatgaccaaccggttgcatatgaaagatatggatatgtttgttgagtattcgttaacatcacaagtgtcacatactcgtatgcaagctcaggtgtaaagatccgatataaataataggtgaacaacatggatctagaacatgcacaataaatgtataggatttgctccccctaaatatatgcatacaaataaatatacaagagatgcaagtgtatgcataattagagaatgaccaatgggggtttatcctatacatatagagaaggcatatgtagtaatgatgtagaccaacataaaacatataccttcatgatctccatgttctcaatgtaaatgagactaaataagataagactcgagtaaacattagtctcacacttatatatcaataacatagaaatcatatatatgaacctatcaaaaagtaggagataagaagtagtacatatcgttttatcttcatgtatttcatccttgtcatgattaaggtccatcacaaaagaatgcatgtcttccacatctcattatcaggaaataacctagtagacaacttatgcaaaagagaggttaatcccataaacatcggtttatcatctatcaccaaagtaacaattacacaaattgtttaatccaagatctttcaatcttttctctctttggtgatggataataacccgatataaacaatatagagagatgagatgaaaaatgatttcaaatcaagataaaaatcttataataaacaaaatatagaataagctccccctcaagatgtgcatacatatggatatgaaggaacgcatatgcacataatcaataaagatcaaataggaagctcacactatattttggatccacaagagagaccaagttagaatatgtgaagtttaatacatacctctcatcatttttactttcatatccaaatgagactagtcaaagaaaggctcataaaaacgttagtctcatataattaaatttgtcattaatcaccgaaaccaaattaaggcatttaaacatacaccaagcgacccatcgtcatcgtcatcatccgcatcctcctcatcgtcagacagacatccacgaaggacacacgaccgccggcaacccaccgcccccaacgctgggtgtagagctttcggtcgttccctacgtgatgtccgatggcctgagagattccgacccggagcaatagaaaagtatgatgggagcaccgacccaaaggagttccttcaagtctactccacagtactctatgctgccggagcagacgacaacgcgttagcgaactatttaccaactgcgttgaagggttctgcacgttcatggctgatgcatcttcctccctactcaatctcttcgtgggcagacctgcggcaacaattcatcgccaatttccaaggaacatacaagcgccacgcgatcgaagacgacctacacgcgttgacacagaactcgggtgaatcattgagggaatatgttcgacgtttaaacgagtgcagaaacacaattcctgaaatcaccgacgcttctgtaattcgcgccttcaaatccggtgtcagagatcgctacactacccaggagttggcgacaagacgcatcacaaccactcggagattattcgagattgttgagcaatgcgcctacgctgatgatgcgctaagacgcaagaacgataggccgaagaccgggggagagaagaaaccagccacggatacatctgagtcaagcaagaagaaaaatcgcaaaaatgggaaaaggaaagctcaagcggaagtcctcgcagcagaatacgcgaaccctcccaaacgtctagacccacaaagcagcgacacaaagaaatcatggtgcctcatacacaagacggatagacattctctggaagattgccttgttttcaaaaagtcgctcgagaagcacatggcatttgaaaaaggcaagcgagtacgcgttgtcgagatgaacgaagagacggctcctcacgaaccggactcagcgtatccagactccgacctccacgtctcacacatcttcggcggttccacaacgtactcctcaaagcgagaatataagaaagtggaacgtgaagtctgctcgacatggcaaggggctgcacccaagatgaagtggtctgagcagaagatagagttctcggaagaagaccaccccaagaccgccgttatcccaggacaatatccgatcgtggtcgaacctactattcggaacttcaaggtagcgcgagttctcattgacggtggtagctcaatcaatcttcttttcgccagcactttggacacgatgggaattccgcaaagcgagttgacaccaactgatcaacccttccatggaattactccccaatcatcgtccagacctttgggcaagattatgttgcccatgactttcggccaagccaacaacttccgaacagaacagatcacctttgatgttgctgaattcgatacagcttacaacgccatcatcgggagaactgcacttgcgaaattcatggccgcatctcactacgcatatcaagtgcttaagatgccgggaccgaagggaacaatcactattcaggggaacacaaagctggcggtgcaatgcgacaagcggagcctcgacatggtcgagcaaacgcccagcccacccgccacgaccgagccacccaagaaagtgaccaagacaaacaagacgccgaaaccagacggcgccatcaagattgttccactctccagtgccaaccccgacaagactgtcaagatcggagtgacactaaacgagaaataggaactcgcgctcatcaccttcctctgcgacaacgccgacgtgttcgcttggcagccgtccgacatgccgggggtccccagggaggtgattgagcacaaactcatggtgcgacccgatgccaagccagtaaagcaaagactgcggagatttgcaccagaccggaaacaagccaaacgagaagagctcgacaaacttctcaaagctggcttcatcagagaagtatttcatccagagtggctagccaatccagtcatggtgcggaagtccaacggaaaatggagaatgtgcgtcgacttcaccgacctcaacaaggcgtgccccaaggatcactttccacttcctcgaatagaccaactggtggattcaacagccggttgcgagttattgagcttcctcgacgcttactctggctaccaccaaatcagcatggcaaaagaggacaaagagaagacagcattcatcacgccgttcgaggtattttgctatgttaagatgccgttcggattgataacagctgggaatactttccagcgcacggtccagggcgcacttagcaaccagcttggcaataatgtcgaggcttacgtcgacgacatcgttgtcaaaaccaagacaggcgactcattgattgacgatctgcgggaaacgttcgacaacctccgacgatatcgcctcatgctcaatcttgagaagtgcacgttcactttctgagatgacgccacctgatggtccgcgagcggtccgatgatatcagtcaaaggaagggcctacgctcaatcaagtcataaagtgatttcgaaaggagaatgcgggatgttcatcgaatatacttatgttgatggcttcatcatgttccgctgcccccttttcacaaaggggcacagggatgtcactcgccgtggtcgggccattggtcatcacttggccgacgcggcgctccacggtttcgccgctcagacctgttaattaagaaccaacctttgataagtcaagaggaatgcgaacacaagtatgtcaagataaatgcgagaaagataccccgaggagaaacccgggtcacgtcctctggctcagaatagttataagctggatgggcccgagcctgaagcagatggatccgcctaccaacgaagtctgcaacgacttcatatcccgacaaaccccgtactcggagatcgtcgatgatgtcgataaacgactgaagagagggggtcaaggggggctttgcggtccaagacggaatcttgtccggttgatcttcgggaaccacgaagacagggttcgagtccttgatctcaagataaaaccacctattcctccacttgctgcgagaagaagggcactggaagggaatgtaatgcgacttcaggccatcccgaagtcggaacccgacgcaaccagataccctattggattccatccaacgcagttcgtagtaaaagcgaaaaagatcaaggaaatgctctaccccaatgtaggcctcacaaagatgcacaaagatgctaaggaaggcgatggaattggggttcaaatggagaagagagaggccatagaaattcaaaaccaggagaagaaattcggaaggtggagggagaaaaccgcagagaacataatcttcgatcgcaaccatgcgacccaagatgggctgaggattagtacctcctgcttccctctccatggttccacggccaggaagagcgccatcctcctggagtttcttcaacgttgcattggtggaagctgatttgccgaggtccattgctgatcgaaggtcgccgaaaagcgagcttaggttgatgaactagggtttcttgcggcggcagagaaggcaaagagtgcttggaggtggtgtgtgtttaacaggtttggcggacttcaagatggactcccaaaattcctttaaataggcgcactaccgacggtgcgaattccagggaacagagagagatacccgccggaaatttctggtcccgttacgcgtggcggttttttggacttcagtttaaaattcgctcacgaccattgagcttcgaatggcgtgctcgactacggtctatctccgcggttctcgcaccgggaatgacagcagtctcgacacccgaagtcgcaaatggttgcacgagttcattttaagcagaagtcgggggctactgtcagggttacgggttaggcataccctttgcccttcgatatacgttacatatcgatatggcatacccacgcgcatgcggatatttcctgtatattctaaggaaacctttcacggaatctatagatgggaagaatcctactcgggcagaactgggtcgttggcatatagtatagggtctgatacctccgagttctatgaggagacctccacatctgcgatataaaaggggccccccgggggggttagacatcgaatctcagagccaacacaacctccacagcctacgaagccggagcttacgaggagccaagtcatcgagagctagtcgaatcaactcgactgcaatctcgccggatccgacaagttcccttgttctctttgtaacctgtgttttctaccatataatcccatatcaactggattagggctattacctatcaaggggcctgaaccagtataattcttgtcttttgtttgcttgatgccgtactacgtagatccttgtaccaacgtaccccaataccctctaacaagatatattaatctatgattagcggatgattactatagcatcactacaacagatcatggattaattaggctcgttagattcgtctcgcaaattagccttggggttatgaaatgagttttgtcggtaataaaacctaataatgccacgaacttacttaaaatatgacacaaatttagcaataatatatatttcatagcattacaaatccactaaaagcaacatttgagttcaaaagtgcaacttaaatagtttcaaagttgctttagcaaaaaccattccatacgaattttaaaggaattggtagaaaataatcatttatttcaaagtaacctatataattatttttcataggataaaattctctagaatttctctgcctttttccattgtttcaaaagagagcctaattacatggttgctggtctccgtcgacgtccatttggcggccgtagagcaagttgggggcggtcgatcggtcggactgtccaggccgggggcggggtcttctctgccgcgatcgacgtacgacgtgacgtgtgcggttgcgcgcgcgtcgtcgtgcatgcatgatattatgatatggtgggtgacgcagctacggatcatgccgcgatgtgcttccgtgtccgccttggaaattattaactggccccttgttagttaaccggccgccttttggttttgaagcaattaaccgcaatcaacacgagcaaatgattttgggggggtgggggggggggggaaggtgaatcacatcggagctggattaattagcgtcagactctacacaggtgcatgcatattgggatgcagttacgagtacctaactcattattctgcaggtaagtttaccatgacaaaaaatcgaccgtggtaattgtcaggaaacttatatagatacacttcatcatgcgcttcaataattaatgagttttgagaagcggacggcatggagtacgtacgtgtgacgactaaacaatctttaattgtcgcaagccaacgactgatgttcgatcgatgaagatgccagctcgatgccgctcgccctatctgaacagagggaggaatggttcagccagcagaagccaactgtttacgtcacccatgatctgtatcctttttagctcgccatggacacgcgaaaaacaagcacataccaacaccaatacgtcgtcagacacttactacacgtcgtgcgagcatgcacacacgtacacatatccattcttacatacgtgatcaacgaagcaatcaattaatccagaaaacaaatgaaaacccagcggccgatcgactgaatggatcaaattaaccatttacagatcgattaagcctctatctagatcccactactaatttgtgagacgaatcttttaaacctaattgctccatgatttgataatttggtgctataaacatttgctagtaacggattaactagacttaataaattcgtctcatggtttactgacggattctataattatatttttgttagtgtccgaacacctcgtacgacattctatataataaccgatgttacatgtcaaaatttaaacacctctaatagatcgaattggatgagatagtactgtagctgcaagaggagatgtccaagtccaatcaaatcacgtcatcgtctcgaacgagcgcatcgatctgccgacgccgtattgcaatcgaaaccttgggcggatcgatcgacgtccgcatccgatcccatacctgctgctgcggcgaacacccggtgctgatgatgatgcagagctgatcaattgatgattggattctttccccaacttggccatggcaaccgatgaagtgacatggtacaatgggcctgtttggttttcagggacttatttctaattcttgtcatatcggatgtttggacactaatttggagtattaaacatatactaattacaaaactcattccataagcttggactaattcgcgagacgaatcttttgagtctaattacgccatgattttgacaatgtgatgctacagtaaacttttgataattatggattaattaggcttaaaaaaatcgtctcgcggattagctctcatttatgaaattaattttttttattagtctatgtttaatactctaaattagcgtccaaacatccgatgtgacataggctaaaaagttttagtcccatctaaacaccccctatactagttgcacttgcacggcttggaagttggaacaggagctgtttgaacgtgtgaggatgatcaacagttgataattaattagtgtcataatccaatgttgccgtgcttactacaccaaattgacactgttggtatactttagcagcagaagcagatcatatcttttttttttaagacttaagcagattacttacttctatatcattgtcaggtcggctcagtgctaccacgacgttcaaatcaaatctaccacgacgtcctcgtggcgattaatcccggccgtccatgtgggcaccagggccccacacgagaccccatccgcacgtcaccctccacgtcatggattcggcgggcgcgcgcgcgcgcgtcgggtgggccccgcagccccctcccccaaaccgcggctgacgccccgccacgtcacgcccgacccgccgcggttgggcgcgaaccgggtcgccgtcctctccagcctttgcgcgtgggacccaccgaaaccgaccggccggctggcgtcacgaccccccgccgtgacgtcaccggcctatatatatcgcggtggctctcggtgcgctctgcccagcacaatttgcatttcgcacgccgagaagagaaaaaaaaagggaaaaagaaaatgtaccaggcgatcccgtacaacgcgaaccgggcttggccggcggcgagccg

SEQ ID NO: 44878 - DNA, 6957 bp, Oryza sativa
ttttttttctttttctctcctattaggttcaaatcatctgatgcttttagcttcttttttttttcatggcattaataatggtgttgtaattagataggacgaaaaacttgaattcttttaggattttaataaggatgattaggagaagtgtgtgtccgttaacgctactgtacttaattaccttgtaactagtacctatacctattttcgaccatgtaaatacgaatgggagaaatgaagagaaatatttgcggtatttacttgtcccaaattcccggtgtttttccggttgagaatctgatgctgcaaagaaaaaatattgctgcacatgcgcttgcaaacatccctttctcttcctgaatgcgttgtcgccgctaccgtgcatgaacggcagcgtattggatgcttgtaattcatggccggctgttggttgttgtgcacctgtgctaatatttttcttttcctagttttgatattctgatatcacaattatatatttagacttccctcaaaaatttatatatttagacactattgttctaaacatatggagtaagtactaaaccttaagtttgattaatatttgcacctctctatatctgtcactgacattttgcagccacctgcaggatttaattcaactaaatctgtagcaatttggaagtaattaagccggacgcaggcaagcctgatcatcagcaaagagaatcaagcttcacacgttggcatgtctgtccatgagcttcagatagcagcattattccacgtcaggaaagcagaaaaccttccaaaactaacgagacacaagccaacctgcagcgtactattgtagtacgtagttgtaccatgtaagaaaaaaatatacaatcctatggaattatagatgttcatattctctactccacctgatcatgcatgcacggctaggccggtgggaaaaatgacaagaggcgaggcacatgagttgtcataacgtcattaacaaaaaccacacgaaatgcatttatatataggtgtcctttttcttccttgctgtcaaatgcgtaccaaataaatcatgcaatagtttggataccctacatttgcactggctggaatggcactagccaactacctaggatcagtcagtcccaaaaatcattatctagaaaaagttagtcccaaaatgaaaaaaaaaatcttgatgctcactttgaatttttttcacacattatgtggaacagatatcaaactgcaacagagaatgtgaatatgcaaaaattatagtggtttgttcgatttgtaggattttcaaaacataaaaatagtatgagaatatatatgcaaatctaagaattgtaaaacataggaaatcctatgcaaatctaagaattgtaaagctcgagtggatttttttttttggtgtgtgtgtgtgttttacatcaagtgaagggataaaatttttctattgtcgattcctttgaaacaatggtagttttagtgcccatttcaaaggatggtataattctatacttttccttcacaattttctcttaaacgaatgagccgtagttctttcgccctgtgggaagccgcaagctggcatgctacaaacctactacaaactgattgctgagttatacgagatgctgattgctgagtgcgtttccctatcatccctatggcactagggcatgaagacagtttacgtcgaaaagtaacccaagtacaaataaaagaagacttgactgaccaatcgagatatttttatatgcatctctcaccgtcccataaagtcataacagttttggagaagcaattgtacaactcaattcttcaaggaaaattgcatgttatgatcaggaaaatgcccttctgttagaagtgattacagcaagctaacacgtcactatcatcacaaattcattgagattttcagatgagctcacgccagagtaaggacgtttacagctcaagaagcacgtggcaagaaagataggggagaaaaggaaaggcggtgaattacaatcaagaaattcagattgttttcaggactgcaaaactttagtgcatgactacatgtctgtgagactctgaccaatcaaataaataaaatatatatggtgtaagaaataaaatgcaaatggaaaagactccgtgttaaccagtccagagtaactgacaaatacatgcatggtttcagtttcagcttgctacaaattgtgggcggtggatagatgtaattatgtaaaagcttaagctaactcttgcatatgattggcgttatgaatttttcttggtaggcatactaatcgcgcacacaaaaataaaataaaataaaaacaaatgatgccttccagaattcagattcagcaaagaaccaaccatgagacgtgctgacatatcagtggcatgataagagcgtctcagcttaacaataaaataaacaaacaagcatgtcgatgtaatccgatgacgattgcaaatgtacttagtctcatcgacgtggcacgagcaaggccacagtacgacgtgagataaagatctgcgagatcacgcagtgacatcaacatgtttgacaagttagctagcagttgggcggcaaatagtgctagtaaatggtttgcaaaagacacctacttgacgtcacgactttgcatatgtactcatcaatatacgtcatactcatccttaataaaccacaatctcccccttatgatggtttccagcaacaccctaagtggatgactttggctacatctaggatctggtctctttgttcaaccttgtcaaaaacttcggttcagaaatctagatgccttgtttcttaagtggattgttctttttgcactaattccatggaatctatttctccttttccaattagctgtgaatattggagtttggccgaccacaacttccttttgaagcttattatgaggcctaaagaaaaacgggccaccttttagcgttagggacttgagtgaaacagaagcgtagaggaaagaagagataagctatggtcaggcagaccagctgaccaggtggcaggtgcatatgttagtatggaatacggtgttgaatataaaaacaaacaaacttggaggcagtcaggagtcaggacgcaggagaaacgtgtttaaggtgtaaagtatggtaaaattgcatggcttaaagtcagcaacttaagtttctagatgaagtgatacagaatttggtattatggtaacatagcctgccattttcttttttttaaaaaaagtagaaattatgtagatccatttgagtaccgactttggggtgtggattctactccttctgttaaaaaaaactaatttaatattggatggaacttttcctagtatgttgttcagattcattgtactagaaaaagtctcatccaatactaaattggttttttatgggacggatgaagtaatgcaaaagagaaccatcaaattaaataaagtatatacacactatttccattgaatgctatgaattgatctacaatgctgagttcaagtatcttaccaaaacacacagctgaagtcatgggatgggcaagagtcatcatgttgtcatgcagatggcccatgaaagcaaccagtttggctgcaggccacacatagcccttggagtgatgcaagagccatctctgtgtatatcctcataataaaatgcggatttttcatggacagggtgtcaagatatgctcacatctgcgaaccataaacatgagagtaaatggcgatgaacacccaccaaaataatatcattactgagcaaatgatcaaggcaaaccccccaaaaaactcaattgtatttctttttccaaattaaatgaaagtgccagcaacaaactttcataaaatccttgtttttcttatggtttatggatcataaaattctcagtagcaagggaaaagacagataggactctcacatttacctttttccacagagagctggcacatcatgttccatcataatcgtgcattagtctgtttgatcctacaaatcattggcagggctgcagcattatataggaaaaaatctgaatcggttagcaagcgctactactaaaaagaagatagcaagtactaacaagcagaaacagtcggtggcccaaattttacagtttggacgatttgagtccattttagcccctgtcggctgaatagcatgtagcatgaaagataagcatcagtatgaacttgaatacatttgtagtgaaaagaaagtaggtaagtaatacatataaaacatggcatggataaaaaatggagaccagactgttagaattagctccgtttcagtaaaaaacaacaaagtactccatccgtttcacaatgtaagactttctagcgttgtccatattcatatagacgttaatgaatctagacacacatatgaatctagattcattaatatctatatgaatgcgggcgatactagaaagtctacattgtgaaacggaggaagtatgctacaggatacacaaaggtgactataatcagataatcagttcaagaaggcacatgtagatgtaggggagctttaggttttacagcagtaagcttcctgcattccagtcattaagcaacagtgtgacaccatagcaaagtctttgccttgaactaacacgtgcagagtggaaaaagtggaagccatggggtgatgggggccaggcttttagactatcactgtatcaactcttgttccccagtgaacctccatactgattggtatgtgagcttcaaaagacagcttcctgaaagctataaactagatcttgaagtcaacataagtgcaatgggcttctgcgctgcagtaaaggatccaactgaaacttcatcatggcaattgtctctagagagaatcaaaccatgaatcaaaatcgtccgacgcatttgagggtccggaattaggaggaacactgacacttgagatgttgtctttgcccttagcagatgtagtttgtttctgtccattcaagcacagtgaagtgtcagtgagcaagtcgtccaccaaatcatcaatagatgtagatatatctatctggttagcatatctgatgtcaatattgtggtcattcttggaagttgagcctggttcagcaaaaccttcattctggacagaaggagaagtctctgaaagcaagtcatctagagcatcgtcacaagcagcagtcaccgatgatttggatgaagtgctaggtgtaactttcttatctggttgattgactttcacatcttgcaatgttgatttgtttccaaatgattcatctaaattggagccagaaagatgagttccaccaagcgtattaagaagcatatcaagttcttcttctgcagcaaccacctcaaactttgccccttcactattgttattatcttctccagtgtccaaatgcacagagtgagaactagtcttgggtgatgatgtggatttatcttcttcaaaacatttcaactgacaatctgctttcatttgatcatcacaacgaatgctgtcatggtcatgaatcaagctgcctttagcatcactatccacatctgtgcctctttgaatctgtatttgattgacctcagatgcaacagcctataacaatcaggcaaaaccatgaatacacaatgaaaaaaaaaatagcaaaagaaaatgatcttaatggcaagtaaagtaggcatatacaaagcttgcaattaaaacatcaatagataaaagcatccaaggcagggagaaacagctaacttactaagatgaatactaacagatcaaaaacctttatgaaccaacgacctaacaattgcatgaaccatgcacaaagctaagtaataagggctctaaatcatcccagttggctgtgtatatctacatgtgggtatagaggccagatttcagtccattatctaaaaataattccaatcgtcccagtacaataggtaaaatagacatagtttactagggtttaaatacccagtgaaattcattactctatctaatcctatgcagatggctattgtactgtacaaaaaataatccttccaccactcagaaagtttggaagctaaaaataagctatgtggctgatggcagaactaagagatcgtagtgcagacagttaccatgatgggccactggcaaaaggtgcattagtgaaatatgaaaggtagatatcaaaccatagtgtggttaatgcacaaaatagagtgcctagaggaatggccaataggcagatggatatcaataataccagcagcaaatatcaaccagagcattgaaaggctgcattgcaggcagacctgccatggcaaggcatatgagctacaggcattaacagcagagattaacttgtagcaagtggaggtcaaaagggtaggcacctaggtgatgatgactactacagatcaaccataagggtaccagcccaaattgtccttttaagggtttgttttatcacatggaaatcagaataaggaacattgcacattttcattgtatacagattgggtgtcgccatagacccgtagacacttcaagaataatgtttgcatgaagtaagttaaacccctacttgaacatagtgtaaaggaccgtttgttcataacgattttttaaattgaactttagaaaaaacaaaacaagggtatatacaatttctcacggaaaagcaaaactacagttacagtttactaaaagtagacaatgtagcacatgatcaaatacatttgagtacttggaaaattagcaaaactaaagaaaattgctataaacagacgtaccagatcctcaggtagcagatctttctctaagaaaagcctctcagaaagcttaagcttcgaaagatgggtggccaatgcatgcagatccatggagagaaaaggtacctaaaagttgaggggaaacaaattctcacataaatatctaaaaatgtgatatgaagctgcccaaattcacaaggttttaagagttgat

SEQ ID NO: 44879 - DNA, 11996 bp, Oryza sativa
  unsure (1)..(11996): unsure at all n locations
ataaaatctaaaaaaaaaagaaaaataaaattaacaaacttagcaacagtggagaaagcaatcacaaatagtaggcccacttcccaaaggacacatcacatgatcatcatcaaaataaccgattacagacatcaattttccaaaactctcaaaccaaaatgtaagttgtggttatatactaactgacacagcagaaactccgtttgaactacctagcggcctacgagatgtatgctcaactcaaattctataaacaaaggagtacctcatgatgtttggtatgctcaactggcttcttaagtgaggtttaatatgactaagaacaaaatatttctcagtttagctagtgccctcgtttcgtgtgatcgtgtctatgtaatggtaagcaaggatcgcagttcatgcttgaagcgattctcccgatgagctttgtcaatgaggtagtggaggtagggtcactcaccgaatggcgaatcctgggaggagagacgctgcgcctcgcggggctgagcccgagcctgctcgagcaggaagccgaagtctgcgcccttgctgcgcggcgccacctcgccggtccactccgagggggccgcggattcatcggcatcgtcctcgccgtcgtagcggtcccagttcgacgggaggtagcggccgcgggggccggaggcggaggcggcggcggcggcggcttccgcgcgcttctgcctgtgagcggcggcggcggcgggagtctggtgggcgcgccgcccccgcaccgtgtgcgagcgcttcgccttcgccgccgccttgggatccattggagggagaagggagggagagggtttcggcggcgtgtttttatttgcagttaagtccctgtaggttcgcgattatttcatctaactccctgagatttgggggaaagtttgctttaggtgtctacttgcatatatttgttgataaattttcttctaaaaatttaatagtattttttaataaaaacatatgtaattacattatagcctgcatgtaattataatgtaatgaacctttagattttcaagagtttaaggaggaaaagaaatcacagcgcacgcatactattttactataaaattgatactcactaacttttaaatcacaatatataagtgtgtcgcatcatcacccaataccaattattatatatagtattttaaatcatatgtaagtgtgttacatcatcattcactagcaattattatctagagtattttaaatatcatgcaagcatgacatcattacaatttagttattatttctaaaactcaatatgcaagcaatcaaatcattatcttcacatcattttcatatttatcaaccatatatatctatcgtttctataatatataacatgcatttatttatctatgccgtaataaaacgtggggtatcaactagtatgtgagaagattcggccccacgaccttcgtttcacgaaaatattatttatgaatgattttctaaagttatatataagttacattataagtacatgcaaattacaatataattataccatgattgttgtgctataattgcatatatcacttttttttaaaaaaaaattgtcaacaaatagtattagtactatataggtagtccttcaggggtgtgtttgtaatttaaaactttatcgagggcctaatgaggacgccgactccccgccgcgggatcggctgccactccagtcccttcgcttccgaggcttgacggcggcggcggaggaggatgcgcttcacggcgtctccggtggtggagctgccggtgggcggcgcggtgctgacgttcgagcaggacaacgactccttcgaggtgggcacctccgtgtggccttcctccctcgtcctcgtcaagttcgccgagcgctgcctccgcgacccggcgctccccttcgccgacgtcctccgcttcccgggcacccgcgccgtcgagctcggctcgggctgcggccccgccggcctcggcctctcccgcctcggcctcgccgacctcgtcctcacggacatcgccgcggtgctccccgcgctccgccgcaacctccgccgcaaccgccgccacctcccgcgcgccccacgcctcgcccagctccactggaactgccccgcgcacctcgcctccctcgcctccccgcgccgcttcgacctcgtcgtcgccgccgacgtcgtctacgtcccggaatccgtgccccacctcgtcgctgccatggacgtgctcgccgacgccgaccgcggggtggtgctgctcgggtaccaggtccggtcgccggaggcgcatcaggccttctgggacgccgtgccggcggccttcccggtgatcgagaagattccacgggagcatctggacccggattacgcctacgaggaatccgatgtgttcgttcttcgcaggaggccgcgacagtgaactggtgagcaatttgcttaccatttgctcctcaatgactctgcaggtttgcaagaattgtttgttcagctccaaagttattatgatcatttggttgtgatagaaactgatgaaatttgcctcaatgtgttgatgcagtcagtggattagtgttagccgatatcgcgacggattcgaccgcgttgatgagtggatctctgccatgagttatggttgacgatacattttgttgctatttttgctactagaactctactagaagagcatattaagtggtattgatggatgttcatgattgattttcttcgtgctgttctgtgattgacaaaacaaaaattaacttgtagatttatcctcgctgaggatatccatgctcaacctttatctgtcagtttttattcgttttatggttgctacctttctgtctgaacttgtagaaactgtgaatgcttgtcttgatctcttcctaatgggctaataactgataagatatcagaaggtgtgacattatgcatcgcttcattgtgttttgtgcctgcaatgtacagccgatctagctcaaactgattacattggcacttggtagatattgctattgtggtttatgaaagactggtagtttggtaccgtgtaatgcttgaacttgtcgcttaattgtagactagtaagaattttgcaagcaccaattctgctgtgtctgtccataagcttgaaaactgaatgtctcaatgcagtatgaagcgtgtccaaggatgtgtgcatgaggtggatggggtttccatttggcatttttattgaatgtgtggttttgtgggaatgagcacggaattcgcaaccaaaactgacactccattctccacgcattgttcatttcttggatgcgtgatgtagatgattctctgctcattattcatcgacttgtggctgaatgttgaaaccaattgtagtcctgaatggatttgctcatatgcataggtccatcaagcctgtatggctgtatgtatctcttcgctttttagggatataatgctgaatgggtttgcacagatgcattgatgtccagttgaatgttgaaaccagttgtgatgctacttgcaggcatcgattgctggaacatgttttgtttcagaggaaatccgcgaagcactgagtgctatggaggaacattctgcagaggattcaaccttatgatgaactatttagcgtattttctgtgggtcccatttaccacgtcagcaaaaaccatttcccaaaacatcgaatgagttgatttataccaggtttctaagggactgtttggtagagcttcaactttgatccgttggtgtcataacgtgtctattggtgtctgtatgctaattatacttagatcatggtgtcatatatatggataagctatttagctataggttttgccaaaagtcgttagtatcgcctgacacctgccattatactatagatccgctcctgctcttccatttagctctaggagctgggtctagaatggagttgtggaactgcctaaactccacttcacatctctagttcattttgtgagagagttccacttagttctgctcctattttagggacatttaactatttgtcacttttaagatgtggcatctaaagatttgccacttgttgtctattacatgtgggtcctcatgtgcctataacatgtaggttctgtggcaaatctttatcatcactcataagaggggtaaatagttaattattcctctattttgggtggagctaaaactgtttggttgagctctagcttcagaagaagtgccaaataggctctaagataggggaggccttatacctggttttacggtcgagggaggttattcgatcagaagcaagggaggagggaggccggtgggcaaatccatttttaggtgggccaaatggaggcccaactttgtgtggcggtatacaggccgtgcagttgggctgggactccgccttccacaccgaaacggcccacgcgtaccgacgcacctcgctcatcccatcctagccgtcggttccaaatctgacggcatcaaggccctccaggccgtgctcatataggtttcctctccacctccagcccggactctcccgatccttccccaactcggcgtcgcgccgcctcaaccgaagcaaggtgcgtctcatctctctcgcaatcctctcctcctcttccaaatccctcgccctcctcctcgccttcgaaaatcgaggcccgattttttttttttgttcttcctcgcaggagcaaagcggggattcagaacgggaaggagaaggtccggttcgtccgctctcgaggttcgtgttcgtcgcccaaaccctaggttccctcccctcttctcgtttgtcgatctatgtatgttgttgcggtaggttttgatttttttttcggggttcggtgtgaacgatctgtgcctggttgatttcggtatgagagatgcaaatagaccgtagctgatgaaaaccgtagcagatcgaggctgctttgctgctactgctgctgtaaatttcctgtagatttacgttcgggtgtaaatattgaacaaattgatgcgattttccattggaggaaattgaatctacggtgactgctgctcacggttgctgctgagtgctgcttcttgcagtggggagcccgccatggttggattagatgggcggagcttgttttgtgggttacatgggtggttccttcaaccggccaaatcattttttatcatcagtggatggaagagacccttaggctagatatgtagttatgtgattggtcggtgtattacaaattatgtctaggtttctactgtttcattgtcttgggttgttttcttcgattgaagattaatgatctaaaatggtttgcagcttaggtttttaaaacggatcaaatagtattctttgtcgggcggatatttcaaggcctactccggaaggaatgcccttgtgcaacaggcaaaaaaaagtgcctctgtgccatgttgtttgatcttttttgcagttgcaggggggagaaatactaaactttctagtggaagagacacctctatgttgttaacagtgtccagatataggttaaaacttatcatgagcaacatctagcttcatgatttcttgaagtggattacagtcgtttgtttttgttctttctattcactttgttcttctaatattaacggctttgaataagtgtgcagattaggttaaaaggtactgggattagggttttcttgcgagagctttataatgttccaatcacacactgatcgtttcaggggtaaagtcacaggaatcatacttgttggtgatctcaaaagttaaaaatgataacatatgaacttgtttttatttagcatatgctccctttgttgtctactttttctgtatgtaatgcgctatgacgactctaaatcgaggtatttctttctccctgtagttaccagataagccattcatatacatatatatagaagcacttcttgagatttggacaataaattctgacaattttttttaatctttttgttatgtacagctcaagtgtcagttgaagtgttttgaaagtcatggcggagcatttggcttcaatatttgggactgagaaggatagggttaactgccccttttacttcaagattggggcttgccgtcatggggatcgttgctcccgtctgcacaacaggccaactgtgtcgccgacaattgtgcttgctaacatgtatcagcgccctgatatgatcacaccaggagtcgatgctcaaggccaacctattgatcctgaaaagagcaggagcactttgaggatttctatgaggatatctatgaggagctgagcaagtttggtgaggttgagaccctcaatgtctgtgataaccttgctgaccacatgataggcaatgtgtatgtccagttcagggaggaagaacaggcagtcgctgcgcataatgcccttcaaggtcgcttctactcagggcgcccaataattgttgagtattcccctgtgactgatttccgtgaggcgacctgtaggcagtttgaggagaacagctgcaaccgtgggggctactgtaattttatgcatgtaaagcagattggcagggagctcaggaggaagctttatggggggcgatccaggaggagccatgggagaagccgcagcccaagcccacgccacaggaggggcaatcgtgaccgtgatgatttccgccgtgaacgtgatggttatcgtggtggtggtgatggttaccgtggcggcggcggtggcggtggtggtgacggttaccgcggcggtgatagttaccgtggtggtggtggtggtggacgcaggggtgggggcagcaggtatgacaggtatgatgatggaggaaggcgcaggcatggcagccccccaaggcgtgcaaggagcccagtcagggaaagcagcgaggaacgcagggcgaagattgaacagtggaaccgtgaacgggaggaaaagccttgaacgaaagcagtgatatctctatggatggccggttcatgccttcatggcaatcactatccgctggagtcgtggtgtgctgctatgttctaagtggatatttagtgtgtgtcgtttggtactcatgcttggctgagtaacccttttaaatgcaggattctggattctatttacattgtgtttcgtttgacgtgtaaaccgccgtttgtttttaaatatgcaatattggatcttttgtcagtctattatcctgtcaatgcgcttagaaatctgtgattctctactgaccatattgcttctcatgttatagcggttcaagctggcacctgttgtcttggaaaaaagaaccccattctttcttttgctcgtttcaactttgctgcctgttatttgtttggccttttgctacctgttgttgcttgaaactctataagtgtatatacttacgtgctgtacgctttgctcatagcagcctcaaaagctatacgaacgatacggcagcacgcagttcatggagtgcccgttgcaccagcagataaaaggcaaaataaagcccagcttggactgaacacaagcttcacatgaaattcgcaggatcaccccagaaaagcttaattcacagaatctcccaaaaaaagaggaaattttgtttttgttttttttaaggaattggggcatatgattatgtgaactttggccgagtttagatccaaactttttttttaaacttttaactttttcatcacatcaaaactttcctacacacacaaacttttaattttttcatcacatcgttccaatttcatccaaacttccaattttaacgtgaactaaacacaccctgagtataaactctgggcatacaaaccgaannnnnnnnnnnnnnnnnnnnnnnnnnnnggcatatgagctgggaatcctcgtaatattcctctttggcatatgggctgggaatcctggtacgacgaataatcgaatatccctcttcctgtgtgtggtactgtggttctccacgaaacaaggaacagtctggctctcctggacgaaatcgcaaagcaaagctggggctgtgcagtgcagtgtgcagctgctgtcactacgccgtgtgctcacgccgttgtctcaaccaatctcctctactactgtacgcgtgccgctgccggtattgctgccaaaaccagcacctcttcttgttctaagcaaaaaagtcgccgtcttgttcttcgaaaaaagaaattatacactaccgtgtatagctttctttgagaaacaagcttgagataaactaaacattattataagcaaagtgtgttacacttttcactgacgtgctagtgacaaaaccaattcgaaaccagaatcacttcgcagtgccaaaagctggggcttttcttgcggggaaaaatatatgggtgttgtcatccatctgatggctatgctagtgaataaacgtacttcatcatcttccggatcgtgatatggagtaattatgtttagctctagtatttgtctacgcgtcgtaaaaactgattattattattattcttttttttttgggttgctagccgcttgtgacaattgccatgacggcattgcattcttggaagttggatatgtgttccgcgcagatataaagacaagataatcagataagcatagtacttaaccattgaatatatcgtcttgcagacaaaatacatgatgtttctactcttcccttaacgatggcaaacgaggggaaagagcacatatagtggttttcttgatagaacgatgtatattttcttttcaaaaaaaaaaaagaaactatcgtcggtggctagctagtacggctaagtatgcgaaggttaagagaaggaacaatggtagcttatgaagaagagcgagggtagcggtgtgtggaggagagcattggcagttagagggtgccggcggtggagaagtttgttgtcgccacccatacctaatgaagttccttacatttttctcaccaaatagttctgacacgtggcgcactagttattgtaaagaatggtaatatagcttgttttatataaaagaaaaatttgagaaatatatgctttaaagggatacttggttaattatagtcagatcaattttattttctactattcaaattttatgaaaaatatatatttggatgaggataacttgtgtcccgttgtctcatcttttcatctaatgctcaagaatagggctgaactagaataatctacataaatttgttttattcttccttttttataattttaaagtacaattttaatggatatctggacataggggtagggtctagtcctaactatcatactcttatatccgcccccgttttcatccttatctatatcaatattttttttgtcttacgtaggtaagtagggttattatagttatttgtgtatatattgtttgaatatgtccaaaaactttagaaatataatcattttgggggttggaggaagttaaaaaagagagaggaaaatatcagcgtccaaaatcattgtgcctcgagtgtctcccgtacgtctcgcctcgcctgcgccgatccccatctcgcgagcagagcagggaagagggaagaggcgccgtcgtcgcgctgcatcctggtgagcatccgcatcctcttcctcgctcatccgtcccttccgcccactcttgtctcgattttgctcgcgttaaccctagcttctcttctagatctggaagaagcttttctcttaatttcggagccttaaccttaatacagcttgtttttcctccacaaaagtttggggggttcaacttattccaagttggatccgccactgattagtgagcaacttttagttcggagggtgaatggaagataaactttgacagctatgagttaccactgataacgtgtattgttttggtgagttgagtgtggttttatgtggaagttttctgtgcttatactatgtaatgcttaaatgtattatgagacacttatactttggtcactttcttgtgggttgtcagttgaagtgattttttctttaggcttcttaaaattgtcgccagtagatgaaccattatttagatgagcatgataagaattggttttctcagggggaaaccccgccccccaactagtccttttttgggtacagttctggtgcttttatggaaaaatggagttgtgataatagtttcatgtcattaatactttagaaaacttctgtgcggaataactctcaaatgcatagttaggaggagatactgtggattggataagtgtgtctttgtgggtaatgttgttcaaaacttgaaatatcagtctatatgagagcagcagcctcagaattgccttcttttttgttttatgcaactgcgttcttatggttcataggtggtttcacaatggattacactgtatatgcaacagcgctgttgactgagtatttgattttactgcaagaatggcttaagttaataagtaacacattgccttggaccctttgattgacgcaagtaaataatagtgactcattttttcttttgattgcaatttgcttacccagtctcttatttacactgtggtatgatatctatagagttgattattcagatggctgcacattgtcattttactcttttctgatatagcaaattatctcagatgtcaactgttatgtgccttgcctccttcatatccctatactttttgagcccacaaagttattaaaatttctaagatattgagcacacagagcatttagtcatggattcaccaaggcttttagatatactccagttttattctatgcttgatacatgtgcataaggtataagagaaatttattatgttgttaactgtttcttttacgatgagatggagtactactactttgaagtatattgtttttctcttattcaaagccttccaaaattagaacactcatatgcttgctttattggtaatgccattttattgttgtcatataaatgttattttaaaggcattagatttgttacatattcatcctctgatttggatataatttttatcaacattgacacccatcaagatcaagattttcttatggttattcatgttatgtctgttgtttgtttatagatgaaaatgaatgtatccatgtagatgtatcttaatgtaacaaataaatatgtctctgatcattattgtttattagtttttgcttccagctataggaaatttaatacacataattttttatgccttggtgttactcatcaaagcatgtgatcattgtgtcattgatgtttgtcaatatatctctccaatactataaacaattcattggagtgtaaactatgaatctgaaagtgatgattcaccatctaacacatgaattcatgtcaatgtttttcagtcatgtttcttgagtttataaagttaacattagtatgtgatatagaaattactaaattacatgggtcgccactcgccagcacaacggctgcagttgaggacagtttggttaggaaggttatctggtaacatatatgtacgtacctgccattcaactgctgtgtggcatactcttggagtggaagatgggaaactcgataattgaactttgcaatatactccatccgtttcaggttataagactttctagcattgcccacattcatagagatgttaatgaatctaagcacacatatatgtctagattcattaacatatatatgaatgtgggtaatgttagaaagtcttataatatgaaacggaggaagtataactgaaggaggcaacaaaagtgaagaaattttttgtacttggtgtatgctttttataggaaatggttttgtaaatcatgctatcatagtatattgtaaatcttatgccttaagaatcctgaaccttctacttgagatagacctgtctatcaaatgtgttagatgtgtctgcttttggcatattcgagcttttaggtctaagttaatagtgttctttatttctacaaatatgtagatttttcaacagatatatcccgaagctggatttcatttagtgtcaatctcctgctattgccaacactcaatgttg

SEQ ID NO: 44880 - DNA, 1301 bp, Oryza sativa
agaatggcatattttatgttgtagtatgttgttatcaactgtacagttcaccaaaatgtgatcaaatcctgagattccactgataccaagcaactccagtataaatagcccatgttatagcagcagttgttcgcataccaagtttccgaccatgctagaggacatcatacttgatgcctttgaggttcattgttgggattgttggttatactggagacttaatatacgggattacagatgtttgaaaacaatacggacatgaggaattaggaaacgaaggtactaactggacgtcgctaggtggtcaccggttagcagactcagcacctatttgtcagtaagaggcagtaaccagtctacctggggttcggtacatggatgggatcagcattcaagcaattcaggcggtggcgatgcatgaccatcagagttagtgtgcctccgtaagcctagctagctgtagcaacacagggggtctttggtcctgggcagtcaatcgggtactgccttctggagtgatctcttgattgttgtgtttttattagtcaggttccatgtgctactgcacattattcgagagactggaaaggtgagtaattgagaactaggttaggaataaacccaatcaaatctctttttgcccatttcttcctaaatcaatctatgttatattcacttaaaatccaagcctcttttgggtatgccttccattcctggttaacatgtaaatactgcatttaatgatcaatgtcattcagttggagattttgtagatgctccttttcgaacataatatcctgcatgtaggttaataaatgagtagcctaacaatgcataaccagtacttgattatattggtggtaattgagataaattgttcatagttaatgttcggatcagttgaaagatttcacttgtagaaatatatggaggaataattttatgataaaatggttaagggagagagggagggttttgtttcaacgttagccggccaaacaattccatatatgggaaacatggttatgtttaggggcaagtgcaatcaccacagttcatagtggatggccgatgatgtcggaacataactctggagttgaaacttcaatatatttctgcgaaatgatatattccacaggccataaggtggtatgcttccattagtacatggcctcaacttaatcttttcagtgagaaactggacaaacatttctgttactttagtggcgaactggcaaaatagaactttgtaatgctttggtgaagtagttgaggtgcctcaagaatcaagatcagccaaa

SEQ ID NO: 44881 - DNA, 27952 bp, Oryza sativa
  unsure (1)..(27952): unsure at all n locations
acgcgtcttggtttgcactgcatttcatgctaatcatgtttgttactccagtttgcaggataggtgatgataaagcataatagttgaccaaactcgctgtacttctccttaatcaattatgttacaaagaaatatggtgtggacacatcaagttgccagtcctgaaaaccaagttcaacctgaaagtttctatcatggaggtgctgggagcaacttatctaacctgagtgtgcaagttgctgttggagttccaggaaatactgatttccggagtcactatgagagcattaatcttcagcaccagcatgttcagaatccatacccacatgtgggtgttgcttcaagttctgtgttcccatctactatgtacaacccctgcatatcaacaacagcagtggacagatatgttcctcctattcaaagttttggattgggcaatccactactactgcctttatatcatcaacttgctcaaggatccatggatgagaacggcagcagtggcaatttttgtgacagcgtcagggaatttatcaagaggaaaaatgcattacttgtgggtggccatcattttgttaatagttttgcaagctcaagctcatctgcttatgtgcctccaaatcctttacataggtcatggaacgcttcatttgaagcaaatatcctacccagcactggagtttccaatccaccagagtactcttctgcagattcactgaacaattccaattcgatggcttcacatccagaattggtgcatcatggcaattatgtatttccagctggtcacatgagccaatacaatgcatgattgcacaggcaagcagaactggtggagtaccacagtgggaacatggcaatgcagcggctaatcctccaggtaagtaaaccttgtaaatagatcaagtggaagttatgatattttttaaaatgatggtttgagggatcattttatggttagcagtggatttggattgctaaaattgtgaattgggaatagaatagaaaatagtgaagtgagtgtgatttgaatttgtaattggaaaaccttgctttcaacaggtggatttgttcattctggaaccatagacatgccaaatggaggtcttcagggataccaagctggcccttttgccaattattatgggcctctgccccatttccaccaaaatcctctgaatagcatgcagcatcctgctctatttaatcatatccaaatgcaagtacctcatcaacattgcctcagtaacaatttattgcatcacccttctggcaatggcctccccttggatccaagaattctggcaatttcatccaattctgggcatacctttgggcctacagctcagccatctttagcaaaccaagttaatgctgggagttcgagaattcagccatatgaggtgattcacatttcctctgttttcctcatagaacaatggcatatataactaattagatgattaatgctggatgatatatctgatcactgttttttcaacagttcctgtttttcaaactggacaatactaaatttaaaggatatcagaatttagttgaaaaatatcacctgatattgttcctggtacaattcatagtttttgaaaccttttaaggtttttttttccttgtgaaatgatttaaacatacattggctgtcatgttccagaaattaaattccctcgctttcttagcaaaccatataccatatctgacttttccctgcaacctttttatcttgtgtaccttttcctacaaaataaatgaaaacatatagttttcattgcggggtatataatctgcctattgctgtgcctggcaacctgctgaccctagtttggaaattaagtacctaatgctcagttgtttttttttttggctatgcataccatgtacatgaaaaatggtatccttggagttggctcactgaagctgaatgcctactctctttttttcgataaaggaagctttatttgtttcccatttgtgagccattttgtaattcatttcccattaatacggatatatgaagtaataaatttgtctctatagaatgctccgttcgtggatctttcgagattgtatgaagcaggagttattgatgaacatagagatatgcggcttgatgtagacagcatgacttatgaggtatggaatggaatgttagctcatttgggttgtgggttacatttagttgatagatttatttgctttcttctcctacaggagcttgtagcgttggaggagcggattggaaatgttaatagtggttttacagaaagctacattgaggaaaatttgaagtcaagttcttatgtcccggacgctgattgcatgcctgatcagtcttctgtggagaaggatgcttgcataatctgccaggtcttcctcctttgtcattagtctattgtagttttcactactgtatataaatttgtatatcactagctatcagatgcatgatcaataccacaattgttccacaataatgataagcttcactcactatttttagaaacactacttttgcgtaagatagtgtacatatatccagttagttttgacatttgacagcaaagtagttaaatatacatttgcagccaatacatattttatgtttaaaaagggagtttgctctttgctatgtaggaggaatatgaggctaaagaactcgttggaacccttggttgtggtcacaagtaccatgcgatgtgcataaaagggtggctgatggtgaagaacctgtgccccatctgcaaaacaacagctttgccagctgatagaagaaacggatgatggatgccaataacatttattggtcatttgcagcaacaaacattcagctcagttttgtacataagacatgctggataatggttgtgcctgtatttccgttgttgtgatacctaaagctgtacagtgagaatcgctcatcttgtagattgttttagacactaaatgttccatgatgcgcgaacagctatcatcatggcatagctattagatcgctcaatttttccctttttattgtacatgatatttatctttattcttttcccaaaaagaaaaaagagaacttgtagttcttctgtacattgtgaaattcaaagaactaaaggagtttctcagctctggagtgataattctatagcagggcaatctttgttttaaatgtgcgaataatcattcatgcaggtatttaattgttcccatgtattttttttttgtttaaccaatcggctgtttggtttgaggattgagatggtcaattgaccatttgattctaaattgtttgtttcgtacgaggaataaaacaggtttgttcatcacttcattcctcaatatatttaaagaatgatcccacgatggatcttcatcctagatggcctgaatcctcaaaccaaacaactttctatgtgataaactgagaacattttgattgttccatgtcaaatgtacagcattacggatacaatgcaaagcaagcatgaaaagaacaagcatgaaaagaactagataactgtagcagcaaaaaattcatgagtagcagtctagctagcagaagagagaaactgtacagacaatgaactgtgctactgaaaaatagacagcaacatataaataaatcaagcggtcaaaccataatagaagcaaacaaatggcctgtatgaaaatctgacggcctcacaatttcatatccctaaactataccggcaagattatgtcctgaatgaattaatgtttcaaatggcaaaacgaaggagacacttagtaacacatgaatacagatgaggtctatgaatgcaataacatcctgtgtcctactgcatagtatcaaccacctcgggtatctccatgtttgtcaagtcctttcgatctacgctgatgaacaacaagcagactttttcactgcagagacatcatctttgccaccaacattgatggtctgcccctttggtggtgcagctgggtcatcgccgatgtcaagagccttcttgctcactacatgatatatctgggtgagcacttcagtgaaggcattctccacattcattgactccagggccgacgtctccatgaagaaagtgttctctttctcagcaaatgctttcgcatcctcagtcgagacagccctaaggtggcgcaaatctgccttgttccccacaagcatgatcacgatgttggcgtccgtgtgatccttgagctccctcatccacctctccacattctcaaaggtgacatgtcgcgtgacatcatagacaacgagtgcccctactgctccgcgatagtatgcgcttgtaatagctcgatatctacagaagcaacacaaaattatgataatttgctgtgcaggaactaattaataaacagcaaaagcgcatgaaacaacattccatcaagcacagcaggcaataatatgccgcatactccatgactccatcaatctaactgttcagcacaggggattggccataaagaactttttgtccccaatctacacacttcctaactccatgataatctagatgtctgtacaataacaatttcctatgataatctagatgccagtacgacaacaacctattctatgccaatgcctggtcctacacaatctttgcctacaatatcttaaaatttatataaaaatgtcatggcctggggcattttagggtgtaatcaaggaagtctatgaattgaaagaatgccaaattatcactcttcttcttaatcctacacaaggatttaatcacgccaatcatatgagcgcggcaattaaatatcacccgaaatcagagatccacacgagagaaacccactaatcgccaacgattaacgaatggcctagcctaatctaacaagcagatcaggatgagcggagctcgcgggggcacaggcggatctggggtggtgtttacctttcttgcccggcggtgtcccagatctgggccttgacgaccttgtcgtcgacgtggatgctgcgggtggcgaactcgacgccgatggtggacttggactcgaggctgaactcgttgcgcgtgaagcgggacagcaggttcgacttcccgaccccggagtccccgatgagcaccaccttgaagaggtagtcgtagtcgtcgtccgcccggtacgccatcgttcggtcacaccccccacgaactcaaccttctcgccgccggcgctgcgcggcgagggggcggagcggatgggagcgaagggcggagggggaggggaggggaggggagagcgtttgtcgcggtgggtgcggatcgatctcggtctctcctctccccaacttttttgggtggctttgtttgtgcgggaagggaatgcagttggttggggttgggttgggttagtcgcgcgcacgccgaaaattcacgggcaaaaacggctcgttttggtcttttttgtgtgtgcgtgtgcctcctgcctgatgcggacgcggttgggttgggccacgttttctttcaaacaggctgcgttcgttcgggtaacatttgagggagataacatcttgtttttcgcgcgcacgctttctaagctactaaatggtgcgttttaaaaaaaaatcctatagaaaagttgcttttaaaaatcatattaatctatttttgaaatttaaaataattaatactcaattaatcatgagctaatgtctcacctcgttttgcgtatcttcccaatctcgtcaatcaccttctcctcaaactcaccctaagttaaattgcaaaaactactccattcatctcataatataagggattttgggtgaatctggacaagaagggaggatctcataaattattttgttactaatgatatattatatcacaagttattttgttacaaatgttcatcaacttactcaaatttattgcaaaaatcactctagtacgtgtgcttaaccgaatcagaaaatgtgagccatcaatgttgttttaccaaaattaaatacttgattccacggatagaaatgttgagaaggatttaaatattatcgcactaagttttgctatatggagttttttaaaaaagttttgctatatgcaaagaaaaaagttcaatcaaatatgaaaaaaaaagtccaacgcaagcacttagaaaaagaacttaggtctagttctttttctctactcaaaacttcaactacctcgttttccgttagcacatttttcaataaatggtatgtttttgacaaaaaaattctatatagaaattgtttttaaaaagcaaacaaattcatttttaatttataatagttaatacttaattaatattatgctaatgagatttctcgttttgcttgcaacaaaaatatgtctccacaactccatatggaacagagccggtatgcagtgactacatagcgaaaggtttaaattaataaacggtacattttgtttagaagttaattttaaataatagataaatacatttttttagttttgtaaaaattaaaagttatttaattatatgctaatggttttttctatcctaacctcacctctatcttcggtagaaaccaacggcaccttaatcgcgtgtgtcaaatcacagaaaaaaaattggctcgtttgggggtaattttcgggcgttttcgcagggttatacatacggcaagcgaaacgcgtctgaagctgcgccgagtcaaggttgtcgacgtcgagaaatcgaaaagtctctctcgctcagaacaaaccgataccaggtcgcatcagcaacgcggcagcgcgcggcaaagtgagaattgtgctacgaagtttggaacacgcttgcttgttgttggctgcgtgctacgtaccacgtaccaccgcgcaccgaattgaagacgaaaaagaaaaattcggacgatcgagagtaccggcacacgatcgctaccagacaagataaagttttccgtgccacggatcaactcatggatcgatcattcagtttggagtaacaaaaattacgctgtggcgagatcgaaatgcatggagcagagaggattccgcgtcatgggccgtgccgcatgtggacgcatttggtgcttgcctgcctgcgccttttctgtntctttcctggccgtgtatcatcttacgccacattgttgtatgcagagtatgtatgtccatatagtaggagtatagtaatacaccgtagtactagtataaaatgctacacagcgatttcccaaacgtatctggccatgcaagcattcatgtgttccccggaagtatttacttgggcaacccatgtggtggttagcagttggtgctcctctacctgtatttagctgcatgcatgagaatatatacatactatacagatcacaatttcagtcgacactaactcgatccagctagcgagcgcttcactgcagccaggaaggaaggaggtaaacgtacgttaacgatgtgtgttaatttgcctgcctcccacgtactactgtactacaggaacaaaaaaaatgtcgcgtctggcacggcaacaggcagggagattcccgacgcggatggcttgaatggtgtactggagtaggggtggcccgaccgggttggtcgttccttcgtcccgacgtgcccaaatccccatgtatatatgtgtgcattggcaatgggcattccattgccatggctgtggtcctggtcccccaaaaggcagtcccaattcgtgtctcgcccaaaggaggcaagcctgtcaggcacttcagcaaaatggcacgctgcctagcttcgccgtgtctgcatccttgcatatgcatgctgccatggtgaacacgctgttatggcccggcccagccagcccaaagatcgatcggttgtgcacgcacagccgggtgaaaacggaatcagaatcagtagcatctctttagaaacgacgatcaaccggtaattgattatatttaccattttaactactactaagtattgatattaatatgataaaaaagatattagaaaaaaataaaatgtaaaaataaaaaaaatgatatggttaaaaacggtacctaatataaaaaatagtgattgatcgatcgagaatttccgtagttcatccctatccacggatgaaccgtgaacgaaccaacttcgacgagacccaaagataccggggaaaaaagaacacatcagagcgtgcaaacgtgcacgtacccacccagccacccacggacccgcgcgccgtgtggccgtgtgtcgcatccacctcgagtcaatgccactgcaagacacgcacacgtacgtacgcgcgcatcacacgtacgcgcacgggtgcgtgcggatggtgcggtgcccggaatcgcgctgctccgcaattactccgaccccaatcagaaggcctcctcctcggtcgcccaccgcggaagggagggaagaagcaaacggacgcgcgtgcgtgcgtgcgtgagatccggcctggctacctccggttttccctcggctcgtatcgtaggccatcatttactctccctctccctctccctatgcagcgcaggtctgcagtttctgcacaccagctgcatccatgatcgattacaatactctactgcacccactgcgtatccgtcgaagtatgcattgcatctcgtcttcactggccggcctgcatgcccggcacttctcccggcctcccgttctccatatcgtcatacattatatatcccccacattgccatttaataccaacaagaaaccatcggatgatgactatgacggagactgagagaccgtgcgtgcaattgctgactcttgctgcgtgcgactgcgagaggaaacgggagtagtacgtggtagaatcctatcgatctcgatcgatcggtcggtctccgtctgctgctggaagggagagacgttgatcgatgtgctctctttcgcgtgtgcagctacgctgaattgaaggggagagggactaggagagagcatggtaagatgggatgggattgacgctgtacatgcacgttttgacctttcattggaaggtctacggtgagagaaggatatgcatatcagaagatggtgctgataagtgataaatctccaaattgttcgcagcagacttgatctatcgatcgggatctagggtgtgtttagttcacgtcaaaattaaaagtttggttaaaattaaaacgatgtgatagaaaagttagaattttacgtgtgtaggaaagttttgatgtgatgaaaaagttgaaagtttaaagaaaaagtttagaactaaacaatgcctagtcctatcattgcattatcagagagactcagaggaaatatatcaggtttttttttttgccgtaatactagttgctctctcttctttctttcttttatttttttgccaggccatatcaaaaaagcattctgattttccttttcagcttctaaccattactgcatttcgtttttttttttgcccccaactgattccatgtcaccttccgtcagttaaccgcggcgttgagagttcaacgaacagtgccagatgatggatggtacagaccgtgctaaaaacaaaatgaactgatgaacgctactgacagtctgacacagaaacaaaacacaacgtttcaaaacaaaatttagaaactccttgatccagtgatacagatacggtggtacgaatagtagttgcgattggggttaatctctagcacctcctgatattctcccatgcaaaagtactggtactaatagaaggccaggcagaaagtcatttgccttgtcttccttccttgacgatcgaactggacgaatcaatcacacctactagcgcgtacttccctacctgatatagccaccaagctatcaacagtgtaggcaggcaatgcatgtttgtatccatgatgggagtggattctaaactattagggcttcttcggttaatttatatgagggagagattggagaggagactaattccatacctattgtagtgtggaattattccccttcaatcgtcccctccatcttttcaatcccctctaaaccgaacaagacttaagaggatatcttttagttgtttacatgccatccaaatgattatgaaaatatttgaaaaaaattaacaagataaattaatatgtaataaatcattctatggagatgcaagttaaaatctaacttctacaagttgcaacgaaaaaaaattaaactacggttagtcagttaacatatatacgcaatcaaatttattttttgttgcaacttgtatgagttaaatttgactttacatgtttgtggagtgattcataacatattaatctgtcttgttgaattttttaaaaaaattataaccatctgtatgacacgtaaacaatgaggggatgtccttacgagagtttaaaatagttccccatccattattccacatatccacaaccatttttacgctgcaataatgtatcatttcaattactacaggactgtttgacggagagctctggagtctaagaagcagccgaagagaattcagcttgtgagaatggagaaaacgaaaaccatcttatggcttctcatgtattttttgagttctacaactacaatttctcataatctcgacgaaaagctgaacggttaggaacaacacatgattctcggagaagctctagctaccacaagcttcccaatagctttcactcttcatgtacttagtctatgcaacaagattcaacacctcccccatctcatcagccatcactgatctagctccccaaggtgcacatcaagtagtccaagggagcaaaacaaaaggaaggaggaagagtgatggcattaattaactgtgctgtgtaaccctgcacacatgtactggggtaggtgaggccattataagcttagcttcagcagagacaggaatactacacaggaagaaagccatagccagatccatagggttcttttcttccccctcactgttcttctacagacttcagagttcagagctgtagacgacgacacacaccggccggccggccccctactccctctctcatcatctcgccatcatccatccatctgatttgatcgttcgttcgttgcaaagcatatctcgatcgccagcagcagcagcatggcctcaccgaacaggcactggccgagcatgttcaggtccaatcttgcctgcaacatccagcagcagcagcagcctgacatgaacggcaacggcagctcgtcctcttccttcctcctctcgccacctactgctgcgaccaccggcaacggcaagccctccttgctctcctcaggtagtacatgcatgtcactgttcagttcttgcctaggttagggtttctttggggagttcttggttaatttgatcggtgtaatttgcagggtgtgaggaggggacgaggaatccggagccgaagccgcggtggaacccgaggccggagcagataaggatactggaggggatcttcaactccgggatggtgaacccgccgcgcgacgagatccgccgcatccgcctgcagctgcaggagtacggccaggtcggcgacgccaacgtcttctactggttccagaaccgcaagtcccgcaccaagaacaagctgcgcgccgccggccaccaccaccaccacggccgcgccgccgccctgccgcgcgcgtcggcgccgccgtcgacgaacatcgtactcccctctgcagcggcggcggcgcccttgacgccgccgcggcgccatctcctcgccgcgacctcctcctcgtcctcctcctccgaccgctcctccgggtccagcaagtcggtgaaaccagctgctgccgcgctgctgacgtcagccgccatcgaccttttctcgccggcgccggcgccgacgacccagctgcccgcgtgccagctctactaccatagccatcccacgccgctggcacgtgatgatcagctcatcacctcgccggagtcgtcgtcgctcctcctgcagtggccggcgagccagtacatgccggcgacggagctcggcggcgtcctcggctcgtcgtcccacacgcaaaccccggcagcgatcaccacccacccatcgacgatctcacccagcgtgctcctcggcctatgcaacgaggcactagggcagcatcagcaagagaccatggacgacatgatgatcacctgctccaacccctccaaggtgttcgaccaccattccatggacgacatgagctgcaccgacgcggtgagcgccgtgaacagggacgacgagaaggcgaggctggggttactgcactacggcatcggcgtcactgctgctgcaaatccggcaccacatcatcatcatcatcatcatcatcttgcctctcctgtgcatgatgctgtctcggctgcagatgctagtacggcggccatgatccttccattcaccaccactgctgctgcgacgccgagcaacgtcgtcgctacaagctctgcactcgctgatcagttgcaaggtatgtttaattattagtactatgttcatgcatgcacggatgcccctgcaaaacaaagttcaattggaacaactagccatgcatagcacattcatggtcatgttgcaagtcgtactactactgctactgcttccccgtcccaagatataatcattttttattctgacacgatcttcgagatgctactttgaccaacaacatctatataaaagtaagatgttttaaataaaatgagttgcatattatgataaattatttaatgataaatttaataatatcaattttacgtggttgatatttctattattttgctattaattaatagtcaaaattaaaaatatttgacttgaaaatatgctaaaaatatttatattttggatggatggagtactatactctggccatagctagtacaacttgtctcttcccttttttgttggttatcatatgcatggattggatgctagctcagcagtttgcattgttcatgtttgtaagcatgtgcatagaagtgtctcctcacggggggtcaccaccaagctcagctcagctcagctcagcttggtgtagtgcatgaaacgttgtgcatgcatggccatggccatggctagctatggcctgtctcgatctacctgcaaccttggctctagcaagccttggcataattggagaaagcagagagtactcttgccgccctgatgattcgagtaatggctagagacagtgcaacaacgtgtccttttgtgtgttagctttgaacagttgcagcattggattgtgttgcattgcgtgcagccacaacagtgggcgtttatatgtagtacacggttggctccaatctcgatcttgcgatcacatgggaatgccaacagctacatatgtacgcatgcatggttgcaggcaatgagacaaggttaggctatgtaaaaatctcctgttccatgcaccgatcttgtcatgctatatgcagcatatatgctagctgttgatgcaaagagggacatttccatgacagaagggtagagggggacttggcagcttgtatgtgtgttatatgcatatgcatgcacgcgtagatctaggctgttgaaactatagcatagaaagggccgataactgtgagctgttctagccccccaagagtggacaaatatggatggtttcactaagaaagagtaattatattggctgttcaatttcttgatgggaaagcatcacatagacggatagacatagaccatgcatgcacatatctatatatatggtactcctacattccacacacattttgggtgtattccaaatgaacacttttatgtcatgaaaacaacagcaaattaagcacagaacacgttatgcatcttgagcatctaggagtgtagtacagtagttgtaacttcgtcacacaaaagacttcgtaacctggataagtacagctagcttgttggttgttgccttgttcacagttcacatgcatagtagaaccataagctaaccgagagaacctagatattaactgagaaattaaagggtcatgcatgatcatgtattgtacaatatgaaagtgatttcatatccctcgagagttatcccatcgttttgtgtatgccatctaaatagtcataaaaaaatttggtaagatagattaatataaaatatatcactttataaatatgcaagttaaaattcaacttctacaagttgtaacaaaaataacaaatatagcttattttgtttttttggtaacttatagaagttgaatttggtctataaatctttttaaaaaagttttataactatttaaatgacatgtaaataatgaggacgtcccctcgaggatgaaaattcatatccattgtacagtatgagaagagattagatgctataaaatatttataaaaaacaaactgaaaaaataatagatggataaattaatcatgagacagaacaaagagtggagtatcgatcaacagtgtcgtagtccagcttaggtctgggacgtggatcgagatcataaatggcacccttgtatggtcatgtcgcagtgcttcttttcaagaggcgataccggggttggggtaaaaagatctatcgaaggcttttttgatcaatttgcatgcgtacgttgttgaaaggattgaaggcgacggtgctcaatcaaaatcctctcttcttggttgttgctgctcgatctccaagcaaacacttgacttgaaagctggtagctctatctttcagggcgtttgttccgagattggacgtgtgcatggcatccttcttctcaaaaagatgctttcaacatcgcctctctctctggcttggatttccgcatgcatagatatgctagctttttggcagtcataaacttgccagaggtttgaatagcagactgactttttgcatgcacagatcagattattggtttgaggtttggaataggagagttttatataggattgaagtatatgaatttttcccatatgccgccctttggtttgaagtttttgagcgaaaatttttatatccttgattttttttttgaggatttcaaatgtaagctcaatacaccatcgtctatcttcaatcttcatctctccttgcaactatattctaatagtaatattttttcctctaaaatttctctaaatttcatgcaaaggatctgaatgaccaattggactagttgttgtgttttcagttcgtgtaagcctatatatatatacatatgtcatgacatcccggagtcctaaagatgttaattaaatttggtttgaatatataggtttaattaaagtttggtttgaaaatacaattccttgcaagctgcagggctgttggatgctgggttgctgcagggaggggcggcgccgccgccgccctcggcgacggtggtggcggtgagccgcgacgacgagacgatgtgcaccaagaccacgagctacagcttcccggcgacgatgcacctcaacgtgaagatgttcggcgaggcggccgtgctggtgcgctacagcggcgagccggtgctcgtcgacgactccggcgtcaccgtcgagccgctgcagcagggcgcgacctactacgtgctggtaattaaacctcaatttgctcacattaactcatataatatgtcgtgctaataaataatcaaaaaattaactagcattttctcgagctaattaattgagtgactttacagtcgttataaagagaagttatcatattttctaatgtaaaatttagtaactctcgttatcttcagtattattaaaagatatcaaaatttgcattaaaaatattaatacctattaagtactataaaattactctaattaatatgtggcttaatttatttatcatttttatgtactttcttatgcatgcaggtatctgaggaagctgtgcattgaagccgtattaccttgattacatccacaattcggcactgatcatgcttgctgcatgcgatcgaatcatcgatcatctaagagattctaagttaattagtaattcgctcactagtttggtaatagctagctagcaaccttcatcgatctgttatttcattcagtacgtacatgtctacttaaaatcactgtcgtgtagtactgtacgtgttttgctcgtctgatcaaacagcaacatgcatgacggttttaattttgatgcaataaccagtggagtaaaccacataaatctatcattgcaagcactgaaacttttggactctctttgaagcctgaactctgaacatgtatacatgcacggcgtgcatggatggtctgctgaaaactgcacacgctgtgggattcagagagaggcaggaagggaaacgaaaacattggtatggtctgcagggcgcatgcatgcagattcagagccttttcgcgcacttgaatgcatatgcatgagttaatttgcacactgtggacgcaggggaacacaagaacaatggcatgcatgcatacgtttcgtgtagggcagctgctggctagcttctcccgtacagtgtgctcgtgcgtgtgtgctgctagctgggaaagtgaaatcatccctcgatatcttctcgtttggtgcatgtcacctaaatagtcaaaaaattattaaaaaattatcaacatatattaatatgaaatatattactccacaaacatgaaaatttgaattcaatttctacaagttgtaacaaaaataacaaatatagtcgaatgtgtgataactgttttcagtttaatttgttattattgtagcaacttgtagaagttgaatttggccttgcatgtttgtggagtgatatatttagtattaatctatgttgtcaatttttttcaaattttttagtaactatttagatgacatgaaaaaacgaggggatgtgtcctcgagggatgaaaatccacatccgtgctagcttagctttcaccggtgaggttagctagcaggcaggcagacaggcacagggcaacggcagccagagccagggctgggctacgcagaccaactctctgtacatgtttaacatcactcgctcgcttcctcagaattaaaagcgaagctttgtcgtcagtaaagtaaacagcgggaaagtctttttagaacctagctagccaccatatgcttacatcaagattcgggcgtagagctcaagtgaaaacaatgttgcgagtgagaaatatatagcacgtatcacgaaagagaatttaatagtttttctcttaaggtacctaaaatttacactacataattttataccttgatatacttaatgtttatgtaggtaacaaattttatataaaaaatatgatatattctggtatctttttaaagatgataaaattatccatatacaagcgcgctaggtgcatccagtaaacagctactagcacgagcatgagaggtgagtagctcgtatgaattgtgttaagggtataatcctatgcatgtgaatggttagctgcgttggtttttgatggaatataagccagtcgtcattgctaagaatttgatcgagttttcggtgctaaaaatatgtccttagaaaatgtccataaattaaagagtaaacttcactctagcttgtgtatactgatatatgttccgtaggtattactactcctttatttattgtattcatactagattattaattagctgattatggatgtaattcctccgttcaaagatgtacttctagcataataattttgtctcaaaacgaagctatttcttcactcactctttcctctcaaccaatcacaaccattccctatttaattttttcacctactttcttttctcaaccaattaattacgatcttccttcaattaattctatatacttttttaatatccgtgctaaccggatgtagtaaaaaaaaaggcaaattgacgacgatgattacgtgtacagtacaaatttaacctctccgatattcatttctaatggcctgcaaaaggcctcaaaatgaatactatatacatacatgttacataccttgaacaaatcccctaaataaatgcagaataagttcgccttgggtctctctatttgttgtccagtccaattttcgtcccttgaccgcaaaaccgggtaccttccgtccctcaacttagaaaaaccaggcaaactttgtcctatggcagtatggtaggcggttttgacctatgtggcgcattgaccatcccacgtgtcgcgctgaccacgtttctcctcttcttttaccgcgtcgctgcgtcggcgcttcaggatggtcctctcctgcgtcagcgcggcgggagcgggagcagcggaggacggcaaggacagcgggagcgggtgccgcggcgctcgcggcggaggacggcggagtgtggcccactccagcacgaagatggcggcgccgaggccaccgacgagcttaaggatgacctcgccgtcctcctcccggacgtaggaccgcagctcggcgaggaagtcgccggttcgtgtaaaggcgagcaacgtggcggcgccctggaagatggcggtgaggacggcgggagagggagcagcggaggatgacgaggacggcgggagctgccgccgcggcgcttgcggcggaggacggcgaggacgtagaagccgaagccctcgtgcgcgatggcggcggtgaggtcggtcccctcctcgaggggggtgcggcgcagatggaaaatttggtggtctggtaatcgatcacaccaagaagaagaagaaagccaaaggcaccgtcattggctcctcagctctggagcagctatcctctgtgccggaggtaggatcaggtgcactgtcaggatgggattagttgtaatgagctgcgagtctgatgattggcgattaatgctttatggaatgttggaactccttatttttcctttatttgcaaaccgagcttttgtatgcaccatctgcttgtttttgtcactttaaacgtgcaaactgactggaaattttgtagaagttcaggttagaagttttgtaaaagttcagatgatggggagcttaatttccctgaactcaacagtgttgctgcttttcatcctgttcagcaaagacgcaacatttcgtactagttttttctgaagatttgctttgcaatacattaagagaaacagaaaatatgctgggctttcaccagatacatgatgtttgaagatgatagcaaaaatctaatctcatcaagtgatgtgtataaagagggcaatttctaagataaggcccagatatagcgcgagaattggattatacaacatcgtaaacaaaatcccatcttcatgtccactacagatcattgtgtgtcggagcacttcaaaacctcttgcaaacaaattcatatggaggaactttatcaaccgcagaaggagcaagtcaataactccacggccgtgggcggcggcggcggtggggggaggcacggcggggtgcccgctcgccgcgacgctggccgatcctggcggcggccgcgtgctggtgctggagcggggcggcgcgcccgcggagttcccgccgctcgccaccgcgggcggattcgttaggacgctggccatggcggacccggcgcccgagttggacgcgcccgcgcagaccttcgtctccgaggacggcgtgccgaacgtccgcgcccgcgtcctcggcggcgccacctccgtcaacgcgcccatcctgttccacaaccacggcgagaagcgtcagaggcgcaacgaggaagaagagggagagccgagaccaccatatttatttttttatcgctgacatgtgagccccgctatttttaaattattcttttgtatgtggctgacaggtgggcccatggtttttattattttttcaagatataattgccacgtaagcgccacgtgggacggagacctagtcaaataagccacgtagacgccacgtcagccaaaaccgccttcaaaatcaccgagggaccatatttgcctggttttcataagttgggggatgggtcgtacccgaatcagcctggacgacaaatagagggacccaaaataaacttattcaaataaatgcatatacacgctaaagaacaaccaatcttacggcccatttgtaaagcccaaatccccccaataatccagcccaatccccaggaaattgatttaaactgacttgggctgtcatccccatagattgacccttccaattgggcctgtagtctgtagcagtatcttagacttcagcacttcggatagctacctagcctagctacttgaccatctagcttaccttgccatgaacacatcactagctaattaattgatcatcctcttaattatacaagaggcgggaacaaataatcccaatactcgccaccaatctcctcgaaatcgatcactcctgcgtcacttttcgagcattcttgcatcgaaacttgatctttttctgaagcgaacgacaccatgtgatcacagttcgtcgcggtctgcacgccggagaagacgacgcttcttgctgcggcatcggtggtggtgttcgctctcggcctcctcctgcggcgcgcgcgggtggaggtctgatcggaggaggagcggccgccggcgaggtcgcgctcgaggtgcttctgcacggtggcgagcgggaagttgaggtgggcgcggtggccgcgcatgcggagcgccgccatgtcgtacgccagcgcggcctcgtccgccgtcgcgaacgtcccgagccacacccgcgcgcccctcctccgcgtgtcgcgtatctccgcggcgaacttgccccacggccgccgcctcaccccgcggtagctcctccgcgccgcggccgtcgccgtcgtcctgtagttggcgccgccgccgccaccgacgacctggttgtgatcaccgggggaggcggcgacgagctgtagctcgccggaggattccgacgcgagcgccgccccgctgagcagcagctcgtcccactcatatgcgcccatggatatccacctccccaagctcggcaacctctgcaagatcgccgaattctcctcctgaccggtcaccgccgacgacgacaccgccaccgacgacgacaccgccggcgacgacgacgacgtcatgatgctggcccacacgttctcgagtatgttgctcgtgtcatgaggctgattggaagctggagccgctccgatcgccatgaccgatcgatcaagctctgaagattttttctcttcttcttctgaagattagcacagtccatttgcaccgtgcaatatatatctatcttgatcgaggtggctgtgtcatagctgagctgacaatggctggctggctgctttgccgatttctgacaaagcaagtcagcgcgtgtggctcgtttgtgaagccagctaaggaatttgcatgagagggagaattcggtggcctgaaaatgagtgaacccgaattaattcagtcgcggcgcaagatctctgcagaaatccagggatgttcacgcgtgcatggtatcttgaggtggttgattttgtgctctggaatgcattcttttctccagcttggttgaccagatgcatggctaccatgtaatgcttaggtcagctccagtgtttcggagttcagatatcaaagttgcaggtgttctcgttaaagaatttccagctcatattcagaatgtcctttaagaaaaaggcatgtattcagaaaatatgtacaaatacttctttgggcacaataaatgtatttgccatttcattcatactttcattcgtgaaattggtgcaattttgagggagatgagtcatgtgaattctgaagagaatttgacacattcatgcatggcaaagtattttattcttatgtcagccatgtaattgcactgttgcagtactagactattggttatgacatacgacatccccatcgattacacaaaagaactatattaaacactaaacattgatcaggagcaaagcatctccttaatcaaattccttaacgaacaagataatcacataatgattgcgtcatcacaatagcagaggagggtttctttcctgaatccagttgcttgatctgcttcacaagccatgcatgttcatgcgtaccgtaggcgccgcatgcattcaggcacaagacccacttgttcctatcattgcatccacttgttaaaatcattgcatctgaatcgatctgtgggtcttatctttgaacacgctctaatataaatttataataatccttacctgacaagtcaaccgagctgaaaatatcactcaatccgaacaccgttttcaattcttcaggctagcatgcaagtcgctttctgataaaactgaaacagcttagtttatctgaccgcttgatcttgaagctaaatactagctaactaggcaccgtttagtataatctggagtttggggctggaacatggaagcagtgtggttgaagcctgactttctggaggaaatcgcgtgtttcccatcgttgcattgctcgtacgttggagcaggagatgtcacaagtgataagatgcttctgggtgcaggaactgaccgtgatatgctgcgatctctgatggtggccattgctcgtccacaaagggcagatagcttgggcaggttggaacagaatgttttgtgatcttttgcctctgggtcaactcatgcagtaatgcatgtatgacgcgatggttagcttgctaattggaatcgagaaataaaatgagcatccattttcacaacaactttgcactaccaagtacaatcgtttccgcaatcttcccgaactgcaaatcagggtcttgaaatcagcccaaacccccaaaaccactcttcatcgtgcgtggtgagttttgacttgaaaggccacacatttgacagttcagattgatgaattatctgatttttcctcatagctatttgagagtataaacgagtgaattaactattatgaaatagaaaagttgctttagaaaaatatattccaatatttattttacacgaaaatgcgttgattaatagcttgggaaacatctataagaaaatctaaaatatagaataataaaagagaacagggcataagccagtcataataaaagagagcagtctaagtcaatggttgtgtttagttcacatcaaaattggtagtttggttgaaattagaacgatgtgacggaaaagttggaagtttatgtgtgtaaaaaatttttgagtgatggaaaagttgaaagtttgaagaattactttggaactgtccaatatctcttccatttttcagacgaaacgtgtagctttattttttgatttttttaggctaatctgaactctgaaggcagtcatatggttgaaccggcccatcaacacaaatacaccatgggctcgaaccataacaagtcaagccagaacaaggcccacactatcatgggccggatcacggcccatctaaacaagcctttccacaagtcagcgacgcagtctgctctttcctgtcttctcctccacctttttatacaacgcaaatcgcctcgtcactactccgtacaaattttcttctggatcccacctctgctctgcccattcgacggcaacgcgctgccgcgccatcgcgccacgtcgcctcgtcttgcctcgcctcgtccaaggtcaacgagagcatgggaggaggccgggaggaggaggcggcggcggcggcgagcaaggtggggtactcctccggcgacctcccgccgtcggcgccgccgcacctgcagggccaggacccgcagcagtaccagtacggcaccttccagccgccgccccatcaccatgccgcctcgggcgagctcgcccgcccccccgtcgggttcccccagcccgccccgcctccaggcttcgccggcgccagcggcggcggcggccactaccaccaccaccatcagcagcagccctacgcgccggcggagccctactacgcgcagggctaccagaccgggccaggtatggccggtctctctcacactgactcctgctttgcttgtgctgctttgattaggtttggtggggaaatatggggaattgcaaatcgcaattggaaatttggaggtcttcatgagcctcacagcatcgctatgctctcaatttctcatgtccaactacaaattttcgatgcttttgtgcttgtggatgattcagaagcctgaccaatatgcgtgatccgaattcctaaccctcttatttctcttcacggatgggaaaacctacttagatttttgacttgggaaggaagatgaactagtcatcagctcaactacgacctggtctgctaaaatgtaaataggaaagtataaaccaagtttatggtaggaaaagagacaggatagctgatttaaacaactagactttcacttcctgcacacacgacgcacctttgatgattgaagtgttgctcatgacattggagaaactttgaggcgtgcaaattcatctaatttggtgaatttgaagtcagctgaatcactgaccataaacagattcagctgaatcttattgtgattctctgcccccccccaacacacacacacacacaaaaaaaaaagataaaagaatatcgtctttaacctcttattgtcgcatacacaatgatcaccatatccttctctatttttccttttgagataatgtaacttcagatcagatttgcatttattacattgaaaaacaaacaagtgaacccctagcatggaagtagaaattgttatatgatcatatggttcgtggtttctcaggttatggtcctattgctgagggaaggccagtaagaatgcgccgccttccttgttgtggtcttgggttaggctggcttctgtgagtgtccatgctttcgttattcttgccatactactgaagttaagtccaactccttaccgagtttatcttttgttcaaaaaggtttattgctggatttttccttgctgccatcccatggtatgttggggctttcatactaatatgtgtccgagtacatgactacagagagaaaccaggatatgttgcctgcactgttgctgtaagtatatttctactgatgcgctgcaatcacattgttatattctccctccgtcacaaaatgtagctatttctggctaagaatctggatcagaaatagctacattttgggatggagggagtattatcacaaatttagaggtgaatatgcaccttttgtagatggaatttcagtttatcttggatttttttattgtgaaccacatagaagtagagaaatgcagtcgcatggttatattattgtcaataattcagaggtgaacttggaccttacgtaaatgaaatttcacttcaccttggaactttcatttaactacatataaactactaggtcatcttctagatcatcactattgctttaaatataaattgcccacctgattagttcttcatagtagatgtccagttttttttgttcataaacggttgtgcttataacatgaattgccttcttaatgcttgaattgacttcgttttgaattcttctgcatcacaaacaggctgtaattgccgcaattgtcatccccttggggttaaccaaaggagcacacgtatggtgagctgcctccgagtttctaaggagtcactgcatgtaaatggcctgttattatttgagaccctgcactgggtcatatgatcatatcacttgtatatgtgtatggatggtaatatagtgagcaacttcagtgtggtaatcttatatcgaaccattggaccctcggtgttcatatactttgtaataaaggatcaatcatacaagaaccttaataaggagtaatatactgcgtcatatcagatcttaccctcgatgctgaaacgacctgaatattttcgtgttcatggataataataaatcaggtgagatgcatactcatatctattatattattaaaggaatagaaaaaggagcctccacgttcgctctcatggcctagaaattctcacattaatcggagaaaaagaaaagacagagttcatatagaaatacaatttagaaatagctaaaattaaaggaatagaaaaaggagcctccacgttcgctctcatggtctagaaattctcacattaatcggagaaaaagaaaaagcagagttcatatagaaatacaatttataaatagctgaaatttggaattaaaaaataaggaatattagaagaggagacatagaaatacaatttagaaatagttgaaattcggaattaaaaaacaaggaatattagaagaggagactagagtccatatagaaatacaattaggaaataactgaaattcggaattaaaaataaggaatattagaactagagtccatatagaaatacaattaggaaataactgaaattcggaattaaaaataaggaattttagaagtagagtatagagtccatgtagaaatacaattaggaaataataaaaatttggaattaaaaacaaggaatattagaagtagagtatagagtccatatagaaatacaattaagaaaaaaatagaaattcggaattaaaaaataaggaatattagaagtagagtatagagtcgatataggaatttaaaactaactaaaatttggaataaacataataaaattaaaagtagagatataaagatacaatttacaaataactaaaattgcaaattaagaaaaacatgggaagaagagtttaaagtcaatataggaatacaatttagaagtaactgaaattcgaaattaaaaattaaagaatattgaaagatgagtttagagttcacatagaaatacaattagaaataataaaaatttaaaaataaaaataaataatattggaagaagagtatagagtctatctagaaatacaatttacagaaaattcggaattaaaaaaaggaaatattaaaagacaagtctagagtccatataagaatatatataatttataaataactaaaatttgatagtaaaaataattaataactaacacttaatattatataagatataatatgaatattacccattagtagttttgtaaagttattgcaaaatttaaaattatgttgtcattttaatatatttgaataatataatgaggaaacatatatgctattatatgagagaaaatataatgatgctagccgcgcaatctgcgcgggccactgtgctagttgtagctaatccgaagtaggaataagttcaccggaggtctctcaacttaacagcgagattttttgaggtaccttaaccataaaaccagaaatgtctacccctaaacttactcaaaccgttcaccggaggtccctcgacagtattttttgtccgattttgctgacgtggcatcctagtcagcaaaaaaagtttaaaaagtacgtggagcccacatgtcagctgcacatatttttttcttctcttttcttctccttctcttctcttttcttctctcccctctcttctccttcaggctggcggcgggcgcagacgtgatggccgagcgcggatgcgggcggcaggcgagcgcggcagcagagcggtggcgggcggtgggcggagcggacggcgggcgagcccggcggcggagcggaggctacgggaggagcagccgcgcaccgtggccgccgtcgtcgtcgccgtgggcgaggcggcacggcgcggccgttcagcggcatcggccaggcgtcgcagtggccgtgcataggtggctcgaagtgccggctgacgttgcaccccagtcgctcgcgctcctcctgtgccgcggcagcggcagtggtggcgacggcagcgtcgccggcctgatcccatggtcctcccggacgcccagctcgcgcagctgtagcaggagcgtgtccacgctcggcgtgccatcggcgtcgtggacggtggtcggcgcgggcgcggtgaccctcatcgtcttcaccgacgtcgcggtagcacttgacgtcgtaactcatacgcatatacgccgggtacaaacggccgcatgtacatgcgtcttcgtacgagcatatatatacatgcatggagacgaccagctatagcctagctagcttcttgttggtttgccgcccgataacatgcaaacgtatatattagccaagcatg

SEQ ID NO: 44882 - DNA, 1655 bp, Oryza sativa
  unsure (1)..(1655): unsure at all n locations
aaaagaaaagagaagaggagaggagaagaaaagagaagaaaaaaatatgtgtagctgacatgtgggctccacgtgtttttttaattatttttgctgactaagatgccacgtcagcaaaaccgggcaaaaatactgccaagggacctccggtgaacggtttgagtgagtgtaggggtacacatttcttgttttgtggttaagggatctaagaaaaatctcgctgttaagttgagggacctccggtgaacttattcctccgaagtaacatgaaccaaaaagctacggcccaacttcatccggcccaaacttgaaaatgaatcgaacaggaaattcagccccagaaaggccgaagcccacggcccattagggtttctcgtcccccacacataaatacctcctccgcctccgcctcctccctcgacggccgccaccccgcttaggtttaggtcttctccgcctccggtttctccctccgccgtcgaaatggtcgcctacagggtaagcttctcctcgccgccgccgccgcctcctccctcgcgttccgtcgatccatcgagcgtggctgatctcttcgtttccgtgtttgtgtgttgcgaatttttccggcggcgcagttccatcagtaccaggtggtgggtcgcgcgctcccgacccccggcgatgagcaccccaagatctaccgcatgaagctctgggccaccaacgaggtccgcgccaagtccaagttctggttggtgtcgcaagaactcttatctatgatgccttgatccttcgtgtaatttcgttgatgatttcgtgttgtttgtttgcgcgcaggtacttcctgaggaagctgaagaaggtgaagaagagcaatggacagatgctcgccatcaacgaggtaccgctcaatttgctcactttcaatttgactgccttgtccatgcgtatcaattgccatgacgtcgttacagatccgcaggctgccactttgatattagtttgtgctgtggtttatcttcctatctaattaggcagtgataagtatccaactcagtgacattgaccaaatttgatagatcaattttgtctccatggctggcagttattctctactggagatgctcggttacatataggacagatcgtggatacttatgttaggtctatctgtgcgccttatgactttgtgatacgaccgaaatgcttgattttgtgtgtctaaaaggtttgatcacaaggaagctgttaggcatttaataaacaattaaatacctttgctaaaacaattaaattctttatagagggaaatgtaatttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 44883 - DNA, 1080 bp, Oryza sativa
cgcgcttttcaagtttttttatgggagcacgtacatcggtaggcatgcaaaaatagggcaaaacgtgtgagtacacgtacgtgtttggcgggagttttttttaatgagttctctaaactgttattgaatttaaaatatgattaattagtttttggctggaagcatacaaactaggataaaatatctaatgaacgttgtctagtttgaatgtgtaggaaaatgtgattatccacgttaattttatatgtggctatctatttagatttagttgttatgtaaatattaagaagtttaagagataatatgtaaaaattgtaatgggagtatgtgttgatggcagcttcaataccaccaccattgaattctttttagaggagtatagataatatcttattgggagtatattaatcgatgtttcaactcacatacatcttgtttctaaaattgtccatttcaatcaaagtaaaaaaataagtttgctatacatttattattgaaacgctcagttaggaaaaaaccaaactagacataaatgagtaaaacattacgacaagttttttcttttaatggtatgcaaacttaaatgtaagctagatttccagcacctcggtgcaataatccagagagtgccatgatgtaaaaataacttggccagcactatctcttaggatcattccaattcctcaaactccgatgcgccgtcattcttctgctggccctgcattgcgccggggtattcgacggcacctgacatgttgaaaccagagccgaacctgaactccgatgcgccattgatgtcgcccatctggttaccgaatggagtatcgtcgcggatgaagaactgctgctgtgccggggtggtctgctgcggttgctgcatcatgccattgacatcttcgaacacacctccgttgctgccgccgatgccacttccctgtccaaaaaagccttcttcaatctgtatccttgggttgactgcattaggcctctccatgatcgtggcattgtcgttgctaaggttcttgttggccacgaagttgttgtcgtacatgttcatcagctctgtaattgacctctggc

SEQ ID NO: 44884 - DNA, 39163 bp, Oryza sativa
  unsure (1)..(39163): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaacagattttaccggtgcactgtaccactgtgcacagcacagtcacacaacctgtgacctgcccagcagcagccagtactactaggggtctaggaggacgcatatcggcatatggggaggtaggctagctaggcctaggagtggtttggcccaacttggtaggcaccagaccaccagtcaagtcaggggaatccagatgcctgcctgcccgttatcatcatggggcgcgcgcccccgagagcgcgcgcacacggcgagtgcgcgccacggaatatgctgcctccgcgcgcaacgcgacttggtccatccatcctttgcttccccaccgagtcatcggtcgcccaccaacgctgcgcccacccaccaaacctttccctgcgctgatcggacggtccccagccgatccgatccccggatcaccgatccggcgacatgcctcccctccatcatccgccgatcgatacacgcgccaccgaacggcaggtgaaagatttacgcacgccgcccgcccaacagccaaacggtagcagtacacgatcatcccgtctgatgcgcgcgttcgccccaccacctcctcctcctcgatagatcgatcggtcgtccgtgtccccactccgctcatcaccgagaggcgactgcattgatgatcgatcgtagccagcgacgagacgacggggctagcgcggcgctgtgtcgatccagccaggctgggtcgcgccgcgccacgtacgtacgggctctctcgtcaaacgcgtttgatcgatccgtccccccgctaagccgccgtaccccccctgttgctttcgggcaaggcaggcgggcgcgagcggcggcagccgggcaccacctgccaacctgtgtgcatgcatgcgccccagctgcacgggggcttgaaaccgaatcgcgtcgcgtcttcttctcactcgcattacctcatcagccgcgcgctctgcaggcgtcaatccggcacgccacatcgtccgtcagcgcggttcagctagcaaaccaatggcgcgtacgtgcacgcacgcacgcacgcgcacggagagagaggatccttggtgcatgcacgggctaattcgctccagtagctgacgcttttgttaggccggtgatgacctgatgacgaggagaagaagatcgatcgaactaattttgagattgattattgcggggtaattcgatctcgcgcgccacacgttttccgttttgtttatgcgcagttgatactgtccttttgctccacctcttttggtcattttattagtgccctcttgacgctaaacaatgattaggggttgctttctcacctctgtttcgtttttaagctcatagggcttgtggccggtccaaacgactcgaccaataaacaacatcctatacaagcccaaataaagaatggaagggtcctaagcacgtgttagcacgcccgtgttgcggaataagtagtgattaactttagtgagttgttctctaatctcgtcatcaaacttaaaaattgtctatataaaatgtctttttaggttaattatagagtttaagcttttgggggcaattttaggtcaacaataagctattaatggattgatttttcaaggtcgttacaattgaactttgaccatcattctcttccatttcgaatatgctatgaacgacaactatgaaactagaatcttgtacatggaagtattttcaaacatgtcaatactattttaacggcagtaaatatggatgcttccagactgactattctaaaatcacaaagtttaaatttagaacacatcacgcacttctcatatttatccacagatcaggatgcctcaagaatgccccaaaggcaaattgaccatttcaagtcacattagccatttccttttcttatattatcttgcatggaactctttgcataaaactattataaggggttacttagggcagattaagcagatctcgagaaggatttgtagccgacagagccctgatttggtggcctcacaaggcctaatccttactacctttcaactgactcaactgttcacctttccctagagtttctccatccccaaactccccaacgtttttcaccccaagtcaccccaagatttgtcttccaagggagaagaagagaagaaaatggtcccagtagatgaggcttttcttgtggccaagcgactgtggatccgttgccacgttaactcggcaagtgctgtcgactaagctgtccctgtccctgatctctatctctctatctatctatccccatgatagggggcgtccctgttagcatgtgaggaggggtcacaagtgacaagtcccaccaccttcacaggctaagggataagatgaggacggatgataagtgccaccttgcaagcaataaagggccatgggagatatggagatggaggagagatggggttctttggagttgtgatcaaacaagggaccatccatcaatccatccgaaattcatcttcttccctttttaagataagccatcaagggaagcttagctttggactgcctaacttttcttagggttgcagctttgcattgacccggctttacgaaaagctgagactatcaaatcctagctttccaagcatctttgatgtgaaagacattgagatcattgacgggaaacaagagaagcaactcgaacaggatatgtcttttttaccaccaatgagggaatggagatgggatcttgggttagtgccactggcaaagtggcaacatcaatatcgaagtgaattggagtccaggtaaattgaacatttcttctgatgaactggcagaaacaaaagtatacctgtctagttaccatcttgacaaaatttccaggcatgaaagatacagcgggaggaaaattttccacaggttaggttgatatttaaccccaactggaaattgacatctatagaggaagacggccaaatgtaccgcagcaatcaaacatgaaacatgtataggcaaaacatgaacatcagtagaaggcttaccaggtagaagtagagccgtagagttactcaagagagcacttcatacattcaccggatgataaagatacaaaccacatacccaaacaagcacaggtgacttaacaaccagacatatgaacagcatttaactaacaaattaaactagaaataacattaagtttccataggaggtttactggctggacggacatacatgtataaaccagttccaagttccagccattttgcaactaatgcaaaacctatatgagaaagacctatagaattaccgggttcacaggagacgcttccaccatggaagcagagggatgaccatggtgaactttaaaagcttaaggtgctctttctttaaacgctacaagtttattcttcagtactctcagtagtaccaattcgagccgtcattcttctgctggccctgcattgcgccggggtattcgacggcacctgacatgttgaaaccagagccgaacctgaactccgatgcgccattgatgtcgcccatctggttaccgaatggagtatcgtcgcggatgaagaactgctgctgtgccggggtggtctgctgcggttgctgcatcatgccattgacatcttcgaacacacctccgttgctgccgccgatgccacttccctgtccaaaaaagccttcttcaatctgtatccttgggttgactgcattaggcctctccatgatcgtggcattgtcgttgctaaggttcttgttggccacgaagttgttgtcgtacatgttcatcagctctgtaattgacctctggccatccatgggcaggccgaaatccagattgttcagagcctggttcggcgtgttgtaggttgccgggaagatggccggtggcgatggcttgttctccgtgctctgctggagtggatcattgtacttgcaagtgtattggtggctgttgcgcgcgttccggtcaaggaacccgtatccatagtcgctatgcgggcactggacattgtggcaggtgtagacacggttgttcagcatcagctcaggctccgcgccagacgcgctcctcttctggatgaactcgacatcggtggcctcctccttcatggacgccggcatgaggaacttgtcgttcagcatagccgcgccgaggttgaacgcggtcgggtcggcgacaacaacagccttctggttgccggcctcgtcgcccttgcagtcgtcgacgacgtcgacgtcgtactcacttgagctggcgttgaacgatatggcgctggtgatgccgccggtaggtgccggagggcgggcaccggggttcagcttcaggtacagctcctcttcctgcttgacgacggccagccaggtggagatctccttggcggtcatcttgtcctggaggcacttggactgccggaccagccggcggatcttctcgatgtccggcgacatgtgcttgatgacagcggtgagcacgctgaccttccaggccttcttgaggtcatggggcttcttgtacggaggcgggccctggtccttggggatgccgagctccggccaccactcctcgtcgccggtgggccaccacggcggagggacgcccttctcgagcgggtaccgccgctgcggagggtcgcagtgctgcatgagcgccgagagcagcgacccgagggtggtgtcctgcagctcctgcagcgagtgcgggctcccggtgccggaggcgagctcgctctcgaagcccgggacggcgttgtcggcctggtacttggcgatggcggcggggccgttgcggtcgaagcggaccttctccttccaccagccgcggaggttgtcggaggcgccgctcaccggcttgcccttctccgggatgatcccgtacacgaacccctgcgcgcggcacacctccatcatcttgagcatgtacttgaggatgccgtcctgcgcgcgcgacatcttcttccgccgcgcctgctcctgcgactgccgcggcttggacgggtcgcccacgacgccgcccgcggggtccttgccccggctcagctgcagctccttgagccgcttcagcttcatgcggtcgcgccacatgcggcgctccagctcctcgatgtcctccacgtcgtcgtcgctgtcgtcctcaccggcgtccgggaagctctccggcggcgggtccacgaggtcgccctcccccatcacgcactgctcccccgacgacgtctgcggcacgagcgcgccgaagccgaggttcttgtcgccgccgttctgctgcaggagatccacgaagttgtgcacgccggggaacatcatgccctggtccatcaccagaccacctcccatcatcgcaacgcacaacctcgaaataattcgctcacaggtagacgacgactcttcttgtaccacttctactcaagtagtaattcacctgcacacaagcaagagaagaagctgatgttaattacagaaatcaaaaccaagtttaagcaactgattacttcgtctaaacgcaataagtgttactactacctccttaactgagaatacatgcgcaacacgactacggttaccgcagcatcctaatgcggcaattacgccattaccaaaaataaagaggcagtactggtttgtttcccttcagaaaacattctaagatctagaaagccaggagaccaggagattatcgcgcgagtaaaattaggtttgcctattgaagcaagggccagagcctaattttgcatgtgtttggtgaaacagagagatctttatctgatcagacatatctcctgcaatcctctcacagagttaagagcacgcaattaacagtcatataggacatggttatcttttgttgtgacataatcatactacacagcataaaggtatcatgattcagacatgatcataaataaagtactaacggaagaattagtcaaagccgaagcatgaaaacattttgtgatgcacgggattagctgaaacggtattttcatgctgctttgaaacaagtagggatcaaaagaaacttaaacatgtgaaatttctccttttcttatcctttccgtgaagtattttgaaacacatgaaacaacaagccttgatcagatcaaagtgggagatgaaaaaggaatagaaaagcacgggaaaaacatttcagaaaaaggatatatttttatggattattttttcggtctaccacgaccggcatggactgttggaaacaagaacatgtacccatgtgcttatcaaaaggaatcggaggccatctaaaagaacagaagaaaacaagagacgaaaatggatcaagaacacatcaaatggagaacagaggaaaacatacaccgccttagaggaagcatcaatgattgtttttggccataaactcgatgcaaaacaagatgcttccttacacccaaccacttaacatttccagagcaggatttacaacatgtattccttaaattaggttaatctctgagatctaatgaacacaacaagagaaaactagtagaaaatttctaagtttttttccctttctcctttggctggcagcaaatcgtataatctgaaaaaagctaagctttgacctctgccatggatttactcaagcttggcagaaacaattctacgcacaagaacagaaaatcacggaataaaattggaagggaataaagggcaacgaagaagtagccaaacaggaattggctaccgcaggcagctctagcatccacgaaatatctgaaaaagaggacaaaagatctacccaaacagatcacagaccaccaacctatcatgaacacaaccacatcctctccaagaaaaaaaaagaaaaaaaaagaaaaaaactcgaacacaagcaaccatcaacaggaggacatggagaacagcaagcccacaacagaaagagaaggggatagcagcaagcaagcaaaggcgagatcgagctccctacctctccctgccgatctcccacttgctgttttcccttccccaagcccgctagctgttatttctcctttgccatgaccttggaggagaggagaaagggagagagagagagccaggcacgagtggggaagataagaacagcggagccaaagccagggccaaagccaaggcgcccagcgcgccggggggcaaaaaagtaatcggcaagtggagggaagggtgtgccgaaatgggtggtggcttgggtgcaacagcgacagggaccttctcctccccctcccccttttataatcccgccctaaaactagtcttcctcccacgaacgaaccgccctgcgccgctgcgctgcggcggcggcggcggctcgctccggtaagccggtaactgcgttgctttgggagggtgaaaaggtgaaacacaggcatctgtccgtgacatgtggggtcccaggatcagagagctaatagctaggtgtactgtgtccaggccctccaggggctgcagggaggccggtttaccgttttgccctcggtagggttctgtttagtactgtatgtagtacagtatcagattggttctccctcccggaggctacatgggggagagactgattttctgcgcgcttttcaagtttttttatgggagcacgtacatcggtaggcatgcaaaaatagggcaaaacgtgtgagtacacgtacgtgtttggcgggagttttttttaatgagttctctaaactgttattgaatttaaaatatgattaattagtttttggctggaagcatacaaactaggataaaatatctaatgaacgttgtctagtttgaatgtgtaggaaaatgtgattatccacgttaattttatatgtggctatctatttagatttagttgttatgtaaatattaagaagtttaagagataatatgtaaaaattgtaatgggagtatgtgttgatggcagcttcaataccaccaccattgaattctttttagaggagtatagataatatcttattgggagtatattaatcgatgtttcaactcacatacatcttgtttctaaaattgtccatttcaatcaaagtaaaaaaataagtttgctatacatttattattgaaacgctcagttaggaaaaaaccaaactagacataaatgagtaaaacattacgacaagttttttcttttaatggtatgcaaacttaaatgtaagctagattttgttaatttgtagaatatactacaaactataattgtttggccagcaaacactaagtttagtgatcaatttactcagacaatttaatatcctactgtcattgtaacatactataccatttacaaagagagtaaagtactcaaatgttgtttaattcactgccaaacatttcctacttttttcacatcacaaaaaatcaccttttggtttatagccatatttgtgctccactcaatctacaaaatagagcatccttcatattgctagctaaggtgtgctccatttttatataccataggcaacttaaacatagcaaacttatatatacttaaggctaagttcgggagagcggttgggctaagctttttagtgacacctgaaatgagataaacctttgatgcatggttaatcgagtattaattattacagatttgaaaaatagataacttttatttttttacatgaaacacagtttagctgttcgggatgtgtccttacaaagaacgagaaagtagtcaatcataaaatcagtttagaactcaccactagagcaagtactatagacctcaatgctcttgcccccaagatgcccgatcacatgagatggagaagagaggagtcacctcttatgtatggggtaacatatatacatacttcttagtgcaagtttaataataaagccaattactagtagttccaaaaattaaaacatcatctatatccaacctaaaaacactcatacagtagtaagctgtaaacatatattgcattattaatatctaatccacccaatagtttatcggagctcgtggtgcagttggctacaaatctatagcccgcttttttttctatctcctctcctttttcttccgcataaatacaaatatgatgttgcaacttatatagcttgcttacatcatcttgttgtactcgctcttaaagagatgagaaatagaccaataaattgaatgaaaataaataaagtaaaattattataatatattaggacaaatgtattaaagataatatgttgtatgtgttacctcttaattaatgagcattaggcagagttttcttagggtgttggaacccttctctttggtacacaaaacaaaccgatgtattagcacgtgattacatatgtactagctaaagagattttttaaaccaactttcctataaaattttttttgaaaaaaatatatcactcgacttatgagctggaaagtttaagagtaaacaaatatgcagatttttcgtttggtatttttttaaaaccataagtcactattgcactgttaagccaaagttaggttggagggtttttttttttttgcttaattgaggtgaggaataactcaaccattaagtttaggttttcaaagttatcggtctataaaacatataagaaaaagatgaattaaaagactaaaccaataaacccaagtctaaaaaagaggaccttagcacttcaagaaaaaaatatattaacatacatgtaaaaaatgagagagtaaattgcgaaagtgtagttaaaaacgcacagacttgctcctagtccatcaaacgaacagaaccaaataggtgcatgcgagtcctaattctttcggttactgctgagctcagtagcacctactacagctagacaatccgcacaagatccagcggctacagcacagcaaggacagcgctagcgctagcagcagcagtgcgagcgctcacagctgctacggagggcaaaacggtcatcggcgaagccacactttcctcatcaaatccggttaactttgacggccttcgattccgcagccgccgccgcagcagcgcgatcctgaagcaccaccacgtgctgccatatgggcttgggccacgtgtcctgaacaaacccgggcccactccctcggccctgtgtggctttacacgcacgcccacctcactcgggccccacacaaactcgggttcacacctccccgggaacgcgcgtactacgcctcggtagattttctaccgcagtaaaaagatccaacattaaccacgctagtgtggagacagagagtacggtattaatcgcactgcaggtaaattattagagcaagtttaatagtatagtccactactagctccaattcatttataactaatataatagataatttatacaataattgcttactatactattagtatatgatcacacctgttctacacacattgtgtcttgaagtccgtgctgcagctggctacagatctgtagcctgctgctcttctctcttatcttttatcttattaaaatatgtttgtagccagctaatagtctattattgtatcagctcttaatcgatcgagtttgtgcaacagtgcaagttaacacggaccttaatcagagccagatgctgttgcattgtactcctggtacatttgtgtgcttttaacttggagtactgctggttcttgttttcctcggaacaacttgcattagtactgctactgcttcagataccgttggccacagcaatacagggctacaggaatctgatagtttgatcttgttcaggcaccgggaaataattgggggcgacggatttaattacggtttccgcaacgatcttgtatttttttttcctcttcgccatttaagttgtactactcccccaatcatgtcctggttagatatcaattttttccttttgcaggtaatacttcttccgtcccacaatataaaaagttctagagttggatacggttgttaagggggtctccaaaaataagtctctaaggtagggacttattttttagagatagtggtagaagtgagtggtagatgattgtgattggctgagtagtggagataggtgggaaaattgaatgttggagggttgtgattggttaggaagagaatgttggtggagaagttatattttgggacaaatactaagggctaaaagttgctatattttgaaacggaggaggaagtagtttttttggggttagatatgttttttctttggccattctgatgtgcccatttgcttgtacatatgctccatttttctaggtcatgtggatcgatacagtagggtgtagtacggtgtccactgtcttagacatgaatagaaaatgaccggacatacgtatgcctcctatttggagtagtagacgtggttgacgtattttgtgtactgcttcatgaaaactaccacatccagaatttccttcctagaactgtatagctataactcaatggtacacttccagctagcagagtacagtaaaaaggttactagtagaatagcgtactccaactttttctctacaaatggcactactactggagtgctactctaactccacgtggactatactgtagtagtaagctcgagttttttttttacttgctttcgtcagacgagcaaccacgcgcagtactagtcgagatgcgggggggatataccgccggtgaaatggtcgccggggcctatccaggccgtacacgtaaaggcgtggggtgggtcgtggtcacatctcgggccgtccgtcgtgaccaccaatccgatctaccgcacgtgctcatcgtgcttcttgggcggtgaacacgtgtggccgtctcggtagcatcacctggtcccgtggaacgcacttcagatcggctttggagtggtccgcggttgaaatgcatgatgccagcgcgtgtacagttttgtactgcacacgagtttgggcacacacggtcggtaactttgctggagcacgcagtaactaacctggagaaatattgctgctggtcgtgaggtgtttttttttggacataggctgatgagacgtggtgaatgaaaagggaaaactaaatgactttggagtaagatttttttttccatttctgttcttagtggtgtccaatagtttgagtgacaaaagcgacggaaaattaatggaaaaatttaagtttcaaatttagagcttagctatggcttataatccgtagctcaaacaggcatgacgacaatatatgctctattcaggacagctaaaatttttgacaattaactggtgactgagtgataatttagagaacctagcttccgataaccaatttattttctagaaattataactattactctatacgtcttaaaaactggttggtttagcctaaaagtttatcccatgaaaactatagttttaggttcgggtttggagtgacaacttcctcgttttctggaacggtttgctttttagaaaaccttttttatagaagtattttttttaaaaaaataaatctatttgtttaaactttgtaattatgaacattcaatgaattattcgttctaaaaacattcagttaattatttgctaatggcttatctcgttttatataccacggagttactgcggccaacactcgaaatgaactacaccttaatactacttcatcttgtttttagctatctaaccaatagtacccatctcctcctaatttccttcctctactcgttctctccacatggacaaaagggtatgttagtcatttatttatttattttatatgtttttgaatttctaaaataaaataatagtctttgagggacggatggagtaaagtattagaattcaggtgagaatttaaactatttgggagagatcaaattctaggagtagttgtagacatgtagttgtcagaaactctctgaaactgacccatggttttacttgagtgaaaacagcgtgtacaatctttgatgagatgcagaggaggttgtatttttgactaggaaaaaattccaccatttttccatgtttgaataaagaatgctcttactttaattcaaagagtactactcttagcatatggagtacaatcagttgacctatagatataaacatgtgtagtcaaccgcggccattgtatcgatataaattgatatgtcgcattgtcaatttgaaaaagtaccaagttgatgaaaaagaaaaaaaaactggaaaaagaaacaggcagccgacaacctgaaagaaatttcagtcgatgtgctggctagctcttaatttcatagtttgtccgagcacgattcttagcccttgtttagttccaaactttttctttaaacttccaacttttccatcacatcaaaacttttatacacacataaactttcaaatttttcatcacatcgtttcaattttaaccaaactttcaattttgacgtgaactaaacacacccttaattatccagctactagtaattctgactgaaatactcctacgctccatttatttatattttctatttttcagaccgagggattaatatgtattttacatatatagatgggaggagtggagtttgctcagcctcactactattttttttattcgccactgactagctgcacgtacatgctgcataattacgcttctaggtacgtcaagacactcaagacgtgaacagaaaagtcaaatcgtatgagtcaaaactattgaattacaagcgggtataatcttctcacgcaaaaaaccccgatattttcttcactgacgacaatatttttttatcgttttacttgtagatgcacgatcaaacctgacctattattcaactttatgacctgataaacctgtaatattatgaaagaaattttatactgatctatggataatattttcagtgtacagtctagtaacaaatgtcacttagttcgtcgaaaaatataagagactttaaggatttatatgagcattacttatccagatgtatcctaaaattcctttattagaacaaaattagtaaatgtattaatattttaagttttaattttatatacataagaaaaatgattagctacccaacatggccgacatctacatataggatgcacaacaaccataaagtttgactttaaaaaatctgagcaagggacaaaactttgcatgagatgaaataagcaaaagcttggtaggggatatatacaaaaccctctctgagagtgcctcgtcttttcgcttgcgcttatacttatcagccacattttaaatttttgaccttaaatttaaagttaatttcagggttttttcatcgaagtttattttttagcatttgcttttagatcgctaagaacacatatataaaatttttatttacaaattatttttcaattgaaaatatgtcgtttcgcgtatccggagggtctggaaatcggcaaatcatgtactatgtaaaaacatacttggtataaaacataacacaataaaaataaatcacatattaagtggttaaaaaatatcttgtcgatcgactccaataaccacaatatcttggacagacactgcactaaggataaaaaaaaggtaaattgaatccatatgtaaatgtgtttattcaaataaatatcgttacaataaatgtgtttatccatgtaactgaaactgtacaaaattaggaccatactactgtcatcatattttccatccatctcttttttttcccgttttattccttctttctcccgtctaatacccctaaacattggtttagggacccatataacagttccatcttcctttatcctcccatattttctcttcctccatctctgtcctctctccagctgataccgcaggcggtgaggagggcgccagcaagggaggcggcccaagaaaaagatgccaattgcagccgctcccgccgccgcgcaggtgcacaatgttgtgctgcggcatgcctccccgacgtcgcaaccccgcgcggcgacatggtgagagcagtcgccgttaaacccgagctatgtaggcgatccagtcggtctccggcaccggtgcatatgtgagtgggtgcttcaaaacccaccgtaggtgccaaggccgacaagccacggttagacctaatttatagaataacatagcaatatttataccaccaaattaattttattaaatccacaattgaatatattttttttggtgctataaaaatattgctatgttttttctataaatattcccaacctttatgaagtttaagataggataaaaccgaaattctgaaacggatgggattggagaagggctacatttcagcgtccgcacggacgcacacaacctgactattgttcttagctaggctagctagcaaaagcattaacccacaattaggggcgcattaaccattggttggatatgattgaatctaggccgtcaaattgctggtatataaaattcagatggctaaattttggcgcatggctcatgagcacaaataccgtgtggagaatatagagaatctatcgcttaattggtccatgatatgagaatacatagaaaaaattaactataatatactcttgagttctacacaatctagatttattaatatcagtatgaatgttgaaaatgatagacattataaaacagagaaaatatgtcacattctattctaatttttttttacggaggaagtattacaataccatctcagcatgatctgaaattcactaggccagtaggcagtagctagttgcggcgtcttgtttatttatgatttggttggtgacagtggaagcaatcattcatccttatctcagtttcggatctcgccctgaacctgtcgccccctggccattcagacaacacgaagcgctggagccatcatctcaactggtagattcacctcaaaatctactagcagtagcagattgcatggattttggagcagtgatttactaccacaatctagaactcgggacgatgaaattccgtcttcaataggagtaggaaatcaaatgagtggcaatcgggtccccatgtgctgtacgccagtttcaattccttcttgatcggatttctgacacgtgctcattactcctccattcgtctcgatcggtttccagtctgtccgtgccacctcaccgaaggaagaggacacagatccgagctggtgctttcgcgcaaccctaccaacgtggtaactcaaccctttcattgcactgagtacggagtatcttttcaattttacatcggaccacccacttaactctaacgaacttgtcaatcctagtatctgatataccagctgaaataaatgattagtatttgatttttttaatatctatttaatttacgtatataaacaaataaattaactcatacgaaattaaaaagctattttagaaaagtattccaagaaaattttacatatatatttttttcacgaaacacattgattacaatttgactatatcgagtagcagtatttgttcctctctaacctcctctcatcttctcaagtattgatattgggtaacgtaatttcgccaacctttctcttaacaagtggcatgtgttagtagcattttgtccgtgagtccatccatacaaaatggaaagccggatgttataattttccacctaaaatatacaaataaaatggaagataaattaggtgtacgctgctcatttattttctttttgggagctgtagtagtctcgacagttggctggacaactgtacattgccgttaaaacccaagcataaattaactgattattgtgacctcacatctcactgacttttttccagtaatcgtgacgcgccacctttttgcggcaaacattttcctagtacgcaaggctcgaaatcaactttctagtgtaagcaagataacatagttttataccgggtgattgcgatagaaagtaattcttcttgtcaagtgcatgccttccacccttggtaaattcctcgaccacttaaacaaattatgcttaacgcacaaggcggctgatagattatgctatggggcacccctagtgtcttccatcatcatattagtagtagctaaaatgatttatcgccatcaccatcacgtgggaaatagcaaatgccaaatgcattgtcaatctatactcctaagaaagaggaaagagcgcgcggctgtttgatcctatctgaacccctgatagcgtagtttaatcagtaatctctggcattgtgggtgctctctttttttcctttttatgtatactctgttttaagaactttcagctattctgacttgctgagcaaatatgataactgatatgcaacatccacccaaactctctccaagttgtgccgccatttttttttctttttgtcctacagaaattcttgtgagatcaaacttccaagcagtccaaatgtgcccatttacttactttggggctttctatatactagcaggtaggagtactcatcacgcagggagcaaagcaaagcttgccactcactgccatggcaccgccccaccgagagactccgcgactgcaaaaaccccaagacggcgagctcccggcggaccggtcgggccttttagccggccaccgcccacgcggggtgcgtggaccagttcgccgctgttcgacgatgcgaggtctcgagaccagagatgcggtttggtgtcggcaggtgatattgttgggcctttttcacgcggtttcgatccgtcaaagtttcctcacacatgctacatccacaacaaaaaagaaaggccaccttttgttgttgtagtagtagaagtattttctgaagaacctttcctgtcctgtaaaaatattgcagaaaggagaaaggttaagctgtggcaagcagggagacaaaatgtatttggggatgaggaatagttctacagactacagtcgtcatccagaatatgctgaacggcaagtcttcgaattgaatacgtatagttgaagttgttcttttctccaatagagcatggggtcaattccctgcgtgttctctgatagagtagaaaagaagtggttacgttactgcttaatcagggttttaacaaagctgatggaaaccgctcggttttgcacaaatcggttaagtaaaaaaaaaactcaattttgacaaaatttagtcgaatttcacaagtattaattcagctatttcgtgaaaactaagaaaactgctctggagtttttgaaggcgttttttttagagtcaatccattttatgacatcgacaaaacgcgggttctacaatatgccactgacaaaactcagttccacactataccatcgaatgactcattttcttccttatatgccatcgacgttagtcaaccgccgttaaaagatgaaaaatgaccattttacccctagcataaaattgagattttgcataatgccatatcgcggtaaaaaaatcttggatgataaaaagacaagcaatttcaatttttcatcaatgagaataaatagtgaatcatgatcagtgaaatcgatgaggatgcatcgtaccctaggggtaaaatagacatttttttgctcttaacagaatttgactaactgttgactggcggcgatggcatgtaaggaagaaaagtagttgttcgatggtatattatagaactgagctttatcaatggtatattgttgaatccatgctttgtcaatggcatagaatggattatctctttttttttaaccctgctgcttactccctccatcctataaaaaaccaacctaatactggatgtgatacatcctagtactactaatctggacatacctctgtccagattcattgtactagaatgcgtcacatccaattctagattcgtttttttggacggagggagtacatctttgttaacataatctgatgtgagactggtcaccaaatatatatatttgcacttcctgaattttgtgtgctctctttgtgggtagtgttacgtgctatttattgagcggatatttgtaataagtggttgtaacttctttgaagtaaaggtcgagctttattctatctaaaaatatatttggtcactaaataattgtacgaacatatacaggagaaagtcaacactagcaactttataattgccacgagtgtcaactgtacgtacacaatgacagtaatgattgtggcagtctattgtttataacgcactactgtgctagctgtatagaatacgtatctatatacctcgagtttacgtattatacacctcaaatacttgatttggtgacatatactgtaccagtttgatccactctctttctgaagggagacgggcaatttttcgttagacgatgacggcgacggagaggtggtctctatacgcacgcacatacataagcgtgtgtatattcacggatttagtcgagttttttctatgtcttcttttgattcaccaaacgaagcattggtccttttgaaattagcaagggggtaatcatttaggtgagccattagggcgcttgaagggtcacttatgaatatagtacaatcatgctcctaatacacacgctactcttgatttgcaggaacactgtcggaaactgcacagtatttcttgatttgcgaatggtagagtttactacacatgtggcaacaccagggattaatctacctctatcactgtcctgactgaatactcgagacacctcctcttgaaacattcagaactcgaggtaattaagctgaatgagtactattatatcgataaaacaatggattgccatggcttgaagatgagttgccggcaattgagggacctgatcctgcgcgacgcgacgccccagaagggatttctctttgttatccactgccccctctcgagtcgagataaaaaaccacatgccgcttgccgtcttcctgcccaattgaactccggagagcgcgcgcgccggccatggcggcaagccaatacatggacaggttcactgaacaactgcctgccactggcagagacagcagcgagtcacacggagcgggcaaagcgaagcccggcgcgcgcgagcgatgatttgtcaatggccaattggcaggcgccgtgctccctcccgctcgggcagcggctgcgcctgaggggatcgttacacgtgtagccgagatcctgagtagatttcactgttccatcttcgagaggtaaggtagcccgcacgcgtagggattcggattccgtgtctcggtcgcgcctacctgtccatgttcactgttcaggacttcagagaaatactactcctagcgttggtttccgtcgcggacgatctagtagagatctcgtgttcgaccatctctgcatctttgctgagtaaatttaccctgatctcgtgatcgaagtaattaaaccggactctaaagttccacctttcatctgctccgctacccgtatcttgtcagaatacttgtgtggcatagtagtccccacactttcactaggttcctgtacacatccatgagagataatgatctgaacatcgagttaaaccggcgcataaatttcacaagggtgtacgtcaaaaaaatatcacaatgaagaggcattaggttcagagattccatccacggggatgcgttgtggaactggagccgtccgtaaagagaaataattaatccccacgagtttgggccttgcgactaaaccacctaaatgctaaacggcctatgaaaaagttcactttagatccctcactgggtataacacattcttcatctcttaaaacaggtgtaaatatagtcccaaggtggtttggacaacggtattggctgacgtgataccacatgacactattgacttgatcttcatctaacgtggcatctacgtgatataagaatcagaaaatataaataaaaatagtcccacatgctaggcacaaaggaaaataatatagaaaccctaagcccacatgtcatcccaaccattccttctttctttcctctttattttctctctccatcgtcctctctatcctctctctggttgacccctccccttgacggcctcagttggtcggccaagatagcggcgccgacggcagagagaagtgggcacccagatgacagcaatagtcggccatcccaaccgtttcgttgtcaatactagcatccagtgtggctgccggcctccgctcctccttaatccctctccaccctggtgtcggcgtcaagctccctttccgccttcctctccggtgggacgtgtgggtcgaggaaattgagaaggcggcggttgatggtgctagagcggcaggtggggggaggttgggggagcggtgttctggtggagggcaaggcattgggggcttgagctccagtgtcagccagctccagcggaggcccacgcgcatggagatgggtggatttggcggcatagtcgctggaggagcgagcatggttggggagagcaaatctggcagtggggcgaggcgctgggggctcgagctccggcccgttgtcgatggggatgcaatggcgctcaccagggcaaaacctccttgggtagccatgttccctttctccatcgctaccgacaggtacatgcgaccgctgaggttgcggtcgacgttgtacatggcatccttccacttgatgcaacaacgcggggtggatgatcaggacggagctcttgttgtcgtagctcctgcggcaggccttgagagagggcgagcgacgcggcggccaacatcgagctcctctgcctagctagtagaaggcctccacccgttgctgcactcctccgccgtgcgtccataggtccacacacacacacacagagggagagtgagagagagagagagaatggaggagtagagatgggtccctctgatatatgggtcctatatatttttaatttttttcatgctgattaggattccacgtcagccaaaccatcaaaaaaacgactaagagactcgattcatactggttttgatagttgagagatgctctatacctagtattgcggttggatgacatgaattaaaacttgacccataactgtaaggtggactttttccaacgatctataatggctgtctcaggaaagggtccaatacgcagaacacggccacagaatctcgacccctttgctataggaataagttcactttgggtcttaatatatcacgaagtatgaaattcgtccataaaccgaaataccatatacaacacctccctcccttgcctctcaataccactgcaaataatgtcctatggtggtacctacgtggatggtttgacttgatccttatctcacgtggcactctctatctcatccttccttcgctatcaatgaggagtcaacgccatgtgggacgatgaccaaagtcaaaccatccacgtaggcgccatgtcagctgaaaccaccatccagatcgccttgtggccttatccacaatagttttgagagttgaggaacacgttgtttctggtatttcggtttagggacgaacatctgacttggtgacaaattgagggaagtaaattgaacttatttatttgttgtacttcactacatgggctcagaggatcagcttgttaagttgggccttccttcccttttcccaggcctatcggcgctgccagcgctatcttaacccagcccattcatattggattttccttttttttgacaactatccatattggatactgtactagtttcctggcaggtaggagaagaagcagacaaaactggagagaccaaccaaacggtcgccctgttggccacctcgcgtcgacaacgacggtccaccagccgccggcgcagccccaccgtacctgagccagccaggcaacgcaggcacggccgaaacgcacaaaaccaggtcacatactcacacgaatacacgatcgacggcgtgcacgcaaggcccccttgcccccgtaccacgctgttccccgcgaggccgtgtgtgtattgtacacgcatcgctggctgccgatggcatggcacacgcgcaccgcagcaaccgatcgctggcgatccacacagcgagcagagtagcagcagcggccacagctcgcaggctcacatgccgcccgtgcccgcgcgcgcgcgatgcaccaaccacctagcctgctagccgaggcggcgttaaccatgtcacgcgtcttgctgccccggtcggttgctcccccgcgccgaagctgctcggctcggctccgctagctcgctcgggcgtcgccatcacgcgccacccaccggacgagggtggcatcgggcatggcggacgctgctcgcggcgatgacgcgatctaagccgtgggcaatgtcacggaagaattctgagaggaattgaatcgacgaacggtgtacatgcatgtacaggtcagatgtgtgctgcttgccggtgtgacggggtagttttacaggagcagcagcgaagcggggaacaccaggagcagcagaagaagaatcaggtggcgtcttgtgggtcggtgcgtcgccggaccgccgccgccgctgctgccggtggccgccgttgacggtgcgttggccggcatgccgccggacaaccctgccggatgtttgagacattgtcagtacagtcaaatctcgccgtgtgaaacaagtatacatgagaaatttgatcagacattttcttgccgtgctgctttaattttggcagtgccgacattcggctacccaaaaagggtggtggttcggtcgaatattttgattccttgaaagttctagccactgaatatatcactaacagtacaaacataatcacattatctgatacacctacttgattacgtagattcactttgctcttcactacttcagaaaactcgatttttacatacagtggagtaaaattctgctgtatcgcgtgctagtgctagatgacagttgatttgacaatggaataggtggaggtggagccaggagtactgattcctaacgggagtttgtcaaattaaagatgcaaatgatttgatagttttgagctactagtaacaacgtcctctctccgttccaaaaaaaacaaatattaagattatataggatacattatgctattaatgaatttagatagtgtcacatccagtactaacttagttttttacgggaggagtatgtgtagtataagaatctagtaaactacaggtctttgattagcatgcaattttcaacaaattaaaggttgtgcatttaaactccacattgcaaaaagaaacggaaaaggtgtagcaaaggcggtcaatttacgacagctccgtttaattgattgcacgcggcagagggcggccgtgtcgtacctgactcctccggcacggcgccgcccggcggctcggcgacgggcacaccgagcgcggcgcagagcctgggcgggggcgcgtcgacgcggcagatggtgggcagcgcgagggcgcggacggcgtcgacgcggaccccgtacgcgccgtacccgccgacgagtccgcacaggcaggcggcctcgccgtcgacgacgcccgcgagcgcgccgcagcagcccttgtccggccgggtcagcgtgctccggtactccacgtaggtgaggcacgaggagaggttcagcagcgcgcccgtgcagtcgagctcgccgggccagggcgccggcgccgcccacggcgaggacgctacctgcgcccgcgccgcgcgcggctgcagcgaggtgagcacgaggagcgccaaaacggaggcagcggcggcggccgaggccgcgggcagcataatcatagccatggcgccgattcttgtgcttcttgatatgtgtttgacatgtggagatggggagcgcggcgagcgtgcgtgtgcggctgtgtgtttttgtgttcgtgtgcgtgcgccgagtgacgggggtatgtgtggtactacatatactccatctacaacagcttgggggccatcaacgctagttcgggtacatctcgtcaagccatacttcactggaaaatataaacggataataattgttgaataacagagggagagagagagagaggggaatactgtaaatattggacacgttgtattgagtctcaggggtatatatatatatatatatatatatatatggattgtatcttaagtaaactcagaaagatagagatgaaaactaatcctatcatatcacaacaaatcggatacaatacgatcttatccatgtattctaacatcccccacagtccaagcgtgagcaacgtgaacacttagactagagaagaaagacgagagtgctcaatacggatgataaccctttgtgccatactcgacataaccaaagcgaaggacatgagggacccatgatcgatgaagccatgtgtaaagtagttgtggtcgatgtagtcgaaatcggggagccaatgatgtcgagatagccgagccgcagggtgtgcatggggcaccgtagagtggtcgtgagcgaggacgtgttgaagacgatgacgatgacgtgatgctgcagttgttaaggaagatgacgccgaagagtcgatgttgtcgaaccatgaaggacgagacgtcacatcgggtttgccagacctagagacaactcaggatgaacgcgtgcaacggggttgccaataccgcacaggcgaatgtaggggaccaccatgaattgacaccaatgtcggaggagcctagtagagagggcttccaagatggttgcagcgtgagaacgatgtagagaaagaattgccggagcagcacatggcctctatccacggaatataatggctccttttaaacgtggtattgacaaacaaacaaatagaaaaatataggattttgacaggaatttaagttcaaaacagatgattgtaaaactcatggaaaaacacataaacaatcgtttcaagtaggaaaaatgcagaaatcgcatgagagagatactcagaaaattttccaaaaggtttgaactcttgctaacttttctccaaaatctctatagaattgtccatccgtagaaatttcaaatgatatgataggattcaatccatcatttcaaaggatttgataggaaatttcctatacgatagaaatcctctaaaatttttatgtttttctacaaatcaaagaggacctaggtatttctaaggagctttagtagatacaaagattaacgtgaaattattttgatgtccctaagattttatcttatcacttcatggatataaagaaaggagaatgctaggggatggaatcccatcccaagcacccgcgatgatatcgtctccgtgattgtgtgccttgtcccctatagcacaggcatcaagcatgcaaaaaaagagcagtgcggcattgggaatgtggcagcggagaacgccttgcctcgttgctccgtcaaggagcatatcactggagaagtggaagggactcgccggagaagagacccatgcccacctcgctcggtcaccagggagcacgtcatcggacgttgctgcagaatgggagttcatttgagaagggcctaaccgccttgtcgtgccaccaaagtacgttttctaagaagaggcccgcaccgccttgttgcgttgccggggagctcattgccagagaggagggtgggggaatagggtcttgcaggagaatggttctgtatcgctggggagcacatcgacctcgccggagaggagagaggcatcggtgaggagaatgtcgtcatcgcccgaaaagggatcaagggagagggaaaggatatcggcctagtattgattgggtattagtaggtaccaatagatatcggttgatacgatagagtaccagatctgatacggacaagtatcagctggtacagataagtattggttgataccaatagggtatccgatttaataccgataagtatcagctagtactaacaagtatcaactgataccggtagggtatcagatttgatattgataccggcagggtatcatatttgatattgacaagtattagtaggtactaatagggtatcagaattcgatacatgcatgatatcatactgtctaatcggaatcctgtaatataacagctcccataaaataatataacgtgtccatatttttcgtaaagtcaatattcgtaacttttgaataattgttaaactaacaatatttagtgtcacacatattcatattttaaagttctttaataatgctagctccaggctagaataccaacaaggactcacaacgagccctattagaactaatattattcttgcttcggtgaactttgttgagcactatttccctatgtcccgtcatgagctcctttgcctctttgactatataagctagtcccgacttatcgctggttttggcctgaagaagttgtaccaccgtactgcagtccgtctctacgacaattagcaggcgcatccattggatccttagggataaaccttctttggatgctaaaaactcagcttccagcacctcggtgcaataatccagagagtgccatgatgtaaaaataacttggccagcactatctcttaggatcattccaattcctccccgatcatcctgagcttcaaaagacccatcaatttcagcttcatccaccttgttcttggtttctcccacttctgaaccggtcctatgtcaggcagcatcaatctcgtagcacgttgtatgacatattgacatagctcaccacatgcttcgccttctccatatctgcttgagggtgttgcttgatttggagtagagtgtcgatgtagctcttgataaacctctgcgagacagccaccggtggtgccgatttgccgtgagtgatttcatttcatacatgctagattcgccaaaacaccattagagacatcatttgtttagggattgaatttgggatgaattgaagagtatcaaagagccacgccatacctgtgtttgcagaattggcttcctgtgaaatatgtcctgcctccctcattgacatccaaagcgcttttgcatgtgggcaacgacacaaagcatgtgaaatatcttccttctctaccccgcagatgacacaatggtttatcacactagattctgctaaaaattgccctgatatgaagtataggtatataaatatttactactccatacaatgttttatcatattagtttgtgctagaaattgccatgcttctagatcccaaatttatgaacttcatctatggacgaattgctgccttcgtggcgtcttccacgggtgacatgttattttcactccttgctgtttatggcatggcagtataacttgtcatgtttgtaagtaataaggagtattatataattgcattcttgttgattttttttctcatatttcgggtttgcaacgcatgtggcctaaacccgactacattattgcataatcatgccattggttggtgagtagagcgaagctgttgtccgtcctcgctgtattgccttcgctgatatatttgttccttggatacctataaatgatgttaatgcaatcataattatatttgtccggtttagaagttcattgagtaacacagccgattaaaattaaaaatggatgttgtaaagtgttgaggtgccaaaaatatctttggcgataaaacgttgtctacagtcgttagtcatattttttctcgaactccagttgtgaccaataagtttctcttgtagaaatattacttgctaggctattgtcagggttagctcaatagctcgtccttcttgataggtcaagtaaattagcgtatagattagcagaacatcatcatatgtttaggattgatcatgcacataaggcgggtacgcaattttaataccttttatgcactaacaaacaaaaaatgtatattacactaacaaaaataggtgcatcagtcggtagcaataacttgttcagcagaccgcaaatggcttacaatttatgaacataggatgcgcgtgaggacatcaaacatgagatgactttaaatgctatcttctgcagctcgtgcaaggtgttactattacacaaaaaggacgagcgtcggacactcggggtaaaattttgccagacagtacaacattattaacactattcagcttgctccatccaagattgaacaaagaatcatgtactaccctcccctaatgccctttttatctagcaaccaaaatgagacaacctccatcacgccaaaaaaagactgtaaaagtagcaacagcgttcctatattcccattcacaactcagaagggcaagaacctggtcactcgtaacacgaagcttgaagtatgtgaacatccttccaaggggcatacagccaaccgcagaagtaccacatgtcctctcacaagtcacgaccattccagttaacatattttactctcctacggtcattccaaaaccaaacttgtagttcttctttgaatggtcaatctgcaccacataacataagttcacaaaagtcactaatctgaaaaactcacttcttgttaacaaaaaatatatacttcatctggtcatgagaacatttgttttggtcatgggggactatgtagacttattcctataaaattatttagattggatgtataaaaactatatgttagatttatctcaagcgttacttaggctgcctttgagccagggacaaagagagaagatttctcttgttctccgcgtgcacgcttcctgaactattaaacggtgtatttttttaaaaaaaaaatctataggaaagttattttaaaaaatcatattaatccatttttgaagtttaaaataattaatacttaactaatcatacgctaatgactcatctcgttttacgtatcttctcaatcttctcctttctcctctcaaacactcccttaatatagtattataagtttatctggtttttcgaacattttgtaatagaaattatagttcaaagttgcgaatatgatacttttatgatcagagggagtataaatacagtggtaagaatagagcaggttagcctgaactgtaatacaactaatacctctgcagaaagaagaaaattaactcccatgttcaatctctcttccaaatatgcagcaacaacaccatttgagtcaaattttccccttagtcggcactgcagtaaaattcattgataaattcaaaactactaaacggaaatatcagaaaacaaggaactgcaggagcaagagtacacagctttgtactattcacagatacccatatacacaaacaggtccatgaagagatgcaaaactggataagctcaagaaagaatacattgctacttgctatttgatagaaacactaacctgcctaagcatatagtcataaccaaagctggaagtaacgtcccttgacatgtgattatacatgaagtcagacgcaagggaaacctgcataccatatccttacaatcagattaaaataaagtgtgaaacttctgttgaaaataatggtggtcttggtggggccctaccttctcggaaactttctggacatagctcaaggcaactataccagtactggcaacctgtagagtacccacctgcaatggcagtaaacagaaaaatcttgctcagtttacaccctcaaggtagctcaattctctttgtacaaaacaagaggttgtgttaattgttaacaatgtcactaaatctgacaactgagcaatgacgaataacagtgcttttacagtgattggtgaaaggaaaggaccagatcttgctaaggattgttttaccgggaatggtgagtttcattcttaagggcctgctttgataggagtggatttgacccagctcccatcggattggagggaaaacactaaagcatacacaaacctgaaggattggatatattcccccattcttctaatcaagccagcattgttttcagtgacattaggggtactgaacaagtaacttgggggaaagtgcaatccaaaatggaagaatctcagtctgaaaagaggacatcaagtacacatgcaaacaggtatacaggattacagggaatgaaaagctacacagttaaacctcaatcaacttgactatcttacagcccaaaacagttctcaatccaaagatgaattgtggaatcgactactgacaaggtctataagctccttaccattttatctgaattatatcgagaagcaaaaccaattcctgacttcctttggtggccaagccagaatatttcagttcccattgacaagttcggcgtaacactctgaaatgcaaaagttcattgtttcactgtcaagaatagacaagatttaacagtgaagattttaatttcacaactgtacttgtgctagataaagaaaattttaactccacaaccatatttgtgcaggtaatttaccataaatataaaccagaaattggtttagtcaggattaacatgtatctgcccactaaactacaaggcaactcaatatgaaccgtgaagcctatatgatccaaatcccaaacaaggtgtacaagaggcaattgtaaattgtgaaccataattgcatagcagcatattgaatgcacaaatgtcagttctgacatgatatttccaaattgatatcaaacgtaatacctcaacttttgtctgtaaccaaatggtatagtttatttccagtcgtaatataaaaggcagaggaaggcgcaaatgaatcaatacagaaaataaacaggccaataagcataaccacaatatcacaaattcaagacaacgagatattaaaccatctttcctgcagaatctaaacaatcaatgaataaacgaacaactaaggagaagcttacatatcatcatttttcttttcagtttacctaaagtcctgaagatgacaatgtgaggcttttaaagataaatgcacgtctgcaagtaaaggtgcttacctgaatataatttgccccatagaacgcattatttccaatttgaaattgagctcggtagtctgtcccctacacagatttgtgaattgtaagaggactacagatatcagatggaagcaatcaaaattaaaaagtagttttctaataagtaattctcacagattattgaaattcacttattggtcaaagaagtgtagtctgaaatactgaccttgtagtcaaagttaaacattccttgggagtaatgcggctcatgagtaagctggggaatgagatttcaaaagccaaataaagaaaaatatcagtcatcacacataagattaaccacaacattcaaattcaggtacctgtgcatttattttcagagtaagatcatctgtcagatcacatttcacacgagcattcagtcttccatctgtcatcacccttcctacaagaattaactgtagacaattccatttcaaaatcacaagttacaaaatacactatgcaaaaaattcataatattcaattccatacagacaaacctttggatctataaaattggcaccgaattcgtaatgtgatgttggaacttttatagtttcagttgactgagatggaacttctaaggaacccataaaaacactgttgatgttgtcagaataaattgcccaaaagaaagtgaaacacatatcaacattatctgtttcccttacctgtggctgagtgagaacttctgatttaatcctttagtgaagtcaaacctcaatccttcaaaaagttcaggtttcaacgacactgaaaatggagaatgtcagcaaactcacaaaagaaatgttcaagagccaaaattcagatagaaaatagcatgtatgcaacaacagatcaaatcgcacaatcagtcctttcaagtttaacactgcaatgagggtagggtaactcatgcagaatgttaaggtgtaactaagattggtgaaaggtattacaaggatggagctatgtttgcagaagctaatgtttatatggtatacatactaagcaatcaaactttagaaggaaactgtgcacgtgagtgtggccacagtgcaatttcttctgtgattgttcgtcattatttaggttcaaatgtaaggagttgaaggcattttcagacaaatatatgtgcacgattatggtggtctgaatgtaagaaactgtagatacattaaaggttttttaccttacactacgctaactatgtttaatcacctaattataaatttgtaatatcctcctttattattcattagacacacaggtttgataaactcataaacattaggaacagccatacagtacttaataagtcattggccattaggtcacttgaaaaaacaggaaagactcaacagcaagaattaaaaaaaaaaagttaaccctgcccctttctaaagcctgaattgcacattgtagcatgacaaggttgctccactcagaagtcggaacaatattgggactagggtagtggcacatggctctgagttctggtagtatgggaggatactaccatagtaccatgtgcaaaaagatattactgcaacactagaaagtgtagtttgcacaaatatcgcatggactaggatttgttgagtgcaatgcaccagtagttaatgtaatctacgtatattacaaatgaatagagaacagtgattccaaatgcctcgagattccagagtaaaacatgctattcacaaattttagacgacaaatgaatcgccaaacaaattctaggactcacaactgaaacaaccaacaaagcactgaagaactacacatttcagattcaacagcaatttggaccaatggaccaccgaacagcatcaagcaaatcagttcgcgaccgagcaacctactataccaccactctatcactaaccacgagataatacgcatcattatgaaacaattcgccaatgccgcagcaattcacacgcggtagcagtcaaaaaatagctaaacaagcgaaggagcggcaaggatgggggcacgaactgagggcctcgcgctggatctcctcgaagggcacggggcaggggaggttgaggtagtccaccttctccacctccttcttcttcccctcctcctcgccgtccggcttcggcgggaggatccccgcgaggccggccccgtacggcggcgcggccatgtggggctgcgctgtgggcggcgggggaggcgcggcggcggaggcggccgaacccatggcggcgaaaaccctagatgtcgggggaggttctggatgggcttttgggtgagggggagcgagcgaggcgtgggctctcgtctcccacctcgcgacgcggcggaggtggaatttttcaccgacccccttttgattttcttttttttcttttcctctctcgcttcagaccttcagtcgcttctcctgccgctgcggcgagtgacgctcttttcatgagttctgggagggttcctttcaatgggagaaatgaaaagaaaccctcccaaaactataattaattaattataatgtataatcactgtgtaattagaacagtacaccataattacactatataattatattggatgtgtgcatagcaaaataagattggtatgtactagctcattatggctgcatggccttaaccataagattgtgggttcgtttctcatctcttgtgttagcatttcttttttctccgccagattgcatacatttcaaggtgaatagtatgatcaagaaaatcaagtgaaaggctaagtaaatattcggaatgagacatagcaaaagcgttctctattttcatggtttgttctctatttccatggtttgatttttggcagaattgcgtaaaccaccttaattatcattataattttaagtttcttacccataacctgttttattgtaaaagcccgcccacccacccaatattagcgcgcctgggtagttcatttagcatatttcttccaatgtagatccgttgccaattgtcttttgtgcttagcgctctcgctgttctcagttgtcttctcgcttcaaactagcctgagaacaagctcgagtcgagttcacctcatagtcacgctaaacgagcctgacctgattattatgatctgctgtgaattcatgtcaaaaaaaaaatataattattatttattttattttgagttattttatcactataagtactttaaacatgatttatatattatatatttacagaaaattttcaaataagatggatgatagttaacgacgttatctattaagcaacggtgggagcatgcactagctctttccttcgagtaactaataaagtataaaggggtggtgccaaaacttggaggctagacccacactatagatggccaaatgggccgcccggcctggcacggcccaggcacgactgggcctaggccgaggctacttgggccgtgcctacccatgggctgcacccccccagcccaggcacggcccaacaagactcgggccatgccggaccagcccaaaggcacgataacgcgccgtgcttctctattaaataagtctattttttccctcatctctttgggctatgtcttatatggttggaataagtctatttttcgtccctcatatctttgggttgggtcttatatggctagaataagtctattttataaacctcgtgtctttgggctatacctcaaatagccgaattaagtctatgatgggtccctcaactattttctttggtcgtgtcgggctgtgtcggcccacggtgccaagggagcagcccaggcacagccccgctgtcagcgaaattgctaatcagcgaatggtcgcgcgccctccccccgcgcggcgcagccacgtggcgcgcgtggagagggggaggggcggcaggagggcacgggaggactcgtgagcgtggttttttttttttttggttttttcgtttctctttcggttttctttggttaattcccggttttgtcgtttccttcgttttttaagtatatacttaacttttgatttttgacctacatacttatacaaagtttgtatacgtgtgtatatattacaaactttgtatatgttgtatacaaagtttatatacgtcatatacaaatacaaactttgcatacgatatatacaaagtagacgtatacaaactttatatacgatgtatacaaactttgtatatgtgtgtatacgcacatatataaagtttgtatacgtgagtatacgtacgtatatatttgtatacacacgtatataaactttgtatatgtcgtatataaagtttgtatacgtcatatagaaatacaaactttatatactatatatacaaagttatacaaagtttgcatatgcacttatacaaagagagaattcactcagtgccactgagttttcaccacttctacaatataccattgactttgtcaagttgaataatatgccatcatgttttcccgaacgtctactgcataccatcacagtccagaagttgttagttgggcatctgttagagctgtaaaaaaacctatttgcccctaactcattgtacatggttttttttttttttgccgatggacatatgaatacatatagataaactgattgaatcatataacagcctatgattgctagcttcacgcgttggtagagacgtagtgatctgttgactttgaaatgggacatatcggaaaaaaataaatgtacataatgaaaaaatatcaaccccatacagttagatataaaacaagtttgaacatggtgcatggcactgagctcatatagatatagaaatgaataccaaaatattttactaaaattagccaaatccatacagtttagtaagacagcataaatatttaattacattagccaaccccatacagtttagagatgaatcacaagggtccatggatcataaggatcagtacatgttcagccatatgcataccaaaatagaagttcaacacatgatctgcaccgcaaaagttacaagcatatagatggggatgacatagatggccacaaatataaaagagaacatcagcgcagttggcggctggttgcggcgacaactgcggaggtggttgcatcagagatggggccggaagcaccaggacgccggcggtggatgcgaggttggcggcttgtcgcggttgcggcagagttggggacggaagcgccaggacgccggtggtggaggcaaggtcagcgggtggtcgccgtgatgctgggggaggtggtcacgtcggaggggatggtagcgccaagatgctgcccgcggggtcgtagtcggcggccggttgcgcccacgatgccgcatagtcggccggccacggcgatggggagcccggcgactggcagcggccgagcgtcgatggggatcccggcgaccggccgccgccgcgcatcgacggggatgctggggaccggccgcgcccgcgcgtcgatggggatcccagcgaccggccgccgccgcgcgtggatggggagccctgcgctcggccacgcgtcgatggggagcccggcgaccggccgccgccgcgcatcgatggagagcccggcgacctgccgccacagcgcgtcgatggggatcactacacttggcggcgcgtagatggggagctaggtggccggcggcgcgtcggggacttgggcggctggccttccatcgagtcgtcgcctcgctgtgggcagatcgatttgggtgtgcagggttagggttttctgtcaacaggtgctagggtttattagtcaagggcattttagtcattaagaaaaaaaatcaatacaccaaacggatgcaccctaacgacttgtggacggcgatggcacgcagtagacgttcggaaaaacacgatggcatattattcaacttgacaaagtcagtggtatgttgtagaagtggtgaaaactcagtggcactgagtggattctctcttatacaaatgtatacgtatgtatacaaagtttgtataagtgtatatattttatacatcaaaagtgagtatgtatatattcaaagtatacatatgtgtatatttatatgtataaatatatatacatagtatagtagtataaggggtagtatagtatactagtactgtagtatataggggaaggctgaaacttaccgtgtggccgcaggcgcgcgcggtcagtcgccgatcagcagtcccctactgtcgggccaggccggcacgggcacgaccgtgtcaggccgtgcagtgcttgggctgggccaaattaccgtgccttgggccaagctgtcgggcctcgggccatatggccatctataacccacacaactggttgccttaccaactgataagtcttcctttgccgtccttgaacatgtaacgagaaagtcacaaatttgacattggcaaatgacatccctttctggacacaaattttggcgaaagttttagattcatcagttctttctagacacatatccatctcaaattctcaactggagcatcaacctcagtctctccttgcgggatacccagtccttcatagcttgtggatgcacacatgcgtcatgaccacgatcctggggccatcatgcttgtgctacactagcaatctacggcttgggtgttgaagagaacaagtcatacatggcgcatcaaacgcacaagagtacaaaccgcggcctccttttcacccgcggcgagttgcagatttgcagtgcccacttgggcttcttctggtcggcacggtttaattttctcccaagaagacaacgacgcctcgagatgcatggcatggcacgatctgatcttactactactcccgggccttcatggaggaagaaattttcaccggcttgatgatttgattttctcaggctgtatacgtgcagaatcagagtcaattaacaccgtgtttagatcccagttttttctttaaacttccaacttttttcatcacattaaactttcctactcacgtaaacttctaactttttcattatattgttccaatttcaaccaaacttctaatttcaacgtgaacaacatagcagcaggtaaatgttccgataaacacaggagtactattgatagtacttttatcgatcggtgcttggtgaatgaaatggctgtgattctttgaatttgtgatgtcgctttccaagggaaccaatggatatgtcagtcatgatccattctacggagtacgtacttggtttaattgcagccatacaagtgcagcagttactgtacattgtacacatcaagaattaaaattgaggcctgacagagtagaaaatggacagcagcgagtcctatttgcgtgatcgatcgaacctttcagccgaataatttgtggctctgaggtagtgtttggg

SEQ ID NO: 44885 - DNA, 24519 bp, Oryza sativa
  unsure (1)..(24519): unsure at all n locations
ctcccatcccaaacacccacttaatctgattaggcaatcaggcacgtcgtccactcgatcaatcaaatcgcatctttcagctaacttaaggcattctcaaggtctgtttagttggcgaaagaaaatttttgggtgtcacatcagatgtttgactcgatgtcggaagaggttttcagacacgaatagaaaagctaatttcataacttgcctggaaagcgcgagacgaatcttttgagcctaattaatccgtcattagcacatgtagatagcactttatggctaatcatagactaattagactcaaaagattcgtctcgtggtttccccctaactgtgcaattagttttttaatctatatttaatgctccatgcacgtgtccaaagatttgatacgatgttttaaggaaaaaaaatttgggaactaaaccaaacctcagtgtatccaacccaacttggtattagtgtgggcccaagcaacaagaggtagtagtgcatgacagagggcacaatgtttcttgcctgctatggagaataagatggggtccaccaagaaaaaaaatgttatttcctatgtagtagaattgctaccttcctcatctaccatgtaaagctattttttttatttgcttgctacccggtagtagcactacaaccaggtagttgttgttacctccttccataatacgtacaacctggtaataagagtgtattcattgcttactacatgcttctgaaccacattgtggttgccttatgctgagttctttgcttggtggtaggaactcatccctctcgcacgtaaaacgggtggcttattagcgcatgattaattaagtattagcttttaaaaaatgaattaatataaattttaaagcaacttttgcatagaactttttttaaaaaaacacctcgtttagtagtttgaaaagcatgtacaccggtggtgtgcgctcaacccaaacatagttctcaaattggatactattgcaagagaaattggaagatagtgccaaaccccagcccaccttaaatacaaaaggattaggatggcgtcgactgaacttctgccttggaacgattaggtggaaacaaaacacggtagcagcgattcgatcaagcctcaccaccacgcattccattctaacccagtgacaacaaatcaccagatgaccactaccacgaagagcaactgtgcctcacaagcgacgccccatgaaacccatacattgtgtcagccatcaagcaagaaggccgtcgaagatttaccacaaaaatcgatgaacttgttggggccaccttgcttggcatccataaccacgagtacccgaggctagagaataaagcaagctgcaccaacttcgcctatcgagaccaacaagcaggagctaggcgcactcggtttgccacctccagccgtcgtcaccatggagaatggcccgaccacccagatccgccacctctagcttcgtccgctaggccgatcaacgagcaggagccgattgtgctggatccagcgcctctcgtcaccgtgcaaatcgtgtcgactatcccaaatccatccgccttcattgcggggaccgtcgatagagagggtgagctacacgggaacccatttcctagagcacacggacacccacacctacagccaccgctgttgacatcatcttctccaatcgccatggcaattttaccggtgagaaaaaaaaaacaaaatgaatctgagctacacgacaaactactctatactagtactagtatagggaggaggcctgacccttcttccagccctgaccggtgaagaaccgtcggaattggagggagaagaggggtcgagatgtttggaattactgtagagatggtccagacaagttggtagtgatcaccgatcgatcaacatgtccagaagttgctacaccgataatcaaccgatcgatcgatcggaacgttcgttttctagaagttgctgtagccacgtgtccgcacatacacctcctagaagccctccatattcataaaggaagtcgtttagaataatatttaagtcaaatcttaaaaatataaatcataaataactctcaagttgttgagtttgaaaatataaaaattatatgaatatatttgtcttgaaaaatatttttataaaagtatacatatatcacttttcaataaatatttttatagaaataagaagtcaaagaagttgtgttttggagaccgtgccgctgtcttaaacgactttctttacgagtacggaggaagtatgtgttctcctatcagtagtattccatccgtcttataaaaaaccaaactagtatcgaatatgacacatcctaatactattaatttgaatatacatatatcgaggttcatactagaatatattacatccggtattcgttttttatgggacggaggaagcacgtaccaacaaacagatcttcctcccgtaagttggctagctaaaccaccattaccgtacgcgccactgaaagaggagtaagcttacccggcaccgccaggttgtccacgagatctggacaacgacgccgaccggtgcgcgcgtcttcttttgcatctagaaacccaaaaatcgattggctgcccaccgatcgcgtcacgtcagagcgatcatctagaagctagcgagagcgaaatagcgaattccaatcatataggctaagatctctccatttattataggccctgttaccacacttgttcttaattagcttctgttaattaagtttatttcttataccaacatttatttatcccccacaataaaatagataatatgtgacaataacatggtcagtccaccttcaaaatttgtaagaaaaatatagaaaacttgaaaactttcaatcctatcagaaagtttctagaaaaatatttgaaacaaacattcaaccctagcctttcatttgaatttcctatagaatggacaattctatatagattttagagaaaagttagtaagaactttaacttcttaatcttttttctttaaagttctatctatatgatctgattcatgtatttttcatacggtcaactcaaattaataattattttttgtatattttctgtgatttacagtcctttattttatacttatatttctatcaaattaagtttaatgtttttttataactaaattctatgttttttattcctctatctttcaatccccgccttttactgaaaccgtcgctaatctatcttaaacaaagcctgaagtgaacacgtactaaaagtactagtgtactactttgaatctctagatgggagaggaaaacaggagcacgctagaaaactacgggcaattttagatggtttaggcgaaaagggtcggtccagtcatccatctctctggctgctgacagatatagagatctcacagtgtgagtagagagcaagtcaatgagtactccagtatactccatatgcttgagatattcacgtcgacaaagttttgaaacgacagttggccccattggcttttggccgcatggattttgaccgcttcctacaggtcatcatcttacaagtccggctagaggttgcagcagtcacagggccagaaaaccggagcataaaaccagcatagaaattaaattgtccaaaataacatattataaaaacacttaaataacagattataatattttatatattatattcatcacagaatataagaaagtaagatagtataagacacatcatacattcctattgttacaaatctgagcctcttatctcaagttcttatatttttgggatagagtgaatatatgtttagtgacttaaaaatacgatgtaaaaatcaacttaaaattaagtttaaatttttaactaggttgataaccaaaagagcatcgatcaagctgttagtattaggtagctgaaatagatcgtccgatggacctttaaaaataatatgtcattctcatatgtatctcaatcttattaaacaaattgtgctacaagtggtttttgaggattgaatttgatgtcatgaatatgctaattgttttgcttattatgttgacaatcatggatctgacttattaatgttgttctgttgtcttaatgtcagcagtcgatatcgttaggtttataaatggacaatatatatgcatcataagttgccacgttgttagttttcttactataatacatgtacacttaatattctacttactctctatccatcgttatctcactcccacttgtaaaacaacaactatgatcatgtgtatattaaactccaaaaaaagagcgaccgatgtagcaaaaatcatcatcgcgtctggtgtaaattaccattaattaatttatttattaagaaatatagtaccgcagacgctcacaatgcacgcacactcactcttatgaacacacccacaatttagagaagcaccaaacatgtgtcatgataggatgtgaacgtataactccacctagcatgttttaaatttgcacttacatattacacatatatagttgcatatgtgaatacattttactcctacgtaataagagtttagtgagattaaagatatattattggtctcgtgtcagaacgtaatagcaattacctacataggatgtgtgtgcatgtcttttgtttggttgaagaacttatctttttcaagcttagtatgaaatatgtaaacagctctgtaagtattaggagcctactattgtagcagagactattcgtcgctcctttctactctctccgtttcacaatgtaagttattctagaattttctatatttatattgatgttagattcattaacatcaatataaatgtaaaaaatactaaaataacttacattgtgaaacggaggtagtatctccgaccaagacacaccggccgggtccttagctgttgtgtacttcaagttttcaagcaggtgtcagaaggataattgtcgaggagagtaaccttcatcgggaacattttgagtgggcataaggtatttgagctaatcacgagaagaaagccaaactacatgcgaaggatgtggatgaagctcggccatgatacctggaaggaatattctactagaagaaaccaaggaccattccaactgctcttacaagctagcacaagcataaatgggccagatagccaattgattataccatgatacccttagggttcctagtccaatgagggcaccgttgtaacttcacatgtattttttctagctataaaggctgacttaatcatgcgggggcgtatcatatcatatgtacacaagccctcacgtgtatatatcgtggacatgaactaaaatatataaaaaaatatagaaaaattatacatgtactttcattagtattgcatctacgtgcaaaatcacatcttcaaattcatcttacatagagtaacaaattctgatagaactataaccttaaaactatcattttttgttatgatagattaaaatataataaatttgatattaagattttacctgtatgtgtaatactatacatgtataaatttttaaattttttgataatatttgttatttggtgtgtacgatatgtacacatgatagcttatgtacacaaaacatgttcatgacgcagattacatctttactggaactgtgacagtgaaagccttttttccaacaccagcactttttcgaatgttttcagaaaaaaaaattccgaatgcatttatataaaatagaaaacaataaaaagcctaaaagagttgtccaagtcaggcagaatgggataggcgcttcccgtgggcgatgacgcctttcgcgcttatctttcccgctgctccgcgtcttccagagaagcgagacgaccttggcacccagcttccgtcactcgctcgccgcgctatataaaccccacatccttgcagcggttttgccgcaatcaacaagaacaaacagctatcaccccgcgatccatttgcccaatcagatcaaggcgtgtagatttgattttggttttattactcgcaacctgcacgttgccctcagtcacctggcggcggagagagagatcggagatgagctcggtgtgcgcgaggcccgtcggcgtggggtaccttgtcggcggggcggcgagcagctggtcccagcggcgggggcgtggggtggcggcgccgcgggcgagagtgagggtgtcggcctcggcctcgaccgtggcgccggagaggcgggcggcgacgatgtacgaggtgctggcggtggaggagaccgcgggcgccgaggagatcaaggcggcgtacaggcgcgcggcgcggcggtggcacccggacgcgtgcccggggggagccgagcgcttcatgctggcgcgcgaggcgtacgaggtgctctccgacccggagcggaggcgcggctacgacatccagctccgctgctgcggcgccggcgccggggcccaggcggcgcggcgggccgggttcgccgactgggaggcgcagctcgccgggctccagtggcgggccgcgtcgcgggagacgtgggggagcaggatgcgccaccgtcagccgtctccgtcctgagccgagaatcgcagaattcgcagtggcttttttgaattttgaatttgtgttgagttttctctttttctttcactttttttttcctcttctgtagccttccttgggatgtgtatataccatacggagtattaggatatgatctataggtggtacatggtagtagtatagaagaatgtacaaatttcaaacattttgaattctgatacctactttttgggaggaaaagatctttctaaaagaacttaagaggaaaacagataatgacatttacttaaagaaaacggtggttaattgaccagttttcacgcattctagagaagcaaagtaaagattagagaagttgtgtaccgtcatatggcagccttcaaataatgggaagcgtcacattcacctcagctctagaacatcagaaataaacaaagagaattgtgcagtaataaaaaaatgagtacaactcagaaattatgaagtttggagtgaatccttcttagatttttgttaaaaaaaacgaattctcagatctattgtggaaatgaagacaatctataatgttagtttagtccaaaaaaaaactgaaaataggattctgggactgatccatataccgaggaatctaaataatcacttccacaaaaaaaaaaaaatctttccagtgaactccgcagctaacatgctgcactatagctccaaggagcaatggtatccgtacacatttgcctaaagaaaatacactaaaactgattttcagttgttgataagatttgtgagaaagtctaccatttcccacatccgagcttgtcatttgccacaaccaacgagtcgcatcctatcctatccgtatagtccccttcatgatgttcctccttggtttgtaccatatgtgtgcaaaatttctccgcacagtccccttcacgatgttcctccttgtttgtacatatgcatagtttcactaaccaaaggacggaatcacacaccaattggtaatttggtggtgactggtgagctgctttttggaaaaggattttaccgagcctttagcttttctagtttgtaaactgaaggctgaggccattttctatgcaaaaggatttccagttgatacagcgctcaatgttatgttcctgaaataaacaaggctgatttcagcgtatggatgaatagcaagtgatgccatattggacagaagcaggtcaaagcagcttacctgagtgcagagttggggatttgctcgacaaggcatggaggtccacctgaagatgcatgggccgttaaaacctcccacaagctctatatgtttgcaggaacaagctatgcgaaggtagatagatggttgccagagactcagagttaagcttaccatgtgaccccggtggaacataagcggacgcattgttggagaaccatgtttccggcaaaccatcaacgaaagaagttgataggtcagcattaggcaaaaccgcttgcaacgctgtcacatccataaactgcaaaatggagtgctgttcagataactgatgggcaaaatgccatgctgaccagcactacatacaacagactgtccattttgaagaatgtgttatgctgactctaggtaaatcaataattattcatttattattaaagaatcagattacacggttttcagtatgaaaataagtacttcctctgtcccaaaatataaaaatcaaagcctcaaagcctcttttagctcagcagggagagggccagtgccctatctcctggtcttcggatccttaccctagccaatccacaacaaatgctactctggaaactgtattttgcatctatattggatcatgtgggtgccatgtccgtctccatgagaattatgaaagggttatctactgtttcatcatcaatacgtctattccacatcgtcaaattctaaacatatattcagtccacagtattcaccgtagataggtaagtgacagtagcacaaaacgatattaacagcttccaatcatgtcaacagtaccatccataaaatgcttgatactcaaatgcattgaaagcagggaatgaagaaataactctgtaacatagtggaaattgcaaatgaaccaagccacgggtgtttgcttccagtttctatctcttccattttaaatgtcatttttccctttacatatttaaatatttaaagttgccaatatgatttctggggtgccaaaaaacaggactcggtggtttgactggtttgccatttttggatcctattggctactatgtgcaaaaaagaatagcataccatatctggagaatccgagtcagcatcaaatggaagatcaaatggattcaacggcatctgctgtacagaggcttctccctgtaaacggtggcattatattccagatccagaatcacttcaaggaacagcagaagtgtacagatatgctaaatatctaaattaccacggaagtagtagcaaacagtgatggctcagggaatggagcaaagggttcgctaggagctaatccacccatgaaaatttcttgggaatcattaccacgagattcctacatgacggaaaaatatattaggttgttatggagcaaaggggtacctttgacgttatggagcaagtaaatggattgcttgttgttagggaattgttatcaacattcttgtgctcattagtttgcagctgagcattggacagattgagagtcatagtctcacttgcatcatcgaatgaatgccagagctgcaaaaacacaacaagggacactactaagttctggggaaacggttgacacttaacaggataggtcaaataccagaatagcattgcagcaacaggaaataacttgcttattcacaagtttcataatttactcacctgcaatttattttcatcaattggttctttaggttctatagaactcattagtgaaagatctggcgaggcttgttgggtgctaacacttttggcctcaaaagcactccaagcctgaagaaatgtgaaaaatactatttataagtttaaatgcaaaagtggaatatcatagtagtgtggcacaatcagatttttttttttaaaaaatgaaaaaataattctcgtgcatttgcaaatgatacatgcaaaaacacaatgaccatttttttgaagaatggactgcattttgttgcatgtatgtcctaacatgagagcatatgaaaaaagttttttctagagcaatgcaaatattcctcacctgagaattacttgcatcagaggatgtatatttacaaggtacatcagactgatcagtcacagaagcattattttttgatgtctttgagctctggagccacgttggttgatcattatttggttcaaacgaaaacaaatcaccactcaaagcatgtttatccattacggaaatgccagaaagcccaatcactccaggttgcttttcttctggtggtgtgtcaaatgtagcccacccagcattgtccattgatggagctgctgtgagcattctatcagtggatggagttgccggaggcatgctagcaaaaaaatctactggttgatccaaaccagttacaggttgttgctgcgcaacaggctcattaaggagatctttctgtgcaatgttggcaacatcagagaaagctgtgaaacttggagtaatgcaatccttcgtttgctgagttctatgagcaatatcagattcaaaaaacatatcagctaagcttgatttgcttgattttgtagatgacgaatctatgtttcctgttgatatagttctctgcagaaagcaatcaaaattaatacatgtcttgtttggtatgaaaagaaaggaaaaccaattatttgtttagagtggaatatttaccacctcagattgagtgattccactagaagcctgtatgtttgattgattttgttgcatagaggggctggaacaccctttatcaaggaaattcggtgagtgtggtgtcgttctaaatgtattactgatgcttgaccctgagcagtcagaaattcttggtccagaattctcattggcaaatcggtcttctgacatcctctcatgcaggctctgtggactgtaagcaaatccagacatcttcccatcatgccccctatctgaaccaggtttcctagttagcatcacggattgcttgccattgcgtctttcttcgtattggtaatcataaggtgggctctgagaaaatgaatggtacgaactagcccttctatgctcttgttcattggtcttttgattctgcattgatggaacatgaattagttaagagagaagcattttggcagaatatacgttgagaaaatgaaaacttaaaatttccaaagaatcacaggaaaaaaaacatgaatgaacttctatgaaagtattcattgtcatctacgcatactgaagcagaaattcaaaagctttgtgataacaaatggacaggtaaagaacagttctcatgcagactaactagatgttgtaaattaagctaaacatacctgtttatctcttggaggcctttcagaaaaccttccaccagcataccttctctccacataaacagcttttatgaattccctaagactgtcgacattgctgcaaaaatagtttagcgtaagcatgtactgtgcccactatatatgtattcacaagacaaagtatgtattggtaactttaaaagagaaggatagaaggatgcccttgaaataataaagaagtagcgattaacaaagcataaaaggtgaaaaacaaaaaggacaacaaaatggaggtgttctcagtggctaacgccatactggtaacactatagtgacaaagctttttacctgctatcaggtagcctcattttctgagcatcaaattcctttaagaacgattctctggctctctgcgtcattcagtttaagagtcatgacatgaaccaaaagggggatttccaagctcaaaccaacccaatggatcgccttacttgattcccaccgttctggagggcctcgacctcttgcgtggtgaacgtcgacatagatactgacttcacacggtgcgtgaactcacggctaaaaattccatgaatgtgtcagaataacagaagagaacatataaagctccttcacaaggagaccagaacttgacgactctgagcctctgacacggtaaaaattttcactacaataataaatgaaatgctatgtatgctaagcacgctaatcccacaagactgaaataaataaactgaactgatgaacaggtcaactgaactctcgtcgcatcgacaagcatgaactagaaaataactacgaatactatgtccgctggcacatggatgcaatacactacacaaaattagtccaaaattaacagaggcgagagcccagcactcactggatgccgctgcaggagatgcagacgaatgtccagaagctcgtgcacacgtactgcggcccctggatcagagttccagcacacacggagagggttcagtacaacaaggaaaaaaaaacaaatcactccggatcagaagcacacacacgagaggagatcggcgagcagctgcgagtgtggcggaagggaaaaatccttacgaggccgttgcagttgatgcatctgcggttgggcggcagcttgaggagccccctcacgacccgctcgttcctctcctcctccttcctggacgccgccgccgccatcgaccactcccccccgcacccgcagccacacagatcgaacgacgaatcccgcgatcccgcagccgccgccgcctcctcggaggattggatcgctccctcctccgtggaaaccggcgaggaagtgagagggcgtgaaacggatgcgccggagaagaaggcgctggtagatggcggcgacggcgacggcgagaggcgccggtgcgtttgcttgagccggcgacgcgacgcgatgcggttgggaataacgggtgtggaaatgactagtagtaatagcgtggaattgcaacggcttctttaatttttaaaaaccacgtttagccagacagcctatcgctaatccgcccgcacatctcgttaagagcaggataatagcaaactataagccaagctataaatataatttaaaacaataaaagagcaaaaataaaagtacgggctacagatttataaccagttacagcacgaactataacagtatgggctacaaatttataaccagttgcaacacggactttaagatacgcgtgtgtattacaggtgaggaccagacattaattatacagtatatatttatagatagctattgtataaattggctattaaattgactatagataatttagaatactaaagttgctctaagtactcctctcaatttcgaaacggaaggatttttttaaaaaaagttaaacaaaattccgtgaaaaccctctaaagttttagcgttttgagtaagccattagagcaaggataatagtagagcttacttcttactattagcccattttaaagccaacatatataatagattagttataaggttggctacaactttcttcttctctctatttctcacctatgcatttaatgtatttacctaggagcttgtgttaatctagctcttgcatgagagccaacatccttgattttttgttatatctctcctccatctaagtttatagtaggtttatagctagctattatacttgctcttagcctgattcctcttccaggaaactaaaaacggtgctagccttaagggcattcccaactcaatgactaggatggtgtccatagcattaaataagctgccacctagattgaaaaatgatgtgacaagtgaataaatgaggaaagagaagtaaacaatatcttgcatgagacatggtttctacacaacatccaagacattatgtgagataagtagcattaaatttaagtatggaatagtagtgtttgcattggaagagtagtatctgatgtggagtttatggaaagtgaataaatgaggaaagagaagtaaacaatatcttgcatgagacatggtttctacacaacatccaagacattatgtgagataagtagcattaaatttaagtatggaatagtagtgtttgcattggaagagtagtatctgatgtggagtttatggaaagtgaataaatgaggaaagagaagtaaacaatatcttgcatgagacatggtttctacacaacatccaagacattatgtgagataagtagtattaaatttaagtatataatagtagtgtttgtattggaagagtagtatctagtactagtttgttgatgatgtggagtttatggaaactatgttagtgtcttgggttgggaatgccctaacattagatcatgtagtagtaataaggtcattagcgaagataccgaggaaacggacccaagcaaacagagtacagacagagagcttaatcccatattccccttgtcccaagggtggatctcgctttaacgcttttgccgcttgaattaagcgacacggataacatgtgccttaacatctcgctttgccaagccaaccatgcccggttggcttggcttggctactccgctggagaacgctggtgggcacgagatttggccaaagattaggttgttgagcagctctaccgatgccggtagcctccgcctgttgggtaggagtgtgtggtcaccggctaggcacacacacatgggagagagacgccgtttgctgttgggtttgattgtttgaactgccactccagctacaaataccgtccgcaaccaccaatattaatttaagtaggaaggtataataatcacacatttcaaagaggttgcggaggaccgcgtggtcactcctcggtgaatcatttttattttggtaaaaattgtaataaagaggtagaaattaacaaagtataaaaggtgaaaaacaaaaaggacaaaaaaaaggcgttctcagtggctaatgcatattggtaacactatagtgacaaaactttttacctgctatcaggtagtctcattttctgcgcatcaaattcctttaagaacgattcttctcaattccgaaacgggggaactaaaaaaacctgggctcccatcgaacggcctaataagcccaaaaaaagccaaattttaaattttcaaacttaattttgagattgattttgagatattttcaacgtaatttttttttcagtattggcttttaagtcactaagaacacacacacacacacacatatatatatatatatatatatatatatatatatatatatatatatatatatatatatatatatatatatataagttttacctacaaattcatttttattccctaataagccgttttggcttattaggaaaaaaagccaaacgatggggcctctgaaaactaaactaaatttccgtgaaaatcctgtaaagttctagtgtttcgaacgagccattagcctgattcctcttccaggaaactaaaaatggtgctagtcttaacatgttgtgtcctgtaaggtcattaccgaagactagctggtgcaggcaccaactgaaagtctgaaattaccttcttttggatctaaaaactgactttatgatccttaaaggttccttgaccccattatccatagtcggtacccgtacacgaagcccggaatcgtcaagggcaggatgccgatcttcggtagtgtttggttgctggaatgagatgagatgggatgggacgaacccacttttaggggtgtttggttgaggggtgggtgggatggattggtcctaggagaggaatattcctctcagatccgggaccaatcgatccgggaaaaagagccggacgaactcgtctgcgaccgacgccgcctcatccgcgcccgccgccgccttgcccccgtgaccgccgccgcctccaggaccagccgccgcttcgtccgcgaccgcctccgtctccgcgaccggccgccgcctcgtctgcaaccgcctccgcctccacgaccgactgccgccgctcgtccgcgcctctcctcacctccgcctccgtgcgcggcctccgcctcatccgagaccgccgccgcctcctcgtccggccgccgcctcgtccgcgaccgcctccgcctccgcggccgactgccgccgctcgtccgcgcctctcctcgcctccgcctccgtgcgcggctgccgcctattccgcgaccgccgccacctccgcgtccggcagccgcctcgtcctcaaccgcctccgcctccgcctccgcgaccgaccgccgccgctcgtccgggcctcgcctcgcctccgcgaccgcctccgcctccgtgcgcaaccgccgcctcgtccgcgaccgccgccgtgcgcgcctccgcgtccggccgccgcctcgtctgcacctcctccgcctccgtgaacgaccgccgccgctcgtctgcgagctagccgctgggagccagacggccctaacggtccgtgaaagttctccatcccatcccacctcaatcccttctaccaaacaaaaaactataaccatcccttaccacaaaccaaacagacaactggaaccatcccatcctaaaaaactgggataggtctaacccatcccactttgtccccaaaccaaacacacgcttcagtgatgaggaaggatgccgatcatcagtgatgaggagtccaggatggtgaaggactccatccatagattgtgttggcatcaaccactacacctctttctacatgaaggatcccgggccatggaacctgacgccggtcagttatcaggatgattggcatgttgggtttgtctgtgagttccaaagattccaccccgataattctgaatttctgatacataattcagtatgttgtactactcacctgttaactggatcagttgctcatgcactcacctgtcttctccagatgaacgaaatggcgtgcccattggagctcaagtaagtggcagtcaatgtattgtacagtagtacgttaaacagttaggacaagttgaatttcaagctaaaccatcgcacttcaatagttgaattaattgaattcacacaggaaaactcctactggctttacattgtgccatggggaatcaacaaggctgtgacctatgtaaaggaaacatatggaaaccctatgatgatcctttctgaaaatgttactaattcggcaattctattagaattatccctgtttctcctaataataatcttgttgacaatgaaaagtagtattaaacaagggttactttatgatcaatgttatgctcttgcaggaatggaccaacctggcaacttcaatatcacccagggtgagcatgatactgcaagaatcagatattacagagattacataactgagctcaagaaggtgatagacgatggtgccaaagtgattggatactttgcttggtcactgctcgacaacttcgagtggaggctcgggtacacatcccgtttcggtatcgtctatgtggagttgtggactatagtctataagacgttaaagagttacccccaaggactcaagcgttctggttcaagaacatgctctccagaaagaagaggaactaaagtatgcagactaattatcaaagcctcaaaggcttccagccttccactgtcagaattcagaacaaagctcactctagcgtatgctcatcttagcacgttagtagctataattaaatgtgaaaaataaccaatgtggagattggtagcttcattagcttccgcaatacaaggggaaataaatggagtggacttcattacaaatttgttcatcaggaccaaaggctgactaaagggactattcaaattatccaataattcagtttcaaaaaaaagatccccataattccaattcaacaaacagatttcattcccacagagaagttcagataacatttcactgcaaaagaagtgtctgaaaatggaactcattatactttgagggttccagttcgacatacattaatataaagcattaaaacgtgatgacataaaatccctgagtgtacgattgtttgtctatatttctatccagtaacctatctttacaaatatctatgcacgctctttctaacatgggaactatgatttctcctatggctatacttcttatatgcaagaaggcaatattaaacagtaattaagacaaacaggtagtagaaattacagacatcattcacaaatttcagacatcattttgtggtgtatgcctgtgcaatggccgtcaggttcccaagttcctaacagccactgttgctgtgaactttccctgtgcagagctcgcaacacaataaatagaactaaagagtgatcagtgagcactaatgcaaacttaggtcaggtttaagcactgcttcaaatctgtatgtccaactgggccactggaaattactaagttcactatctcgattcaaaaaatttgcacactataaaagggtaatactactccattctgaatatctcttaagatacaatacaatgagccaccatcattcaacaacacagaacatgcatcgaatttggtattcccgtctcaattcaaacagttagcataagtttcacataccatgtaaacatacggatcactgcggccaccagtgtcattacacctcaagcaccccccatgcttcagcaacctgcagattccacacaaacaatttagcaacatggcaaccatttcaaaaccgcttcaaattggaattaacatgacaaaccatttcaaaaccgcttcatattgaaattaacatgaacaaccattccaaaaccgcttcaaattggaattggaggcggtgtggtactcacaagcgcagggccttgctggtcccagcattgtcgccgacggccgcccggatggccgtctccgttgccgactcgtcgcgccgaacacctaatggagaaacgggagtgttgcgcggaagtagtacctaacagtgggaggaggtggaggcggggacggcgctggcgacgagtcggcgaggaagaggagcacgacggcgccggcgacatcggtgaagttggggaacgccattttcattcattcaagtacttctacccatgctccattttcattcacagccaccctctttgttaaaacacggtatcctcgtgtatgtcatgttacaactttttataaattatacaaagtgtacaagtctcaactctagattcagtgagacagaaggatttctcctccttggttgaatgcaggatctgatagatcaaataaatttaccggtcaattccttcaatcttgtcttcaacctcagagtagagctccctgagcttttccaagttttcctctgatgtctcccagtagcctctgccactggcttctaggaaggtctgaactagcttcctgaatgaattggggttggtgtccatgagcctcttcctcatagcctcatcttcaataaatgtggcatttgcctcctcataaacccagttgtcaacctgtccagatgttgcactccatccaacagtatttgtcagccgcttctcaatctctctaactccctcgtagccacttttcatcatcccctcgtaccacttagggttcagtagctttgtccttgcatcaaggcgcactgtctctgacaatgtcctcacctgtgcatttgctgtggttgtatctgctatgtatgaggaaggtgcccgcccatccttgcgcagtccttgcaccagctttgtcgggtctgagtcaaagtagtggctcacatctgttagtgaaatctctgatgagtctaggttctggaatgtggcatctgctgttgctagagcaagctcaaatgtcttgcgttgctctcgcatgcctgcccctggagcatcacaatcaaatgcaaaagacttgcgactcaggtacatgtcctggagctgcttctcatcagtccatgatgcattctccactgccaagttcacattcgatgagtaagagcctgatgcatttgagaacacccttgttgccgcctctcttaatgaaacgccaagttcccgtgcctgctcttgtgcatgcttacgcacgtagttcatctcttctggctcatccagttcggcaaccatcttcactgcccggtccagtagattcatctgcatcagtgtgttccataagtacattatttcagcaatgatttttccttatatatgcacaaaatctattatattattaaaggaatagaaaaagaagcctccacgttcgctctcatggtctagaaattctcacattaatcggagaaaaaaaaaacagagtccatatagaaatacaatttagaaatagctgaaattcggaattgaaaaataaggaatattaaaagaggagactagagtccatatagaaatacaattaggaaatagctgaaattcggaattaaaaataaggaatattagaacaagagactagagtccatatagaaatacaatttagaaatagctgaaattcggaattaaaaaaataaggaatattagaagaggagactagagtccatatagaaaacaatttagaaatagctgaaattcggaattaaaaaaataaggaatattagaagaggagactagagtccatatagaaatacaattaggaaatagctgaaattcggaattaaaaaaataaggaatattagaagaggagactagagtccatgtagaaatacaattaggaaataactgaaattcagaattaaaaataaggaatattagaagtagaatatagagtcaatatagaaatacaattaggaaataataaaaattcggaattaaaaataagtaatattagaagtagagtatagagtccatataggaatttaaaactaactaaaattcggaataaacataataaaaatgaaaagtagtgtttagagtccgtataaaaatacaatttacaaataactaaaattcgaaattaagaaaaacatgggaagaagagtttaaagtcaatataggaatacagtttagaagtaactgaaatttaaaattaaaaaataaagaatattgaaagatgagtttagagtccacgtagaaatacaattagaaataataaaaattcagaattgaaaaaaatatattaaaagacgagtctagagtccatataggaatatatataatttacaagtaactaaaatttgatattaaaaataattaataactaacacgtatataaaatacaatatgaatattacacattagtagtttcgtaaagttattgcaaaatttaaaattatgttgtcattgtaatatattttaataatataatgagaaaacacatatgctattatagccaccatgctagttctacatatgtaaggctggggcagaattcatacctggttgatgaaaagatctctgaagacacccgagcagttgataacaacgtcaatcctgggacgtccaagctcctcaaggctgacaggttccacacggttgacacggccaaaggtgtcagcaaccgggcgcacaccaatcatccacagcacctgggccaatgactcaccataggtcttgatgttatcggtgccccacaagacaagtgcaattgtctcaggatacttgccaccattgtcaaccttttgccgctccagcagacggtctacaataattttggcgctcttcaaggcagctgtagttgggattgcctgagggtcaagagcatggatgttcttccctgtcgggagaaccttcgggttacggattggatcaccaccagggccaggttcaacatagcttccctcgagggcaagtttcaagcttcccagctcattatctgccacaattagcttcaagcattctcccaagaaagtaaacaaggttctcaatttctctctgtctgctctgatgaacttggtcttggacaagtgttgtacccatggttctgataaaccaaaaccaagcatggtactaagtttgtttgtaacatcaacaacttgccctttgttgtttgtagtcctctcaacaaaggtagtgatggcaccacgtgaagcttctgttatctgcctcaacagttcaacatccgccagtattcccttgtcacttcctctgtacacatcttcaatgttcctgcccactgtctgagcaagtatgttaggcagtgagtatatttcatcctctgggcgatcaagggaagctatgttcaccaaggtggccacagcctcgatggcacttggtggctcacctatcacatgcagaccgcatggtaggaggcgtgattctatttccatgatcttggcatacacctttccaacaataaggtcacgctcatttggtggaagctccacaccttcctcaggcaagggaacatccttgtcaagattacactgttttgcagtgctaatgattgagctcacaatctgcggaccacgtcctgtgtccttgagagattggtaagaagagatgagctctgaaagctgcttgagccccttgtagagaccagcattttcagctggtggtgtcaggtagcttatggtgtttgcatagcttctgcgcttggcaacagttgcttctgatggattgtttgctgcatagtagtagatattggggatgttgccaatgagactgtcaggatagcatgcatcactcatcccaacctgcttccctggcatgaactcaagagacccatgggtaccaaagtgaagaacagcatcagcctggaagatcttctcaacaaaggtgtagtatgctgcaaagccatggtgagggctagcagattttgagaacagaagccgcatcggatctccttcatagccaaaagtgggctgaactccaatgaatacattgccgtactgtttcccatagacaaggaggttttcaccatcagaattaaggttcccaggtggcttgccccagttctcctccagcaaggaggcataggaagtgagtgactggtactcccgcacgttcatgcggtaagcaacattgaggttggggctattgaattgggcctccttatcatgaataacctcctcgatgagggcctcagctgtgtctggaagaccctcaacattgtagccatccttcttcagatcttggaggacggagtagatggagttgaaaacattcaggtatgctgctgtgccaacattgcctttgtctggtgggaagctgaaaacagtgattgccagtttcttctcctcctgcagcagacaaacaaataaggttattgtttctgtgtgctttgcaaacctagtcaccatacaatacttggaatgagtatttcaacttaggaacttttcacgaaactgcaaactagataacataattggattatgggatcatacacataaacttttgactttatgtttacgaatgattgtattgtttcatgatttgaaacttcagtcagtaggcagttttagcatatatgtaatgctacaatatattcatcactgagcttcatgttaaggtatgcatcacagggattatgtggcaagcttgtggcaccgttatgtacatgagttcttcagaggatggaagagttgattgatcgattatacgagtagttctagttctcagttgaacatactttatgcaccttaagtattgagccttttgttctcacatgatgtattgtttcatttgaaggataactttcagttggcagctaatgattgcataacacgtggcttttcattgaacttaatatcatgtgatggtatgcattactggaattttcacatcaggattgcggcatcaaatgtacaagagctcttcatgggatgaatggcgcatgtgcaataccagttttgagcatgacagtgaagttgttaagctaatatgtttgtttagcatgcaatcttaaatccctcaaaaacctcaagaagatatgaaagtgaattcagaactatccagatgtgacgtttgtggttgcctttgctctcaggcagaaacaatgcaattctatacgggtactacaatttatacaggaactgtgtggaattgcgtaccttagttttcctcttcagctctgcccatctgattgctctagtgcagagctgctccaccctcttgtgcaacgcatgtgacttccctgcatcaaacagaggaaaaaacagtttcaggctcagctacaagtacaggattacctgcgaagtaggtgagtgagaccaaaaggaatctggaaatgtccttgcctgttctggggtcacggccggcgaacacaatgggctccatgccaccgtcaagctccgggagcgcaacctgcagcgccacctgaatcgggtgcaggcccaatgtgctgttcagccactcctctgtcgtctggaacacgagcggcagtgccacgatgtacggcacgtcgagcttctgcagcgcggcgatcgccttgggatggtcctgcctcgctggccctccgacgagcgcgaacccggtgagcgacaccaccgcgttcacgaacggctttccggtgatcgggtcgacgaggtaccgctgcgtgggtcccgagaagtccagcccgccggcgaagatcggtatgaccttggcacccttggcctccagctccatgatcacggcgacgtagtgaccgtcgtctccggtgacaatgtggctcctctgcaaaacgaggccgatcaccggcgcgttggggtccttgagcttgtcgttggtgtcgcggcgggtgccgtaccagttgaggtactccttgacgtcgtcgtacatggtgggcgccagcgggtgccagataccagcgtcgaggaagaggacggggtcgtcgtacttgatgtcggcgcccttgagcgccggcacgtaggagacggcgatcatcttgaggaaattctggaggttgtccggcgagcctccgagccagaactggaggctgaggatgtacagccgggcgtcctgcgccttgtcggagggcaagtacttgagcaccttgggcagcgtgcgcaccagcttgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 44886 - DNA, 714 bp, Oryza sativa
cgtggtggggctcggcgggctcggccacgtcgccgtcaagttcgccagggcgttcgggatgagggtgacggtgatcagcacgtcgccggtgaagaggcaggaggccctggagaggctcggcgccgacggcttcatcgtcagcaccaacgccagtgagatgaaggtaattttaaagctagtttgatcaagtcaagagattattaaatgaactttaagaacggattacacgatagtaattacaatctacaactcctgtacaagtagtaaattaataggaccactttggactgagttaagaagagatcaatgaactattcagttctacattaatcgtgtagtcatatggaaggacatcctactgatgcagatgcagtaatatggcacatcacaaacatacaatttcaaatttgacttttacaagttgcgtttgatatgttatttttgttacaaattatagaagtcgaatttgaatttgcatgtttgtggagtgttatattagtagatgtcaatctattttttcaatttttttaatatttttataatcgtttaattaacatgcaataaacgggttaacatccactcaagtggttataatccatctccatcaatttattgatgtgctgcagtgcaactttgcaaggctatgcaagccgaagaaatctttgaatacaactgatgcacctcattgccgacagagcatctgggctgcaggaa

SEQ ID NO: 44887 - DNA, 5014 bp, Oryza sativa
  unsure (1)..(5014): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcctcgccctctagctcacccagcaacgtcgcacgacatcactcttcaccccattgccaagaaactgatgcgaggtgttccatctcatcctcctcgccctcatcttctctgccggccgtggtgaagacaaaggccgtcatcgccatcgagtcgcggtcgtctctatcttttgcccgttccatcatctcctttcagtgccatctccattccatctaatcacaccccatttcgtgcagtgacggcgttggaacgcgacctcgccaccagagctcgggagcatgctccgagcaccgccgccatagcgacctcggcgttccgaccaccgtggagcattaccggtcaagctgcctcgccatcattatcacctcgagcacctcttcaaaacgccccaagaaccgccaagatcgatgaagcgagaagggagatcaaccttttcttctccggcgccggtctaccgccatcttcgtcaaatccgtccacaccagtgagccattgcccgattccctatacacgtgctgtccctatgacctcaccacgctcatgcatgccacaagctagcggctcatcgaccctttcgcgccatcatcgtcgtcgtgaagctctgcatcgccgcctggagactttctccatcaccatcgatgtctagaccttgccgaaccctgtgtgcgattcggtgagtactctagagcctctacaaaccacatgcatgcattcccttaggctaaatcgagctctaacacgacatgcaccaccatcccgaacttggccggcgcccgtaccgctgacaccactgattccgttcaccattgcttgcaagaagactatggtagcttcgccttggacccctctacaaattctcttttgactgcaacctcatccaagccgccgttcactgccggcgacgccgcaaacctcgccgttgccctgcctggctgcctcccatccaccacctcgctgacatgtgggcccaacccgattagcggactccaactgcgggtttagatggtgcgataccgggggcaatcaggtcatttagaaaatcctatcccctctttttctcagaaattataaaatattgcctctggtgtcctacggctaattacacaacttttgtagtgtctatgggcagtgtcacatttttgcggtgtctcccagccaattacatttttttgcgtgtcctgtaacaaattttgcctataataaatcggttagatttttttgttgcttcatatacatagtgtgtacacgagattacttgtgcggataagatatgtgtccgtttcagaagaggtacaacttaatgcagagagcaggtagctgctacaatagatgtatgcactgtgtagtgtgagtacgatggtacagtcaacgcaaagcaaactctgagtctggacgagctttttgtttctgactgtgactgtgtttagtttctgaaaaaagttggaagttcgaggaaagttggaagtttggaaaaaaaaagtttaaagtttatgtgtgtagaaaatttttgaatatgatatgatgtgatggaaaattagaagttaggggtaaacacggcctctgtacaagtacttgacaatctcaatgcatgtaccacaaaagattagtatggtcttgttcgtttctccaacaacatggagataaactttttatactcgtggcacgcttttcaaactgctaaacggtatgtttcgtgtgaaaactttctatatgaaagttgctctaaaatatcagattaatccatttttttaagtttgtaataattaaaactcaattaaacacacgttattaccacctcgttttgcgtgaaacacttaatctttatctttaggagattcaaacaccacctatgtgtcatctttgacaataagcagatagcaagatcccgggaagaacactataggccctgtttagttctaaagttttttttccaaacttccaactttccatcacatcaaatctttcatacacacataacttttcagtcacatcgttccaatttcaaccaaacttccaaactacagtgtgaactcacagcctatgaatcaacggatagcccgcaaagtggtgggattcagtcatactaatgaacaacaatgccacacccaaatgacagatggacatcctaattatttctcttgtaaaaggcccaactgttttgttgggtcaatgggcattttgttgggccgatgaaattgttgtacacagtatgaataagtccaccttgaatccttcacgtagggtttcaatcgtatttctcaaacgaaaaaccaggtacaatacattgctcatcttctgaaatcagtcaactatagttcaaagacagtattgactaattgagattgttttcgactcatgtgaccccatgttgtgtgttgactcggtcatcgtcctacgtggcactcatatcaaaggaaacaaaaaacagtggagcccgcatggtgcccactcatcacataagaagagacagagagcccaaacaagaggtgagagggaacgaggatggatggctaagggcatcaccaatgtttactgttggaattaatgaatggaccttagcccactcgaagattaattctttggaaaatcacaaaagcccacctcatgggatggcatgcatgtggagtttagtaccaccttacttattctaggagagggggacctccttaaaagggaggatgccctcctagccacttgaagcatgtgtggtggagagaagagggggaacacacgcgcgcgcgtactcgctcgcctggcaggcggcgcacgtgcacgacgtgcacgtggttcgccaaaattggttcctcaccttgcgcagatgcagcctccttttgcaattttgttttgctgcaaattcggattcgtttttgttttggaaacgttccagaaaaatccggtgcatgcaaacggtgtggagtccggataagttacgcgcgacttatccggttcggttacgcgcagtggagatcgtgcgggcgcccttatcaagcgacccttctctatataaaccgagccgccgccttcacgcaacacacgcgaaatcaatctagggtttgcctccgactctgtgctgcgcgtcgctcgtagattactccatcccgctcgccggcgtgcacctgtgatcgggagagcaggtctccggaacctctgccttcgacgttctgcaccgggagaaggcggcaataaggtttttgggaagcgctttgcgcgactgctccctgttcgtccgcgacggctcgtcttcctcttcgcttgcgtgctgcgtgccttcgtagatgcctgcgaaaagtttcgaccgagcagccggtctttccgccacctcggtacgtgttcaatatgttgcgcatatttgatctgtttatgttatactgtgtagtttacatgtgtagatctaatgatgcgttcatgctagttttcatctgtaatgtcatgatttatttatggagtagattaaatcattatatgcctataatctcaacaatccaaaaaccttattataggcattgtgattttactatggctggttttgccgatgcactgaggccggataaattcaccggtgtgcattttaagagatggcagatcagggtcactctgtggctgacagctatgaaatgcttctgggtgagtactggcaaacctgaaggagttcttattgctgaacagcagaagcaattcgaggaagccactactctctttgtgggatgcattcttagcattcttggcgatcgtctggtcgaggtgtatatgcatatgaccgacgctaaggagttgtgggatgcactgaatactaaattcggtgctattgatgctagcaatgatctgtatatcatggagcagtttcatgactacaagatggctgacaaccgttctgttatcaaacaggctcatgagatacaaaccatggctaaggaactcaaactccttaagtgtgtcttacccgacaaatttgtggccgggtgcattattgcgaaactacctccatcttggagaagtttcggtactgcactcaaacacaagagacaggaatactccgttgaggggttgatagcgtctcttgatgttgaggagaaagctcaggaaaaagatgccgtgtctaagggcgatggtgggcagtccagtgccaatgttgtgcacaaggcccagaacaagagcaaagggaaatacaaagctcagcagaccaccaacttcaagaagcagaagaagaacgacaacaatcctaatcaggatgagaggacttgctttgtgtgtggccaacttggtcatctggctaggaagtgtccacagcgcaaggggatgaaggcacctgcagggcagacttctaagtctgctaatgtgactattggtaacactggagatggaagcgggtatggtaatttacctattgttttttcagttaatcagtctactaattggtgggttgatactggggccaatgtacatgtttgtgctgacatctcattgttttcttcttatcaggacgcacggggttccaccgtcctaatggggaatgggtcacatgcctctgttcatagtgttggcacggtagatctgaagtttacttcgggaaagatcgtgcagctgaagaatgtgcagcatgtcccttctatcgacaggaatcttgttagtggctcccgtatgactagagacggatttaagttagtttttaagtctaataaagtagtcgtgtctaaacatggatattggggcgcgcgaggcgtgggcgcgtggagtggttggtgaatggtgagagagagctcgccctcgccctcaccacggcgtgcgccttttatagcgaacgaaaggcggtttcttaattgtgatctgtggtgttaagcaag

SEQ ID NO: 44888 - DNA, 8513 bp, Oryza sativa
  unsure (1)..(8513): unsure at all n locations
tcaataactataaattgatagtactatattctacgctaccgaaaacattggtactcctgttttgattggtgtgattattttgtgtatacgaaagaaaagatatgcatggatggatggatgagtgaatgaggtgtcgttgcgtcgagtattaattttctttttctactgtaccacacagttcgcaacgtatcatgtactatagcgctctctccgtttcgaaatgttcgaaatgtttgacatcattaactttttagcacatatttaaccgttcgttttattttaaaacttttatgagatatgtaaaattatatgtctacataaaaatatatttaacaatgaatcaaatgataggaaaagaattaataattacttaaattttttaaataagacgaatggtcaaacatatgataaaaaatcaacggcgttaaacatttcgaaacggattgagtagtatatagtcgttgcatcgcacgtctctcctgcaggctttttcccttgctggttttgcggaacaaggaaagcttagggtaaatcacattatcacacacacaaatttaaatacacctgtacgttcaaaagagaaaaagtagaagtatagttggctgggtcctgggtgggtccatttcaggtcaggtgaaaactgaaaatactgccagctacgacgaatcctatattcaattcaaacgagcttgctctagtttgggacctctcagaacgtttctttgttctaaaataaaatataaaaaataaaaagactagcacttagtagtaactttctttggcaatcccaacgatgatcatgcaataatgtatatacagtacctccgtcctaaaataaacgtagacatagatatccatcttcaacatttaaccatcctcttatttaaaagatttatgcaaacaataaaaaatagtcacacataaagtactccttccatccacaaaagttacacctatttcacatttgagtttttctaaataagttgttcctatttgtagtctttatgcattcaagacttgaatgaagagataaattaaatgttttattagaactcaaggaatcatctaaatacttattggttgcatgcttgcatttactacttgattttgtaacatccaagatgatttaatttttccttggtcttggtgtcaaaagtaatatatgtaacttttgtggatggagagagtactattcatgtcttatcatctaataataataaaaatactaatcatattttttttaaataaaacgagcggttaaatattggacatgaataatgtaaagttacatggatggagagagtactttaccggaatgactacgcatacgactggtcaatacgactctgtagtccgtacgatcataacctgaacccacagaggtaattaatctaagcaatgtgattagtttgatgaggtgagacatacgttagtagtacgtatagcacttctcatactctacgtgctctattgcccgctcgtcagaaaaaaataataattaattttaaataatctaggtgtttctttagtgtgtataaccagttattcagacgtggtttctaaactgctaagattcgtaagtagtccaaccaattaatcaaacgtgcatctcgctctatgaataaccagcatagttatgcaaataaaaaactttgatctcaacttaattatcgatgcgcgattatcataaaaattcatgattaacacgatgatggtatggtcaaagtctgttgacctgatgttaagtgacttttttttttgcaagcttttcagtccataccaaatgccacgagggcatagtagaattattagtgcaaatgcagtcaaacatcaaaacagaaacacacatcacactgatatggttcttctccgttaagatgaaaaaggaaggtggcaacagaagatgaagacaaacaaaaataatgcagggttgtggtgtgtatctcttgctccggtgcatgttgccaaaaagcccaaacaaggcaggagtatacaggtacagccagctttatttttttttcctttcagggagggaaaagaaggcagctcacacgcaacacatggacgttctgtgcttgcagcatcacagtagcttttgttggggaatcacaatgcagcatgaaaccaacacacacagggaaacatacggttcagcaatacaatgctgcaatgcagttgtgcaagcaaggcagcatttacacttgcacgtcagatcacgcaacacaaggtagtcggagcaatttagaccaccttactcttcaaccacaatataataacaatttagaccaatagtccttactcttcaacaatacaagtatataacccttaatgttgcgttggataataaatcttttatacttgtactcttaattgtcaaaaaccaagcctaacaaataagaagtggggaaagaaaagagacatcctaaattaattcttgactagactaagggggtgtttgggagagagaggctanactttagcccctctctgaaaaccatacgtctatcggggggacttatgatttagagagctctaaaccaaacaccagtaggcagggcagctatgcatctaagatattatgctcatttaaactcggttccagaagattaacatctgaagcaaggcaaacacacacacaaacggttagctttggtcttcagaagtaccaagtatgctcttattcaggcatcgacgatttcacgttacttagaggcgggctgtttgcttctcaagaaaagttccctgcgcataaagataccagcaagatgacagcgatcgttagtacaataacaggctactagccagctataaacatattttaataagataaacgataagagagaagagcagcggactacagatctgtagccagctgtaacacgcaatgtatgtatgatatgtgggaccatatattaatagtataataaacaactattgtataaattggctattagattgactatagataaattaaagctagcagcgggctatactattaaacttgcacttacattgatgagaacctaaacattgcaaaagcagactaattaaacgtgtgcagagaatcatttaatttaccgaggcctgagatagaaggtaatgcagctctccgacatttaaccagatcagaaacatataattctgtattaatcacaccatgcgagactgtctcattcacagaagtatagtccactacctgtttgacaataaagactgaatttcaggatattcggtgcagtgacggactcagaaagatcacgttgggtgtgcacattcatatctctcttacagcgataaatgcagaaatgaaaatctaagctacgggatattacaggacctgaatatcaaattattatacatacaaatagtatgcttaaatgcagataagattgtcaaaaatagtgcttaaacagttcaatcatcatctcatatatagtgaacaaaaatagaaaattacaaccaagaaatttaattggttggattaaaaattctgcacaacaatataaatattcttgaattgattcccatgatccttatcatttaaatggttccagagctaatcagatgtttggaaagtgatctaagcaattagaaattcaaaagttgacaactaaaggctaaaagggaatctttcaatctaaccttatttattagtgctaaataagctagaaatccttatattttggaactgatggaatatatatggtagcataacgaatatgtggacaagaacgtgtaccttgtatccatcaattcttgtttcccttttaaaattgtctttcaaaatgttcatctccttatcaaacttatgggaaagtgcatccagatcatgggtgattttcttttttaaaagaccattatggagcttatccacggtatcttgaaccaagatatgtgttattgcccctaagcctccaagagcatcaagaaaggatagaatattttccattgtgaccctattatgatataactcgttggcaacctcacaaaagatagttgtgtacgtcctcaccatctgcaattcagaaacgatcagtaagccgaacgaaattttagaagtacaatagaaagaaactttagaacttaattacctgatctgctgtacgttgagaaatttcggttgtaccaagcccgaaggcagcaacatcctagaaatgttacaataaaattgatgaattaactttagaagcaccaactatacatataacaaatggaaagcgtacacatgacatcataatttaccatgacctccgaagctaaatctagagctaatcgtgctttcctgcaaaccgttgacaccatctccttctcgtctgcattctgtcatagtgtcatcgccaaattaaaagagaatgaaatgcatcaacgataagctgcaacacatttattttggtagatctttgttaaacaataagagcatgcttgtcaaaatttcaccataaagtaatgtgttaacaatgaattcggtgcattagcaaaatactagtgaacttgacataaccccaaagattggtcagctagtgcaaatagggaaaagatgtgcgcactaattttttttaaaagaaccattacaaaagcagatgtttcacattgtgactgaatcttgacttttaataaaggcaaattgactcaatcagttaacatttttgttagtaagaagtttgtaaagaaatttttagtacatgtagcattgctcttgcaaatacatatcaatggaaatgttattattgtggattttttaattagaagttttttcccaactgtttcacagacagagtataaacaagactaaccagaatcttagaactggaagaatacatcttctgcatgataaccgcaattttgtacttctccttacggaacatatcagggggcgtacgcttcaaaagatcaaaattagaggcattaggaacaacaaatataaatctaaccgcaggaaagtttgctaataatcactgactcaccttataaagaaaatgatctcggttacctctgtccctagagtaataaaactaacacagtagtagattgctttcaaaattccaattgaagtttaaatttacattgggaccactgtttttagaaaaaaaaaaacttctgaacttaaaagcaattttagaactcatacagctgatggttgacatcataagcttgggactttcatttgtaacactctggtttacaagaagaaatcaaacattggcaaatgccaaaacatctacttcctccgtttcaggttataagactttctagcattacctacatttatatagatgttaatgaatctattttatgtctagattcattaacatttatataaatatgggcaatgctagaaagtcttagaacctgaaacggaggtagtatcattagttatcatattactcctctgttgcttataattcccactgctcatctatatctcgagggactagtaatctagtattacagcatgaaccagattaatctagattaacatctgagatcgagacttaccaggcccaaggctgctctgtaatcatccaggaatttgtctaatctctcctggaagatgattgctggatgctctgatcttgcagctgcatcctgttcgagcaagcaataagcttacatcattattagcacaaaaacatagcgggagatcgaaggctcgccggaagaggagacgatgccgctgcgtcggctagcattacctcgtcgtcggcgccgtcgtcctcgtgctccggctctgactccgttgggctctttgtacagtgggagcggagctgtatcctcctcgccggcgccggcgaggggaggcggcggcgttggctaatcagagggaggaaggccagggcgctcgtcggcgcggcggtcaccgcgagatgaggcggcgaccaggtggggcggagcgccgccatgtgttccggagtttcgcggaggaggaaaagggattagcgatggatttatctgttcgttcgttgcaaccccgcatcgtatcgcgcacaaattagttaccataatactatcgcgcaacattctaaacgataatttcaaatcctagtttagagattcactggtcaaaaactcggattaaatcctccaatttcgttcgaaatttacaccaaacacggctacatttgccaagcaaaaacttgatcacatcatcatcacctgttctagctgaaactgaaaagcatattacacgtgaaaaaggattgggatgttgctgttgttctactactggtcgtaggtgtagatgaagtcggagttcccgaccatggcgttgagcacctgggagacgaggaacccgccgccggcgaggacggcgacgatgagcagcgccgtgacggggttcttgagcagctccacgatgggctgcgccagcgtgtacgcgaacccggtgctcaccgtcaccacgtacagcgcgtaccgccgcatgttgtcccagaactcctccaccagcgggccctccggccccagcgccgccgccggcccggccgccgccgccgacgacagcgccaccgccgccgcgatggccccgatcagcgcccacgtcgggagcccgcacgtcctgtctgccccgccaccgccgctgacttctccctccgctggttcttggagggggtggaggagctgctgctcctccgtcttctcgggctccggtggtgcggtcgtcacggcgaggaggcggtgctggttcgttcgctgaggggaagggaggcgagcttggaagacggtggtgcggccatggaggcggaggtggcgggggtggtggtggagtacgggggagaggcgaggtaggtggaggagcgagaggtggtggttcatcttgcgccgccgcggctggcttggccggcggtgaggtgaggacggcggcgatgagggaggaggagtgtgtggtgacgagttcgcctcgcagtcgccgtgatctgcacccgctctgcatgtggggtggtggggatgcgggtggttgttgggccgagtggaatgttgttgggccgaagcaattgttgctgatggttgggccgtgggcttggttcgtgtccatgggcatggttcgataaatgggccggtttggtgtgcgctttggcttgttagcgcttttctacttttgtgcggcttgtgtaggctaaagtggctaaccaaaagtttgatgacatgttagcgctttctacatcttttaatctgcgcaatgatttagcaaattgttttgcttttctctgctagaaagaggccgtctcgtaattcgttttagctttcgtgaataacgtggcgaaatcgtgtttactaaagcattttatcacggtaatgatacgttgtggctatattttgtttcatattgtatctttatctctaaaaattgaagatgtttttaccggtatttttggtacgttattcgtgtatgagtcagtttttaaattcgttcgcctttaaaaaatacaggatgagtagtataaaaaatctctttaaaaaaactcgcatgctaacatgagatgatcagacttatactacctccatcccaaaatgtttgatgccattgacttttttaaaaatgtttgaccgtttgtcttattcaaaaaatttaagtaattgttaattttttttctatcatttgatttattgttaaatatacttttatgtatacatatagttttacacatatcacaaaagtttttgaataaaacaaacggtcaaacatatttaaaaaagtcaacggtgtcaaacatctaaggaagaagggagtaattgcagctaatgattttctagaaaattatgcagcgaagcaaattttaaaattgaatttctccttactaaaccgtataacaataataaaaattaaaatattcttcacctgttgtaatgtacgggtattttttttctagtttgatctaaattgagaaatatttaggcattttctagctagaactgaactgaattagaaacctcaccccttctttctattttataataatgtaaagcgtagtaaatactaccacagaggctcttggaggttgtctgtactccttcattcttatctttcaccatagattatattcgtcaaatcgatcaatcggtagaaaacactatattttttattaggattcaacgaggtcaatagtattgattgataatatatactcgagataattttatcaatttactgctgattttgactttgtacattccgtttaacagtacatctttacaagtagtaacaaaaaaccgaaggcgtaagccgaagaagactttctttcacgccctcctccaaatccaagggcagcagtagcagcaaaaggaagtcaccaacccttccttcgtcaccctaccaccggtcaccggtaaacccgcccccgccccgcccgccgcaaccccagcgaaccaaaccaaaccaaacgaaacgaaacggagtagattcccccaaggccccaacctcctcctcgccttcccacctgtccacctccccccctccgccgccgacgacgcctttttcccgggggcggggcggggagaggaggcgcgggggtgcgggg

SEQ ID NO: 44889 - DNA, 24485 bp, Oryza sativa
agaaaaaggaagtcccgggcggcgcttccccccaacccctcgtttttttttttgggttcatctcgtgtgttccgtgaaattctcgtcttctcggaggtttctgaggggagggagaggctgggctgaccggctcaaggtgttgtgaaaggacatgagcttgctgcgagaggctccttgtctcgtttagtttgagttcgggctgggcgtcccttcttctataggtgacggtggtggtggtgctgctgctgcgagggatggcgaaggaggaggacggcggcggcggcccggagttcgtgaggtggagggaggacttcgtgtcgcaggagaggggcagccgcgtcgtgcattactacctcgaggacgccgcgggcgcgtcgcacctcgccgtcgtcggcacggagcggagcctgcgccacatgctctatgtggtctcggaggatttccgggaggcgcagggtgccgatggcggcgggccgggggtgtttgcgcgcaagtggcggtcacgccgtgaggtggtggattggctcgcctccttccttccggcgaagtccctcgcctcgagtaagtctcgcctcctttgtttatagtgctcatacacgagttcggctgatactgaatataccaatagctgtttatttaacatgctatatgccatgtagtgactttagaacctaatgaagtaaatagctggtttggagtatgtctgttgttcacagtaggctagccatgaattcagattagaccttactagtaaaattttggatttctagaagatcctgtgcaacttgctgtgtaccctattttcgtagtgcataatcattttttctgcgatggatacaatacggaaaatttagccttaaaggacctttaggactaaaagttctacctgaaagacctatacagattagacattatgtggtagaggcctttggtttatttccacccatcatattagacatggtaacaggcaatatgtgctaactggtaacatatgtaactgtaatcacaacatttgggacttgagagtgcttatgctttgttcaagttcaaagagaagccctttcaaacagggaaattacatgaactttttacaatagcttgttagtgacagttgtccttagtaatcaactttttctttgttccctttcttaccacataatggtctgattaccagtttgttcaccctgttaagcatataacatgtatgatcaacatatgaaccatttgttaacggtttggtcatttcagaactttcaaaatttggatcacatatgggtaatgacattggattggatggatacagtgaacctgatagctttatgggtcacaatctggtatgcaattacttgtaactttgcatacagtttgttctcatctttattagcgttttgattttttttatattgttaggggaaagcctgtagctcggacattatgtggtctggttcgtcctggacttgtggcaagcagctttaccactataaagctttttgtcgtaatggtaccacaatatctgtaagtattttgtcatggtcatggtcatgtgtgtatacccaattgcccatattgttttctgagcttcatgtgccatcttctttgcagacccactcttttgtgcttgtcatgtctgaggaggaaagtcgctatcttgcatacttggaagatatgtacgaagataagaaggggcagaagaaggttaaagtgcgatggtttcatcaaaaccaggaatttgcttgcgctatacctcctccccctcctcatccttgcgaagttttcatcactccttattctcaagtaatcagtgtggagtgtgtcgatgatattgcaactgtgttaactcctgagcactatgaaaaatgcgtcaatacattgccaaattcttctatggtgggaatccgtttctgctttcgccaatacagtaaaaataagtttaaacgttttgacctgagatcattgcgtggatattttagtcaagctgttgttttgtccttaaaacttcccccagagcaagaaaaggatgatggttctgatatcataaaaacttttgagcaatggacacctgggaagacaaagtttcctaagcagtttgagaggctttactcaaaatgtttgggaactaaaatctgccgaggcccacaagaagactccatagcatcttatcagaaaccaagcagtaagcaatctcccagaaaacatctctcagtcaagttcatagggccccagaatcagcgtatgccaacctacaatgttggtgacagaatagaggtcttgtctcaggacagtgggattgtaggctgctggttcaggtgtacagttctcaagtcatgtactaatcataacaaattgaaggttcagtatgatgatctccagaatgctgatgatagtgggagattggaggtatgactactggtcttagtttgaaatttaagtggtatatgtatttttgaaaggcagaatatgccataatatttggtattttgttgttacttctattctttttcgtaatgccatgatttattttattaactctgtgtaaaatgtatgctttcataagaggatgagattattctatgcttctttgtaggagtgggtacctgtatcaacattggctcgtcctgataaactgggattgagatgcccagagcgacgcagagttaggccacgccctcaacaaaatagtttggctgacggaactaatcttttacctggagctgctgttgatgtatggcaatttagtggctggtgggaaggagttctagtcagtgcagacaacatttcagctgatagcctacaaatatattttccaggtaaatttcctttttgaatttttttttctggtcctttcttccaatgaaaaacaacaagttgttttgataaaatagatccttctgcagtccgtatctaattttgaccttccaagctaggggcaattgcaaatttgctgttggattgaatcgttattgcaagactgccactagaaaaatgcaaaaatgacacactgtcattcgagtggtatccctgcaaaattgaaaaaaccattggcaaatttgcaaatgccccagtggtattccttgcaagcgtatggaagctaaaccatgttccttatcatcaaacaacgatttcctatgttctttaatcctctatttcatctgcaacatgttgatatttctattgtttttacaggcgagaacttctttagtgtatgccagctaaagaatttaagaatttcgaaagattgggtcaagagccactgggttgatatagaaatgaaaccagatgtgttatcgaaaataccttcggttggtgttcaaacaaggcaacctgataatctgacatctgttgagaggccggactccagaaattctgcaatgtctgaccaagagcttgcagccatacaaacaaactctagtgaagataaacaaacaggagctgatcagccagcagaagttagtttgactgatatggcctctgcttttgcagaggaccagaaacaaacagttctaggaaagcgacctagggatgatgatgctgaacaacattgcaatggggaagtaggcatagatgttggcaaattgtgaagtttgggaagcgcaacctcattagacgtatgtacatagctatagatatggtaattggaccccagcagaggggttttttactaggttgctgatatcagtgagcatcgacatcttttttcatacacgtgttcccttgttttactgttagcttcccactttcaggctttctgtcaccagatacagaggttgcaaactaaatattacccttaccagtcatattgtatagcagtctgattgatcattgcttctcttatgttttcctccggagtctggactatagtttcagtttattctcaattgttaatatagtttaagttcatatgaataacattcttgtcctagcttgcttgtgctacaagagtatatctgcatttaagctgttgtgaagattcaacgactaacaatcacacattgtgattgggtatggtgtgcaattgcacatccatcaagtatgaactgcacttgcgcatgttgatctgaagaagttgcaaaatgagtggttttttctcctcctcaagttctgtatcatctatttgtggcatcctgggatctgaagtcaattctacctgatgccaatgccatcccatgatatcattatcttctgttatgttaggcctgatgtccctggcacgagcatgtcacattcatatgatgcattacctagttcctttacacatgcaaactctcatctgctatgattggctggtctaacaaatctccggtcccattatatcgcaaactttgaattctataaaactcaatctttgaagttgattttatggtttcatcgtggtttattttacaacattttgcttttgtatcattaaattttacctataaattactttttgtttgctaataataggcgatacgaataagcataaagataagtgaaatgatggggctgctcatctcactacatatggatgtatgtcaaagtttgttacatggtacatcgttacatgtcagctattatatctactaggtacatgttctatctgcagactgcagtggagaaggaaccagcagcagtctgaactttctgaacttgtgaagaatcggcgatgatctacagccggagccactgctcgccgttgatgaagctccggccgatgaacggccgcgcctcgtcgtaggtgagcgtccgcgaccacggcaccctctgcttcgtgctcgcccctggccctttgcagttgtactccccgaacagcaccgtcctgtcagaagattcagacacattctctgtcattttctgacggatatgatatggcagtatcgtctctaggatttcagaaaagaaaaggaactcatttggtaacagccttgtcacatgtggtaactgaattcccctatcaagactgtttggtgagcctgcaatgcaactcccaaccacttcctatgccatttgatcatcgaggatggtaagttggtaactagtaaaattcagctaaaatataatctcttcgatcaataatattaatatgccatgtgaacctgacagagtagctgcaattataattgtaactgtaattttaatcaagagcagcaaattgagtgtgtgattaaatggcaggaaagttgatcactttgttcttgattgatcaccccagtcgctccatccctgggggacgatgatgccactgaggtcacagtaggagtacaccactctggagtacttgccccatgctcttcccaggtagagcatgccggagccggtgagccggcagccgacgaagctgaacccggactcctccgacggcgagctccgctgcgacgccgcgatcgcgccgtagctcgtcgccacggcgtgcagcgtgcaaccctgacaaaaagaaaaaacaaagttacaaaaattcagactgccaagaagctaattgtccattttaatcatggcatattactgcctccacgtgttacagttgtatattgatctaataataatatattgacgtgtaaggtttttgcatgttcgtgaaaaaaataaattgatcatggcaccacattgccatgtaatgtcactctcattaacactcactccggcatttttcattcagtgacagttgtgccgaaggtagaaagagaatgtgaccactaattctgaacaccgatttgtgtaagagcattggtggcattggtgcagggctaagtgcctaaccaccttatcccacttagctatatagctaggttaagcaaggtgctaatctaggtgcctcaccagagtgagaagttcttttgctgtaaggtataaaatggaagagttggtgaatgcctgaattgtgagtttgtgacagctctgatcggaccaacaggagacacagcataaaaggtatagtactactagtctagaggacaactagagcaaagtgtgggggacagagtgtccaaagattttatcatgctatacataaacatattcttaaaaaatataaaatacttcctccatttttatttacgtgacattggttagttcaattttgatttgaccaatgtcaaatagaaaaaacatatgttgtattaaacatccaataagaacttagtgagattagggatttgcaactgctctctatctctttaaacgagtattcagcggtcatacttgttgtgtgtagtggcgtatgtgcgcgtcccttctaaatagaaatagaagtcggtttttcttataggattatttctcatggtaacagtacactactgatccttaccaagaattaccacaaaaatacctgtggttaatttgggcaacatcctgacttaattagacagtagtaaaaggcagcaacagtagtagtaacagcagctgtggtttaattttatttatttattagttacctggtacaaggaccttgcgttgccaaagatgaaatcgatggagccctggatgtcgcagttgtagaggtagtgcctcccgatgttgtcgaacagcgtgtcctgcgtccccagtatcctgcacttgtacagcaccgtcttgtcgccggacagcctcagcgccaccgcctgctgccccaccgcccccggcgccgccgccgccgccgagttctgcaccaccaccacgcttgttacatccaggaacacgtttcgccgccgccggcgagccggccggcgacgacgacgacgacgacgtgcggtgtgtgtatacctcgaaggtgatgtggctggcgcagaagtagtcggcctcgacggcgacggaggcggagtagaaggtgcccacctggtggcccgacgcgccgacgtcggacgcgcgcgagtgccacgtgatcaccgtgtggccggtgcccatgccgatcagcgacacgaacggcttcgtgatcggcaccgtcaccttctccctgcacggcacgccgtcgccggcgaggtcagcgccattgcagcttcaattccagtcttaaaaagcttcgcgagataggacgacattaactcgtccatggcggttacgagagggacaggtagtggggaggcgatcgatcggtcgaacacccacgtacctgtagacgcccggcctgacgacgatcttgaccctcctcgtgttgccggcggggaccatgtcgacggcgccctgcacggtgcgcgagtgccccgtcccgtccggcgacaccacgatcgtcgtccgctgctcgccgccgccgccgccgccgctcctcttgccgccgccaccgccggccgtgtcgtcccacgtgctgctccgcgccgccccggccggcatgctcaggtcctcccacgtgatgaacccgccatcacctcctactccggcgccgccgccgccagccaccgtcacggcgaacacgagcgccacaacgacgacgagcacgcccgtggcggccatgtccaactagtcgagagctaccgatctctagctagagctaattaaccacgcggattaatttggaacacacgagagatcaaccagcttagcttaatggagtatatatcgagctcgctgatttcacattacacacgccatggatgatgacgacgacgatgtgaagaagaagaagaagaagaagaagagaagaaaggatggaatgcaagaagacgttggaggcgtgaggaagtgatgatgccattaaatatggggagcgccacacacaaagccatgggtgttttggtgtgcccattggagatatatcaaagatttttaacattttagggcacaaaagtgggtgtttttgcttatggagttgtgtacacggtttcgtcgaccgcgaaaaaccatttttttttcatgagactaatttcgtccacgaaaaactttagcggtttgtcgctcgaaaagccgctttcatccaggttgcgtgatagtggggacctatttgtcagtgactgtttcgtgatggttctttaagagtggattgttggtagagctagcacgatggtgttgcattgcatggacttgttttgtgggaagggaactcataagggtgtgatagttattgcatagtattttttttgtgattaattaattaattaattagtatgtcatggcataatggttggtgctttgttttattgattacaagaattggaaaggttgttcatgagttgtgcacgagagagaccaagatttgtttggggaattttcgtggtggaatttggacaaggtaggctgatcaaacggggtagttagtaggttgttagtgcagaacggttgagtctagcatgcacgtcccactttctcaaccctttttacctagctcttgtgaattgtgatggtccatagttaactgcttttcttgacctaaatggagaaaaattagattggcaaaaatgttttctaaaacaaagcgctaatgcttcagatgagaagaatggcaagagatcaatggtcaatgccattttgtttcctattgctagttataatggattaggcgaagaagcattatgtaagtgcgagcctaacactgctgaaatctgtcaaaaggtcaatgcactagagctatttttgacgattaggtaatcttctgcagaaacctgcagttcaagtaaagccgtttactgtgcaatcaaatgaacatgggttgtgtaggatctatgcccaaattactcaaaaattcagcaaatcgacacgcttattcgtgacaactttcatcaaaatttcgtttacaaatgagcacggtgaaagcaatttttcagaccgcactttgtcgttcaactcaaaatcaaagtcagcctataaagtcagacaactttgtacaagtgtgaacttaaaacgagttcatgtccttggtcgtgccaaataaaaatggactgaaatagtccgtatttgtatgagggattgatgaattcaatataggctctagtactttcaggctcagccttgcaacaatgaaatggtcctgtggtttcagcccatggactggttactggttagagatttcgtaattgtcatgctgttctgtggaaatttccagaagcttctagaatcaccatatgcacaaacagatatggcatatatgtatgcatacaaaaacagtttttgttcatgggtgattaaaacatgggtacaagtgattcccgaattccaaatttattgtgattgatcttttcacaaatcacaatatgttcaggagattaccgaaatttggtatattctcatttgggttactctggatcccaaaaaactttacaaggaagtgggattttgctgtgtcatcagcatatgcttaagctttgcatactgcagagaagtggaatttttgcattggctaacaaaccaagtaaactgtgatcatatttagcaagtgatcttcaagtgggatattaaatttttacataatcctaaatacttattcaggttccaactaccatctccacttcaccaaatgttacacatttatttctgcaaaatagaaaagcatatattaggaacaaacaaattcagcatagacagcacaaccagattgctacagattggcagttttttggcaggggatgcacaaatgcaaggcagtatttatatactgaggcaagtaagcgattgagtaccatgatattatatcccactagcctaagcgattgagtgatatactgaggcaagtaaggtttggaaaccggagcggaatgtccctagcccactacaccagtacaacatggtactctagctaaagtctgcaatgatgaccatgtgcttcatccttcatgcgttaagtcgttatgccatagcccataatattgtttgttaacatctacgttgagacatccacagatagaaatagtacaaaattggaaatgctaacaaccaaaagatgccttggatgatgttatagtttattaaattgaaattaacatgtggcatcttgttttacatccctttccctcctaaataaacacaggcacgtcattagtcataggaactttctatacttgaaccaatagtcagtggagaaaatacagtaccaaccaagaagcatacaaatgggaactaggtatagtgaaaggcacacccttaacggcttaacagtaatgggatccatgttcgataagagaggcctcacagccctgattttgttgcatccacgcttgaaaaaattctcaaacttcagacttaggtattagaattccagaaatttagaaaatattgcgtaagctagcaactctagtctctaagtaacccttttttcattaagttacaaaagttggtaaccatttcatatctgataatcacacttatgaccagcataatcctcacagcgaagcaaacatagatatttgattatataaataatttaaaagaaggaaaatctatctccatgcagcatcaagatcagggataggatcaatttgttcatacctaatacttgttcgacgattgttcaagttcaggcctgtggactgacatgcgagcaatctcagatactgccgtctcactagcctgcgtatcatcaccagcaagctcctcatatgcagcctcgaatgcttcttgccagaaccgtggaagccgtacccgatcaacaccggtgcgtgtgtacacatcccacatccggcgcactagcttctctctgtcctccatctcctactcattatttaaaaattaggcaaaacttcagtacaagatttcattcacaactaaaaaatgcatatagttttgctcgtctatgttttagcttaggattctgctggtcatattgactagacaattatgcagatgaagcttgggaaattaaaccgttaacacaaatagcatatgttccagacaccaaaatcaagaaataaaggtgactgctttctcgtccatgtaatggaacaacttaaaataccatcagaccaaaaaaaaaaaatcatcatgtttccagcagagcgtgtacccttccttagcatttttttgataatgagcattttcttagcacagaactaaacctttcagaagagaaaatatgcaatgtatgtccaaatgaaactctataaacagagaaaattactagattgcagaatgcttagtctactatgtgaatttctaataaaataagctgtttgtgactttgctgaaacaagtacccatttcatccccactatgaaatctgaaatcaaccaataatgcatctcctttttcgcaatgtcagaccgttgggacttgggaaaaatgcatgtacacatcggacagttgaggaacaatggaagagattaggcaccgaccaccgagtggcggcaagatctggaaggaaggaagggaatgttggggtaggggagacatacgagggggtcgaggtcgtcgataagcgggtcggggaggtccccgaactcggcggcgaggtcgccggaggaccagcggatggtgacggaggcggcgaacatggaccagagcgcgaggagcgcgatggcggcgagcgcccacgccttgtaccgccccttcccgagcagcgccgcctccgccccgccggcggcggccgagatggggatggagatcttggtcgccggcggcggcgtggaggagtggtggtggtggtggtggtcggcgggagccttcatggccagcctcgagtatggcggtggcagtgggagctcagcagctgggtctgggactgggcgatgtgggcaattactctaccttttgatgagatgatttgagcaacgtgtttatttttctttgatagttgtagtgtactccctacgtccaataaaaaattaaaccagtattaaatataatatattctaatacaataaatttagaaatacatatgtctatatttttaggatgtgtcacacatcccgtactagattcctttttttttttacggagagagtatatggataagaggaccaagattttaatttttgatgttgctgccaatctatttttgttaatgatggctatgattattcactcaaggaaaagaaagagaagtgctaggagagaatgtgttaaatatggcccaatagttaaaagagataggatgagaattgagtatctagacacaaaaatttagaggaacgataccacttgtatcaacatacttagacttacgttattaccaccttttagaaaagactctttgttttggctatgtaagttctttagaaatcgtggtttgcttaacgataccatccacatatctattaagaaacaagtaactatgtttctaaatacagtaggggacagccttagaaatagattagttatcactaagtttgataggtctggagaaacagttagacgttatttcaacaaagtgtttcttgctgttggtgagctacaagatgaactaattaggcctcctttattggacaccccaactaaatttgccgggaatcctaggtggaatccttacttcaaggcgtgagattcatctatgtctcattttcaattttatatttaaataaactagtatgaatggtgaacagttaacagtgatggatagtatatcatcactaactgttgacaccaagaccctttactagaagtttttagcaactgctccctccgtcctaaaatataaagatttttatggttagacaccggtattaaaaaattatgtggaattaaatgagataagattatgattggttgagaagtaaaggtagatgagaagattgaattgtggagggttgtgattggtttagaagagaatgttgatgaaaaagttattgtattttgggacaaaccttaagcgctaaaagctgttatattttaagacgggaggagtacaattccttttaacatatgtagctctatagattctcagtaaaaaatatatgtatagttatataatccacgaaataaacaaaataaacaagaagtcaaaaactgaaaaatccaacctttgtaaattcttataagccaagcaattgttaataagaattttaagctaccgagagctttaagccttttaactcgaagttgccaaacaactgtaaatcttggctaaaccgctaacgcatgtgaaagtaggcctggtgatggtgggccttgggcttagcatgatctgtattaaactaattaaaactgctaaatcgcaaaaaaaaaatagaagttgctctaaaatatcaaataaatctatttttcgattttataataattaaaactcaactaatcatatgttaataccacattattttaaaacacttaattttcatctttatttacatgagtttcaaacaccacctacctatatacttaaataaacatctcaaacaaaattggtttaattaggagttaggtggccgtgagagcctgtataggtgtccaaacgggcggcacggcccggcccggcacgggcacgggtccggcacggcccgtttcggcacggcccgttaggcacggctgatgaaacgggccgtgccgtgccggcccacgtgccgagccgccggcccaagcacggcccgtggatggccgggccgtgcccgtgccggcacggcacgcctgcggcccacgggccgttcggggcacggcggcccgtgaaggcaggccggcagctgaggcctgaggcccagtgcacagtgtttttttaaaaaaaaagcaaaggaaatgtataaggaaaaaaaattaaaaatggaaataaaatgtttaaaaaaaagtaatgatttactaatgttaaaaaatgaaaaaatggtatttaaaaaatggaaataaaagtttttaaaaaaagtaatgatttgctaatgttaaaaaaaagaaaaaatggtattttttttgttgtgttgaaaaatttaaaaatatagattgtgattcattattttgaaataatttaaagataaatccacacttgcgaaaatattgcaaaagaatttgttaaaaatagtaatgacctttattgatgtttatatcattacaggatacaatgatacatgctgcctcgttaaaaaatttgtcatgtaaaaactcataggggaaaatgagaaaaccatgacaaagaaaagagtacagctcaaaggtcagaactacttctaacaaaattctactggggttggtctggatccaggtagagttgctcgaactgggcggccaattcttggttgtccgcagtgtattgggcatgttgtcgagcaagctcccagtctttaacgcttagtagcatttcgatgtggtcgctgcgcagagtcgtcctccggtcttcgatgattcgggcgcatagactgaaggccgattcggaggacaccgtcgacacgggcaccgtcaacacatcccgtgctagttttgaaagcacaggatatgttatcttgtggtcattccaccacccgaggacgttgaaatcttgtgcttcgtggtggatggcgtcgctgtccaaataaccggacaactcttcggccacaacatgcgaagaggcgtctccacttgtagccgacgaactgccaccaccttggattgaagacgatccaccccaaatcctaccccactgtatcttcttcttacctgtagtggggataggagggggtctctgctggcgaacttcctgaaactttacttcatatcttccaaaaacctcatataatttacgtctaacctcagtataaaaagaactataatctacacctatagtatctccaacaagtgataaaatagcagacaatccccttaatttacacctaggatctaaaacaaaagcaaaagcatacaacataggtatatttttccaatatttcaaatatttttgtttcatgtgaaagacaggttcagttagaacgtcatcattttcgtattctttaaataaattagcaatttcaagaaggttgtgcaaaattatattagcagttggataataaacttgtgataaagttagagtacaatcataaaaagtttctagaaattggtgaaatttttggacaattgcccaaacatgctcgttcagtactgaagacccgtcactgtttcttgggccaccacgtgactgaacaaaatcagaaagtaaactactataaggtaaaacaacttttaacattaaatatgttgcattccaccgatgctctgcatcggtggcaaacttacgagctttcacaccggccgcattgcaaaacctcttccatgcagcaatctgcgggttagaagcagttaaccacgcgattgcttgacgaacagcatcgatgtggtcacctaccctcttcatgccagtcttaacaatcaaattaattatatgacatgcacaacgctgatggagtagaaaagattgagcatacacacaaaataaaggttacaatatttcaatagccctagaattagcagatgcattatctagggtgacagcaaatattttatcagcaagattaaattcattaattacttccctaattctttcagctatgttttctcctgtatgtgagacatctattaacctaagccctaaaactctcttttgtaattgccaatcatcatcaacaaaatgaacaactacgctaagataatcctctctagctctactactccatatatctgaagtaacactaacagagaaagtacatgtactaaacagttccttaagtgcagttgcttccttgtgataaacattctctaaatctctagttgatgtttgcctactcacagctttaaacctagggttatgagattgctgaatgtaatgttcaaaagcaggggactccccaaagttcaggggtaaatcttgcctggcgattaaccggacaagagattcccgagcaaccatgggatcgtactcccaactgcgtaccgtaccgtctgggtttaccataagttgctgctgccggagttgtattccttgcttcttggcacacgactccgcatggcgcttgaggtgacctgtaccaccagaagaacgagcagataaaatttgcctacatattctacaacgggctttcgatacctcccttccgtcggggcatgtttcctttatctcgtcgaagttttgccacacaccggaggttctcgatctcttcgagccggtgtgtgtcgaaacacttccgctcgcggttccggaaaatccttccgaagctgtcgccgcctgaaccggtacctcctcaacgacagccgtatgaaccggtacctcctccacagatggtggagttggagccgatccggaggtatcgtcaaaccccgacatgtagttggggtcgaaatcacccaaggtgaacgacggcgactggtatggaaagttcggatccattctgaaaatttaaaccgacataaataaattttcgaatatttattgaattcacaaacacaatacaaataatacacaaatttgaatattacttacatctttccaaccgcgagctcttcaaacctctgcgatcaaactgttgaactacgaaactaattttgatttttgacaaaatttgagcaaattttgtcaaaatcaaaaaaaatgcacacttgagaacaaagagagcacttaaaacacttgagagcacaagatgaggagtgtgggatgaggagaaatggctggggttcatgccctatttatagggcgaaatttgagattttttggaattttttcgaaatttttatgaattttttagcctcccaacggttattttcaaatttgaacggtcaaatagccgttagtgccacgtggcgccttcccattcgaccgccgcccgccctgtcagtgcgccgctggcgctttcggcctgacgggccgctggcgaaacgggccgtgccgtgccgtgccgctacagtagccgtgccgtgccgtgccggcccgcgggctcggccagcggcccaagcacggcacggctactcgtgccgtgccggcacggcccgttactgtagcaggccgtgccgggccgtgcctgctacaggttcggccgtgccccgggccgcccgtttggcccggcccgtttggccacctctaagagcctgcaatgagatgggctctgtgcaaaagctgagttaggtggcccgatcccctttcttccccgcaatcaattgctcaccggcggagaggccgccgccgccgccgcgttcttcctcctcctgagccctaaaagggaatccagctcgaggtcgaaccaaccaaaagcttggcggcgtcgcggagacgcggccaacctgctccacatacaccgcccgtttcgccagtgtcttttctctttttactggcgcgcgcgcgggcgcgggcgcgggagaggcgagggagtggtggtggcgcgctgcagggggggctgcttggctgcggagtgcggacgacggctataaagagggcggaaagagagcgcccgatcccgctactcatcagctgccgtctcctctgtgtgtgtgctcgcgcgcgcgctccggttgctcctccttgggttcttgatttgctacacgcgtttgcttgctcaccacgtgtttgatggaatacctgtgaggtgaggtgaggtgaggtgctgtggctgtggtttggttgatgctaatccagctgttatttgtgctggattgattgcttatttgtgcttgttattactagtcgttgttagaaagcttctggctaaaaagtcgtcatttttttgcgaaagcttctttagcctacaacggcatagggatttcgatagctaaaaggtgtgcttatcttgttaatgaaagagaagtgcagatgctttatttgttgtcttgttgttccaaactctagaaaagtatgctctttttgcctttatcccacgagtagtagtatatcatcataaaacttaagggtccctttgaaacgcagaataggaaaaacacaggaataggaaaaacgtaggaattgaagtagcatgttttcctaatcctacaggaatggaaaacacaggaaatatgaagagggtccctttgatagcaccataggaaacaaacaaagcaaaggatagtttccaagaggttgaacctcttgcttattttcctatgaaattgagctataggaatgcaatcctaaggaaaatttcctatactttcctatgaatcaaagggtttcataggaaaaaatccttaggaaattaaatcctctaaaattcctatgacaatcctccaattcaaaggggccctaagtagatgggagaatggagatattcccgatatacacacgtggattggagcccaaccgtgcatagctagccatcatctttgtctcactttgttaggaaatttaagtgaaatcaattaaaatctaggtaaatccaaaggttacgcctttcagtttaactatcaaatactccttgataaaactttactaaatataaagagtttgatgttgtttccagagaacttatatcaaatatcaataatttttggtatccattcttctgaaattagtatttcccttcggaaaacatacttaaaatagcagatagttcctctatttcacaatgtagtcattctagcatttcccacattcatattgatattaatgaatctagatagatatatatgtctagattcattaacatcaatataaatgtgggaaatgctagaatgacttacattgtgaaacggatggagtagcaatctatagcttctttgtgtatcctgttccaatggcaaacgcttgctcctttttcttgatcagagcaagcaagtctgaaaattttatgtcttttccagtttgcaggcctgatactgcctgttggtccctccccatcaaaatgcttggttcacttatctcttactcaccttcagtggtaagttttagattcatatgcagtgatatatagattaatctcttatgctgaacaagtacccaggtggaaacattattagtcatgtaaagataatcaaagatctgtgactttttttttgtgcttattgctgacattcgctgatattcgtatacttctgttttgcttttttcatttagaatccaaagacggagaaccctgatgagttaattgcgactggtgtccttgcgagtctgcaaaactttatccgcaaatgcatcgtagctgtcctctcatatggcccaatgcctaaacatattgcatttattatggacggtaaccgtagatatgctaaattcaggagtatccaggaaggctctggtcacaggatgggcttctctgctctcattgccagcctactctactgctatgaaatgggcgtgaagtatatcacagtgtatgcatttagcatcgataattttaagcgagatctgactgaggtgaaatccttgatggagttaatggaggaaaagatcaatgaactgctagaaaacagaaatgtcatcaacaaggttaactgtaagatcaacttctgggggaagttggacatgttgagcgaaccggtgagggtagcagctgagaaactgatggctagcactgctgaaaacaagggactggtcttctctgtttgcatgccatacaactccacttctgagattgtcattgcggtcaataaggtctgtgcagaaaggagggatatactgcagagggaggatgttgacagtgttgcgaataatggtgtgcattcagatatttcagtggcagatctggaccaccatatgtacagcgctggttgccccgatcctgatattgtgatccggacctcaggcgagactcgcctgagcaatttccttctgtggcagacgacgttcagtcatttgcagaatccagaccctctttggccggagttctctttcaagcaccttgtctgggccatactacagtaccaaagagttcacccttatattgagcaaagcagaaatctggctaagaagcagctgtaatcacatcctccctgggaggagatagaaaccatcatacaagatatctgtagttacacaataatctgtattctcctttgatatctcctagaatgtgaaatatacaaaaaaaagatagctattccattgtaggcaggccaaacatgtgtatgcttgagttggtccaaatgtgtgaaatgtaataacatttggtctaagcaaagtgccttattttccctgaagcaattttgttcgctgtgcagatgtgctactatatccttcttgttacagtatgcatgcaaacaaactgagaacctataaagcttaaagcatccgtaaattaccaagtgcttcttcacacctttgatttatgctttactcaatcaaacaaattggcacaaaaactgttcacattttatccgggaaacttttgtgcttctctgaatcaaaagaatttttgctccattgattcggaagattttgaactagcatatttcattctaaaaactccttatggaattgctgactttgctgtgttaaggatttatatgattcttaaagcaattttcttacatatatattttttttagaaaaaatcatgcttagcaattcgaaaagcgtgtgagcggaaaacgaaggagtagaagttagaaacatgcactctcttcataaaaaaaaaccctggctatgtatacagacatgcgtatcctaactatgtatctggacatatgtatgtatgtccatatacacagccatgtttttttttggacgaagggtagtacttcctccgtttcacaatgtgttattctaccatttcccacattcatattgatgttaatgaatctatatagttatatatgtctaaattcattaacatcaatataaatgtgggaaatgatagaatgacttacattgtgaaatggaggaagtagtatagaatatgcccttgttgtctatacaatatttttttgaactattttcatactaaaagaaacccatttggaatcaatgtgttcaaagggtggcaattccaaatggattttaaaaccatggatatacatattttgcaacttttgtccccattgatcggcataaggcataagccaataatacaccatataacatattagcgataataataatttgttgataaaactgttatatatgtgttcttatcaagttaaaaggtcatggtgaagaataaactttgatgaaaattttaaatcaagttttaaaattcaaattttagccatggttgatttcatttgggcaaacgatggaggcctctttgcttgttaagcttcaacatggagtcaaatactccattcgtttcacaatgtaagactttctagcattactcacatacatatagatgttaatgaaactaaacacatacatacgtctagattcattaacatctaaatgaatgtaggcaatgctagaaagtcttacattgtgaaacagaggaagtatgagataatattttgcatttatattggtgttgtttattgaaatttcatttgtattggacgttatgggtgaaatagccagtgcctgttgaaaagctctcatctagtctcatcgtttcacctacaactaattataagttgtgatgcttatcagcgactcaaaaaataatttatgagtaaaatttttatatatagttgaaaaataaactagataaaacattaaaatcaaatctcattaagatctaaaaattaaatttgggctatgactgataagtttaaatgtcaatgctgaaaaaaaatacaatgagaaaacactaaaatcaactcaaattaaaaattaaaatttaatttttggttgtagcagataagttgaagtggagctgatcgtctgcttgtcttatcagttgtagcaaaaatttgaatctaaaaacttaatttcaaagttgattttaaggttttctttgttgtagtttatttttcagcattagcttttaaattgataagaacacacatataatgttttgaatataaattttttgggttgcttagtttattttctactgtttattagtggtagatcaacaatcagagcaacaagaaactcacatgcaaaagcacggtttgcaatactattttccttcgatgacaatatcagaaattctgaatttgggatgaattcaccacctaacataaaattaggctctatatttttcctcctcctcccctccaattcggctgcacaacttgtttccatgacaaattagaatcaaatccagcacatataggcctttttctcttttcctgatgaaacaaatagaataactcaggtctattctgaaaaatggtggcgatccaaataggggggtttgtgctaaataacgacatgaaaaaaaaaggcaaattgggtgaccactgtcaatggtttacaaaaccgcgtggttatcgcacggttatcacctgcggtaacctttttagttttgaaaccatggtatatttcacggttttgaaaccacggtataccttgtgataaccatcaaaccgcaagatgatggtaacctatctaaaatggtttggtaaaccctgctcctgtccaatatacgaagtccaatatacgaaaggaaatggatcatctgacgtgaacttttccctgacatagtcactatcatgttggtccatggatgcatggtggagtctatacgtcagtgacaatgtttatctcactttacatccgaggatccgaatcctctatcaaatgtagagtattctaatttagcatgagcgagttggaatttgcttcatcagaagatccaggacaaattactctgtagactatctatctctctgtacacactcctgtatcggcctcatcatttcacttacgtatatatatgcatacccaaacagtttattattaactcgaaaaataatttacaaataaaactttttatatatatgtactcttgacgattcgatataaatgttgtaaaataaaataaagtgtaatgagaaaaccataaaattaacttaaaattaaaaaaaatattgacttataagtataagcatatgagaaacgaggagttcgtaagttcctgacaggagtaacttagtactatctccatattttaatgtatgacgccgttgactttttgtctaacgttctaacgtttgaccgtttatcttattaaaaaaatatgtaattatcatttattttattatgacttgattcatcatcaaatatcctttaagcatgacataaatatttttatatttgctcaaaaattttgaataaaacgaatggtcaaatgttggtcgaaaagtcaacggcgtcatacattaaaaatacggagtgagtagttcggagagctgagcagtgaggccagcagcatatgtgtttacccatgttctgcctccacctgcacacccactcctttgaacaaattcttatccaaacgtgtatttagaagttgggttttttagacagtgagggtatagtttttacttatgaataaaagccaggcttattaatccgtagacaagcacatccttaacaagtactagtatttattcgtctgctagaatgcattaaggggatattggtggtgatacctaagagtgccacgactaagcataggtaaattatagtatgaagtacgagaaaaatattggtcaaaagtgttactccatacaatactttactctaaaattaaggtagaatctaaagttaaaaagtgtggtataacgtaaatgtggtaacgaaggtggaatctaaagttaagaaaatgtgttataacgtaaatgtggtaacgaagtaaagacatgcttctaaaaaagaaagtaaagaacaatggtacgagtgcacgacgactaaagtgtgacgtatcaaagcaaaggaacggaccaaaaatacactgaatcttaacatactccctccgtccaaaaaaaaaagacaaaccttagtttttcgtgttcaacatttgattgttcctcttatatgaattttttataattagtattttcattgttgttagatgataaaacatgattaatatttaatgcgtgacttgtctttttaatttttttcataattttatcaaataagacggatggttaaacgttgaacacgaaaactcagatttgtttttttggacggagggagtacaaatatacacgtgctaagagaacaaagtcagattttgccagccaggtgatggtgatatcggacatgtcactgtacatcagaaagctaaacagtggattggtgctggttgactcgcagcaggagcataattaaagcagtacggttattttgtgctttgtggcgacgaagaggcgtacgtggaatctcgcttgttggtgcttggtggcaccggtagaggagggcgaccgccgccgccgagatgttgggctcgtgggatttgagcccgagctggatgggccgttcaatctgccggagtgatgggctactgggctagtgcatcactgtttaaaactgatgaagataaaaatgaattcaacgtacgtaaaacgagaaagctactaggacataattaattaagttttaattattattaaacttaataaattaatatattcaatattttaaagcaatttctatataaaaagtagtcgtacggtttaaaaaacgtgctaacgaaaatcgagaaaaaaatatgtatctttatgagaaaaaaacatgtggtggacgctcacatgttcttttgatgtgaccaaatggcacatcactcacgtacaagagaaagtgtagaaaagagggtatgttgaaaatcaaatgtctaaacggagaaatctacaagtatataataatccttccattttatattataacattctttgaccttttctaattcaaacttttttatatttaaggg

SEQ ID NO: 44890 - DNA, 18789 bp, Oryza sativa
aacaaaaggcaggtttacccagtccaaagtgaaaatattgcttaaagggtggtccaaagtgaaacatcggtaacaaaaggtagcccgaagagaagtttactcattatattttaatagtattttcgttttgggttgaaaaggttgctaagtttctctataaatttggtaaaaatttaaataatattaaattttaaaaataaaatgtttcataatatgaaatgaagggaatatagaaaaagaggggacagtttatctgttagagtgctctctcctcattggttgtcatgagcgctaatcatccttgttagcactaacacacagcaaaataagcatggcatttagctgtccccgggtccattttccatttttaagaaaaaaaaagggaaattccatgggtcctgactagagagactatagagtcctgcgtgcatcgatctagggagtaaacgaacaacaatgtttcaaacgattctgtcgataaaattttgtcacatctacctaacacaagatatataaaaaaaatcacatacaaaatggtttgcaatggagcaattaataatgattttgttgtaaatgtatatgttatcaacatgtatgttatatcgtttgttaattaacatgcggtacccttctactccctctgttccacagtgtaagttattttagcatttcccacatttattttgatgttaatgaatctaaatagatatatatgtctagattcattagcatcaatatgaatgtaggaaatgatagaatgacttacattatcaaacggaggaagtagctcttttatcttttgtttccccctccacattacaaatatcctacgtgttgatctcccagacgatgacatcgtatcattattcttgtccctctgatgttattttcttattaacgatatccatggaacatatttttttccaactaacttaaaaatgttcatcattacgatagtccttaatttattcgaagataaacgtattagagtaaccggattacataatatgattatgaaccattgtaccacaatccgtgcatagcattgtagtggctattatataaggcagtgtacatagcagaagatgtattcataacatatccctaattgttgtggccgtttattttgcctactaatagtcatacattttgacgtgatcatgttttaccaacaataaactatgcccattatatagttttcaataaggagttcctattggaaaatttgtgtctcaccatggacagtacatataactacacgctgcccataccttctaactccactcgttagctcatcgattggactgaagtaacaagtacaccagtcataggagtgtagctagggttgaggaggaagagggagagggagagcacattgatgcctatataaaagatggcataacaattagactatgaatggatgacaaggtaatgtaatagtgtcactgtatgttagacaaaacttaatggattatgggtagacttgatggtgaagctaatatatcttagcaatcagactagagtagcgggtcgattatcgatcacacatcaatggtgactacatgaaggctctatgtgttataaccgtataagcaaaatacccacaacgaggttggatacgtgggtggaggcgtagctatatgaagacaacactacgtaactcgtggcagatcagctcaaaaaggaggagaagctattggccaatgcgctagttatacattagccatatatctatatcgctaacactgttacaaattgtcttgaatctatatttattcatgtccaaattgctgcatgatagccaaactaaattgcatctttcagagccatcgtttcacttattcgcggaataagcgaaacaacatagcgatctaaaatcaaagattgaaaaataaacttcaataaaaaaccgtcaaaattagctccaaatttagggttgaaaactcaaattttggttgataattataaatataagtaaaaagatgaggcgctttttctctcaaagaacctttgccatgtctctctcatgcatattgagcccctgcacatcaacgtagtcatagcacaaattgctactactactacacaactttttcaagacatagcaagtgctcaataatatcctacatagaagcgctgaaatacttttgtatgtgtgttttaccttgctatacaacctatttatgtttcttgaatatttttacataaaacaattactactaacacacttgtaatatggacatgttactatgtagtgaagccacacgtaaacatgatgatggcataattttaattgataattaaacgtctaggtctttcaactagccgatctgggtttgaagtattacccattctaattatttgatattaagtcatttcctaatatttgtcttttaattaccaatcaatcaaacatgaagcagtagcgcagcgttaaacgtgatttgagcaatattgcaaaccaaacaagagtagtgcacgactccaacgcgaggccccgggtccaaatcaaacccgtgccagccgcctccggccccactgccagtctgcaccccaactgggtcgcgcctatctcctcacagatcatccgacggtcctcctctccccaccccaaaacggacggccacgaatccacaacaaccacaaaatcgacccacacccctccatcagcctccacgtgggtcccaccgcattccgtccccacattgtcagtcacccacccgctcgaacccacacgtgagaaagcgattccatccattaactaataatatctttgccccttaaaagaaaacgatacgaaaaaaaacccagagaaacaaaagaggaaaaaaaaagaagcgagaaaaaaaagagatgcttttggcatcatccagcccaccacgcctccacgccgcgctccccccctcctctcaaaagaaacacacgcctctcggatcccgccacgtcatcgatccgcacctcccgatccgagccctcccattggctgcgtatacaacccgcgatccccccacctctcccctgcaccgagtccacggtgcgccccgtgaaccgcctccaatggggaggtaaacacccttgccccgtatatatctctccgtttcaaatcctctcgaaaccaaacaccccggaaaaaaataatttattttttataggagaaaaaaagaggagaaaaaaaagggaagaaagagatggacgaggcgtgggagagggcggtggaggcggcgctgcaggccgccggagaggggagctcgtcgccggcgaggagcctgacgctggacggcgccgtgaagtgcctgcacggacgcgtgcccgcggcggagattctggagcggtaccagagcctggagcacctgtcgatcgccggcgtcggggtcgcgtcgcttgccgggttccctcggctgcggaacctgacgcgcctgacgctctccgacaaccgcatcgccggcggcctcgaccacctcgtcgccgccgggctggcctcgctccgcgacctcgacctcagcaacaatcgaatccaggacgtcggcgacctctcgccgctcgccaacctccgcctcgtctcgctcgacctctacgagtgccccgtcacgcgggtcaaggattacagatccaaggtgttcggcatgatccggactccgaagtacctcgacaagatggacgccgacgagaacgagaggccggagtcggatgacgacgacgacgacggggatggcgacggcgacggcgaggaggaggaggacgacgacgatgacgaggatgaggatcctggcagcggcgaggtggccaacggaggcgtctcccacccgcgcggtggcgtggcgtcgcacccggtggaggtgaacggtgtgatcgatgtggacgaggacgagagcgacgccgacgaggtcgtcccgaacgggggagacgaacaccacgctaatgggtttcggtcgcggccgttggggacgaggatgaatatgtggaggaggaagacgatgatgatgaggaagactatgaggaggaggatgatttgggggaggagatcgatgaggatggtgatgacgaagacgctgttgttgaggtgcatgatgtaccaagtagcagtgatgaggaggaagacggcatcgaggaagaggatgaggaggaggacgaggatgaagaggaggttgaggatgatggtgaggaggctgagccagagagcagcgggagggtcgctttggcggtgggggacgttggagaagagattgatgggcatgagcacggagagggggaagatgaggatgagaacggtgagattggagaggaagatgaggagagattggaggatgatagggtttatgaggaggggaatgatgacgacgaggaggatgtggatgatgaggtataacacattttgcattaatttctcgcaagcgtatcaagatctttgctattcgttgcaatgtttcgtagtaacggtagcatcggtagtcgtttatattcatgttctagtaaaattgatattaaccattctcagttgcaggttcttttttttttcaggggatttactagttcgtgcgttagttatgtgggtgtttgtttagtctacttattataagtgcaacattttttttgtcatgctgaagtagataacttcaattgttaggtttcctttccacaatcacctttttggtgatgttttacactctgaaatagtgtcagggataatcttctttacctcagttacttagcagcagggataaaatcatttttacctcatttactgagtgtgatacataggagcagttcagagacttatgtgtgcgctctatcattattggctaatgtatccgtgtgatgattttatgagttgtgcattagtactttgtttgatatgctgcagctatgtgcacaatctttttgaaaattccagttagacccaaaaatgacaggaaatgtgagaaattagtgtttcagatatgattagatagatactgtatgacagcagagtttagtttcttcatgtagaagaaagagaaggttttagttatctcttttatgccctattttcggatataacaaaagattttgcatctgaagtttttaaatttggcaattgcttaaaagaaaaaaactgatacatctatgaaacctgggattttatatgttctttttaccttatttgatatccatatctatgtatgcttagtaaatcactagtgtttctactctaatttttattgatatatttctgttttagtagtgccagatgttttgtcatgcatttatttcttttggggctatcttaataatgcattatttcattatatatccctgactgtgtaagtgtgtacagacctgtagttcttctatccatgagaacatgctttagtttttgcctatgttatctggccagtagaagctcttctctcatttgtgaactgtgcaatttattcgctgctaaatatccttgtagatagattttctcctgtcatgcttgttatggcccattgttttgttcattgtgtaacgagaaggccttcctttctgaatttcatcttcttaaatccttcgagaggtggttgatactgcttttttactttcactattgttttagtgtgctattcttgcttataggacatttaatttattgttaagttgatcttttgatgtaaatattgctgatgtttactatggttttgaaaccatacatattttctttcagtggtagagacgcttattgtatttcagcaattgcatggttactttgcctatgtttttcattgctaatttattgctgcatgtatgttaaaactataaatcatggagtaatttgtttgactctttgggcatttcacttagtgagctgtttatgatacacatgacttttatgtttgaggtttttctaaaccctgttccagaatgtccttcctgttaatgactatctctaaaagcagaattgtggaaacacaggtctaatgagaattcatccaattttgcatttcctcaggatgaagacacagaatatcttgttcaaccaattgctcaacctcaggccatggcggttggaaacgactttgatgcagctgaggctgatgatgctgatgaagatagagatgaggttgatgacgatgatgatggtggtacggacctgccctcgtcctcgcagggcgctaagcggaagagagatgatgatccatcaggcagtggagatgacgacgaggacgatgatggtgtcgaggacctgaggcccttcaagcaccactgaccaagcagcaatgtacatggatcccttcctccccctcttctcagctagaaagaaccaagcaagcagcagcaggagcatcagcaaacagaaatggtgggtttccccctgttttttcttagcgtttttcttgtaaagactttggattgagagagagcttcttcatccagccttcctcttcaaacatcagattttaggagggaaaatggagatacctgtgtagcaacttagcaagtagccatggcagctcagtttcagtttcagtttcattgtctccctagcctgcaccatctcttttgattttcttttttccctccagaatttcaaatggtagttacaagccccaggtttccctccaccctttcaaatttctgttacattggcagtgtagccgatgtattgccaactctcaaaactgtagtttccctccaaaggaaaagcccgggaaatgccccccctttcaaatgccccctcaccctcagtagccgttgctccccctccaatttgaatttttatacttttgccctagttggttgaactgtgttgctgtgtgtggtaagagtttctcactggggagtgtggacgacggtgccaccaccccggggggggcttctgtacgcgggcgctgcgtgctttgagataggtgaaacggctgtggttgtagcgatgcggaggcgtccgcggccaaccaacgaaccagccacctctgtgggcgagagggcgggcaactgggctcccggtgctcgcagcagtaagagccatttctttaccaatttttggaccgagcagatgcagcagcacagcccgcggcggctgcgcccgtgtccacggctcacggcatgggtcctcctctctcactgctcaccgggccccactcgcaggcaattctgttgtggtgggggcgggtggtaactggaccgggtggtgaggtgaaccacggcgcgggagtgggtgggtgggtgggtgggtgggtgggtgggtgcacgttgtcggtgagcggctcgaggcgaaggggaggagaggagattcggccggatttggatggatgccttcttttcttccttggatgcttctccctcttgaaatgacggtattgccctccccctcctcgtcgttggtgggggcccaccggcttgaattaggcgcacacccccagctggctccccaactttgacacgtctctctgccgcgggatccgaattaaagaatgggcgacgcgcctagagacgacgcatactttgggtgtgggtcccaccacggtgatcgtcgggccccacaagtcagtgatacgatagctctgcttcgagcggtgaatcacgtgcaccgggtccatgtcacgtacggcgactgggaggtggggccccggttggggtggctacgctcgtctgaccatgtggtccgtgtctacagatagctctggcctctggccccgcgcaggcacgctatgcccgtgatgccctgtatggacggcgcggatcgtggagagcggagatcggacggcgggtgtgagagcagtgacgtgggagatcatccgcctagtgtagaggagacggtgccgggtcgtcgtgccgtgttgctcgcgcgtacagcgtggaccgggcccagagggtggacgtggttggtggggccatgggggtggtgtgggtggagaggtggggtccacctgggcccacttgtcagtttcatgggtggaaggggatggatgggaaacgacgcgcgggcgggcggggtggtgttcggctacgcggcgcctccgccgtgtccgacggggccgttgcatctccgcccctcccccgcaaaccgcttcaattttcaccaagtcaagtacaaagcacaaactgggaagtattttcggcagtaaaaatagggtttgttgtgagatacggagtttgtttgtaaattagatgttttggaaaatctaaatactatcccatctcaacccatctcaaaatatagtatttttattataatcttaacatgcatttgtttagatttatagttataaaacttattatattctagaacaaagttatgactccctctgttttagcttataagacttttttactttggtcaaagtcaaactaatctaagtttgactaactatctaggaaaaaaatagtaatatttttctacagaattagttaaatttagagagagtcaaaaagtcttatatttgaaacggatggagtattttctttccaagtcgatttggaacaaataaattagtatttttcccctaagtgaatcattagttcattaacaaaaaaactggccacatatttttagcaaatcccaaaaaagttctctttctattgtttctccagctgtagcgactaatccgaaccgttggttgtgatcggacggcaaagagataatgaaacgaatggctggctctcaggcaatcgtgctgctcgcgcctcgccactgagctccagtttccgagcagatagagcgagttgtggcgggaaaccaatgccatccaactgaatcagtggaaggcaaccaccaccacggccacggcgagccactgcctgccaagaacgaaagctttagacggtcacctcatcggcgtcgccgcccgattttcccatggcgtcccagccactacgcctcgtgaggccgagcccgctcgccggccggcacgcggcggcgtgcaagtgctccgccgccatcccgctcgtcttcgggcggcagcggctgccgctcctcgtcgccttccctcgcggctccggctccggctccggttccggcgcctcctgctccgccgtgcaggagtcgtcgtccgccgccgccgccacgactggtccgcccccaattgcttagctactgtaaatcctttataagattaggaaagaaacgcatcagtgttgattagatcagtcaaatgtttgccatagtagcaccatgccaatgttttgcgttttgccattgaaaagttgcacttattttgttgatcttttggttactatggatttgtggtgtggtgtgcagtcagtgagaagaaggatgcggccgatgccaagaaggaagccaccgcggaggcgaagcccgcagcgaagccggccgcgaagccgaagaagcctccggtgaagccgctgccggagatgatgcaggaggagatcatccccccgctgaaggcagctctggaggctgaggacgacgtgtcccaagtggagctctccttcgaagataatagggtgagtgtgccgactagtgccggagatgataatagggaagtgatcacactgcatattagcatccctaactgtttcataagtactgttgtctgaagcttgttgattttgtgattactgattagtactgaaacgtgtaaattagcaacttggtataagttacagagttacagatggtataaagcaattcagcatagcatagctaattgttcgatgaatgttaaacaagtcaaatttaattacatggaataggtttctcattgctttttttaaatttgattcagcctagttctgaacaatagcattgctgatgatgtaggaatttctgaaggaaattaaaaacatttgcttaggctgtgatagttttgtacaataaggctacagcctacaaggaatgataatgaccaaatatttctgctttttctagataattgataattcataccaacatttctgctatgctgcgttattacatatatatcgacattattaacccttgctttgatgaatgcagttggagggttccttcataaaggatgaagtgccttattacttctgggccttctttccaaatggagacctcacaggtacaagctacctcctgcacctttctcatttcttcatacaaaaattgctgctttcttgctgagaataccgttgggaggcataagcaggacaatacctcaatgcattcacataacctatatatttcataccttttgaatttttaactgtaaactactatcacttgatattccgtgttctgaaggctgctatgtagcgtattatttaggtataaatccgcattctgaagactacaatatagtgcatctaggtgtaaaagaccagttatgcagagtacagagtacttaagtaggattgcagaagcatattttgcaagttgcaacactgcatcatcatcaaagatatgggcgcatagcttattgaatagcttgaaatgtttacaccagtatcattcatctcgacgattaacgcaggaccgaagggcttcgcgctgtcatcgtatagcacagaagtgagcaccatcgagccgttcctgatcgacgagaagagagcaaacgccaagtatgtggtgttctgggtttacaagaggctggctggccaagggatcctccctgtctggaaggaagaggagggtgagggtgagggggagggggagtcttcagcgtagccactcaaaaacacacacacatgggcacaggctgctctgaatatagtacattgtgcaattcctaattgtgaatgttgtaaagatgtaaagttcatctgctaatatatcacagataatcttgatgttcttttttggagcgaagatgatcatgacgtctgaaccttgcatctatctctttggtgccgtgtcaagtatcagtctatcagcagctgaaaaatggtctcttgctgagtctgcagggtagccactgaaaaaacacacacatgggcagtacaggttgctttgaatatagtacattgttcaaagcctaattggacagaattttataaagatgtaaagttcatctgctaatgtatcacagaaaatcttgatgttctttcaggagtggagataatcttgatgtctgaaccttgcaccattctcttctggtgccatgtcaaatatcattccatcaaaagctgaaatatatatatatatatatattcaacaatagaacttattggatcggagatgtaaaccattccattattaaaaaacagcagctggaaaatggtctcttgctgatgttcagtgccagtgtgctgtgtttggttggggcgatctttctgggctgggccgcaagttcaggttctcttgaaatgcttgtcacaatcatagagtgaatagtacaagatcgagctatggccatgtgtcatctgaaaggtatggtatgtggagtttatcatcccttagtcctagctgtcgccctccgtctcattcagtcctcgccattatctgatgctgagatgaccatatgcatggctcctccacagagaaggacaaaacggaaattgaaatgtagatattatattcgtccttcgcaacctaaggttcataaagtgcaaatatataatatatataaagcaactttggcattttaagagcacttggatggtcttatacggtgcataaccaacctcgacagcctcctatcgcgtttcctataatattttctcccttaatattaacaatattattgtcctttttatgaccatcctagcttatttttaagatcttactcaagtatcttttttctttacaaaacacttcttacatgtagataattttgtgaaattcgtctcatcttcaacatgtgtgtcttttttttcctttacacctactccatccgttccgaaaaaacgaacctagacacggatgtaacattttctagtacaatgaatctagacatgagcctgtccagattcattatattaggaaatgtcacattcacatctagatttgtttttttatagaatagagggagtatgtatgagtcttccgtgtaacgaaagatggtttgcaacctccatgtaatgatagaaagatttggatgagctttgcatacaattttcactttttattaaaagttcatcaaaatttataccacaaattttttttggaggaaacaaaaaatctttttcttcttccactccactgcaaccgtgcaacgctgacactcacttttaaatcgcctcaaaactaactgaatcactgaacacccgcacgcaccgcagtttagccatatcgccgccgccgccgccgccatgctcgcctacctcctccacgcccccgccgccgccgccgccgtggtgcccagcccgctctccctccgctcgccgccgaagacgcccttcctcccgacgtcccccatccgcgtgcccacgccgaggcggcgccccgccgcgttctcctccgccgccgccgcggtggtgcccatcgcggcgtcgctgctcgagggccccgtgctggtctgggccgggaggctctgcctctactacgcgctcctccacatcggcctcgccggctccccgcgcaaccccttcctcgcccacggtaatctgcattagccgcggctggtttcgattcgggggaaaaaaggctgggggttcttgatgcgcctcgtgtcgtgttcgtgcagagattggcgatgatggcgccggggacagcgacctaacgttctcgaagtgggcggacaagctgcgcggcggcgcgccaggtttcgtgcagtttcaattcaaaaatcgatttatctctccttctcagttaattttatccatgatttattagaacgcgaaaggtgtgtgggattctgtaatcgttaggagaatgtggatcttggataagatattcctctttgggcatctggatagcgagctttctgctagctaggagagagtgcatgcaattgcatctttggatgggtttagatttgggaccaaaaaggtggagatgcttatgatatgatattgtgtgaaaaagcaagttttccgtcgtcgtttatagtggactataatttttagatgtagaaaaagtaaaagttgatgacttggtggatcgataccattatggaatagaaatgtattgaagatttgtttgctacggatatgggaatcagattctcttggatgtttacagactaatcacagaacatagtgcagtgcaggctttaaatgtgtatagaggtttccctagacttagttattgtattatgcaagaaactcatttctcaaactagaacagtttagcatggatgtgtgcccaaaggtgttatcaagcatttctcaaacttatttagtctgacactttgttacctattatttggtggggttaatccaagttttctacttctggtgtgtatcacctttggtttattaacgaagaatccattgtgtcaattctcactatgccaggatcaaccatttttttatcagataacatgcttatgcagttatgctcaccagctgaatttaacatttcaagtgtcaaattctgtaagattgtgtctaggaggaaagaaacataacattacccaagtggtaggcttaagcagttcacaaggggaaccttcatcattttggtaaatagaacgattttggatccaatattgtagatgttatcattgatatcctgatgaggacatcacccatggacatattgttggctaaacattggatggtggttctagatttctgttccattgcttcgttatgtattggactatggttttgatcaaaagtacttccattttcacacacaagatggataaatgatgtgcgtgttcatctcattcaggagaaaacgaagcccaggataagaggaagctagttagcaaatggaaaccaacaactaaaggcacgctgaagaggacttaccgagttcgttcagtagaagaaggtcggcggattcttaaagaaattgctttggttctctccgaagatgaccactttgtggacgcctccagtcacaaggtgatttttttcatgatccactgcaaatacactttctagccattatgtttagtgtttaataatttaacaacaaggtgcttcagaaaaaatactgagatatttgccatgtttcttgctcttattgtaaagttgatgctcttctaactgaatgttgttgcttacaatcagggttgtcaaataaggagggaaagtgcgcacggcgagagtgtgtgctgctataatgtgagagctctgttcgatgagcttcctacccctcacctagttctggagattacagctttccctgctggacctctcactgataatgactaccgcaaggccgagaggctcgaaatggtgctgaggatgagtgcttccatttaatttcagaacacccattttccatttcagcttacttttgcccaagctgtaaattttctaccgatggggctcgaaatggtgctgaggatgagtgcttccatttaatttcagaacacccattttccatttcagcttacttttgcccaagctgtaaattttctaccgatgggcctgtaaattgattcagtcttgctaagaagttaagaactacttgtaaaacctgagttctgctcaatctttctagaattctaatatttgtgctcagtctttctagaactctaatatcaagaagtctttgtcatagaccttacatttttatggcaccgcacttattttttttaactttgcaactaactgttggacagtggctaattcatgtgctatatctgtttctgttatgtcccaaaatataactaattttagcgttcaaattttgttaattccacatataatttctttacctattttcttatctcaacccaccgcaaccatccctcatttaatttacatttctgcttaatccccattaaaaattttagaagtgttttatattttgggaaggagggagacacattaaccagcagaacgtgttctatgactcaaatttgggaccattctaacttgttaggtcgtcacatcgaatgcaaaagctgataggaactaaaaatcagataaaatgcaagctacaatattcacggggaccatcagtttcagggtttcaacttagagttcagtattagatacagcaagtacagatataagcatccacaaacagaaccaacagtcagttgatcattgcagtgcttttagttacaggaaaacttaaaatggagccacacatgtttggtccatttgaggatgaaactacttttttttttcccataaggtattttcataagccaaggatgaattgccaccagcagggagagagccaaagtgatggtgctgagctgaacccacttcacccctcttcacctcacctcatcatggaaacgcgctggtgaatggcgttcgcgaccagcttcccatctccgccattctgcgctctgaagctcattgtgggaaggaagccagctgaggggaagtggctctgctcatggttaccaaggaattctctgctggttgagacgctcgcgatttcagagggagaggaagctgaaggcgcgctaccggtgccattctgaaggcatgtcctattgccagagctcgcgccaccggatgcggcctcctcctcctgttgctgcttctgctcctcgagctgctttgtgttgaggaagcgccctccagatccacgagctcgcttcatggcatggcgatgccgagattcatggaggtatggctgagaagacaggagaaatgtttttaacttataacaggggtaattgtaagttaaaatgtatagctgtaagtagctattattttgccttgagaaatgaatcacccatgtgattgaggatggtgatcactttaaacatactgagtccaaatattttgatcaatgaatagcataaagatgtactctgagcacagataactccctaagtaacccaaggcaggataatgaatttttagctgaaagatatgtaaagatgcagtgcagcagtcagcatgtatctaagaaaattagggaagtactaacaggagcatctcttttacagtttcatagcagaaagaaaaaaaaaagggtaccaggaaggattgcaacatttcgtattaccttccgacctttcaccaacttattttgggcctccaatttagctcgtatctgtctcctcctaagaattgcatggtactgctttgcgtttacaaatattggctcttctgctgcaggctcaacaggcaacggcacccgggagttagctgtaccattttgctggggatgaacctgggtaaataatacacaaatgacaaattgttgatgctgtgccataagaaaattttaaaaaaatgtactgcgaagatgcacgaaataagtgttatacaatatatcatctagtttctcaggaagacagttttgattgggtggcatcttttagctgataagcttagaaatggtttgtacgaagtccaaaatccatcgatgaagctacgatctttaatctaaaaaagatgcatgaatcaattgcaaactccccacctttaagttttatttaaaaggactctttgttgttttattttttttccttctaaatattaatgaagttcaacaaaaaggatgcacgagtcccctgcaaattcctctcttttatttcaaagcacctgtctactcttttgttttgcttctgaataatactcgactgcaacaattgcttaactaccagaatgaataagatcttcgatgctcatcaaattgtaaatggatgaagaggggagaaaaatgatcttatcaccttgaatcgtcaaagattgtacaaatttgatgtgagaacagaaatggtagagtgaactcacaattgcatgtgaagaatatccagtcaagaccccaccatagtatgcatcagctgtataaggaatacaagcctagaacacaacatagctggtcaactgaaagtaacacttgattcaaagagggcaacaatccacacaattgcatgaacttacaaaggattggctatagttgagctttggaggcaaagctcctggattccccaacgatgatactgactttgttttgtcctgatctggcatctgatgaccatcatcattgtctgagggggaaaaaaggacaaacgagatgttaggttgggcaccggaatgattaacagagataatcgatgtaaattgagcactagaaggaataacaggaaaactcactaatgaaatgacagactcatcaaaactgtcacttcagaatatgcaaaagattactcgaaggtttggtgagaagcatagtaataacaacaataaaggaaaatttgaaacgtgagcattacatacaaaacagatgacatggttttgagttttgacgcatatgaactattatcatgtggaaacacatgataatactcttcgttccaatatgggtttcatgtggaaactcaaatgaaaagttcacataatccagaaaaaaggttgcctaagaccacagcagctcgtcacaatttacagctaccataaagtcacttgcactatagcatagatgagcttgcaaataatcattgaacgtattggtatcatgaatacattcaacttggcactacatccatagacaaacgattgccaaccaagaagcagcatctacaaatgtgttttaaagagacatgattgaagcgaagaatatgttgcgacaataagatctgaaactatactaagaccggattaccattatgacaatacttttaaatatcatgcattaccagattgtgttgaggtatgtcgctcatttggactgctatcattcatggcagattcttcttggtgtgactgtccagaatcgcttgacggggaatcttgatcatacatcttatgacctaactgcttcatctgataatctccagagaaaaaatcctacacatgcagagtctagctggtaaatgtgttactcatgggagtagcaaagccagcaattcccaggttgcaccatcaataactactacttacatagttgggcgtagtatgggctcgatgatcttccatttgtcgcaaaagcattagcattatgagatggtctcactttggtccaggcaccatttttcttcgtgtacttctataattagccttcaagacaagttgataacattaacttaagcaaattgaactgatagggcttttaacctgacctcttcagattggtggggattttgttgcccatcaaaggattagctctaatcctttctatcaaaagatgcctattaaaggtttctactcattaactggaatatgattatgcatagttactttcaggtgttgaattatctaaaaaaaacgacaatagatgttgtaatactgaatagagacagtaggaaataactgaatcatgagattctgaaccataaaagcaaataaattatgatattaccttaatatcataataaggtaatacttaatagtggtactgttcagtaggaacagagtaggcagagtaggttgttaagtgcttgttgcaagagtaggaaataactgaataaaaaaacaaataaatcaacctaaaaagagtaccactacaaataacacacagcatcctaccctaagtagacagacagaaaattcttatatagaaacaacctgatcaagaggaataagcacaaaatgcacattaggtagcttacatcagcctctttttctttttctcgaataagaggtagcctacatcagtctcaggtttacatttattacatgcagatcataaagagataacctacacaacttttagtggattgttctcgagtccaaattgccaatccatatgcacagaagaagtcccttgtcttaatcagaataacgattgaaaagctaaaccactagtaaatcagaacatatcgcagcaagttcacacattcagaatcttatcagagacacaatcgcttgata

SEQ ID NO: 44891 - DNA, 8801 bp, Oryza sativa
  unsure (1)..(8801): unsure at all n locations
acttctgctgttttatcccaaaataattgcctagcgattcatgaagttggcacaagtattataaatataaagaaagtaggcaaaataaaatggaggcaattatttattaattaagaaaaaatatgtggagaaattaaatgcgagatggttgtaattagttgtatgtagagtaagtgaagatatattaataggatttattttgtatgccaaaggttattatgttttttgagaagggtagaactaattatggataggttgctctattttccaaggcttatggagattcctgtgagctaacagttaaataaggagtaaagccattaccctttttttttctcaaagtactattttggaatggtaatgtgttgccaaatgataactcatagatactactcgctagctctatcctaaaatataaaatataaatacttctagaatttctggattttttacagcaattaagaatagacgtgaagttatatgagtgatggatatgattggttgaaacaaataagtagtggagaaattagataatagatagttgctattggttgagataagtgagtagttggagaaattagatgatagatggttgtgattggttcagataaaaaaataggcggaagataactatagttttgaataacgctaaagatagctatattttaagacaaagcgaataggatgttccttttgtttggacaacacttgaaacttgatgttgcaacattgagttcttgagttggaacaactgcttttttttagttggaacaacagtcacgcggctctaaacgtgttgggtgctttctttattttaagagtatagatgggagattcatacacttatacagtgacatatacatgcacaacttacaaatgcttggagctttttggagaaacagggtctcccaagcatgtttagggcatgtttgatcgttggctggcattgtcactattcaacctgtcacgagtgtagtacggcacacaaagtgtgttaaacaattcattggccacaagtatggtaatgtttagctagagaataagagtatggcatgcatgtggacagtagacctatggagcaacaaaatgtgacttgtcatagttgaaacaagtaaccaaacaataaacaataaattatggcgtgcctaacatgtggtgtaataatgtgcatggcattcaatcaaacaaccccttactacttgaacaaaacaacacaaaaggtcatcaagcaatggcttagcacctagggcaaagggggcatagaagagcggcgctagtttagctcaacgtagtttgggaatgagaaggagttgtggaggtttaagagaaaaaacacatctcctaaggagaggagggggcgaagaggccaagggctaaaaggggatcatggttcacgagttgagatgcacactgttgacccttccatgttagtcgcaacaacagccactacagagagtagaatgaaggagatatacgatggcacggatggttgctgatcaaaaggcctaggaaatacatgaacaaccatggacggagctaggatttaagcatggagtattagggtgataggccaaagccaatatcaataacaattaatacatgtataatgatatatcgtctccacggtcagataaaaaaccaatatatgttttagttgttttactcttcatcttagttgagcaattttaatacatggttggaattgaaacacaagataggaaatcacaaaattgagtacttattgcagttaggcaagaaaccaacatgtgttttaatctcttcactttcatcctgttgagtaattttaatactactaaaattgtaaaaaatatatatatagaaaatcacaaaaccgaatctcatcgacggactctagtctccacatagggactaaaaaaagagtagaacttacaacacaaggatttagtaagattttatgatatgagggagaacacacctgtgggcagcggcttggtggatgaagggtgccgacatggtcggactcaaagactcggcgatgaccgacaacaaggcgtgatcgccggttggcgtcagagcaaaaggaggaggggcatgtcgccggcgcactccgcgtagccatgtgcgaagcgaaagagatgaggcttcagaagaagcttaggagttgaaattaatgtgtgtcgaggatgggtgggtgggtgtgtgtgggggggaggggggagganganggcccgtncnnaattagatggggatgtgcggtgtgaacaacgtaactataccaaaacacgtggacgagctaagcgcaaggccatacaatatatgtctacgaatattgattttatatattggatttgaggcttgttaataaagttgccccttcactattttgcaataagccagcttccttcactgtntattatatatttctacaacacaaatataattgcaatataatacgcatttttttacaagtagtaaaccttagcatttccgaggatataaatagttatacctttgcatttttttttccatttgcctcttccatcattttcatgtaccattccatgtgtagctagaagaattatagtttctctctctgaagaggagaggaaacctcagaataaatttttttttttggctggcatcatgcaggtgataaaacggtcatgaattttggttttattatgagagctaccaacaacctcattgtcctcggctgccacgtgtaacggtgccgaggatgactccttcccaattgttttgtttggctgacatgtagggcccatctcatagctaaagttcctttctagacaggactctccagtggaggtctattctattctaccactctaccagacgcctttgtatagtagctcctgcagtcagtgacgtagaattggccgatcactctataattttaacaaaaaagatgtgaaggaaaccatcgttgatgcagcaactctaatactagcgcgggatcctctaaaataataaaagttttatcgttttggaccactttttagtaaaatggatccaaatactagtaacaaaaagtaggtaagttggtatttgtcatttgggagtccatagcagcaaatttggctaaaaagcaccggccccgtgcatgagagaggcagcagcaattaatagcaaaactttaccatacatctaaacactaacttataaaattgcaatgccaaatcttttgccaccaaaacttttgctaaaaaaatttgctgtagcaaattgatctaaacatgctcttatttcgtaaacggtatttctatctaaacacacgtaattgaataatgattaatgaatactccagtatttacggccttgagcaaagttttgatactacatttttttaagataaaattatctagttcatatttagcttgctactaatatgaagtaaattagtcaaatcttaatagatggcgaagaaacatggagcatgtgcactaccgattatttggcttcaatttaaaccatcataattaataaattacgtttatctataaaaaacatccatatgttttttttcaatgaaaaaccaaagaattgaacccaaaagattaaaaggatggtgttatgatggtgatgctattattctattctagtagataaaaaaagagagaaatatctcaacatcatggttagcaagtatgaagtaacaaccgagcaagtagagccatccaaaattaatagtttgatatataatttgatactgaatatagctagagccctctgttttttgtttttgttaatggaagaagccttgtttttatctgaacaatggcacaagtaaaagtaatgttctggtccttgattttgttatacaaccatcctgtttgattagcaagtgccagccaacggttctatgatgccagcatgaaagcacaaaaggaagaattttcttttgctttctttttttttccccatgatcagaaggtggcaaaagcttgcttccttaatcaatcttagtatctttaggaaacctctatttttccgggatggtttgtccttagttatgttgtacattatacttggttcatgacatcacctgtaaacatatctatcacgctgcatcttgccagatacgtcatcgaagaaaatgatctacataatttattatcatttgagttagagttctatttagcaactacctttccactgagcattgattcgatgctaaagtactaggtcattaaagggtagtgttaatgattaaaaataaagaaaaataatgcaagcacgcccgaccaacaaatccagatgtgtgccatgatatttttctttacgagttaaatgtgcatgtgcaatactacttttttttttcaaataacgcatgtagggtttgttttgattgcatctaattttcgcggtttgtttgattgcatccaatttgtgcgctttgtttggactaaagtcaatttcagccctaaaattttttacaactttaataatattgaatggatgcttggtttactgctaattttttccacattagtaaaagttctattctaacaattttaggcgttgttcagcagtggtttttgcagcagcagtagctgcggcacgtgtttgcggctgcgacgcataactatggctagtagctatagctgcagccgcaaccgaacaagattttagtggtgccataacttgataaggttttagtactactaatattttttaccaaacataatacaaaggtagaagctcatataaagacatgcaagctcatccgtgttgcaaatatttaaaaaaatggcttcaaaccaaaattataaagaagctcctcatgaaaaatgtgttttcttacatatttgtatccctttggatataagttctttatataaaagtaggaaactaaaatgcaaacagaaagatgtagtaggaaatataaaagtatgctacttgcaccgtacaactctatttttaaaccactaaaaagttccattgtctttaaatagagttgttgccgttgtttctaaatagttgtcagcatagttgtgcatgtgtgttattcattctcaatacacgttgactttttaatagggacaagtgtacttatagattgaaactttataatactttaatataatttgtcatgaattatacgctaatcatgatttgttataacatataaaaatggaaactaacagtcaaaattaacattttgacacaagacaatcacttcctaagaatcaacaatgaaattacaatatgaacttggacatcgaaatacaattgaagttaatttactttgtaaagagacaatgttagcctctcaataaaaaccgatcgaaaaccacgaaatctcgatatttcaatgtgtgacaaaaacatattccaactaaaatctttttaaatgattttcagccattaaaatttaataaaaatagtaaaaatcgattaaaacttaggagaaaaaaaactatcacaccgcttgaatccagattcggctctgatatgcatggccctgttcttttctccaacaaaagttagattaacttttggatactcgtggcacgcttttcaaaccgttaaacggtgtgtttcgtgcgaaaactttctatatgaaagttgttataaaatatcaaattaatctattttttaagtttataataattaaaactcaattaatcatatgttattacagcctcattttgcatgaaacacttaattttcatcttcatcttcagaagattcaaacaccaataataatagtttttccttattgtacaagctgaccacgaactccaactcgaaccggacagtttttcctttttaaaaaaaagctcgaacctgaccacatcttggaccaaactcaaacccgaccccggccccgacgagtcggaactcgaagcatctcgcctcgccgccgccgccgccgcacgcccgacggaagcgagcgcctctctctctctctctcaccggcgacgggatcgacggcggcgggggcggggatggtgggctggctgaaggcgctgtgctacggcgcggggggcatggcggtggtggggctcgcggcgctcgtggcgctgcaggagcgcctcgtctacgtgcccgtgctcccggggatcgcgcgggcgtaccccatcacccccgaccgcctccgcctcatctacgaggacgtctggctccgcgccgccgacggcgtccgcctccactcctggttcatccgccactcccccacctgccgaggcaagcacctccacatacctcctctcgacctctcctagattttgtgcagttcgtggtttgctccctggtgtgttagtacttaggttagcctttgtttttgggtctcggttggtggatctctgtctgcgaggcttggttgggaaggcccgcgttttgatccgattcgcgtgcgtggcttcatctcttagcttcctcgatcgcgattggattggcggatctcggtaggaaattaggaattggggtttcactagaaaaaaaggggggcttaatggtgatgaaatttgtagcgggatgatttagttatctcccatgctcgcgaagattcttttgtcaatttctagggtttctgtgtaatttggttacataggtctgtcttgtctggagtatgaactgattgactgatgttatgatgtagtttagtgggaattgagttaacaagttccctttttttgggggtgattttgtagttgatactctttgttgtatgcgatgcgatgtgttggtgcttagtattaggatttctctattgttctatcgtttatatgctctgtagtgcaagccccataaatgttcaatgtacgataggtttaaacttttatattgtgatgaagaattgatcgtgcttcgttgcttccttcccattcacttgttctacagtcattagccaatcacattgcaccatatggtttagtttatgaacttagttttggaagacatgcagtttagaaagtactatactgctttccgacgatagataacagcatgcgtggctaccaaaatagttcatgtgagcagagttgattgaagcaggcgggggttggaaattatactggcggtaatttgtcgatgagaaaaatgtggaaaatgctacatatacatccaaaatacacatcagcatccttggctcttggtcccaagaaacgtgccacacaactgaagctatcttctgattagctgacctcagttgttgactccttaggcccacaccacaaccaaaacagctagctttaaaattaatgtttacacatatgcatgctataattattcaaggcatcaatgctagttgttagtgtcattgctataatctagctagtgatatactagattatactgctaaatgtataccatgaaccagctattgttgtctatgcataagttcgcgttcttctattttgttggttgaacgcatcatgtgctggtgttttgagttgtcatgctaggttagaagagatttgattatgttctttgtttctaattagatttcataatgcttaattgtatgagattgcaataattttaacctttaggagagcatttgaataattgttttgatttttatcctcttgcgcaactgtcctcccgatccagcattcctatgatgacatgaaccttatactgtgtataactgtatattcttacacattattctgctcattcttcagtactccacaaattttacatcatctttttatggcttgcttatgtgttttccttatgcaggtccaactattctgttcttccaagaaaatgctggcagtatcctgaaattttctatatagacactgaaagttataccacattttacaggcttatagacgatggggttatattcttttgaattcctttactcttaatagatattgcacatcgtttggactttgttcgactaatgatgcaacgactacagtgcaatgtatttatgctttcttacagagggtatggttctcaacagtataaactagttctgttatctttgttgcaccctttttgctcaaagctctccatatgttgtgggtccaaacatgcttcttcctccattcactagtgcatctaaaccttgaattatatttgtaggtatggtgagagtgatggttatccttctcagaagggcatcataaatgatgcacaggtttgctgattcgttcaatcggttttatgttaagttttctgtttctgtctattctcttactgctctctttttaataggctgcacttgatcatctagttcagaggaaggatattgacacatccaggatagttgtttttgggagatcgttaggaggtgctgttggagcagtgcttgcgaaaaacaatcctggcaaggtactcatgataggaaatcttgtgtactctcatgtttctgcataaaagttagggaggcccctctgttctctctgctattggatggatgacgctagtatcctccattgcacctatatttcatgcctaagtaatgtgggtcaacatgcacatgtacatgaattagggatcgatcagcttttccaattttgttctgatacagatctagtaaaaaaaatctagtttactatgtaatgacattatatcacggtcattactccaccagcaaatttcaaattcactgatatattgaaataactactcctttgtagaaatttgaagaacttagttttctttggaagtgtggatttcaggattccttctccaaacatagtttcaccaaagaaaccgaagttttatgtgcaatctgctattttttaagttaaatcatatcactttttaatgtcaatattaaggattgaagggaaaaggtgaactgatctatgtgatgaagagtaatgtcagcagcaact

SEQ ID NO: 44892 - DNA, 6437 bp, Oryza sativa
tttcccccttaaaatagactggctgcaactggctaactaatatacgtcaaaacaactcctaattctctcatccattaagggtgtttggatgagataatcttcttgaagtaaatctgaatatcttgaaggtatgttaaattctgattttcgaagtcgagtaaaattcattgtatgtgttgccatatgttgcaggtgtcagctctaatactggaaaacacctttacatctatattggatatggctggtatcatgctacccttcttacgatggttcataggtggcagttcttcaaaaggtccaaaacttctgaactgtgttgttcgctccccatggagtacacttgatatcattgcagaggtgagtgactatatcaacatccaagatctattgttttcacgctttgattaccgctctcattttcttcttttctattttggaaaattagattgtaggttgcatatctttagagaatacatatcaatttcttatgtgattcaaatattctaatttgcttttttggcatgcatatttgaaatttaagctaagattttttttactacattatttcagctactgtatatatatattgacaagagttagaacttagaattattaaaatctataaggcctcagatctttgtaaatactctttccactttttggttactattttaccgagacctgatgctgtgcgttatctattgcctagttgatgtgtccctttcttatgctcgcttaaccttttcctcgcaggtcaaacaacccattattttcctttctggattacaagatgaattagttcccccttcacacatgaggttactatatgaaaaagcttttgagcataataagaattgtagatttgttgattttcccaatggcatgcatatggatacctggaattctggaggagaccgttactggaggacaatccaactgtttctggaccaatatgctccagaagtacagagttgtaataccagctgcaaaagtgaaattgctaatgatggtaattttctatcttgtctattaaaaagtttctcaagacagttctgttatcaagttttccatttgctttgttgacagggtcaatttattctgaagttctgtattgtgtttactgcattagacttttcatatgccgacaaatattttttttaataaattaaatgcacttcttttggatactacccatagttcatttatgttgtttgcttgccatttgctgcctggctttaccccttgtattgggtgactagatttaaatccatttggattgggggggatcagaacccattcattggatggacaattttctctgcccatctgaagggatttagtatttgtttgcttgaacaaatcattatgtgatgatcggtgattctgtctatctgtgtacactatgcagttttagcagtgttgatgtctgactgctggcaaatattttacccatctccttcaaattttagaaccacgtactatttttgctgttgactggagaagtttgttttgacgaattcaatctttttctagatgaagctgaagagtgaccagaacatctggagcggccttcttttttttttcttccaggctccagttttctggtgtgatgcgatttaaatcctgatgaactgaagctcactgcaaacaattaattcaggcaattattctccattcaacctgaagaaggcaaagttgtgaataccttgaggttgctctccatcctagcactacatttgtctctggagctatatatagatttctgagaagacctagcctttgaactgatgattccccctcccccccttgatttaatctgtgatgttgctttgttgaagttttttacaatatactgtagcgcattaccatgtcataatctggcctcggtgtataacagtgtaatgcataggtttttaggctctggttcagcaatttggttttgtgttttttattattggtgttatagatctggttgcctgcttcttaagcctgttataccaaaactgttgcaatatcaataggccatgtcttcaccggcagtaattttttagcattacacgaccttattgactcgttgctttatccagtttgatagttgtaggattgtcacgtttgaagagtgaacctgatgcatttttcttaacactggcatctactatgaaatgaagcagcatgaaggaactgactttgttaattgagtcctcagctcgaatttaggcgcgtatctcttttcctaatcaaatatgcacctaaattcacaattttttttggtttcctgtaaaatcaaacgattgtggacacggtttggaatggagtgcgaagatggtttgcattatattaagaaaccattcagttcaattcacgcgaattcttttaattttatttggtaaggtatcagacttaacggtacccatatatctttactaaattttagggtctagttggtagtgcttaaactcctaaatttaacttcaaggatgaagctatggagctatctaaatcaaacttcatctcaatagttcattttttgagagtattctaactatgtttactcctttttggatggagctaaaatcgtaaactgttttgttgagctacagttctagaagagatgaagttatgccaaacgagacgttggcattaccaaactttaccaaatttggatgctcgaatttagtagtagcgttaattttggcaaccgaacaaactacacaagccgccgatatgagtctgtcgggctgaccggtgggccccacgcgccagtaaaatctggaaaaggaaacaaaaacgcgcccgccccgcccgccctaggcttagcctaactaagctgggaagggggtggggaaatttcgtcgtcgcgatgggccggggcccaccaagtggaggcgcgggggggcgcgcggacacgccccgttctctccaatccaaccacttaagtcgccttccctccccctcgcgtccgcttccccctcctctcttctctcttttaaacccctccccctccaaaagataccaaaaaaaaaacaaataatgtcagaataaaacgcggcgcagcacacaccccagctcctcctccggcgacgagaaaaaaaaatggacgcgcagtacaacccgcgaacggtggaggaggtcttccgcgacttcaagggccgccgcgccggcctcgtccgcgcgctcaccgcaggtacgcgccgccgccgccgccgccgcagccggaggtttttctagatgcggaccgtttcgagattttttttttatgctgttatgttagtggggagttttttttttggtttttttttctggggttgtaggatggttcgctgattggtttggtgtggttttttctcgctgcagatgtggaggatttcttccggcaatgcgacccgggtgagtggaatttctttttcccgcttctgttttttttttcctgcctttcgctttcgatgcgcgttggaatttgtacagggaacgcatttgtttcgtccacgaatgcgcttagctcgctgcggatttatgcgctgcagtagaattccgcgcaaatctccggtttattttttgaatccgacggtttgaatctgtgtctcgttttgaatacacgagtactactagtagttaagcagaatacgcgtcagtacgtgaagctctcggaagtcagaattcgaatcaaatgccctaattcgtgggggtttagtgggtaatggacggttgagattaacctaaaccgacacttccagtgagaatgtgagagtgagaccttcaacttcacactcatgaggccatgaaagctatagcaggtagcagtagactagtagcttggcagtgaaatggaccaagggaagaagcagtagcacttggcctggaaggcgccacaatctgtggaggctgctgctacatttgagtttgggatttttggttgttgggttcagcagcattagtggggtcctgtttggtaggtggggtttgattcttgtggcctaaataatggggggttgatgtggtttctgggattcttgggagcacatgtcacaggcctacaatggtaggaggaggtcaaccttgctggctttgctgcaagcaatgctgcttgtggtgtgtagtaggagtacagaagtaagccggtggctgggcagttggtgttgtgaccagcgggttgtgatcccaatggttcttggctaaacatggggtacagtacagctccactgttgcatacagccaagagcggtgctgtggcccgtggggatccactggatggtggtggtggtgtgtgattgattttgatcccacaacaaagacccagcatttgatcctataaccggcagcattcacccatcctatcctcaatttagcctctgttgaaacatcgtgttgctgacatcatgctgcctcgtgtcattatctctgctttcttctttacattagaccatcacaacaccactctctgcacactgtactgcttggtccattgaagcctgtaagactaataaatgctctgaacaccttactgtggaacgtggaggaggtcaggggagggcattgtgcagtgaagatcctcagttgttcccaaataatgaaagttgtccttgtgtggattgggcctttgtttggtgaattacatcaactacttgtcatttaatgtccaatatccatgaactggctagtggaaacactgcttgaagcatttggttaggaaatagggtcttatattgaagagtctattctcatggcaatggagcagcaaaatgataattttggtgagcttgagtcatgcttattttgagttcatatatatgccgtgaaggtatggaagaagaaattcattgacaagtggtttcacttgcggctatttgatttcaaccactaaatttcttaataagttgggttccacctgtttttataaatgtgcaacatgtttcttcctaagccatagcactttgtaacagattgatctacatgttttcggatagtaaattgtagcaaataccctaaacttggatacttttctcatatcttttgagccttagttgaattattgttttgcaagcccacccgtttctcctatgttacaaccgtcgttaggaaaaccaccgttggctctaaaggtttgtttgattatacttcaaaggtgaccttatttgaacaagatgagatgcatatttcagcttactttagctaagtcatactcaaattctgaccagtgggcaccattttctcctagtacacctatgctgacctgatatttgagcactcataagcgtttaactaatatatttgtccagccatacataaccatgcgtttctctttctgcagaaaaggaaaacttgtgcctttatgggtttcccaatgagcattgggaagtaaatttgcccgcagaagaggtgccacctgagctcccagagccagcattgggcattaactttgcacgagatgggatgcaggaaaaagattggctgtccatggttgcagtgcacagtgatgcatggttactttctgttgcattttactttggtgctcggttcggatttgataaaaatgacaggtatctcatccttcctatatctatacttctcttacctagttatggtgcttcatgtgccttttttttttttagatcctactttgctcatgcattcaccacacatgcagtatttaagccttaatcagatagactcagttttagtatcatagcatcaaggaaaaaaaagaaggggtaaatattgttgtatactactagtagtaatggtgcttaaataaaatccggaatgggtaggtgtccatcctctgggaatcttttgcctcactaatagagtgactcagcatgagcgtggagtaaaattttctattacagactgaagaatagtcttgctaacattttaacatgctataatggtacttgtatgtatggattgcttaatttcattctgtaattctacggtttgtttcacaaagatctagagttacctaaaagagccagctctcagctgttctgcttggtacatattcatgtttgaagtttaatatatgttttctagttggtaatcttctggttttatctgtgatgttagtgtcttgggagtgtttcggtattaatggaaatgatgcacatggttaagtggttaatgtttatcgcatgccttaatgactttaattgagaaatgatgttcttgaatatttgccgctttgtacctatgtttgacctgtcatgtgttactgacactctgctgttgttgtgcaggaagcgcctgtttggtatgattaatgatcttcccacgatttttgaagttgttagtgggaagagtaaagccaagccaccgagtgctaataaccacagcaatagtaaatcaaaatccagcaataaaacggtacggcccattctcctgaattgtactcataccatgcatgactcttgcttgtgtgaccaatctcagacaccaataca

SEQ ID NO: 44893 - DNA, 2732 bp, Oryza sativa
cggcaacgggggtggcggcggcgtcagcggcaacggcaagcgtgcgcgcccgtcctaaggtgtggcacggcgagcccatccagagttaagatttgggctcgccgtgtggtaggagcagtctgcatagtgcagtgcagcggctattcttatttgcaatggctgtaactcgtgaggatgatttttaactttgttaagttattgtatggcagtggctgtaacttgtaagggtgtttttaacttgttaggcatgcagttgtgctgccccttagggggctaagactgcttatccattgtactcctaatctaatcttaatttggtttttttttaattaagtagatggctgtatttagctggtctaccagcttactactgcgtcctgtgttaagagtttgctttcttgctccatttaggtaccgtagccgtttgcagtgcagagatgtcgaacgaaataccgcataaatgcataatgatgttctccagtatacggcactgtatccaaagattcagaacatagctatgccggtagattttatcagtaacttttggttttctagtgttttttatcttcgtttttcgatcacttagaatacaagggcaatggttttacattagattttgttatcaacttgaattttctagtgctttgatcttcgtttttggatcaaaaagaatacaagggtaatggttttacattcatcaatttttattgtttagattacgtacctacctataataacattagtcagtagctacgaattggcaatcactgatattcgagttcgaccaaggacacgtcccctaaatgctgatgctaacactcgtattcaacaatcaatatcaaactcaagtgcgaaatcaggcgtgctagccagggtattataattgcaaaggctcacattcatatttgaatccatctttacattggatattgaaaatgaaacgacacatggtaccaatcactcatctgcaacgacagaactaaaaatttgtagtactaaacgagaagccattataagccagtacctcgtgagagatgagagaagcaaaaacacaagcacgcatgcccggagtccactgataagtgacaacccctatgaagtgattagtgatattcgcatcatgttagctgaacagtacactactaatgcacgggaagacgactttgatgcaaaacctaatgacaaggacaaccagggcgaaggaaacgtggcctggggtggtataaacaaagaattgtacagcttacaagttacaatccagaattaaacagctcggtagcaaagcacatattgaatcatgctgccgatacaaaaatcctgctgtttagaagatacaagctaggaatagaaaagcaagcgaagactcaacatcaacattgataacatgtgggaaaaatgattgttgaggaaaccatagataaattggccgaactcaactgcccatttttcccaaaactggtttagcaggaaagtttaagcagcatgtacaatgaaattgtatgtgcagctccatttatactagtcctgcatgcaatgagttctagacaaccgaagttgataaaagtttcatgacactgccatacaaacaacaaacaaatctgtttcaggtctaatgagaggaaaatgattgttggagaaaacagaataagcttaacccaactgcccactttcctctaattgatatagcaggaaacactttcggcaaaaaatgcatagcataaggcattaggccgatacacactatcctgcagggtaacatgacaacggaaaaaacaaatgtaaaatccatgaaaaagtaaaacatttctttggtactgctatctagagagaaaactaaaagctacagaagcacaataaggaataaataaagcaagaatgcaatttacagatcaccaaaacagacataatgtcataatataaaaatatgtagagataaatgagaggaaaatgattgttgaaaaaagcacaaaagcttaacccaactgcccactttccccagatcaatatagcaggaaacacttttggcacaagacgcacaaaaaagcgttaagccgatacacactatcctgcaggatgaagcatatacagtgggcagaatgattacctactatactaatctcatgtaaaaaaatgagaaatatatcaggaactagaaagtgagacacaccataaatgttactgagcaccaggaagaaattaatagtgacgaatcttgtattagttgctgatgtttgcaacttaaaaactagaactctttactagtaataatgttaataatgaacattacataactgaaaaaaacatgaagcgcatgcatcagatcacctaaacttattctatttaagcagcaactgggatctcagctgtaagaggctttgaaaactcatcctcatccttaggggcatggatggtaacaagatccggtaaaggagtcattggtccttgcttgcccttcggatcccaatcaagcataatcttgaccttaatacccagcacaccctgaaaacaagaagcagcttctaagaaaaaaattcaagctatcacaaggagacagcaacattttattcaaacggatggattttatgtacaaacctgtctcagaagaacatgtctaacagcagagtcaatatacaagttaacaggataaccagaagaaatcatgtatccgtccttgaacttcatggatttagcacgctgagccctaagcttcccactcacaataacctgtaaac

SEQ ID NO: 44894 - DNA, 2046 bp, Oryza sativa
  unsure (1)..(2046): unsure at all n locations
gatctcggtgcgcatgggggtgacgcggacctcgacgccggagtagccgtcctccgcgagctcgcgcgtcagcatctcgttcagctccgcgaagaacaccccatccgccacgaactgcgagccaaaaaaaagggcgcatcaaatctcgaaatccatgggtgacgagatcgagactgctctggaatggataggtctcgatcggagccttaccttgcgcttcttgctgatctgcgtgtgagtcgccattggagtggagagtggaggtgggggaggaggnagncggcggcggaggaggaggaggaggatgaaaccctagacttggatgagagctgtgaggtgggggagcgagtggaatatatagatgggagccggatcggacggtaggggttcgtcgggacctttttcatttcagtccctactttccttctaatttttgacaaagtatagagtcgagcggtcaagccgtcaaggtaataacatagggttaattgaatccatgtcattataaatgtatcggatttaaaaattatcattagtattcatgaaccaggtggattccattgtacttttcaaaaattagaaacatgtcactccgtcatgacttctatcaacacatcttcttcctccttgttctcgaatcttcttgtggacgcaaggagttggatgagactgcacgaagctatagggggttgagcttgagggcggatggctgtagggcaatacattggtggcaatcttgacatctacagatggcttgtcagagatcgcatgcatgcgaagcaaccaagcaaatcttagcaaagagtcaaaactctttctaatatccaactttcggctcaatatgtgcctaagcaaacaagcactataaaaaagacctcaaaatttctaaagaaagtctagcacagatgcgagcgagtctgatctacaaaatcccactcgacctccccgaggacacaggctcagagaaccaccatcgccagatgcgcaaatcgcagtgtgacgccctcagctccatgaccagtgagcttgagccacgttgtgcaccacctccacaaggcaagcgtgatttgagggccaagactgactgcaacaaggaaatgaggaatcttgtgcaccatcttgtccatcttgctcgtcgctgtcctgcttaccacaagccaccaccaacaccccattgttgccgccgctgcctgaccctagaacatgcgaggaggatgtgggtggggggagaagatgaccagtcagccaatgctcatggcccgttggatctgacggaggtattgacagaacgaagtgacatagctataatttcaaaataatgtaatggtatccaccccgatttcgttaatagtaatgacattttattcaaatcaataaaattgtaatggcatgaatccaattaactcaataacataaagttgcttaaggtattttctccaataatctgtgcgccttttttaagaataaactcgaggtcaccactcaacaaagagtagcttaggtaatttctccagtaaaatagttcgaattatatcatcgattcctcaccatctcacgaccaatcgaaatacaccgaatacaaaacctgaaatttcagagtgttacatcatgagaatacagtactacagttttcagctaggtccgtttatgtatccggtgctaaagcttttctcctagttctgtcaatgtgtactacggagtaatatataattaagggaaatcagcctctaggaaatttctaggtccgtcaatgtgcaggaacaattgctcaaaactactccctctgacggagcgtggggctcctcaccgggagaccgcgctggcccccctttgccggttcggccggggaccctgggtgagactctaagctcccaatctgtggaaggttcgcgagacaggaagcacacaagacgccggcgatgtatacaggttcgggccgctgagaagcgtaataccctactcctgtgttttggtggattcgtgtatgaaggaactacaaagtatgagccagcctctccctcgttctgggttcccaatctggaaaag

SEQ ID NO: 44895 - DNA, 25329 bp, Oryza sativa
tggttaggtgagccccgccatgctcacctaccccatatacgtggcgcaaaacccacaaggggtcggggcgcttcagccctcggggccgagacgggagcggcccgaccccttggggagacaaagagaagagcggccgtatcaccctcgggcccgaccccccccccgagggagttaggccacgtgggtgatcgtgtctgcctcaagtctctaagtcatgatactcccggtaaagaggagggcgaacacatcaccctcgggcccgacgccccctgacggtgccaggccacgtgggcgattgtgtctgcctcaagcctctagtcatgatactcccggtcccatgtcaccgacagtagcccccggcgttatgccagggcgatcgccctcctcgagggaagcggtcgggcgtaacgccacttcctaaggcctggtgacaggtggggaccggtctccacagttgggcagaaacccaacggccacaaatcacgcacatcggcaatggtaactcggctgtcaataatgagcggtctcttcaagactgccacattactcgagtagcacacgaatctggacatggcgattcgtttcgtctggagatatggtaacgtcgcttcggtcggcgagcgtaattaacgcgcgcacgatatgatctatctcgactgccacaaccgcatatccacctcatgcgccgcaagcgggcgaatgggattagtggaagcgtgggcgcgagaaacgagggggcgaaatagtgggcgcgagaagcgaggagccgggcacagcgttggcaagagtataaaggcactgaggaagggatctgtttccttcctttcgccattattccccttgtcttcgccgcttgcgccctaactccttctttcctgtgccctaccttcgccacacgcgctcgctcttaatcttctctttctccggcgccatggcacggggctccgctctgctcgatggtagcgtgctgccgccttcccgcatcgtgagcgagaggcaggctgggctgccgcgccgcttcatgccggaatctgccaccggccgggagatagtcacgctgggcgagggacgcccggcgccagactacccggggcggtccgtcttctttctcccctttgcaatggcagggctggttccgccattttcttctttcttcatggatgttctggagttctacgatctccagatggtgcacctcaccctcaacgcggtgatgacattggccatcttcgcgcatctgtgcgagatgttcattggggtgcgcccatctcttcggctgttccggtggttcttcaccgtgcagtcggtgtcgccgccatcggtagttggtggctgctacttccagccacgggggccggtgctgaaccgctacatcccctgcgccctccgcaagaagtgggacgactggaagagcgactggttctacaccccccttgccgacgaagtgcgcctccgacttccgagccagcccccggcgcaggcctccagctggcgggcgccggtagatctgggggatggctatgacgccgtcctcgaccgcctggcgggcctgcgatcccaggggctcacaggggccatggtgtacggcgactacctccgtcgtcggattgcgccgctccagcggcgcgctcggggcgcctgggagtacaccgggtccgaagacttcatgaggacccacctgggagtgagatgggactgggctcctgaggacttcaagatattggtccaacgggtgctgaatctcaactccgtggaggcgtccctcattccccaaggaatcctccccctctgcagcgatccagaccgcgcctccatcctatccattatgatggcggtcggggcctcagaggagcgagctccaaagggccacgacggcgcaggcgggagccgcaggggggaatgatctaccccgggagggggtcgtgcttctgggtcccgcgacaggggcccggggagcagccgccctgccgacgcccgggggaagagcaagcagggaggaacacctcccccatctcctccccgagggggcggggcggtgcgcgccagcagcaggcgcccggagggggccgtgccgacatcgcagcccgagggggagcgcgagaagaagcggttccgcaagatgggggagacagaaccatctcggggaaacctcatttcccctccaaagtggtcgtttaaccgaccccctcgcaggttcgtctctcacccatcgcggctgtattcattctctcaacgcgagttttcactcacccatcttgttcgtcttctggtcttttcttttgtttcagcgagatcccgtcgcgtccctcccgccattccaagcccggccagtctgaggccgaggatccggcggccgcagaggcccggaggcgggaatctgaccggcgagaggccgcggatcgcctacgggaagccgaggaggccgcccaggaggccgcccgggctcgccaggccgaggaaaccgctcgggaggaggccgcccgggcccgccaggccgaggaaaccgctcgggaggaggccgcccgggcccgccaggccgaggaagccgttcgggaggaggccgcccgagcccgccaggccgaggaagccgctcgggagaaagccggatttcgccaggacgaggcgttggcgacttccgaagcagctcgcgacgaggccgcgggcgcgtcgcttgggcccactccctcgggcgacgctcaggcgacagcttccggggcagctggcgacgaggctgcgggcgcgtcgcttgggcccactccctcgggcgacgctcaggaccaaccgggtccgggggacatccccgagtccggcacttccatcggtggcccgagccgcatggcatcctctccaaggcggctcttccccacgccttctatcgccccactgaacgcagagccccttctgcaggccttggccgccgcaaacaccacggtgttggatgggttaagtgcccaggtggaggccctgcaggcagagcgggcggagctcgacgccgcgtgggcgcgtgtcgaagaggggcgacgctcggtggaggccatggtggaggtgggccgtaaggctcaccgccggcacgtctcggagcttgaaacccgtaagaaggtgctggcggagatcgccaaggaagtggaggaggagcggggggctgccctcattgccaccaccgtgatgaacgaggcgcaggacaccctccgccttcaatacgggagctgggaggcggagctagggaagaagctcgacgccgcccagggggtgcttgacgctgccgctgcccgagaacagcgggcggcggagaccgaagcagcgtcccggcggcgcgaagaggcccttgaggcgcgcgccatggcgctggaagagcgcgcctgcgtcgtggagagggatctggcggaccgcgaggccgccgtcaccatccgggaagcaacgctggcggcgcacgaggctgcctgcgccgaagaagagctcgcgctccgcctccgcgaggacgcgctcaccgagcgggagcgagctctcgagggggccgaggccgcggcgcaacagctggcggacagcctatccctccgcgaggcagcgcaggaggagcaggcgcgccgtaatctgtaaggtgcccgcgccgagagggccgcactgaaccaacgggccgctgagctcgaggcgcgggcgaaggagctggacgcgagggcgcgcagcggcggggcggccgcgggcgaaagcgacttagccgcccgcctcgcagctgccgaacacaccatcgccgatctgcagggcgcgctggactcgtccgctggggaggtcgaagccctccgcttggcaggcgaggttgggcccggcatgctttgggacgccgtctcccgcctagattgcgccggtcggcaagtgggcctctggagagggcggatcgtaaagtacgccgccaaccagggaggtctcgcccagcgcctctcgaagatggccggggctctccaacggctccccgaggagctcgagaagacaattaagtcatcctcgagggacctcgcccaaggagcggtggagctcgtcctggcgagttaccaggccagggaccccaatttctctccatggatggcgctggatgagttccctcctgggaccgaggaccgcgcgcgcgcgcaggtccgggatgccgccgaccatatcgtcgacagcttcgagggctcggcccctcggctcgcgttcgcccccaactccgacgaggagggcaatgccggtggtgcagacgacagtgacgacgaggccggcgacccgggcgcattggattaagcccccagacccccgccattcttcagttttttcttcttttctttcttctaaggccttcgggcctcttttttgtatagatcaacttaatctgtaatcaaaaatgaagaaatttttgtgtcaatttcatcttgctgtgtgtatgagatgaggatgatctgtgccgtggcccttttgtgtcttagcttgattaagggttcgtgcccaggtcctagtcctcaaaaggcgcgggtcggggctagtgcctggggagatccacatgtcgagactggccaggccgggaacgtggtgaccgagggttatgggtgacccgattgtgggcttttgccgattcccccccggagttcaccacgccccggggcacggctcggttctgggccccgtttggcgattttagccgacccgagcccccgagggcaggattgagcacgagtgacctatttcaagtcaagattcttcaaaaggaaaaaacagcacagatacagcctttaggaaattgaaactgcttttattgaaatactgaaataagagaaataagaatgtgcatgtgtggcagcccccggccaaccctgcacgcccgagggggtgcggggttggcccgagcccgaaacctgacacccgacccccctcaggggtagaagcgacgaaggcgttcgatgttccacgggttaggcagctcagtgccgtcgcccgtggccagccgtatggagcccagccgggggacgccgaccactcgatacggaccctcccacattggtgaaagcttgctcaatccagcacgcgtttggacgcggcgtaggacgaggtcgtcgacgcagagtgatcgggcccggacgtgacgctgatggtagcgccgcaggctctgctggtagcgcgcggctcggagggccgcgcgccgccttcgctcttccaagtagtcgaggtcatctctgcgaagctgatcttgatcagcctcgcagtacatggtggcccgaggagacctcagggtgagctcggatgggagaaccgcttccgcgccgtagacgaggaagaaaggcgtttccccggttgctcggcttggtgtagttcggtttgcccagagcaccgctggcaactcctcgatccatgaatcgccgtgcttcttgagtatgttgaaggtcttggttttaaggcctttgaggacttccgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaccgggccgtgatgcccttaatgaacttaagtgcggagtgcttatcgatcttgacgaccggataagccttgggccacttagtgaacttgtcgatcgcgacatacagatactcaaacccgcccggggcccgcctaaacggtcccaggatatcgagtccccagacagcaaatggccacgaaagtggtatggtctgcagggcctgggccggctgatggatttgcttggcgtggaattgacacgctctacatcgccggaccaggtcgaccgcatcattgagagctgtcggccaatagaaaccctggcgaaaagctttaccaaccaaggtgcgcgaggcggagtgggctccgcattcgccttcatggatatcggcaagaagcacaacgccttgttcccgaggaatgcacttcaggaggactccattagccgcgcgccgatagagggtcccttctaccagcacgtagcgtttggagatgcgatggacgcgttcactcccttcgcggtcctcgggtagagtcttatctgtgaggtatgcttggatctcggcgatccaagcaatcaatctaagggagctgggagcactcccctcgggtcccgaggcctggactccgacgggcctcgggggccggtcaggcgcatccgtctcccctaaggggtcgggtcgcgccgacggctgggcaagcctttcttcaaaggcgcccggtggggtctgggctcgcgaggacgcgagccgtgagagttcgtcggccatcatgttatcccgtctgggcacatgccgaagctcaatcccatcaaaatggcgctccatacgccgtacttggcgtacgtaggcgtccatctgcgggtcagagcaccggtactccttacagacttggttaacgaccagctgggagtcgcctaacaccaggaggcggcggatccccagtccagctgccactctgagtccggcaaggagtccctcgtactctgccatattattggtcgctcgaaagtcgaggcggaccaagtatctgaggacgtttccactcggagaggtcaacgtgacccccgcactggcgtcctgaagagacagggagccgtcgaactgcattacccagtgggcggtgtgaggcagctgcgaggggtccgtgctggcctcggggatcgagacgggctcgggagccggggtccactctgccacaaaatcggcgagggcctggctcttgatagcgtggcgtggttcaaagtgcaaatcgaactcagaaagttcgattgcccatttcaccacccgtcctgtaccctctcgattatgcaagatttgaccgagggggtaagacgtaaccacagtgacccgatgcgcctggaaataatggcgcagtttcctcgaggccatcagaatagcgtaaagcatcttctgggcctgagggtatcgggttttggcatcccggagggcctcactaacaaagtagacgggccgctgcacctttcggtggggccgatcctcttcgctaggggccgcatccctggggcactcttcgtccaatcagcctcgcggggcgcacttgtcttctgtgctgatgacttcggggtcggaggataacaggggcggccttcccacagtggcttcggggccgtcctgggggtcgggggctcctggcatcgtcggacaagcgggcaaagggccaactccggtcgtcaggggccttggacctccgttcggctcgggggcctcttctccctgctctttcccgggtcgagtcagcacagggttagcctcggggtcaaagggcgataggtgcggccttcccacagtggcctcagggccttcctgggggtcgggggctcctagcaccgtctgacaagcgggcagagggccaactccggtcgtcgggggccttgggccaccgttcggctcgggggcctctcctccctgctctctcccgggccaagtctgcacagggtgggggtgcgcggaatgaggattgtcctcatcgcgctccacgaccaacgccgcactaaccacttgcggggtcgccgctaagtagagtagtaagggttcatttggctccggggcgaccagaaccgggggagagctgagatacgccttcaactgagtgagggcacgctcagcttcctccgtccaagtaaacggcccggagcgtttgaggagcttaaataagggtagcgccttctcccccagcctcgatatgaaccgacttagggcggccatgcaaccggcgacgcattgcacatccctaagcttgctgggggggcgcatccgctctatagctcgtatcttctcggggttggcttcgatgcctcgggcagagaccaagaacccgagaagcttgcccgcaggtacaccgaacacgcacttatcggggttcagttttatgcgggcggagcggaggctttcaaaagtttccgctagatccgagagtaaggtttcttggttgcgcgtctttacaaccaagtcatcgacataagcctcaacattacatcctatttggctacccaaagaaattcgagtagtacgttgaaaagtaggacctgcattttttaacccgaagggcattgttgtataacaataagttcctatgggggtaatgaacgcagttttttcctcatcctccctagccatgcgaatctgatggtaaccagagtatgcatctagaaaacacaaaaggtcgcaccccgctgtggagtcgacaatctgatctatgcgaggcagggggtaaggatccttaggacatgccttgttaaggtcggtgtagtcgatgcacatccgaagcttgccgttcgccttgggaacgaccaccgggttcgccagccactccggatggatgacctcgcggatgaatccggcctccagaagtcgcgccacctcctcgcggataaaggcttgacgttccagggcctgccgccgcactttctgccggaccggccttgcgcccggccgtacggcgagacggtgctcaatcacctccctggggaccccgggcatatccgccggtctccatgcgaagacgtcagcgtttgcccgcaggaaagagacgagcgcgtcttcctatttgccgtccagaagaccaccgatccgtgtggtcttggacgggccgtcgcccagggcaacctccttgaccgggacctcatcgcacgtgactatccgctgcctcggggcggcgggggcggatgtgccaagcctctcgtcgccaccctcgggcttggacacgacggcgaggcggtccgcgcgctgctccatacaagcgagcgcgactttgaggtcaccatggacagagatggggccatcggggcccggcatcttcatctggaggtaggcgtagtggaccgccgccatgaactttaccaacgcgggcctccccaagaccgcgttgtagggcagactgaggtccgccacatcaaagttcactcgctccgtgcggaagttgacgggtccaccgaaggtgaccgggaggtcgatatgacctagcggccaagtgtgccccggcgtcacaccgatgatcggctgggacggccggagcatcatccccggggccttgatggcgtcaaaggctgcgggggaaaggatgttgagggccgctcctccatcaatgaggacatgccccagcttcacgttgcaaacagtgggggaaaccaccatcgcgatctgtcctccctgggcaacgcacggtgggtggtcggtctggtcgaaggtgagggcaacctccgaccaccgcgcccggcgcgtcgcctcatgagtaggggccgcggccagaagctctcgcttcatggccttgaggctccggcgagaaacgtgagcacacgctcccccatcgacagtggcaatggtggccccaggctcttggaaacctaggtcatcatcgccgtcatcgatgtcctcggcgggggccttctgcttggcctcactgcgccgattgccggaaggaaccgccggggacttgccctctcggcgctcctgcctcctctcctcctcccacttcctcgtccgctcagccaaacttttgaccgcacggcagtccatgaggtcgtggagggaggtgttgtggacggtgcaccacttgccggctgggcgctccctgctgggagcgccggcctttttctttttgtcgctcgcaggcctccccttttgggtggcccgcgaagcgccctcgacggcgaggacatgaccctcgtcgtcggaatggactgacctcttcttcctcctcctgtcacgccgccctgtctgagcggcggatccggaggcggccgaagctgccacaccggaaccggaggggttccaagtccaggcctcctccttgcgagccactcggtccgcgagctgaaaaagctccgcggtagtctggggctccttggaggcgatcttttcgagcatgcggttgtgccgcacgccccccctgaacgcgtagattaccgcgtgtgcagggatgcatggtatggtgttgcgggcttgacagaaccgctgaatgtacgagcgaagtgtctcatcatcccttcgctgtactgcgtgtaagtccgcttcttcacctgggcgcggatatgtgccctgaaagttcatggtgaactgttggcacaaatcctcccaggagtggactgacgcgggtggcaagttcattagccaaccccgcgcttgccccttcagggccatgggaaagaaattcgccatgaccctgtcgtcacccccggcggcctcaatcccggtcgtgtagacctggagaaactcggcggggttgacgctgccatcatatttttcggcgatggtgggccggaaccttgggggccaacggacattccgaagactcgccacaaaggctctacagccgacaccaccaaccgggggcacggagggctgatacccgcgtccgtgttgaggtgacactctggacgaggaagcgccctccgttgcgtgggtagcacgtcggtcattacgccgccgctcgatgctggtgcgggcgtccggccccccacgcagatcttcccgggtcgaatgagtcgacgaaggagtggtggccgaatggcgaacagcggctgccgctcgccgcgcccttcgtcttgatgacgcggagccggtggtagcagcaccagaggccttggtggcggaggaccgcccaccagcatctagacgctgccgtgcagtcatgaccaatttggccacatcgtccagccaacgttgggctggagactccgggtcatgggcgacgggcgggtgacgtaggagcgcgcccgcagcttggagcgcgccctgggacgtgctgctgtcaccatagacgaggaggcgacgctccccatctcgccgcccttttccacctcctgtggatgtcgaagtcgcggatccttcggccctctcgagcgcctccccccgcttaggactttggcgtggagggggcggtggagtacgagctcgacggcgtgggttcggctccccgtcgtcgccactcacactcggagagaggtcgtgcgcctttgcttgctcagccatgaggctgaacaggaaaagcttggcgcacacgaaagagtgcaagagctcagaagatcactcgcagagtcccctacctggcgcgccagatgacggagcgtggggctcctcaccgggagaccgcgctggcccccctttgccggttcggccggggaccctgggtgagactctaagctcccaatctgtggaaggttcgcgagacaggaagcacacaagacgccggcgatgtatacaggttcgggccgctgagaagcgtaataccctactcctgtgttttggtgaattcgtgtatgaaggaactacaaagtatgagccagcctctccctcgttctgggttcccaatctggaaaagtccaaatcccccctctaagtgggcaaggtcctccttttatatcttaaggggataccacatgcaccatctccccctctctttcttccaatttgacttctcttcattaacagacggagatttgcatcgccgccgtctgaatgaccttctgacgggacggcccatacctacctccacttccgccggaggcaggcgcgacgtgggaagatggctgtctgctgatgacttgaccattgtcagaccggtcacaaatcggtcattcttgtccaccacgtgtcagtttaacaatctgcatgttcgctcttcttcatacaatatcttgcctgtaatggttaggatgaagcctggcatacatctgaccggaaccaacgtgccatctccaggagctaacacgccggctccagctagggacgagtgcttggaggctctcgtcctgacgggatggggcgaggcgtgcgtcagaccgcctgtcgccacctaacccatgatctgaccggtctgtgactggtcacagaccggataaacgagcgtgctgtactgcgatacatgcggcgtgacgcgctcctcaaaactgcaataaatgtggttaggtgagccccgccatactcacctaccccatatacgtggcgcaaaacccacaaggggtcggggcgcttcggccctcggggccgagacgggagcggcccgaccccttggggagacaaagagaagggcggccgtatcaccctcgggcccaacccccccccgagggagttaggccacgtgggtgatcgtgtctgcctcaagtctctaagtcatgatactcccggtaaagaggagggcgaacacatcaccctcgggcccgacgccccctgacggtgccaggccacgtgggcgattgtgtctgcctcaagcctctagtcatgatactcccggtcccatgtcaccgacaccctccgtcccaaaataagcgtcctaaagttttgcactatttgtgttcaacatttaaccgttcgtcttatttaaaatttttttatgatcagtatttttattgctattatttttaaatgtttcataaatttttaaaataagatggacggtcaaacattggacatgaatatcgacagcaaacaagacggaggtagtacctaattcaagttccctttaccgttttgatgaggcttaccgctatcggttaccacagtaactgcacggtcaccacgaaaactgtgatgctacgaaattcacaatccgtgacctcaaaatgctccggaaaatcatcacagcaatatagtaacgttcaggctagagcgcataaatcgtaacgctggctagactatacaaaggtgcacgagcttgcatataaaccaggtcaggatacaaaatgcccgcgggcataaacatctggaataacaattaggtttgacatggcactaccaaatgtccaaatcaagtaccgaagcaaactaggcgagctgaaagttcactgcggcttgggaacaggttcgagggcttcaatcatcacaacactgtttcccctgataacctgcagaagttactgcattatcagtacttgagtatatattcctaatcgaacatatgtgagatcttctctagacagaattgaactacgggcctgtttagcacagctccagctccagctccactcttcctggagctagagctcagccaaacagttttagctccaccaaagagctctctcacaaaatgtactagagttgggagctgggtttaggcagctccacaactccactccagactcaactcttggagttatatttaggagttggagctgtaccaaacaggccatccctatgaaacaggaatcccaagaaagatctcattccaaagagtttacttaccaccatccctatgtcattcttctcgtttccattgacctccactgtgttgtccacgaccaaattcataaactgatcgaatcctcgaagagtgccaatgacaacacggttcgcattcagcttgactggcaaaattgaaaagagagtgaatgagtacaccatcaaagctgagtaagaacacaaggattagaagttcagcatcactcaagactattattagcaaagactatcaagcagtaacgagataaaattggatcaaattgcaatatttttataatgtataatcttggtgcttctagccaatcttaatccacgtgcagaccaaatgtgagcgtcaccaaactatttaattagcttagcccaaacgactatacacagtcacaactcacacaaatatatcaggtaatggtactgatagcaaccatagttccactataatgcaatattcaaatcaaagggatcaaccagcagcaactgaaacatcaaggatatgatttgatccttgatgaagggacggtagagttgttttcctccctgagttgagggtgagccaaatattaaagggcaactagccaactattacaacatcaaggtagcctatcagtgtaactatgacaaaaggcttcacttggaaaagaatccatagctttccaaagaatgtcatcatttaggcagcctactgatgttgattaatgagaaccatgaaagaagtgtcaagaaaacaggttctactgaacagaacaaagacaacaattggaattatatattctttttagagaacaataggaagtatgaaagaaaaaaaaaagttccaactagtacaaaagactggacatggcatggtgtgcacaaggatctcaacacgccactgataaaattatataaggaaatgaagagtttaaatgccctatcagagtaactatgacaaagaagcttcatttggacaataaatccatagctttcctaagatatcatcatttagggcattcacaaatcacaagcactggcacaaaaatctgcaagctattacagaacatatatctgcaaacaccaacatagttgtgctcaaagataagcaaacctgctgtattcacatatcagatctggttcaaacgaacttccaggtttctaaccaggcttaagatttactaacaggttgagctgaattcttcagccaaaatatttttgatataccaactctactacgacaggaataaacaacatgaaaagcatcaaagatcaatacgacaaaaacaataactcgatatatctccagatgaccataccaaatcaattaccaatacctagtcatatgcttcataacacccctatctcgcaagttgcaacatagagctcttacaacttgcaccacaaatctcagctagggcatgtattaagatgacgaagcgaattggcgataccggaccatacataatcagttaatcacagaatctacacagcgttatcttagaattaacgaggcagctaaaaactttgggttggatgagtgcgcttactttggagcttcttgtccatgtacctgcaacccaccagaacaaaaactcgcatcaaaaatccaaatccaagtagaacaaaccaagcccacaaatcgaactcaagatgaagaaaaaaagcactaagaaattacttcttcagatccggaggctgccccgatcggctcatggcgactccccgacggaagatctagaccttctccgctcaaccaaagccaaatcttcggagtaggcgagagaaaatagccgccgccgccgccgcagagaggagaaccctgaaccctaaaatagcccgagacgggattgctatctccacactataaatagtcgctgacatgtgggcccgcgtctccgctccatcgcgaacacaagaagacgaatagatacagaaatattattaaactcaggggtgtatctgcaaatataccaccagcccagcctggagcacgacgaagcgcggacgaggcgagaactccttggagctctgaactctctatcgcgtgaggaggtcgacggcgagagagatgcgcggcggcggcggcggggatgcgggcaccagctcgaggggcggcggttccggcggggcccccgcgcgtccgcggcggttccctgaggcggcgcagccggagatcatgcgggcggcggagaaggacgacggctacgccgcgcacgtcaccgaggcctgccgcgacgccttccgccacctcttcggtgtgttgctttttctccccccgtctcgtagcttaagattagctccgcgtcgcgcgatttgatggtggtttgggttttggtgatgatgcaggtaccagggtcgccgttgcttatcagaacgaggtgagagcttaaattggctgtgttggcttgtggctctactcgggttatgtgatatttgtcgaattctgccggaaatttaacttatcttatacactgtttgctacatagactggtgatatgagagtgaatgcctgaaatcagatgaattgtttcggtgtttgggtaaagtagttgaaaattttcaactattgtatattgtcgtatgactttggtatgattggcaatgagcatttagtgtattagctttttacaacttcaaatttgattgcacacctataatattacatgctttcaagtttcaaggcttacaagttgggtatgcattactgtactggggattaaacttcaactatcaacggacttttagggctgtttgatttcttcggcgttttaactcatgtagctactttgcatttgaattcaaatagctaatttgttctagtcagtatgaactgacaggttatgttattatatatatctgatttccatgcttggtggtgaaattagtttatttatataaaaaaatgaagatggattgcattgtgttgcatctcagtcatcagattctcagtagcatagaatgtgttgtgctgtgtggcagaagcacaaccttttaaaatatgaactacatcaaattgttctctagatctgtaacatagagaaatagtataaattttgttctctgcatttatttcggtgctaatattcttattgattgtccaaaattacatttctcatgaacatttgcagataaaattgcttggtcagtctctttattacttgctaacaactggttcaggccagcaaacacttggagaagaatactgtgatatatctcaggtcatactgcttttttgtctttaatgcacagtttctactcgcagctatttgatttggtacttggtagtataccattagcttgttgctcatctgttgccttatactttgaggggcacacgttgtaaatttgtctctgtaactgtaggtagtatatactggacatgtgctgttatttcagttttatgtaggagacacaagaaacctttgatggagtaaatatggcctttttgtttaattgaggggtctgtttgcatctgaagtgaaacacaaaactgtttattttttcttaaacatgaaattattaggagtcaaataactggtagatcctattaggaaaatgtaaagggaacacaaaatgtgttggtttcagttattgagatagtcaatttttttattcttgtcgacaagacacaaaaaattgttattagcagaagagtcttcaatgaataatattaatcttaataaggtacagccaaattgtaggcttgaagctgccattcacagaaaacataggagtcaaaattcactctatcatgctgatgttgtccatgttgtaaacaggttgcaacctcgcacggacttccgcctacacctgctagacggattctattcattttgtaccaaactaccgttccctatcttgctgaacgcatcaggtttgacaataatagttttggtcattcattcctatttagatcggctatcttgcccaatgaaactgattgcataatttctgctcactgtgattttaacagctctagaattgttgcacgtggtattgccctcgaggactctcagcttgatgaccattctgaaagtgatagttctagtataggcactgcagcacaaccatccccaattaggaacagtccttcaagaagcttgagtttttctcatttgtcaaggttgagaggcagagtccataccttgtgggaatgggttcttcggaaatggccttcggtatgaaattattctaatttgtgtgtggcatccttttcttatagcagaaaaaactctcttgatttagtaatagggaaatgtttctgtagaattaaggttgtagcaacactatgaaaatgcatttcttgcctaacacctatatgttgttgcctgactctaatatgcatgcagatgctaccatttgctcaagattttatacagttaactatccggacaaaccttatgttcttctattttgaaggtatcttatgttcgatacagcatgtcaaattttgaaatgagtttgaggaccaataaatttttatagggtgacaagtagcaaatgaagagttctgtttcttagtactgctcagtggctgccttaaagtcatggaacctgaacttattatgacgcaattagaaaaattaaattaccagaatacaacttattggtaaataacaacccagtttatcataacatctaacagaacatttccagtgaattgtgcaattcactgtcatgctctgctgcatatgagaactctatcatattctacttaactgaaattgctacatctatttcaattttttattttatttatggtaggatgcaacaccatgattctatcaagccttaattaatgtaatggcttagttagagttgacttatgttcttttttttatcacctcaattgaatctgtagcaactgtttgatatttgattaacatttccaatttcttgtaggattgtattatcatttaccaaagcgagcagctggcattcgttatgtattcattgggaagccattgaatcagaggcccaggtactctctgtttctctgctcatctactgtttatactacatgaaacaaatcatacaaacaatgggctatgaaacaccagtaataaatgagtttgagaatgctgataataagtcttttcatgatctgtagtttttttggacatcttcacatgtattacctccatttgagagcttaaaattctccagcaggtcacatttaactcattggattttgcaggtatcaaatcttgggtatttttctgttaattcagttatgtattcttggtgctgaaagacttcgaagaagtaatttatcaacaatagctagttcgattaaccaaatctcatctggaggctatccttcatcaagaggtggtacactctttttctcaatttatgaaaccagttttggttctatgttaatgctttgtgtttacttgtttcatggatataaataaatgttccaatattacctttgtgaatggcaaaacaggtcgaggtgtccctgttctaaatgaagatggaaatataatcagcgacatccgccatgggaaaactgcagatttggctactagttcagaggtatttttttctagataaattcattgagatgactactattgtgtagcacaaaatgtttagctttgtgttggacgccaacagcttttaagattatcggtatcaagcacttcatgttatgcaacagaattctatttaaaaaagaaagcaacaaagtaaaaaaaatgttacaatttaagattatgattgaactgaaaatgcttttttaccactattcttatattgtttatgttatttgatgtattttgtgtatgaatataattcttctttcatattgtatgtctaatgttcaggcatccagtggtaagagcaaatgcaccctttgtctcagtacccgtcagaatcccactgccacaacctgtggccatgtcttctgctggtaagactcgttttttggcctttacggatgcagcctgaaatttttctctcatgcactcacttgaatggtatggtaattcatgacataacatgcaggagttgcattatggagtggtgtaatgagaagcctgaatgccccctatgcagaactccgattacacattcgagtttgatttgtatatatcattcagatttctagcaaatgattactagcaaggggtcatatcattctccagtggattcattaaaatgatactgaatccccacattttggcgagaactcttcttctgaagtgttttagtgtaccaaaagaggagagtagaaaccatccaatgaggctgaagatcaatgctgccattcaactgtattgtagagctcaaataacaaaacaatcaaacagaacaaaattttcattagagctcaaacggatacccatgtatatgtacattgtagacacaacttgattttgtagggtagaacagtggctgactggaatcattagagcaaaatgtatcgacctgaaattctgccgggaaatttaactatttgccaatattagattcgacaattattcaaatgcccctcttagatttggacttaattttttgcccctcttaagagatgccttcttaactatttgccacttttgtccacgtggtatgccaatgtggcaacacagggtagaaatcggtgtgggacccactagtcagcctcttctctatccttcttctttccctctggtccggcgaggagcgtgctctgccacaagccggtgctgctccggtctccatccttgtgcgcggctgctctaatccaccgccgctttgccttcgtcagtgccaccgcttcacctccttcgacagcgccgccgctttgcctcctccaccaccgcgaggagcccgtccgccgccgctacacatcctcctctgccccgaccgttgctctgcctcctccacctccacgaggagcccgtccgcgtcgctatgccagcgccaccgcttcgcctcttccaccaccacgagtaacccgtccgccgccgctacacatcctccttcgctggcgccgccgcttcgtctcgtccacctccgcaaggagcccatccgctgtcgctacgcctcctccgccggcgccgccgctccgcctcctccaccaccacgaggatgtccgccatcgctgcatctcctccgccgccactgctcctttccccaaccacgccgtcatcgcacgccggaccggagggaaagaaggaggagagagaggagaggctgacttatgggtcttacaccaatttctaccctatgttgccacgttggcatgccacgtgggcaaaagtggcaaatagttaagaatgcatctcttaagaggggcaaaaaaaaaagtgcaaatctaatagaggcatttgaataattgtcgaatctaatagtggcaaatagttaaatttgcttatccccgtatccctctgtatcacgttctttgattgcgttgcgtgactggcgtacgagacatttgcttatctcatactccctccgtcctaaaaaaaagacaaaccctggtttccgcgtccaacgtctgaccgttcgtcttatttgaaaaaattataaaaaaaattaaaaagacaattcacgcataaaatattaatcatgttttatcatctaacaacaataaaagtatgaattataaaaaatttcatataaaacggacagtcaaagttggatacggaaacctagaatttgtcttttttgggacagagggagtactctactgtgagttctgcccacacgcagtctgcaattctggcatctctgcagaaacgcaatgcctctcctctcgcctcgtcactttgagctcagtagaattggagtgtggcaaagcaaaagagcgaagccgtttgtcacaagtgccaccaaccctctcgtccggcggctgcccaacagaatccaccatggtttctccatcctttttccattttcaatgcaatccaccttaaatttctctctcccgtaacgccatccataccccggcattgctctgcccgtacacaaactaccacactagtcgcaagttaaaaccactacaaaatccattccaacttgcctcatctctcccacctccatcaccaaaccagcacaggtcgctgtctctctccgaaatatcatttcgttttttaatcatcttttcctcctcttcgctaatcaccatgatttgcctccgagccgccttccccttgacctcctccttctcctcctcccctctccgccgcctcgccctcaagccctcctcctcccgcgccgccgccgccgccgccatgtcgtccgcccccgccaccgccatcgccgcgccggtcgagcacatcgtgctcatcaaggtccgccccgaggcggcggcgtcgggcgccgccgcggcgatggtgtcctcgctgcaggcgctgtccagcgtggtgcccgggctgtcgtacatccacgtcggccccgtgctccgcctccggtcgccggcggcggaggcgctggggccgacccacgtcctccactcccgctacgccaccaagcccgacctggcggcgtacgcggcgcacccggcgcacgtcgccgccgtgcaggggcacgtcctccccaacgcgctcgacaccaccgccatcgactgggtcaacgccgcgctcgcgccgtccccggtcaccccgggctccgccgtgcggctcacgctggcgaaggtgaaggaaggtgtggaggtgccccagctcgtggagaaggtcgccgcggcgacggcggcggcgggcgaggcgaagggcgccagggtgagcttcggggagaacttctcccccgcgcgggctaaggggtaccagttcgggatggtggcggtgttcgacagcgtggaggagctcgacgcggtggagggggacgggaaggtgcaggaggccaaggcggcggtgaggccactgctcgacgaggtgctcgtgctggacttcgtcgtcggacctgccgccgtggaggctccggcgccggccaacctctgagaggtttgccttcggtttggaaactcttagttgccttgttcaatcgatcgagaataatgcaatccttgtgattgggtgtgctgctgctgctgtggcgtgtgattggcaatggcaattgattttggaatgaataagaattgtacctgactacctgaactaggaattaggatggccgctcttgcttggatcgtcgtgtaccaagaaagagcttgctgccttcagtgttcatctttctcttgtcgcgctgcctacaaatgtgcatgtcagatagtcttgttaaccacaactcggtgctatgcctctcatgcctccccattaagcatgaaggaaccactgacatgccactggacaatcttttagtatcatgcacccgtagaagtattttagtcttgctccaattctgccttgtgaaatcctcataggcatgatttatggaacatgtgcctttgtgattgtagagtattatacgcaataatcgctgttgtcggaatcggatgtccgggttactacattttgagcagttttgatgactttggccatgttaaagttgaggaggtcagtccattcaatagtacagaggacctttttttagtggtaatagtgatcttgctgaacgcatcaggtttgacagtaatagttttggtcattcattcctattgagatcgactatcttgctgaatgaaactgattacataatttctcattgtgattttaacagctctagaattgttgcacgtggtattgccctcgatgactctcagcttgatgaccattctgaaagtgatagttctagtataggcactgcagcacaaccatccccaattaggaacagtccttcaagaagcttgagtttttctcatttgtcaaggttgagaggcagagttcataccttgtgggaatgggttcttcggaaatggccttcggtatgaaattattctaatttgtgtttgccatccttttcttatagcagaaaaactctcttgatttagtcatagggaaatgtttctgtagagttaaggttgtagtaacactatgaaaatgcatttcttgcctaacatctatataatcttatgtttgacacatcatgtaaattttggaatgagtttgaggaccaataagttttgatagatagggtgacgagtaacaaatgaagagttctgtttcttagtactgctcagtggctaaagtcatgaaacctgaacttattgtgaggcaattagaaaaattaaattaccataatacaacttattggtaaataccaacccagtttatcataacatctaacagaacatctccagtgaattgtgcaattcactgtcatatgagaactctatcatactctactcaattgaaattgctacgtccatttcaatcatttatttcatttatggtaggatgcaacaccatgatactatcaagccttaattaattgatggcttagttagagttggtcttatattctttttttatcacctcaattgaatctgtagtaactgtttgatatttgattacacttggacgtttccaatttgttgcaggattgtattatcatttaccaaagcgagcagctggcattcgttatgtattcattgggaagccaatgattcagaggcccaggtactctcctttattttgctcatctaggagtaccttttatactacggccgagtttagttccaaactttttcttcaaacctccaacttttccatcacatcaaaacttttctacacacacaaacttctaacttttctgtcacattgttccaatttcaaccaaacttccaattttggcgtgaacatgaaacatatcatacaaacattagactatgaaacacctgcaataaatgagtttgagaatgcagatgatgagtcttttcatgatctacagttttttttggacatcttcacatgttttacttccctttgggagcttaaaattctccagcagatcatatttaactcatcggattttgcaggtatcaaatcttgggtatttttttgttaattcagttatgtattctcggtgctgaaaggcttcgaagaagtaatttatcaacaattgctagttcgattaatcaaatctcatctggaagctatccttcatcgagaggtggcactttctttttctgaatttatgaaaccggttttggttttatgccaatgctttgtgtttacttgttacatgggtataaaatgttccaatattacctttgtgaatgggaaacaggtcgaggtgtcacatcgaatatttggacacatgcatggagtattaaatatatataaaaaaattaattacacagaatacatgtaaattgcgagacaaatcttttaagtctaattgctccatgatttaacaatatggtgctatagtaaacatttgctaataacggattaattatgtttaataaattcgtctcgtagtttataggcagaacctgtaatttgttttgttattagtcttcatctcatacttcaaatatttgtccgtatattcaatgtgacatgctaaaacttttcacccctaaactacacagggcctttaggctgtgttcgcgggaggatgttcccaaccagccgttagcgcacggaaaacggaacgatctattagcacgtgattaattaagtattagctaatttttttttaaaaaatggatcaatatgattttttaagcaactttcgtataaaaactttttgcaaaaaacataccgtttagcagtttgaaaaacatgcgcgcggaaaacgagggagatgagttgtgaaacttgggtaagaacacacccttaattaatctcgcgttaatagaccgctccgttttccgtgctaactgttccggttgggaactggaaatagcgaacacaatcttagggtgtgtttagttcacgccaaaattgaaagtttggttgaaattggaacaatgtgatagaaaagttgaaagtttatgtgtgtagaaaaattttgatgtgatgaaaaagttaaaagttcgaaggaaaagtttggaactaagtcctcagtagagttggagtgtggcaaagcaaaagaccgaacctgtttgtcacaggtgccaccaaccctctcatccggcggctgcccaacagagaatccagcatggtttctcggtttctccatccttttcccattttgaatgcaatccaccttaaatttctctctcc

SEQ ID NO: 44896 - DNA, 2722 bp, Oryza sativa
cgcccggaggcggcgtcgtcgggcgccgccgcggcgatggtgtcatcgctgcaggcgctgtccacggcggtgcccgggctgtcgtacatccacgtcggccccgtgctccgcctccggtcgccggcggcggaggcgctgggtccgacccacgtcctccactcccgctacgccaccaagcccgacctggcggcgtacgcggcgcacccggcgcacgtcgccgccgtgcaggggcacgtcctccccaacgcgctcgactccaccgccatcgactgggtcaacgccgccctggtgccgtccccggtgaacccgggctccgccgtgcggctctccctggcgaagttgaaggagggtgtggaggcgcaccagctcgcggagaagctcgccgcggcgacggcggcggccggggaggcgaagggcgccaaggtgagcttcggggagaacttctcccccgcgcgggccaaggggtaccagttcgggatggtggcggtgttcgacagcgtggaggggctcgacgcggtggacggggacgggaaggtggaggcggccaaggccatagtcaggccgctgctcgacgacgtgctcgagctggaattcgtcgtcggacctgccgccgcggaggctccggcgccggccaacctctgagaggtttgcctttggttcgaaaactctagttgccttgtttgatcggttgagaataatacaatccttgtgattgggtgtgctgtggcctgtggttagcaatggcaattgattttgaaatgaataagaattgtacctgactacctgaactaggaattaggatggccgctcttgcttggacgtctaccgaacaagagcttgctgtcttcagtgttcatcttttcttctcgctctgcaactgcaaatttgtatgtcagataattttaagactcgcaactcggtgctatgcctctcatgcctcccttcccccattaagcatggaggaaccactgacatgccactgcacaatcttttaggatttgatattcatttgacttagtattatgcacccatagaagtattttagtcttgctccaattctgtatttctgtctcgcagaatcctcgtaggcatgatctatggactatggaacatgtgcctttgtgattgtagagtattatatgcagtaatcgctgttgtcggatgtctgggttactacattttgagcagttttgatgactttggccatgttaaagttgaggaggtcagtccatttaatagtagcggggacctttttttagcggtaatagtgatctggactacagctctttcagaaaaggatgtatggtcttatactcttatggcaaccatctacttactggttgttggccttgttaacaatggtggtgaaaggaacaggactggagtaactttcgaaaatgagcgatactgcagcaaattctgatgaatttggcaatttgctgatgctgtgggtttgaaagagccaatcatctaaagctcaaccacattgttttctctcaggcagcagtagcaatccaaacaagcaaggtctcgggttgccttaccaggcaaagttcatgaacatctccaatgtttctcaggcatacaaatttgtcaggcatggtgctctggcctctgggcaccaaccaaacagggccatagttttggtcgcttcaaactgtagtttggtcttccttctattgcccttcaaccgataactctgcaactaacattaacatggaccttttgttttttctgttgcttccttcaatatattcagagtgaatttgtaaatatgctgtttttctcattaagaaacttagcatataacaaaagaccggtcacatccttttaagggttcgtgacagcctgctcaacatagaaggtcagacacttaaataaattatttgccttccctgcgctttaataaattcattgtcaagttttgtgcttgacaaagtattggtagcgtgtgcaggactgaggcatgcaccacttcctctaggttgaattgattttattgcataatgctctgttctttgttgcaagtaatattttgacaaagggaaattaccatgacatatatactcagatacttaaaaagaaaaaaaagattggttttaccattatttttttctatttttctacatggttatattttatgaaacaacaagactgagtataaattgataaagtggacataacttaagtttaggaagggatacggtttaggataaatggctctccataaagggaagggatgatttggttgcctaagatacaattatttgaatttctcaacaaccaaaccctacattatataaatttataggcaggcagatacagctaggatgtttgcatccaagcaagacactatcagagttttgaggagtggaatatgtattcaaagcaaggaactaactgaatttgcaatatacttaattcgttgagaagttacaacttacaggaacattattaaaacatgtaaacatttgttctaataatgccaatcatggatttgaatattgagaactgagaagcataaaaccatttccttactaagagtgagtctactcctctaagggcacctatttttatatgcaggaaataaaaacatttgactaactaggcggatcaaaccatcaaattacatcctggattaccatattataccatttcttgcctcaatagtttggcacttatatccatatccagctatgcacatgctaaccaagtcttgcag

SEQ ID NO: 44897 - DNA, 22710 bp, Oryza sativa
cgctgcgtgccgtgcggcttcgacgtgcacccgctctgcaccatgttcccggcgaaggtgcggagcccgctgcacccggagcacgagctcgccatggtgccggcacccgcggccgcggcggcgacgctggggcggcagtgccgcacctgctccggctgcggcgaggtctgtggcggctggttctaccggtgcgacgcttgcggagtgtgcctccacgccgagtgcctcaatggcgcccgcgccaagcagagtgccggggtgggaagccagggcaccggcgtcggtggcgcaggcagcagccagagcggcggcggcggcggccagagcaccggcgtgaagcggagccggagttcccttgttgggaagttgcttctcaaggctgcggttcgcgtcgccgtcgatgcggcgacgaacggactggcatcggcggtgctcgatagcggcagcgccgacgacacgtcttccttcgatcaataatgtggttgtgcgtcctattgatcaatcgatatcagtacattatgtatgagtatcacctatctcccttgttttctcaagttcatcagaggtcccttacttgtcaacgtatccgattttcgtccttcaaccggaaaaccagatacaacaggtccttcaactatcaaaaccggtgcagatgaggtctctcggcggttttggctgatgtggcacatatgtggctagtttgattcggtattcatctgacgtgccattgatgtggtgcttacttggcaattcgatctgaaaaaataataaaacccgtgagacccacatgtcagtttcacacacacagtaataaaaatggtgggaattgtgggaatttgttgctatatttactttctccttatttcaatatctcatgcttagaatgatgatgttaagtttctatgcattttgcgataatttcattcatatcttgtatacacatgcttataaagtgtcttgctggggtaaataagtactcactccttcataatttgacatatacaagaatcgtgttatcaagaagccccagaaggtagtgaggtctacaacagcgacgagtttttctagtctagtctagacttgagcttttgcctgtgtcatttagtaggttggttttctccttgaatttcaaataaggatattttagtttggatcttttaatctttaagagttgtaatagctagtcttttgtaaaacatgtttgcaataatcgaaagctgttatgtatatcaatctgtgcgtgatcgaaatcctggacgatcatgagtggatatttgggacaccaagaatcaattgggtgttatcataattaccaataacatgaaaaattatatgagaattatcagggttacgggttaggtataccctttacccttcgatatacgccgcatatcagtatggcatacccacgcgcatacggatattctctgcatacattaaggaaatccttcatggaatttacggatggaaagagttctactcggacaagactgggtcgtcaatgtatcgtgtaaggtctgatgtctccgagttctacttggaaaccgcttgacctgcgatataaaagggaccccccggggaggacctgaggcatcgaatctcagagccaacacaaccctcacagcctacgaagtcggagcctgcaggagccaaatcgccggggatctagtcaaaccaactcgactacgatctcgctggatccatcgagttccattgttccctttgtaacctgtgttttccatcatataatcccacatcaactggattagggctattatctatcaaggggcatgaaccagtataatcttcgtcttttgtctgcttgatgtcgtattacgtagatccttataccaacgtaccccaataccctctatatccggtctacgggtatcacccgtcgacagtggcacgccaggtaggggggcttggtgctcaaggttctactactatgtcatccagcttcgtcgacaacaacgtcaacaccaacctcaactaagtattccctgcttcaacaatgctggtgtggactcaagtcggcaaaatcgtcttcccggtttacaccacaatgccgatctcagcctgtccatcaatgaccggaaacgagaacgcagtggctacaaaccaagacgactccatgtcgaaagatcctcccgccgaggcggagaacggaacatcgacgacatccgagctcgagaaggattctaatgcggccaaaccttgtcgttccgacaagaaccgcgagcctacgaagatgacttccgaagcgacaaggtcctggtgtcctatccacaaaaccaggaaacacaccttgcaagcctgctgggttttcctcaacgtccgcgctgaaattcgcgcttgcaaagagcgtggaattcagcgtatttctccaactcgtgatgtctattgtcctattcacaagacaaagaatcacaacctctcaagctgcaaggtctttctcagcgccatgaaagcgccatctcctaaggttcaacagtcacacattcccatcagggataaagacaaggaacaaggagcgacgtcaacttcagatcgatttgttggggtaatcgatatcgatcctcacgaaccatcagtcttgcaccttctcgaagactatggatcatcgacaacgagcgcgccgcgggaggtattggctatcgatgatatcggcacgtcaacgcgcaccaatgcagaagcggagaatcaattggccactccggcccagcacatcagagctgtcaacgctatactgagggaaaccccctacgatcctattctgaacgacgatctcgcgcgttggacagaacgactacgggaatcagtgaccaacctcagcaacgcgttcgaagaggccgctgccgcagcgcacccggagtagccaccaactggcgatgccaatggtgaagaccctgaacggagggaatcgcctcatcgagccacccctccacctcgcggcactggcgatctccgagatcacctcaacggccgccgggaggcacgacgcacacgagacaatgagaatcgttataagggctatggccgattcaattccaaccccgaccacaacccctgcacaatttatcgaataattattttatatgtacttttcagcaatgttttctactttaccctagtctcatccatctttgttgatttgcatcataagttgttcatcttcgctgcaagagtgtgatatccttcgtaggttgtcccgtaaaccttccgattcgcccacgagacgggtggttatctataaatagatctaaatcaacctagaggctggtgtaatatctaaattggttgcgctagccggtttaatcttttctaaacccatattagtttggatttttctagatcgaggtgtttggtgactctgttaacaccacaaatcattaggtgagtccgtgttgaccgaaaaaggcgtcaacaaagtcggtttgactttttctaagtcaaacttggttagctttgaccgagtttatagaaaaatatagctatattttaaacataaaacaaataaactatgaaaatatattcaatgttagatttaataaaactaatttggtgctattaacgttactatattttttttaaaattggtcaaactttcaagaaatttaacttaaaaaggccaaaacaacttataatatgaaacaaagggagtatatatgaatctcgcgtgtggcaccgcggtgagacccgggcgatgctattcctataaaatcaagggcgttgctctggcgaggtggcgacgctattccagtgagttagtgagcactaggggtggaaagagagtgaatagtttccatccgcttgagagaaaaattgaatacgaataaagttcggaatggataatccggatatggatactaatatagatattttctttggatatgaatacaaaaatggtactatagttttcgacgaatatgtaattccggtgaatagtgttattcggatatccactaaaagcatgaaaatttcttcttatctatagaccttcaacctacctctttagactttaatggtagcccatctcaacttttaaatatttcacaaactatagtacaatattatgttataatttcaattatacatgcatttttatataaaatgagctaattatgtgtgatggtatttgtttctattagaaattgaagtggttatcttgtttcgagaaataaatatttgtgttcgtattcgtgtcagatcatattcggataaattgtatttattttcatatcgtccaagctattcgtattcgtatcaggctgaaaatacgataatgattagagtcttttacccctatgccattaagaaagttggaggttacgtgtgtgtcacaaaaaagttttgagttacctgtatgccatgaagacaaactttcttttacatgtgcgccactttggatggaatcagtactaacggagacaaacggaggtttgaaagatctattttgcccttgctaatggaaggaatcagcggcggaggcggcgtgccggcaacggcgacgaccagcggcggcggcggcggcggctagaggtgtgccgccggagccggatagacgaggcgaggcgatggcggcagatagacgaggcgcgccgccggatagacgaggcgaggcggcgggggcggcgtgccggcgacggcgacgaccggcggcggcaacgaccggcggcggcggctaggctagggcacgggagagtagtagtagagatgaaaatgcttcaggggcaatttagtcattttcatacatgggtcccacatgtcagagctcattctctaacataaggtggatggaatggcacacgggtaaacggaagtttgtgtcatggcatacaggtgactcaaaactttttcgtggcacacacgtaacctccaactttcttaatggcataggggtaaaagactctaatgattattgtatgagcactattgcctgtatccgctcggttttcatccctaactagcgcaagagctcaacccaccatgtgtccatgttgttgccgtcaccagattcatgcgttgagaatcgagagttccctttgaggctatgaaagggacgggctagaacagcttattggttttaacccatttctcacccaaaccgtataaaattccatgggctgtgatcgaaccgtgaagtcctagatgtaatatgtataagcagttacacgaaataagattattacattaatccacttcaatgcaagtgtaaattatagcatataacattgttttcttcctaaggtctacctccgtttctttgtttgacgatggttagtaaccgacgtcaaatattaatggatggagggagtacattctaaccaatttgttcgaaagataaaaggatatttgctcacacatgctgtttaagaagtggcatattcactcatcctcaaagtgctgtttatcactgtccttattgggatcaaataccacctcctcctattcgttgtcgtcgtcgtcttcttcttcttcttcttcttcttcactgtcgtcgtcgtcttcacattcctcttcttcctcttcctcttcctcgtattcctcttcttcctcctcttcatcatattcctcctccgttagtttttctttgttgtccttcccatggattgttcctggccctcctgtaaccgtcgatcctaacttcaatttttgcagtattgatgacttcctgcttcctgctttctgtcctgctcctcttataactgctgttgttgcgccaagcaatttatgcgaaattgtagcaaattgatttgcagctgctgtttttgatattctagtcttttttgttggaactgcaactgcctctgttccttgtattccaaccccttctgaagctgcaagttcaacattagttcctccttgaaattgttggggtactcccatttccacattgctcgtgttgccttgctcccatttgtggctattgtaaatttctacatgtgcttcttcatgtaatcttggattatcttctcccgttacttgagaacaactctcgtggatgctgaagttgcagagcttgcaacggtagcaaatgagagaacctgactgacgacatatgtcgcaaatgaatggacgtctgagcttggtctttattaatgggtgagcttggtgtgacgcgtctataatcggcatcctagtttggacacgcaaaagatgtaaaacttgggaattctctccatcgagaaatatacaatatccataaattctgatattcaaaatctgaactttggtcaacaattcattgaacaatgtatatggttagtgcaattcatatatataagtggtgccatttgatttatatgctaagagtacttctggcgttgattaatttcgtggttagaaaatttactctaatagaaattctgtcataattcagtgtttgagatcctgggaaatcaaaccacaccttataatttaaaatttataggaacaatagttctttatcacaaaacgtaaaatattttttttaaaaaaagagtaaaacaagacagatctatatgttcagataaaaaaggggaaagatttatacgcacggagagaaagttaagaattttatagtggagtatacattctacggttttgctttggaggacatgtcctgtacacacaaacttttcatatacaccatgtgcaccaactaacaaattttataagaagttctataaaagattgtacatatactttaaatagtattacatttatatgtaaaaatctcaatctcaaattcattatattttagtcgtaacaaaaaaaaaacttaaaaatctgtcagaattttgtctttctttttctccatatatataataatttgaagatcggactttgaggacgtatccgatgaaaacgagctaagtgttgaaaaatcgtgaaaatcatacctaaagttttgtaaattcatgaaaatttattagagctagatgtagatatgaaatacattctcactaaatctcaaatcaaaactcaacttcgttagaaacaaaaaagacaaatttcgggtgaacagtgtcttgttactatttacctaaaatttgtatttttttgttacttctaaatgaaattgagtttgaacttgagatttgttgataatatatttcatatgtatacatatatctagtattttttttcatgagtttttggtacgatttttacgagtttccaacacttagctcgttttgactggatatgtccctaacataaatataatactactaatagtacatatataatttttttaagaattttttatgatattttttagttgatgtgtacacgagaggtcttgtatgcatataagttcacgttccaggtatctgtgtacacataactaaaaggctagttaaagaggaggacgatgtggacggttttattatacggttttaaataatgatatggttactttaattcggtagtacgtttatactctctccatttaaaactatatggtatattaggtttctacgcagtctccgacatacactttaaccactaagtttctaaatagagtattaacatctataaatttaatatcatatgaaaatattttcaaatataaatctggtgatactacatataacacactaaacacatactccctcggtttcataattcttaacattttgaataatgacacggtcttcagatatatgtttgactatatttttatattataatatataataaatattttttattttattatagtactttgtaagataaatctatatgttgttctagtgcctttgaactaaatatttttaaagtcagtgacagttaaagctaaaaaaaattaacctaattttatataaacgtcaggaattataggcccagaggagtctaatttttgtttgttggttataaaaaaattaatataaactttgcggaagaaaaagacacctcatatattcaaatggagctgggatcctctcctgtaatgcatgtgtaataagtatgtgcagtaagtgccactgatacgagggcctggaataggtgggacccacatatcagtgacacgtaatgcagtgcagtacagcagtggatttgcatcattcaaatggagtgggtgccagctaggaggattaattagacagccgaacggaattaagtgaaagttgtagttttgtcattggtctccatatctcactgcacgtgcgtaggtgtcttgaatataataaaagagaccgctcaaaaaaagaatataataaaagaaggtaaaatctaaatcaagaaataaaagaaatagcaccctgatgaatgcttctgtgagcagccgttagagtagtttatagtattttcttaaataaatgaaatggaccatatttgcaaattaaacatagaaaatgtttacctttccttcccaaattaagacgaatccgaccaagatcctctccggactctagttcaatctcggaactgaagagcacacgatgcgtcgatgtgtacggtgtacctcgctatgaggagccttttatagatgtagtatttcgcgaaaagaaaatttttagatgtcacatcggacgtttgacgacatgttaaaagagatttttggacacgaatgaaaaaactaatttcataactcgtttggaaaccgcgagacgaatcttttgagcctaattaatccgttattagcaaatacgggttactctagcacttatggctaatcatggactaattagactcaaaagattcgtctcacgattttcccctaactctgcaattagtttttttaatttatctatatttaatactacatgtatgtgtccaaaaatttaatgtgatatttttggaaaaaagttttgggaactaaatagagccgtatatgtatattccgttgagcaagtctgattttatattcagttgaacaagtctgattttttttttctttcttgcgttggataagtctgcgatgtacagtcaagaaaacaattggagaaacccatcgctctccaatatgcaaatagctaaagaagtttgaaaataaaataaaatctatcactaccatagaaacgtactccagcttgcttcagatatactatacggaacaactcatcatagatatgtaagttaattgaggttatatgtgatggatcgtaactattatcatcacaattaccatcaccgatggcctcacattcagtagtattgtatgaaccatggcaagggtcccattttcacctgttatggaggtgtgatcatccgatttggttcctgtgctgtgcagtgtgactgcaacaactagggctgtctgtcattggcctgggcctcgagattgggcggctcgttgtgtttggccggactgtatccgatgtcggactcaccgcatccgtccaccatgttactgtaattttcctcttcgtattgatctcaaatgttactgtaatattcctcttcgtattgatctcaaatgttactgtaatgagataatcgtgccatatcaatttcggaaatttcccaaaaaaacactttcagaagtttctgaaaatcatttttggaaaaaatctgaaaatcacagtactttcaaatccaagaatgagaaacacttcaaaaaagattttgatcactaaactcatccctaaatattaaggcaacatccccttaatagtacgactttactaccaactcaagagcaaatagaaaagctataccaatacaaatacctttacgccatcttctctctttgccttgatcaatactaatatggatttgaaaacgaatcacatccccttgaactttgacatttcatcttgtgcttcttcttcatcaagggttgatcctcacactactacaaaaacgattttcctgtacgagacccttgtgaggttacagacggatcataactgaccgcatatgcaaaaatcgacctccattttcgcatacggctccttaaaagacccgcacacaaaaatcaattttcgcaggcgggccacttaaaaggtccgcacaaaaaaataatctattttctcaggcgagccacttaagaggcccgtctgcaagtctaatccctctcaacccattcaaaacttatctcttcttctcctccccctctctctcccttatcttctcctcacttcatctcctcctctcattttcccttatccgttctcttctcctcacagcaacgcgatggcgggcgcgacggcgacgtgctcggggagcggtggcggcggcggtggcgggctcaggagcggtggcggtgggttcgggagaagcgatgggcagcgggtgacgcggtctactgtgaaggccgtggctccctcgccctcccccacgaagcttcggcggcggcctcgagggatgacgacgacaaggaggcggccgggagtggcgccgccggccccacgcgcacaccgactggatccgcaccgccccagccgacaatgacgacgaggagacggcggccaggagcggtgccgtcagccctgcgtgcacacgcgttagtcggatccacgccgccccgctgacgacgacaaggaggcgacgacggccgctatctccgcgcgcacgcgccgccaccgccggattctaggatttccttttttgaatttttattttttttggaatattatttttctgtgcgggcgacataatccgaccgcacgtgaaaatctaattatcccgtgcggtccacttaacccgaccacacgggaagatggatttttctgtgcggttgggccgcccgcacgtgaaaatatttattttcacagacacctcggtgcagacgggcaagacctccgcatggaaaaatccttttcgtagtagtgtcaacaacttgtgacatcatatggccttgattgattcgtcggtattcaacaaagcacttgctccttcaccactgcatcatgtccttcggcgccaagcctccacttgcccttctcccatgcatggtccatcgtgtatccaagtgttgccaacccttcattgcatcttgccatcttccgtcatttgtagctttgcatcacaatgaaaccacaatgtattacatctttctctacatcatcttcattggactaatcccttgcttatacactcaataaaagcattagacccttaatcatttgccatcaattaaccaaaactcactaagggcatagatgctcattaaatctcccactttttggtaattgataacaacacgattaaagcttacaaaagattgataataatgcttttgaaccaaaagttagtttgagctcccccaaaatgtgtgcatacaaatatatggagtgaatttctgtgatgagtgataccgaaaggaaaacaagacacataactcaaattcttgccaccgattcaaaatgtatcaaatgaaattcttaatgccaattgcaaaaacttgattttatgccaattgattctggtaccgattgagaaatcacgagtaaccaaatttttgaatcaaattcaaataccaataaataatgtcaattgcatctggcctagcaatcaaataataagcatgaaatctatcacaccatgcacactccaattgacaaacattttcaaatatactctccccctttctcatttactctttggcatgtccaaagcatgtctttcgataatttctcacaattatctcaccctttgatcaatcttttcttcacccccttccttcagtatactccccccccttgaaatctaagcaacaaaaagggcatacgcagggaaagaaaagcagagggatcctcgtcgattacctttctctcaattttatatttcatcacttgtgattacgaattaaacactaatttgacacaagtgaatcaataagcattgagatacaaattttgcacataaaaagctcacattcgaagggtttaaagcataaaccaaaaagtatccctttgaatgtgacattcttcttttcttctaatttaatgtatccctcccccttagtcctctcccactttgtcatttaagcatggcaaggagagggcatgatatataatgaaggggatcattgagatttgaacatgccaaaccacttcttcacaaactagagtgagaattaagagttaaaaataaaaacaaccgtcccaaaattattcacaaagcatttcgtaaatgagtttagaatatatgaattccatagtttgtactaaggcaaaaaaatccatatagaatgaagtctttgagcactttgattcacttagaatactaactttatgactactactcacgtattgagtaaacaagcattttttttcataacattatgcaaactaggctaattagcaagaagtgaaagttggcctagatgcacaaagactaggcaagtgatccaatcattccaattgaaatagcaagctatggatcatccggttaccttccttgttaatttttgacacgcccatcgaaagaaatacattacaaatgttcttcttggtgtttgtgaccttgtcaaaagattgacttagcactaaaagcaaatatccacagggataaaccagagaccaaatagggtgaaaaagtgaagagaagaaattttggtaagcacttatggttatttaatgggcttgagaagcagtcaacatggagttttttttagaagaaaaataacacggagaatacgggtacgaatagcacaataaggggcagccgccaactatagtttggcattaactttcacctcttcatcaatttcatgacattaaaagcatgggagtgaactcttgccaagaaatacaggccatcgcttaatatgtgatggaagaaattgaagaacttgcgattttttttaaaaaaatataaataaagatgtattttggttggagtcttaatttcatatttttttataaatgttacgtcataaatatatagctacttgtttaaattaatattgtgatatctcgtcaaggaacaaaagaatatcaagtgtccctgttaatgggagcaacttttcgaggtttgttattagactctaaagtttatgggaggaaaaacaaagtaattgaaatacgacactattcatgcatttgattcgtaggaataagaaaaggaaaaaatgtaggaaacttttctattcctacgattatagaggaaaaacgtagaaaatttaacatccactataacctcttggaaaacttcccttgagtctatctctttcatctgtttcctgcgtttttcctgcagtacaatcaaacggttatttctgtgtttttcttctgttttgtaattctctattttgcacttgttgcagtccaatcaaacggttattcctgtgttttttttgtgttttgcaattctctattttgcacttgtattcctatcaaaatccggtatttttcatattcctctattttttttaatcctactatttaaagaggccctaaatgtgttcctcttgttcctatctattacctttgcctttctagtgtcaattcctttgaccttggcaggtctcgttcgtactggctctcatgtggaaagatataattcgaagttggaaccactccgcacaattgtcgcaattcaccagtaaacagattgaattaagggccgggtatatgaatgcagaatgcgatttcacgtaagcagctatagactcggtgcccagtctgagtcgtctgcaatattttataggcaaattggcaacatgttccaggagtccttccactgtctccaaacctgctgacttgtttcacttatatcgtcgtattattgcaattcttcgtactactctttaagggacgtatatctaatcccatcttcgatctaagataaaaagttattttaggatttgtgtctatcaagatcctttttgtctttgatgtaacagtgatctcagtctacaaagacttactacagtatatttttaagttttagaattagtgtagagttaattttctactcatcttatcctctcagtattagtactatcttatagagcttttctttgtgtcgtcatgtcgatactgcacgtctttgtttatatttaatctcaccctcgatgtaaggtaaggtagagaattattatttgcatctgtcaaaaattttggagattcagaccgttaagtattactctcgtactaaaatataaattagttacttagacaaaatccatatatattaggacgtgcgttgcacgggttattatattctccctccattcaaatttgattgtcatatttcagtttctgaaatattcagttttgatcgcgctccctccaattttgtctcgggtgtgatgcctggttgatcgttttccatgcatcattagtgcatccatgcaagggattggttcaggttgtgacccgttcattttccatgcatcattactgcacccacgcaaggattggttggcttttcaaatgcaaagcaacagctttgaataagtattattgttgtcatagatattagaatttcaattatatatattcaaacattagttattattttttttcaaacttatatgttcaaaagacagaataagtttatttatgataaaaaaactaattccagattatatacaaatcaatcctaatatttttgtatattagttccgattttcttaattcaaattttcaaatttttaattacagttgtacacatattggagtctcaatttaataatctctgtaatttaatttggaaatttattaataagtgctgagttatactcgatttgaagatacaaatttccatgatttaataattctgaaaatcgagattaatagactctgagacgtactcggtttgaggtcagaattagaaattattttattagcatatgtttagctttacttggtttcaagtttgaattatattcatttcgaagaaaagtttgaattatatcatagattttccatatcgttccaaaatttagaattaatcactgcctatttgttctcgtgtcgaaatattaatgttcagattcattatcttaggaggggacacatcccatcctaggttgagtttttttgacggagggagtacgtggcttagagcaggtacaatagcaaactattagccatctataaatatattttaatgaaataaatgttgagagagaagagcagcgagctatagatctgtagccagctacatcacggacttcaaaacacaatgtgtgtatgataggtgggaccatatattaatagcatagtaaacaactattgtataaattggctattacatacgctgtagatgaattggagctagtagtggactattatcttagcgatgaagagagttgagggacataaagcggactagaagttcacatggtggtctgctgccggcctaaagaaaagcccatgttaccaccagcccagcgtatccggctactgctttgctccccgtcccccccgtctcttcctcgtgagttcgcctgccgcctccatcccgcgcagcagcgccgccgccgccgccggcgacctgcttcttcagacgcatcctcgccggtgagcgcagcaccaccctccttctcgtctttccattacccacgacttctctccttgcatcaaccttaggcttgcttatcctagatctggaagctttttaatttctctttgcaactaacagcgatttgtttccgaaaataatttgggattcagctgaaatcctcaccatgtcccacgtgaggtcggcccctgcgggcaagtccggcgggggcggcggctccacgccggcgaagcgcggccgccccttcgggagcaccaccggcagcggggcggcggccgcggccgcggcggctgcgatcggcgatgcggcggcgccggccgcgctggttgggccgtccctccaagtcctcacggcactctccggtgagtgagcctctttcttcgcctgcaagtccgcaacgagcttgtgatgatgtctagggcacagctttggagacgactttgttgcgggaagggggattagggtttttggtctgctgattatgtgccttggtgttgaaattgaaattgggatgctgaatataccatgcatcgaggatttgctttattggactgctgacctaacagggaaatagaggaacaatgtttttagttttgaataaggcattgcttcgatttttgtcttatgaggagctagatgggactggtcgtcaaattggccgtcaagaacggcgtgatttatgggtagtacactggtaatcctatgacgaacattggaaacaatggggacaaacaatcgtgctgtagttgtcttcataatttcagatgcagaagggatggcttgtatagtttctttacctatattttttccctgttcatattggttcattcaatagagatgctacctcacatgtgtcatgagcttgaaatgcacatgcactccttttttctgcacacttaacatgtactgacgacatggttactaagaaggagagtttatgtttctttgtggacttttcagatcagaacaataaaagaattgttcttgcattgcaaagtgggttgaagagtgagatactatgggcattgaacgcccttacagtactctcatttaaggagaaggatgatctccggcgggatacaacacctcttgctaaagttcctgggctcttggacgctctccttcaagttgtaggtttttaatgttaacttccccccttccaatttgatctatatgttatggaatgatgcatctcttctgaagccaaaaatcatgtttcccaattcctctagcatgcattaattgatcaatttgaatcagagttcattttagaaaatgattagtcaatcaatcatcaccctattcattttttatggtggacctccgtactgttgatgccaccagtggccgcagccacctgttccagaccaggaggatcaggaaatggattgtgagactgatttatctttactttttgttcgcaaatattctttcgtttaatctgcagaagttgttaggcaatcctcctacttaaggatgggactatcgctacttgaaggcaaactagaataggtaccctaccccctgcttctctgcgaacttccgtgtacctcctgtcttcctcctgcacaatggtgcccaagcgccatggtccaggtctccaggatcttggcttcctgcctctcactcctattcccttgccaccagaatcttgcccacaatatccagacactgatgaaaatgtgatgatctcatgcaatatccaggactggcattgttgtccactgtagccatagaaacgtaaataaaggttccgatatttgcacttacacttaattggttggtggccaaagtatcgctttatttaattggactaccgtgcttctttgatatgactaaatttgctaaataactaaattttttaaacaatgcactgatcaattttcatccagaaaagaaatgatatggtgatcatgtacggatacgcttattaggactttatttctgcattctgtttgatgcatttccattttgtacagatagatgactggcgagatattgcaatgcctaaggatcatacaaaaccgccaagagtaagaacattgggtgtcaatacaacactctccggctttggtcatgagaatgttgaaaaagtctactcagacaccatcatgtatgttgttattagtctcatcaacatcttcacctcatttttaatgagttaagcagcaatacttgtatttttctgaaatacggtatctcagtccttcagatgaccaaacaaagacagctgactccactgtcacgaagaagcgatctgcaggatttttgtttgatgaagagggcctatttaatgttgatgacgaaggacgaacagaaaagcagcagtgtgctgttgcagcctccaatataattcgcaatttctctttcatgccagaaaatgagactgttatggttcaacatagacactgcttggagactgtatttcagtgcttagaagaccaaaacactggtaaagttccaaattcaattatattctattttaaaaaccataaattaatatggaaatgaccgactacctcttttggttgtgttgtgccataatttttgcttttgacaggagatggcaggggataatccagctgtaatgtattaaaataagttaaaagagaattttacatagatctaaaggatataaaaaaattaccaacaaggaaaactttatagatagcaagaagtgtgttgcaaattattctatccaattgtctagggcaattcaatttcaagttgatgttaattgtgtgctaaatcaaataagttatttatcctaggaccaagttatgataacatgtaaactaaccttctattcatttttatcatgtaccggaagattatgagctcataacaaactaactttttatgcatttttatcatgtaacagaagatgatgagctcataacaaacatgcttgagacccttgttaatctagcacctgtcctggacctgagaatcttcagctcatcaaagccatcatttattaaaataacgtgagatcaaacttatgacaagttcttttcattttgttttcatagtgatgcctgatgctttactctgctttttcaccaataatacagtgagaaacgtgcagttcaatccataatgggcatgcttgcatcatcgattagggtgtggcattgtgctgctgctgaattaattgggcggctgataatcaatccagacaatgaaccatttcttcttccagccattccacaggtaaatcatttttaacttctagcatattgtttcaattttgttgatatgctatggagatggaccgaataaagctattcggttgtggatgataaaattctgtactttacattgctaaattttcatacagatatacaagagactagttgacctcttgagtgtgccagcagtcgatgcacaggcagctgctattagtgcgctgtacaatgtagcagaagtgaatatggacttccggctgaagcttgctagcgagcgatggtgatatctccttcattctattagatatagcacactgatatgagaacttaaattcaaactcttaaatttcgtattatttgaaccagggctgtcgatagactccttaaggtcgtgaagacgccacatcccgtgcctgaagtttgtaggaaagcatcaatgatagtggagagcctagtctctgagcctcaaaacaggatgcatctccttgtccatgagaatacttttgctgagatactcacgtcggaagggaaatactccgacacatttgcaaggattctatatgagctgactgcaaggccgagcaacaaagtgacagcagggcaagctatctgggggaacataaactgatgcatcattgtattgttaaaatctactagataagatgtactttagtagcttaggtacctgttatgttgaaaatgccttgggtttctgactgtatgtaacaagcttttagctgtatttagttgcagccttgcaagcttacattttaacgccttgatcttccttttctgaagtactacacttgcttccagagtttcagagtactatctatgatattttttgttaggcttggaatggctggtatatattgtagcatgttggtgttatgaatgctgctggaattttctgccaaatcgttttgctgtgcctagaatgagcaatagtctggtgtttcagtgaggttgttttgctcggctttctctgcagcccagcccgtggacaacgtctctggcaacaagaagaggccgttccggtacaatggatgttgccatgttggtatggatgccttcattttattttataccagtactactagctgtgaagtgtttgaagaggtcgtgtgtactcgtactctcgagtgccaagttgaaattttttcttttctgccgccaaggccaaaggggcgcaacttgcaaggaatctgggatcgttggttgacatcttaatttaaatatgttactcatgaacttgggaatctgggattaagataagataagcatacacgctccactaaccaattcaacacgctcactcattagccgcttatattgtttgggtcaagctaactgatacatctcctacggaatttcacatccgtgaaacagttgatatctcaacctggtaaaaaaaaactctatatctcagcgacgcattcataatcactacaactaatcacataaaattgaaaaaaataggtaacaccagagctttgtatagggcctgttcggctgcctgtgctacggctgtggcgcagccagcaccaacagtttcgcacacgcacgacacagcctcagctttagcaaccgcagccagcttgccgaccagacccataatttgctctgtttggcttaccttgctttttcttagaacccaaggtgattttgaattttaactttcaagaatgattttggctgagtttttttactcatcttttagcacctgtaaaagggagatctggacaaagtaggtggtgaagaaaacactctaaaattaatataaaatcaaaacttaaaatttaaaatcaactgtgttgcagctctcccatgatcaaccatcaacattgtcaatactaggaaacagcctggattaaaatggtagtctgaataatcataaaaataaatcctcagcgcttgttccaacctcagcacaagttgagcctaaattaaactgctggttttgttgaacgtgaaatttactatccaataattagcaagtgctccggagtgtgactgatcccacgtataccaagtcatgctcatgcttgctgccggtacatacattttttttttcttttggcacacactgtaccaagccgggttattgtcttgtcaggctagaaaagaaaaattaatcaactaagaccgacgactcgaaacatctatatatacacatccagtacaagcatcgtcaacaccgcatgcacaactactacaaccaaacaaattaaaccaagccatatcgatcgaattatcggtcaagagatggcagcttctgtcacctgcaagctacacccagggcactcgctaacgaggcaccactacggcggcgaggagggccatgcctgtgtctgtgcactgtgcgagcgcatcatcgccggcgccggctacaggtgcggcgagtgcggcggcttcgacgcccacgaggcctgcctctcgctgccgatgcgcgtcgcgttcgtcgggcaccccgcgcacgagctcacgctctccctcctcacggccagccggtggtgcgacgcctgcagggtggcctcccacgccgggcgctgcgtgtaccgctgcgtggcgtgcgacttcgacgtgcacgcgcggtgcacgtcgctgcttgacggcgagcagcagcatggtaggaagcgtggggtggcgaggcgcgtcggcatggcggctctcaggatggggttgttcgggctgcgcgtggcggacgcggtcaccggcgggttcgggtcgccggtgatcgaagtcattgagacggcgcttaatctctagacgatcgaaacagtgcacgcatgtgtgcgactggatttttttttcctcttctttgcgttaactgcaccatctgcactgcaaacttccacctatcacaatgtgctcacgattcgatcacaagtcgattttctttttttttttaaaaaaatgtagccgctggaagatttgtgcatgcaactatgctgtactcccttcatccgacaggtcttcggtgctgtgtgtcacactctcactccagcagctagcagtcgcgttgtcgaggtgattgttacggtctttcgtgttagcctttctaagcccggtagccccgtgcggcccaaaaaaaggcccaaccacctcgtaccctaaaggcctaaacatagccagtcggacgccgcgtcgcctcccccatcgccggctgatgccgtccttttcctcgcgcgccgctggtcctttctccagccgcgacccgcgaccccttccggcaacgttgcctgcggcggggagttttaccacctcgacgtattttccttcttctccgaacggcgtcccgatgccagggaattcaggctattccataattcgtctgttatttaatttaggtcatatttgaatgaacttgaagcgaaaaacgtccgagtgtctttcggctagctcaacaaagtggtggcacaactagaaaaatctttttttttgcatgcggccaaaaatcatttttccaggcagggaaaggtctgcctgtatataaacgcctgcgaaaaacatcgattttcgcaggcagccgaaaatcctcttgatgaacaaaaaaaatcgctaccaccccccacccgtgctgctactcacctccggtcgatctagggttagggttttgggaggtcgagggagaggaaggggaggtgaggggaagcatagccgctgctgaagggctgccaacgctggtggtggggggcgccgccgccgccaccgccctctcccttccttcggctggatctaggatggagggaaccgccgctgctgccctcccccggtctccatccggtcggatctgggaggggagccgcaccgggtgccgccgccgccccgcgccatggtcatccccgcgcctcgccgccgccgccctcccccggcctccctctggccggatctgggaggggaggggagccgcaccgggtgccgccgccgccccgcgctgtggttgtccccgccaccctcccctggcctccctttggccggatctgggaggggagccacgccgggtgccgccgccgccctcccccctcccccctccggctagatcagggagggagggaggggccggaggccgccgcggccgccatgtcgcgagggagccgccgctgcctccggccgg

SEQ ID NO: 44898 - DNA, 4528 bp, Oryza sativa
  unsure (1)..(4528): unsure at all n locations
aggggaggggaggggaggggaggggagtgaggagggacgcaggagaggagtgagggagaatgaggacttagaaaaaatcggccctaggtcagctctatttatattccaagtctactttcataggcggatcacataagaggtccgcctgcgaaaatggatttcgtaggcggacagcgagcttcatctcggtttgcatttttgtaggcggctatttggctctgagggtcatgtccgcctccaaaaatgaatacccaacgtcggcgaaaatgatttttatagtagtgtgggctagctggtctggatttgaagtctcaccccttttatttataatattaggtcattttctaacattcactttttttaatggatttgaggccacatttgaagttttcgagtccaccggccggctagccatgagggggagagagagagagagagagagagaatgagcgcgccatcggcagggagaggcagccctctaccctgatcttggacatcgaaactgttgagttgtgaccagcttctgccagagcgaagcggaggcccgtcgttatccttttaggatttcaccttcatatatacttcttgtaagccgtcgttcggtgttgtaaccttaccccgatagagtgaagatattttgctaactgatgctcatagttttttctctcctgctttggaaagattttccacgttaaatctcgggtcttctatgattgatctattattttttatcgtttatttgcctatcgctttctaacaggagccgccgcacactccctcgacacatcggtagccaatgctacggatgatgtgctcgcatagggcgcccctcgccgccgtaacatatgtcaatggcgtaaccaggagattttccttgggcagtactagttcacaaatgcacatcacatactacaattttctacaccgaaaatatgatatacaagtacaaaactagtgaaaatatgatattattataatgtcttaaaacatcataagtggcttacttaacaagctaaaatgacacattcactaatcaatatccctgctcctcttcatgttttaccaatcctgcaaactgcaatgacacatttacttaacaaactgctctgcgctgatcttggacgtcgaagccgccgcacgcgcactcgacgcatcggtagccggcactgctgatgatgcactcggacagggcgcccctcgccgccatgctatctaaattcgggggcgtaacctggagatttgttgggtaacatgtggtgcacactcacatgttatactgaagtgacctacaggtacaatattatcttccaaaacaaagtgagtgaaagaggtgttgaaatataataataatgtcttataacatcgataagtggcttacttaacaagctaaaatccctgctcctcttcatgctttaccaatcctacaaactacaatgacacattcactaaacaataatcacaacttacaaattgtatattcagttattcacttattcacagactcacaaatcagaaatctatttttgaagccattacctacagagacataactactgagctagtcagccaaaggaaggggagtagaggcagttgttcactacctgcaggggaaggcgccgttccgttccgccggaattgaagcaaaggctgcatggctgcgggcaagcggccgaggcgccgagcgctgcagcgggagcgggaggctgtggtcgcttggctggccaagagcaccagagcggagatggctgtggaatgtcctgcagaaggcgccacgaggacggtgggtggtgtatccacggcggcacggcgcacgggtggcggtggtgcgacttgacacacgggtgtcgcctcgtcggcgactcggcaaccgcgcgtggtacgggcatcgggcgaagttgaagggaggaagacagggagtagcgttgtaacggctcgtccacccaggattgctaatccgcgcaaacgcgccagattagtacatcgcgagcgtttcctagttcgtagcttctcacactcttttttttttcgtttttccgccttttcggtttctttcaattctatatttatttgtaaagaggtgtgtgaatgattaaaaaaaataaaaaagaaacgaagaaaacacgcctaagatcagagaaaaaagtgcgaatacgcaaaaaaagaaaaggaccggcggaaggggatagctgatcgctggcgcgtatgcgcgcattagccatcccctcgtcctccactctcaacgtttttcttttttttaagggagggggggggggggagggggaggccccacctaaattggattaaaagaagtaagagaattacagaggaactatacaaagacgaggccaaaataaaagggaaaaactaaaagctacaaaagagataaagaacagcaactagagaagagcaagagaagcattaaacagcgatagccagagcgggaggagtgctttaagcggatgtttaaagcgatgtgcccagagctgagcatcctgaatacaacttctattgagccgagaaatggaggggggctggttctgaaagacaactttgtttcgatgattccacaggcgtcatcaacagagaatgaagaaggtattactctgaagagccgaaatgctgtccatcagggtgttggagtgaagcaaattcatagatgttataagggtgctacttgaatcatatcccagaaagctgaggccaggggacagttgaggaaaaggtgatcagtgtcttccgggcagctcttgcagagttcacagctcaacgtttttcttgggtttgggttgctaattttagtttggtctattggatttggttatttgggcctaattttttgaggtgtaggggatttcttggtcaaaattggggtagtcccgagcccacaaggactaccccagctacgtccttatgatgcttcgttaggtcgattgaacctaagctaccggagtatttctttttaccctatctctccctctgttatcctctgcgcgtctccatgacaccggcgatgtatgagagacgatgaagtcgatcctcacacaaaaacactaatacagtagcacacaacaatgtgaaaatttctgaaatttcaaacaatattggaccctgttccggccctctcctgtcggtctacacagtagcgctgcacagtgtacacgcggtcctggctcgcctgtgcatatgcggtcgggaagaaggtattgatcgtacgtacgtgtgcgagacggcgattgccgctgacccctctttttttatgtttagaactcattgagtaacctcgagtcgtcgctgaatgtttctgtatgcatgtaagctagcacaaggagcaagtagcaatacagtgagtgcacctatatactatgggccgcttcaattcgatcagtgcgtagagggaattaaaactgcctacatatcaggctcgatctcaaaattgacttacttgtaaattacactattagcgccagctgtttcatacatagttcgcgacgtggaaaaattcaacacatcttaaaagttaaaaccaatttcgatcagaacgaaaaaccgtaagctactaatagtacattgttcagaaatcagagttgacatatgaaccctttttaagtgcacgaggaaccctgtgaatgaagcacatatatcaaagctagcacaaacgtcaaatcatcaatagcttatcatggcagcagcgtccggcaatcagctgaccgagagccggacgcacttcgcccatccacagcacccgcttctcaagacacagtacggcggcggcgagcggcagccgagcagccgccacgtctgccgcatctgcgggactcgcgtcgtcgccggcgccggctaccgctgcgaccactgcgacttcgacatccacgaggcctgcgccgacttcttcccggagaaaatgataactccacctcccaacttcttcgggcatccgtggtcgcacaacctcgcgctcagacaggtcacggcggcggatggatcgtggccgtgcaccctgtgccgggggcccttccagcacggccacctcgcctaccgctgcggcgcgcggaggtgcgggttcgccgcgcacccgctgtgcacgatgctgccgggagagatccgcagcccgctccaccggaagcacgcgctcacccacaccgagctcatgctcatcccgtccggcccgtgcacacccgccgagatggcccgggtctgctccgtctgccgccgagactgctccaccgtgcgcacgcggcactaccgctgcgccgcctagctgcatgttcgtgctccacatcggcggctgcgtttccggcgtcccgccgccgccggcgccggccggcgaggaccagggtagcagtggtcctgacggcgcgaggggttcgtgcggcggagctgctgctgctccagcccccgccgtcgcgaggtttctcgtcgtggtcggagcagcagctggcggcggatttcccggctgccaatggcatggtggcggtcattaacgcccnnnnnnnnnnnnnnnnnnnnnnnnnnnnnnnnnnnnnnnnnn

SEQ ID NO: 44899 - DNA, 11288 bp, Oryza sativa
agcacttgcttatttcttttgttttaatagttacaatcttttgaatcgtatatcggatttaaaatccatttgaaccatcactttctattcaaattatacaacaaaacgagtccaatatcgaatatattcggacaccgtgatatttaaaatttctggacccacatgtcatatagacacgtctcgtatatattcagtaaaattgtgctacaaataatattctcatataaaattaaatatccaataatttattatttcttctatgaagttttagcacaaaaattcatcaaacaccagatgaaaagaaccaaatgctgataacttgttcaattgtgcttacctggaatctcttgcattacattcacttgtttcttttgcattacgctctcttgctttgccttctgcatcatttgactccgtagccgactacaccaaaataaatggtaaagcagcaaaaacacaagatgattaatgcaactagctccagattgtgataaaagaagcatatgtacataagacacactagtcaaataaagtgtgaacttgttcagttggctgtcttaatgcccagtattaaattttgcttttcagcagagcaaacggtcatcagactgagctgtagtttttgacactgcaatcatcattttcttttatatcaagctgtgatgtttataattggtaattcgtaccaagactaacttaggaccaaatttattaaggtcatgtgctggcaaatcagtacaacgttcacgaaatgacaagctctactagttgaactgcacagaaaatagagaatgtaatgcaatttactgaagaggcaatgacaacgtattatagaagagtacaaaaggataacaccaagttagttactgcttgaatcatcgttaacaggaaaatagcatggcgttcagacaaatatgttcatgtctcgacacagcaaagcaatcgccgaagtactattagttagtcatttagctcataaagacatgctatgtttcaatacagccaatttgctagccatttaaccaacgtgttccctttatgttggaaaacaaacacaaagtagccagtgctaacctaaagaatataaccaaacagaagggacacatatcgaacctttggatgggattctttctcagatacgaggtgaagtggctggggaagaagtattcgccgtgaaagactctcttataggccttgcaacgggagggtccttgtacctcttgcactttctttatttcatcatcatcttcttcttcttcttccacctggatgtagagggtgggcagtgaccgcagcaccttatttgtcatgtccaactcaacgatccaaaacaggaactcatcatcgatcttttccatgagcaggaaggaaacgacacctggatcaaccaagctcaggtgagaaaaagtcggcacagcacgcggaagagcacaggtgtgacctacggaattagcacaaagatcccagaactcggcggcttccattgtaaaatccagttcccaggtcttttggtcgatgctgaccagagtccatgccgtgatggtgaaagcaggagggtatacatccttgtctgcggtggcggcaatggtgacgcagaccagcttgatgaagaagccactgtcactactacctctaacacaaacacagcgaactgggtcggcgcagtaggactggctgaacaagcgggtgctgccatctctcaccggtttggggagcgggatgaagctgaattgatgtggctcgtccccagggttgaggacgtcgatgagcaggatgccctggtagtagtcgacccagcacaggaagcggtcgtggagggggagcacggcgtcggtcctccactcgccgaggttgaggccgagcatgctcatggcgcgacggacacgcaggggagtgatgctccactcctccgcttcccctgattgcacaacacagagctccacctccttgctcccactggatgtgaggtgcgccacagtgaagagcgaccggccgtcctcgccgtcgccgtcgccgtcgcggcacaggaggccgacgtctcggctgcacatgtagcgctgccgctgctggtggtacggctggtacaactcgtcctcctcctggtcggtgaagccgccgacgaagcaaggcggcagccgcgtgagcaacggctgcgaggagggggaggcggagtagatgaagtagtcgagggggtagtgcccatcgacgttgaacccgggttcctcgaaggggacggcggcgacgaagaggatgcagccgcggtgggcggcgatgacgtcggggtagcggacctcggggaggtcggccggccactggggagggcagtggaggtagaggcgggagacggcgggcgggtcggcgacgcggagggaggcgcggacggggaagccggtgcaggtccggccgaccttggacgccgtgatgtcctcctcctcgtacttgtgcctcctccgccagctgcagcggacgtacgggtcgaggacaatccagtccgccgcccccgccggctccggcgatccccggccttcttccatgtcgccgcgccgcagttcggtgttcggttcggatcggatctagctagggttttacctcccactcccagatgtctcgccgccggctggagtgggattggaacaagggaaaggggaactgaatggggatatttcctcgggaacgggaaggaacgaaacggatcccctcctgttgaattttttttatttatacatttttttattaaaatatttacaaaaataattttttgtttcgaaaatttacaaatctaattgcctgccgcctttaaaaatcaccctctcaaagggcggcaagggacctaaatacaaaatttttatttgtgttcaaacccttcccaccggttttaattgcttaaaaactaataatgcttattcgatactccaaatgattttaaatggaaaagtgataaactacaaagttagatctcatcaagatctacaactttatataaagtttatctccatccaatgtcgtttgaaatgtagatctgagattttttaaaatgtgttttatattttgtaacgaatatttggatatctaaaacatcttaaatgaaaaagttattaactacaaagttgtagatctccttgagctctacaattttgatataaagttttatttcatctgactttatataatataattttaaattgtaaaattatagagctaacaagttatgctggaaaatttacatttaggtcccttgccgccctgtggaagggcgatttttaaaaatcgccctcccaaagggcggcaggcgattagatttgtaaattttcgaaacaacaaattattttttaaatattttaataaaaaaaagtataaataaaaaaaattcctcctgactttggggggtggaaagttacggtgtcgctgcacttggtttcatccctgccgaccagttcatccaacggcacacatccatcttccctcctgcataccctattcatattgggctacccagttcggcctgcaactgtggccatcggcttgcccatcaggccacattgactttgttgcctgctaccacatgcgcgaatgcagattttctttatttttaattttatatttattaaaatattttgaaaaataattttctattcgaaaaatttatacagaactagtagcccatcgccccgacgattttatcgacgtggcagacgaccattagccctcgcctaacgaccggccaccgagagcaccgaaaatttacaggcggtcccattgccaccctcccagagggtggtttttggctctaggtgcccgcctataaaagggctaggagggcggcttggagtcagcaaaccggcatggcttcgccgcttcccttttgctctctctctctcgcccttccctccttttggattttgagtgaatataatgtaaaatcggagaggtacaaggggttttataccccgagggcataaaatcaccctcccagagagtggcaagggggccacctacaagtgccatgccatcctcgccacccttttgcaggcgacctcccgcacataaaaaaaaaccctctggaacgggacaaggggtccacctacaaaaatgctgggccgagcacctgcacattaaaaaatcgtataatcgaccgcgttgaataattcaaaataagacaagtttcaagtaacatcattcatgcactgtaaatcgacaactaagttttggacaacactataaggcaaatggctattgtgactaaaacaagaataattaactatttaccacgtttacaagtggtgataaagaatttgtcactggacccatatatcatagacacatgaggacccacatgttatagacagtgtcagattatgaataccgcgtacctaatagtagttgactaaatctcggcatgagccaccacataccatgtcctatatggaaacaacctgcggatataggaggagttccgggtaaggaaagacaaccagagttctacatggaaacaacaaggactactcggattgtatccatattggtttcccctagttctacttgaacaagagaacacctataggtataaatacaaggccccctatgaggagaggggatacgaccacctcaatcaacacccaccatagaagacaagaacaatagatcaagacacaagatcaacatataagccaacatacgccaagacaagacgtcggatatcgacttcaaggataagcacggctagtcccctacctggcacgccactgttgacgtttgatgtcgcgattctctcgaactagtacgtagcaatctcccgcaccgtaacctccattggtattcgagagatgattctactcgctcgctagttctcgaaccagtacatagcaatctcccgcaccgcaacctccattgatgttcgagagatgattctactcgctcgctggttctcgaaccagtacgtagcaatctcccgcaccgcaagcttccattggtgttcgagagatgattctactcgctcgctggttctcgaaccagtacgtagcaatctcccgcaccgcaagctccctggttctcgaaccagtgcgtagcaatctcccgcaccgcaagattccattggtgttcgagagatgattctactcgctcgctgggtctcgaacaagtgcgtagcaatctcccgcaccgcaagtttccattggtgttcgagagatgattctactcgctcgctggttctcgaaccagtgcgtagcaatctcccgcaccgcaactttcattggtgttcgagagatgattctacttgctcgctgggtctcgaacaagtgcgtagcaatctcccgtaccgcaagccttcattggtgttcgagagatgattctactcactcgctggttcgcgaaccagtgcgtagcaatctcccgcaccgcaacttccattggtgttcaagagatcattctactcgctcgctggttctcaaaccagtacgtagcaatctctcgcaccgcaacttccattggtgttttgttttataagagaggagaggtggctacatggccctatatgttttgttttattttttttcctgatgaggataccacgttagcgaaaccaaccatcgatccatactaccataagacttagtttaacccaattttataagttgtagggtcatactttctccatcccaaattataggatgcctcttcttaaaaagttaaactcgataattttaactaataatcatactaaccctatcttccaatcactaaccatatcttgcagtaaatgttgaataggggatgcatcggttcgtgctcctccatgtatagccgcttcccaagttcccaacctcctcctcagtcctcacgttcacatctcccaagaacgatacgcgtgggacccaccatccccacgccccaattcaccacccaagccgactgacagcgaggccccacacctccaaccccaccatccgaccccacacgtcagccacataacccaaaccacccctcgtacgcaaagaaaataatctccgccgcggcagcgcgctgtcccctctgcctctgacacgcgcagcgccaataacgagacaaacccgaggaggaggaaaaggatcgctggccccacctggcaggtgacacagccgaggaggggggaggaaggttggcccccacctggcagtgattcatcaggggccacgtggcgtgagggatttcaaacctggtggtggtttttgtccatggggtcagccatgatcgctgcggcctgagctagcccgaaacggcaaaagaccaaagctgcaaaactttttccctctcgctcggtctctcctctctcgaggagagtgcagcggcaggagtgggggtagtcgcagcagcggatcagacacacgaacagagagagagagagagagcagacaacgagtacttcgctttggtttgatttgtctccttcccgtggtgtgttggtggaggaggagaggaggagcatttgagattggagagggggagggggaggaggaggaggttggtgcagtactgctgggtgcggttcgggggagaagcgcggatgtgagaggtgaggcgcgcagcgtccagcgatcgaggagatcgttttgatgttgattcggtttggggggttttggttgccttgtttctcagattcgtgtgttttagttgggtttctcgtttttttcgaggattttcgccgggatccgtgtggttttggcccccctctttttgcgcgtttcgtttcctcgaagctctcgtcgcgagcatggcgtacgtcgcctctgttgctcgccgaagcgacgagagggggaggaaatggtgctctgtttccggtggtttcgtcgtgagatgttggggtttgacaagcgccgggttctcgctggcttccatttgcctggagttctcgtggattaaatatgccgttatgtatattgcgatgatgcggttttttttcgcttgtgctttttgcgttttgtgtgggtttgggaaaatttttaactaccttgcggtgctttcatttgatttctggattttggattgatttgcctcatttgacaaggatttttgaggattttaatcattccccgtgcaaagtaggggaatgcttgattattctcttttcctttttcagaatctccgttcggatttgtccgatgcacaagtcatccatgcgtactgctaatatgcgtcgtctagtgtctcggcgcttctggattgaccagtgctagggttttaggtgctgttcgttgatggcttcatgccttgttttcctttttttttttttggagatttgggcttttcgatgatttacgttcgtgtgtattccacctatttgtggtgccacgattcgaccaatttcagccgccgtgcgaaattttccttgtcgtgcctgcttaaaagcagaggcgactgatggattcgtggaattccatttttgtgaatctgtctgcagtttcagtcccatctcctggttcttccgcttgctgcttttgtttgaaaatgtttagcgtacagtgcggcgatggctcgagtttcgtgggtttctttctgtacagagatgatattttgtttcttgatttcgtttatgtgaggctatgggttttcggttgatgtaaacttgagcgaaatttatttatgtgttcgttgtgttcatctgtgtttcaagtgtttgaagagttcgttttgtggtttgattttggcaggacgcgagtgaagagacgaccgggagcatggatcgcgccaaggcagcagcgcgcaaggacaaggcggcggcggcggggaaggagaccgccgtgtcccgcgccgtcgcgttggacgacaccgcgctgctgctcgcggcggtgggaagcttcaggaaggagggctccgacgcgtcgcggatgctggaccaggagatgtccacgaggctgctccacctcgcctgcaagcacgacgccgtgcagtgcgccaggctcctcctcgagggcggtcacggtatcaccgcgtcacccgtggatgccagggaccagctcacgcggacgccgctccaggtggccgccgaggcgcactcggccaggtgcatcgagctgctgctctccaagaacgcgcgcaccgacctcaagctggtcgatggccggcctcttctcgcgctcgagatcgctctcttgagcagaaggtatgcacgctagctagtgtcgtccattgcttgtgatggtgatcactgagctcacttctcaaattctctccctgcaatggctgtttccctgtactgactgatgttcttatccagagctcaagttaaatggtcactggacaactccattgaggatcttctgtcttctctgcaggaaaaggtctgtatggttactaccaatgttcattcgctgtctcatcatagctggtccatacatcttctcacacagaaatgccaccttgttccatgtgtaggatctgaatgtagtgaggctctggcagagaaaaccagagaggttggggaggtggcctacagatatgccatggagggtcgtgttactgtgttggcaatgctgcttctggtggctgaagagaagatatcggcaccagtcagtgtagtaatagagggcgtcaggacaaagaaatcaatctactactctattgtggatgaggctctgtccattggggatgctccagcccgggacagcaatgagaggagaaaggccctgctcagtgagattcagctacttaaccaatttggggcagcgttatggagagatcgcaacattgacaagagaagcctgccccctctgcttaaagctgccaaggtacctctgttcatactgctgttcttgttgacagttcacagagctatttcagaatttccttgcttgacactttatgtggtatgcatactgatgagttacaattaataccatgtaagctgagcttttgagtcattttcatgccctgcccaatttcaaaactaaaatttctccaattatggtccatgcaagatgcttaaaatgtgctatgcataacaaggtgaagtttttagtgttacaactgtatacaccataagactttcttctgactgacctctcctgtaggttggagatgtaattacctgacaattcaggggcccgaatctgtataaaataccggcttcggccaacaggatgtagggttattacctgacaattcaggggcccgaacctgtataaaataccgctttctgtgaggaaaccaacgaaaaccaagctacaaccccttttcgatcgcatgtccaagaaggtggccggttggaaaccgaagtttctctctccggatggtcgtctttgtttgatcaaatcagttttgatggccattcctgtccatcttctttcggtcatgcagctcccgaagtgggccattaaagatattgaacgctgctgcaggggttttctatggaaagggcaagaagaagttagtgggggtcactgcctcgttgcttggcgagtggtctgcaggccggttgagtgtggcggcctgggcatcagggacatcgatcgcttcggaaaggctttaaggttgaaatgggaattcaacagactagagcaagaagacagaccttggacaatggtgcggtggaaatctgataaggatgttcgcgacatcttcaattcagtggcacagcacattgttggagatggcaatcgcactgatttttggagaggtaagtggctgccccgtggaggaagcattgcaaacaactggcctattcttttctcctttgtgggtcgcacgaagatcaccgttgcacaaggcctgctaaacaacagatgggtgagggatttgcaggggtctctctctaatagagctcttgttgattacctggcgctttgggatgagctgcagctcgtctcgcttcagagtggtgaggcagattcagttttatggcggttctcagctaacggggtcttttcggcttcttcggcttatgagtttctcttctccacctcaatcaaatgcccccacggggagctgatttggaagaccaaagcgccagcaagagtgaggttcttcctctggttggcggtgaaggggcgttgcctcacggccgacaacctcagcaaaagaggttggccacatgatcccacttgtctgctatgtcaatcggcgccggaggactgcaatcacttgctcgtcaaatgccctttcactaacagagtgtggcagcaattgaaggcttgggtgaatgtcacttttcctctccctgctcagcttggcatggaactggcagattggtggcattgtgcccgccgctgttttcagatgaggttcaggactgcttttgattcacttttcatgctggtttgctggagagtttggaaagaaaggaatgccagggtttttgagaataaatcggttgtggctgatcgcttagttgcagacattaaggaggaagtcctgatctggagagcagccggccttttctcttgcgaggagtagccttaagctctttggtgcttgtaaatagtctttctcagttttcttaatttttcttcttttattcggggttcttccccggctcgacagtctaatgtcgtgtaatactggtaactcttctttcatcttaatgaaatttggtcggcgtccttccgccgacccggcaaaaaggttggagatgtaaatgtcacaaagatgctcctgatgggggatgttgatgtcaatgaagccgatcctgaaggaaacacagcacttcactggtgccttagtggtagttcaagcacacaggagccaaggtatgctatcagaattttgttctatcaactgttaaaaacttaaaatacaacatactagttcttactgctctttgcattctctttacttagttgtcttatgtatttgtgcaggattgtgtggctcctgctgaagaatggtgccagagttttccaggggaacaaacttggtcttacaccagtacacagtgctgcagctaagggaaattataaagctcttcaggtagccttttgttgcttctactcacacgatggcattttttgagcttataactaattgatagtatgtttgtttgctctgtaagtcacttctgcttcacgctcaagattgcgttgatacaccttccaagaccaaagaaaccccattgttcttagcagtgaagaatggttctttggactgtgtaaagcttctcctgcgttctggggctagcaccaaagtacagaacctaaggtggtaatatttggatttaagaagaatattgcttctgtttgatggcttgatgcacttaccatcctgtgatcctttgacattgaacagaaagcaaagaccaatagatgtggcaacgtcccaagata

SEQ ID NO: 44900 - DNA, 5033 bp, Oryza sativa
  unsure (1)..(5033): unsure at all n locations
atgctactgaacgacttggagataggtacccattgagctccccgaagggtgatttcagagcaatttgcagaatggagcttgatcatagcacacttggttatcctaagctcagtgatttcatgcgctcccttcctggtatctgcagaatgtgtgtagtccctgtaggaagcggtcctgcaacacacaaggtcctccttccaccggtctcgcgaccgaagtatgtacccttgctagtaccattctcctttgatcatgatgagctcccagaatcagtgtcagatcatcagttcccgatgtctccacttaccactaatatcaccgaggactcccctcgtaacacagacagtcagcacggtgatacttgcagcgagagcaatgcggagagccagcaggatagtgcttccactgacaatggtagccaattgtacacttcaattgagcctgtatctacaagaaagcttgatgtagttgagcctctacctgcaagaacacctgatcgagttgaacctcagaagattggttctgatcctgcgagaaagactatttcccttgaatctggacttggtgtgcagattttcataggcaatggtagtgcaaatttgtcactacaggtcgacgtcaagaaagacgttgaatacatgctgatgttatatcaaaagagaactggaatcagcagtagaaatatctattttgtatacagagggaagaggctcaggttaaaccgcagcttactatcatatggtgtacagaaagacagtactgtgaatgttcgcagtagaattctggggggtgctggtacatcactggaggaatatttacacaagcacaagaatagtcttgtgaaaaaaaccgccttgtatgatggaagattcttcccagagttgacacccagaagcagtattcttttgagaacatgggtcttatgttttacaaaggcattcaaggagcgacattgctgggagcccaaatgtgaactctctcatttcaaggttatcaatggtcatgtcaaggttagcacaccagcaaaagggaacctcacaacgcattttctgcaagaaaatttatcttttctggcaaagacattaaaggatttcttcagaacaattggaacaaatcttgtctcagaatacccaccgtactttgaatattttatgaagtttatattgaaaatagatctaccatgcgtaccacatttgcagaaagttataattgaattgaacctatgctttatggattcatacatgagaggggtgctgacagtgagattgaagcaaaaatttgatagcctacctccaaaacaaagagccactttgatagataagatcaatcatatcacatgggatacatctcgaatgccaaatctttctacaattcctgtctttgataaaatcatcaaaaaagcaaaggatgatggagagccttacttcattgagaattcagtgaacttcgagtttaaggcgttcaatggatttaggttgagccgtgatgctcctatacatgctcctcaacacagatttgtaagtatctaacttgcttcagttttatttaattgtgaattgtttttattatgcttaatataatcatatccttgtcttattgcttttgtttgcttatccactaagtatcagtagtagtttagttgctcttttcttgttagtttactataaatatatgccatatgcttcgaataaaagatatagcttcaaaaaaaaatcaatcctctgttctgcttgctctctcaccctctactcacctccttcagttcattctcaacatattataggtatcacagtgctatttgtacttttcaggacaaaacatcggtaccttggaaggaaaattttccagataatacaatagaattgatgacacctgcttatctgggtgatttgcttcccgaaattatctggtgctttattctaaataaggtggacatcacagaggagtaagtatactgaactttttgtgagcttcttttacataatactttaattctaatccttatttgttgctactaatagattatcacaaagtcagactccatgctgtactatgtgccatcctataaaaacaggtaatatttacatcttgtctcatttatcttgatgttgcactctttgtaactgtgtaatagtttttgtgttagatgtgggtgaatatcccacgacacagcaaactactgtgcaggataaacagcctacaatggaagatgttggatcctcctcatcaatgcagcaaaatgtatggaagaaaatctggtaaggcgaatgagctgaagcttcacaacaaccaccaccgatcgagcaggagccggatgaagggtggaaaacagtagggaggaatggaaaaagtacatgttagctgcctcttccagctgatgaaaaacaggaaaagcttacaatgatcgtccatatgatttgaaaaaggggactgcagttgatcattgtgtactctttgtgcgggagttttgtaatagtagtgcttttgtattagaaacaccatgcttgcaaatagcttaaccatccaaactcatcagagggtactaaatgttctctctctttccaatcgcctacaacagactattaatgtgatgaaccttcaagttaagaaccgatattaactagatatgatgttgcttcctggccagtttgggtgtgaattatatttgctttagtttgttctgaattctgactattttcaagaatggcaaaaagaagaggatattttggtattacttttggagttcataatcacctattatttattactcttaggttatttacctgaccaattcgctatgcagnctgagagttcctggactcatatagtggtaattgtgcaattaatctggcactttactctaatcagttcaacatgtttatgtcttttagaagtagaatggccagttggatttgaatttttttttctttcaattatcatttatttttttcttttgtgtaaacacaatgttgtatagtctcagtgtgagtaatattgtcacctgaaaaatgaaatttttgtgccttcaaaaactttcatctgaagaagcattatcacattgtttctcctgctctggacatctttatttctcttttttttgatgtattccttgaaatctctacctgttctaccttttttcaagataatgttcatgtcctagcattggtccataacacactttgtggtggtcttttctggattggaggttttaacttttaacatggatgtcctgtttaattattagtgctcctttgtgccaccaaatcacaattaggaatctagcaagaggggtgaaaaccgtacggaaacggacgaaaaccacctttatcgttttcgttttcatacgtttttcagaatcggaaaccccggatacgaaaacggaattgaatattatcgaaaccgaaaatgaagcgaaaacgaaccattgcgaatacggtaacgaaaatttatcggaatacaaaaacccctcaaactgataaatccaattctcaagtctcaacggtcaacaattcatcataaaacataattatacaagtccaattgttaagtctcaacagtatatcacaaagcacaatctatggaataaattatctatgtttaagagagaaatgtcattgataaatcccaatgcaggaaataaatattcttatgtaacttcagatttgaataacaaatattttttaaaaaataacagccaaacaccatggtattcactgttcagtgcttaaaaaagaatccagggtatttcaatcacaaaatttctggaaagttttcggccgattccgagttcagacgaaaactgcccttatcattttcgattccgttttcgagaaaatatttccgaattcgtttccgtttccaaaaaattccgaccgacagattctgttttcgaaaataggttcggaatccggaaagttttcgtaccattttcaccccctacctagcaatgatttatttggtgcatgccttttagagcccacatatcctaatttactgtgtgtatagggttaatttgatctatgccattgcaaatatgtctattcaaataaatgatgtaattcgtctgtttatagctgtgccactcaaatattaaccaactgggccttacatacttcatacttcattcatgaaatccaacggacgaaaatcatctaatctaacgcctcagatcgtcccacatacccccttcaacctccgcacgtattccctcgccgaaaatcatgccgctcacatcgctcctcctcccccacgcgctccgcaacctgcgccatcacctcccatgccaccactagcgccgccccactccccggggcaaacctaatcgccgccgccacctactcctctctcccctgccgtctcaagctccacccccttgctcctcttgcgccaccactggatcactctccaccccggaggcaccgcgggtgatggcgacgcggcggcggtgccagaccgccgtggctcctctctgctctgccccttccttgtgcctcaccaccttgctgttgaaaggaagaaggaagttgcaaccactggtgtcagcgacgtcgactaaaccctagaaccaagctccagaatcgatctccttttgcttaccggtaatgggtgagccaattccgagcctacaggtacggactacttcctccctctctccccgacaatcacgacatcgattgatttatcccattgctcctgtgaacttggtgcattgtttgattcccaatttcagaatggcgtgtgaaattgcaagtacagagcgagcccagtcagtcatctcctcaccagcacggcggtacgagaagtttgggcacaacaagcaagcaggaggctagcaaaggtttgtcagctctaatccaaaaaacaacaccttattgcacatatgttccatgtatgtgaaagaccatatctactgtgcagacaacatgtgttattatcctatcgtcaaatctgatatacaaactatattgatatttcgagtgactgaataatcatattatcggtataggttagttcttttactctgggctgcagga

SEQ ID NO: 44901 - DNA, 8294 bp, Oryza sativa
ccctataggttcacatacacttgtactcaaattcgtggcattccaaggttaaaggtgctgattagtggtcgtatcatgaggtcgagaaacatgtagttattgcgatgtatagatacatcataaatctgagtaaatcgttaagcaatatacattctccattatttaattattgcaattgttaattatgcttaaaaacataatgttaatcatgctcaaccgtaatgctggcaactaaaaatattacctagattgacagtagtacagttgaacatttgaacaatacctagactgacagtagtacagtttgggtggtgaaggtctcattgctcactgatggctttctaaatcccctatgccgccgtaagcctgattatcgtagtatattatttctttgaggtgttataggtgatatgaatgggcatgtacactgttatggccggaataaaacctaggtttgatgcccatttacatatgaagaacacacgaattaatttgatcagttattatgctttattctgcttgtttctatgcactacaatgccaatttgagtgcctatcttgtcatgctattcagtgtaatgtcttggcaggctatgaatctgttcatgcgtctatatgcagccttcatataagtaaggattaaccagattacttgctttgtctaatgcagcctcaccatttcatttgtggtgagcaccttaattccatcttgacattgtcgagggagtatatcatctacatctaattctgtatattgagtatatattgactaggatcttggaatttttatattaagtttcttagtttgatgatttgattagtttttcaactaatcaccattgatcacaagtaaacaccactaatagaagtttaatggctatttatctaaaaaggaaaaaactaagtttaatgattgaaactgcagtggtactatgatctataaacaaataaatctgctgagtttcctagcagctgctgggtgcactttcctcttgttgtgtcttccattaaatttcaaaactgcaaattctttgtataggtattacggggactcaaatgtacacctttcagttcacactcaattctgtataacagtaaaagcgtgaaaatataggaaagataattgatttgttcagaaaattattcaaatgctaaggtaatcactttctcaacatatgtatatgtacaacaatgcataccgtttctacttttcacagttggaacctgaaatatcaagattctaaaactaatgtgtgtctgctgcacagttcttaaaacaatgctatggagtattctatgactaatatgtgtgtactgtacagttctgaagattgttcaaagtgtggggaacttccgagggaaagttcgtcaaaaaactgcaggttaccagtgttttggtggacattcacatatttatgcaatttgatatgctaaatgaatttactactaatacattacatcaatcttctggttgtaactggttcagtggaccattagagctttctgttgacaaattaaatgagctttgttcatttatccaacaacttgttttctttttctgaatcttgctccaaattttgtgtcatattattgactattattttttaaaaccatacaaataatttggtagattttttcccttttcgctggacaaccagaactgcattcaattgtatgatttgtatcttagtcctttgcaggtaaggtatcgagaaaatatcataatggaaacagaggaagtgatgtaattctggaccttaattgtgaaccttaatatatacataactagttgattccccgcgcgttgctgcggaaattggttggaggcaacaaaatacaaaggttatatttgaaaagaaaataaaagaggcttgtacaaagattatcaaacttttagagtggaccaataggccaatattttgtttacatgacattgtttctttacatagggcaatatttggagtaccagtgatgagaaaatacgaattaattaaatcaagaaaattatggtgatctataaagatagtcccaaaaactttgtatgaaggaaaaaacaatttcatttttataaaaaaggaaacatagattataatgcacccgatacagaaagtctactccaatattaatgtaagtaagacaaacaaagttgtgcatgtacgcacatctttattgaatgaatgtcggtcagcaaaaaaagtgaattttatttctcaagatgataatttctttgtaagcctaatactttagtgcattatatctgtgtaattatgctacatccctaaattctgcataccaaccttgattgcatatatcttgaattgacaacagaattgtttgcatacctgtgtacatgtcaagtcttggcatctcagtgagcagtgcttgaaaataaattatgactaacagcaaaacactacttgattaggttccaaagtaaaccaaatcatcggtacatatgtagaatgcaagtaaagcatacctgggagtcaaatctggtatgccttgaaataggcaaatagcacaaaattcctgggtatcaaatcccgcttgaagttcgtttacagataaatatggcaaattgtaagtaaaagaatatttttatctggttcttggaattattgtcaggcctttggatttctgatataagtataaaaattttcaatacagaatgccttactggagtagcaggtcaggactaactttgaacccatcatgattcatgattcatgaactgaatgatggatttatacatcactcaatagtttgcaatattgaacacacacctgtgtacatttgtatcaggtaaatatgaaatagaagtgaatatccacttacagaagagagattagaagtatgtattagcggcagtttgctctaaaaggttataaaaataaatggggacattggaataggaatagtcatatacttgtattcctgtacacggctatacgatgaatcactgaatataatcgatagccactaaaaaaattgaacaccagaccatttgagcaaggccattcaaattccataccagcagcaaaactatagcgtagaaagtctcacatgaaagatcttgtccaacatttcattcaacaacataagtacctataacttggcagagatagttatatcctgttaaagaagcagagaattgctcctaggaaaagaagcaggagaagagaataatcaggaaacaggaaaacatcaaaattaacagaagtgcattacctaatgtattgctgccggttagaaggattggataacaaaggaaaaatgaatccgcagaaaaaataaattgggattaggctgacataaaaacgaaataggtgcggcaaaaaggtatgcaaaatagcaacaggcagatgagctgattgcctgaatcaaatagagaaaaaaaaaagaaagagtaaatcagcaagtgctccttgcgtgctatagggccatggatgctgaagcttggttctggctatggatgttgaatagtggttcgtaggcaactggcgatttggatcttatagatgggaagagagacggcaatgtgcagtaaagatgagaagcgagaaggatgataccaaaggacgtaagaagggaatatgaggcatcacgggagagacgggacggtgcagtgacaaggaaggcgatgcggccaggggccagtgctggaagggggaaggcgaagcgtgaagcggaggccacgcagcgtggctggtgcatgggggatgggggaggcagtgcgatgcggggaggggaagcgaccgcatctgtggccggcgcacgggggtggagaagagagcgcggggtgaaggagaagggaggggaagcgatggcaggcccgcggtgcagctcgcgcgcgcgcgtgcacgggggcggagaagcgagcgcgggccgcaggggcgaaggagaaggtaggggaagcgccgcatccggtgcggcatagcctgtgagcgatgcggatggggtaggagaaacctggaaagagaagcgcattgggcttcacgcatctgcgaccgttcagattagatctaacggctgataattaaatggtgatgtggcttaaccacagatcagctttgggtcttaactatatagaaagaagggatacttatttcaggaagacagacagaatacatatttcttaattccgaaggcattcagaatgtttattaaagatcattactgctgtttttaggaaacatattacatcagcgttgtcacgtttatgagctgacatagagtgatggtgttcatggtttcaaacgataatatatatatatatatatatatatatatatatatatatatatatatatatatatatatatataggagcatgtaaggcaaataacagggattttggccaaactgacaaaccaaggaaagagataaaggtttcttgaatattataaaaatacaataacaccgtagcattagcacgggcatattactagttttataaaattgtaaccatgccatcgccgtcacgttttccatcttcttccccatctgcacgtggggcccacccgtcagattcatcttcttcctccatcctctcctcttttctttttttcccacttctctccaccatgttcatgatgttcgccgtcgcgccggggaacgggttgccggcacggaggttgttgtcggcgtccgtcaccctgtgcaccaccttgtgcgtcggcttgccgtgctcgtccacgccattctctgcaaagatttcacatttctcactgtcaatttgacaaatgaactcatccaatctagggacaacatctgtttggatttaacaagaatggaccaaccaagatcgaagtagtcggcggctcgacgccacgggggagggcctcacggccgaggcaatgcggaggccgtcacgccacatgtcggggtccctgaccgccgacacgttgccgccgccattcgtcttgagtctcttgacaaactgcgccaccgagtagcacgagatggcgaggacttgacagactgcaccaccgagtagcaggaggccgaggagagaagtggtgtccgccacaggcccacgtgcatgggatgaggccaagaagtggtggagagagatggaaaaaaaaagagaaaagggaaaggatgaaggatgatgatgaatctgacgggtaggctccacatgtagatgaggaagaagatgaaaaatgtggcggtgatggcatggtttcaattttataaaatttgagtggcacaactaaaaatagacgaattgtaatggcatttatttgaatagacatatttgcaatgatatagatcaaattaaccctatttttttttatgttacccaatcactaatactgtaaatctaggaaatccgtggtagcgtgaaatacttcctccgatttttaatatatgctgttaatatatgaaaacgttgacttttatacatatatttaaccatttgtcttattcaattttttcatacaaaatataggtcatgcttaaattttttaatgataaatcaagtcaaaagaaaataaattatatttattttttttcaatattatgacgaaatatcttaagaagtcaataacatcatatattaaaaagctgagggattaccatttttggtccaggacaacacagtgccatggcatcttcctatctgtgctggtaaactaaaattacgaactcaattagaaatcacaatcctatctgtggaatgtgctgtcactgttcaattagcaaaagtttccttggtgattcttcagtaatgatgtagggtatcaatgatacagaacagaaggcatataaagtcatgcacttatgtaacttgatgaatgatctgaagataattgactagagattgagctgaatgaagcaaacttttggttacacaatgtcaggattcctattagttagattctcagcccaaaactctgaatattttttaggagtctgggtgaatttggcccccggatcctgacaaaaggtatcagagctactcggttcttggccagatccatcgaatttggaggtccttcgttggtgagggtttgaggacgagttcctctgtaaaattccatagccagatccttgagtccgattcggggatcaactactttaagtggtagcagggagggttggaagaagccgtaggtagttttcttctgtaaaatctctgtacctgttgttgctgctcatggcgaggggtggccgtcagatggaaatcgcggtagaggaattgagagtgaattttgaggagtttcagaagaaggttggggaagagaataagatgctgcaagagcagattcagaatcaggcagtgcaggctaagaatcacaaggacgaagtgatgcaaaatctggaggtgatacaagatattttgggatctatcatcggttgtcaagggcaagatggtcgaggtacactctgtcgcccgggaaatgctcagtcggtggcccctgcaagaagagcaaaatgtaaagctagactcccccaaattcttcagcttttgatttcataggagttccctgcccgatgcctaattttgaaatgggagaaacatatgccatacacgctcacaaaaccattccaactcaatcaccaccaccccccacaattcatgtatgtactcagaatacctacccaaatctggagtggaacacttcagtttactttggaacaccacctatacctccacctccacctccacagtatagaactggccaattgatgaccaatggacaaaaccctaccttaccaccatatttctaccctccctatcaatctccttggggttatcaaccaagtccaccacctccacccccaccctcctttgatttccaccgacctcttgatcgtggaccaccattctggcacagacaggaggagactcgttatgattctgttgatcacagttacagaaaaagacctcaatatggtgacccttttaatcgtaatcataagcatgtggattttccggtgtttgatggggatcaccctgagtcttggatctgaaaggccaacaaatacttttctctggcccgtacccctgaagaagatgaagtgcctttggctaaagtgtacatcattggcaaagcagatcagtggatctcaagttatgatattcctaccgatactctttcttggcctgaattttgcaccatgttgtgccagcggtttgcagttaagtcagtatggctcagtagacaattacattgacaagtttgaagaaattatgcctcttgtcaaacacaataaaccccatctcaatgaagaatacttcttggaatacttcatcttaggactgaaggatcatatcaaaagacctctcaagtctttgaagatgcaagcttatgaacatgctcacaattatgacagccccaccttctcttctatacagccagctggcactgctcattcttaccctaaagtggctcttaaggattcccctatgcaacctgtcaagaaggaaccaatgcaaacagacgcaaatctcttcctgttgtccaaaccagaggagggggcaaatgcttcaaatgccaggagccgtgggtccctggtcatggaagagtgtgtaaagtaaactaacaactttacttggttaccatggaggaggatgacctaccagttgaatattcaggtgatgttatttacactactcctgacagtcctactgaacctcaaccttctcctgaagtgtcgctgcatgctttgaatggtctaaatgctggtataactaccttcaccttgcaagttaaaattggctctctccttgctactgcactggttgatagtggcagtactacgatattcatgtctcccaaagtgaaggtaagagttgcttgtgtaaaagcaatttcttctatttgacttatctagccgtgtcttgtcttgcacatactcggctcagtgaatggttcatcggtgcacaaggcaaatttggaaatctccaaccatcctccaatttcagtaacaatggctaatggaggcacattgtccactggagtctgtagctcagtgtgtccttcaaccatatgaaattcaaggaactgtttctgtcacatcttttcgcattttggatatcaagggttatgccattattttttgttgtgattggatttatcaagggttaattggatccatgccattacatatttaccaattttgaaaaataccattactatttatctatttgaagccatgccattgaattcaatatatttgataatatatgccactacttaccccttcaatacattttctgtttttcttgaccaaattacccctatcttcttcattcatcccctttccactctctcatgtcatcctct

SEQ ID NO: 44902 - DNA, 10893 bp, Oryza sativa
cgacgtctcgatgagctcaaaccgctccaggtagggctcgccgtcgacaacacccgggtccaccgcgtcatgtgggagctcagcatgtgcaacttcggcctcgccaccgacggccacaatgctcattgtcctacctcgctgccgcggcctcgccttagacggcctccgtcggaatggcctctcggcggtcgcgctcacccacgtcctcgcgtgcagcagcctcattgcgccgctcccgcccatcgtcgttggattcctcaccacggcgcgttggcgcggcacctgctcgggccggaggtagataagaagagaggaaaggggctgacgggtggggtccatattgttttccacgcgtgcacaccacgatggcatgccacgtaggcaaaagtggcaaatagttaagaaatcacctctctccagtggcaaattattaagtgcaaacctaagaggggcatttggataagtgcctaacctaaaagtggcaaatagttaaatttccccaccattggagctagatctgagtatgtggtggcagtggaagaggcaacaggaaccgggatgggggtgaagagcaacacgtcgagcaatctgtgggatggcgcacagagatgcagatggggtgatgttctcccagcgggaggaggtgatgcagtgcaggcgcagcaactagtcatgaggtttctacggtttttttagactggtcaccgggggggagagcttccccacctgaattttcatttaaaggaagatcgaatacataaagtcatgatacatttgaacggagaggagaagagagaatttgtttccaggactccactactatcctgtcggtacaattcagtctttcagcccagagagtggcatcctctatgcacttagaagctaaacgattaagtgaaggggattcccctctgaaaacaacatcatggcgatgattccatagtccccataggcagagcaggaagaaggtgctgaagtgtttatctggcagactaccgcttggttgtagagagtgaagttccctggtatcactgatgtttgggacaattccaatcttcagccagaaatcaacagcgaaggggcaaaggaagcatagccgtttcttcagtcaggtgacagagatcacaagatgccgattgcacaatactccctccatattttaatatatgacgcagttaactttttaatcaacgtttgaccattcgtcttattcaaaaaatttatgtaattatcatttattttattgtggcttgatttattatcaaatattctttaagtataacataaatatttttatatttaaacaaaaaatttgaataagacgaatggtcaaacgttgttcgaagagtcaacggtgtcatacattaaaatacggagggagtatctttttgagaagattacctttcgttgggagtctttcctttgacagaagccaagcaaagaactgcacctttggcagggcccggatcttccacacaaaagtccaattagggcttgataaatgtcttttgtgcgcaagatcccccttgaactcgtggggtttctacggttgatcgatattggagcttgagaggatgataggatagacagagacgacggatcagcaatcaaaagaatctggagggaaactttctggctagctagctagtggcaccagccatggatatcatttcaggatttgggcggttgcattgcacaagacaagatggtttgtcgcatcctttctgctgcaccccacccctggtctgttcctgcttcatcctcccactgccaccactggcgccacctgcttcgagctttagctttatggcaccgaccatcagatccagcttcggtggagaagatgaacagtagaaagatggaaattgaaaggaccttaatgtcgcctagagggggggtgaataggcgttcctaaaaattatcacaacttcatagcatattagaatgatgagaactttcggttcaaatagtaacttccgatatgagattggaagttccggtctcaaccgaaaagttcggcggataatgaaataaaacactagctatgaacttgtagctcaaataaagaaaatgtatatgaatcaaaaggtgacaaataaggtatctaaacaagatataaggtcaccaactaaatcaattaagcatgcaagtcgatcgggtaaaaacaagctcaaacacaatatgagagaatgcacaaatgggcaaaccaagagaggagacgcgtgatttgtttcccgaagttcggttccacggatcctacgtctccgttgaggagccacaagggccgggcctatttcaaccctttcctcacgaggttgcacaaatgcactccttggtttcactcttgatttctttccgtgcagaggtgaaatcgaagctttcacaaactttccgtggcacaccacaaccttaggtgctcaccggcgacgcctagccgtctaggagaccttagtccccaagagtaacaaacacaatcgaagatttgcttgctatgaactcgagtgctcaaagtatggagtgaagctcactagctctgaacttctcaatcactcaatccaactctttccccttctcaaatccctctcacaaagagtcaccacaaaggatggagtgaagctcactagctctcaactcctcactctctcaatcaaactctcttcccttctcaaatcctcctcacaaagaggcaccacaaaggtagggaaatagggatggctattgggctttggatgtgtctaatactccccaagagcagcagcccctcaaaggaggggtggaggagtttatatacccgagcccctcaaaaactaaccgttggaggccaagactgtaattttcggagtttccgaaaagcattttcggacaagtttgaaaacttactgaagcaaatctcagattcacagccattttcggaatgtccgaaaattttcggagaaattttcggagtttccggtaatttttcggactttccgaaaagcacagagtaaaacgactataacttttcgctcgggagtccgttttttatgaacttggactctatggaaagctcactcagaggactaccaaactcaaccaaaaacaaggtctaaaaccactcaaagaataggttaaaggttgggtttctctcaaggtagcactatgataggtcactttgagcaccgagacatacacaaacatctcgacgtagcatccctcttaatagtacggcattcctaaactcaaatgtaaataagaagataattataccattaggaatgcctttttttcatctttctttcattgtcttgagggacgccaatgccgataccgtttcaccatatattcttcaaatgattgatgcggttacttgtagcttcaaatggtctctcacggtccatcatgacaaagccgtcacttgcccttcaccaccggatttggttcttcggcgccaagcccccttgcttgcccttcaccgccgcatggtccatcgcgaccgagcatcgcttgcccttcaccatcttgctataatagccacttcgtatcacacatcttcaatatcttcactttgtcattcttggtattattaggtgtaatgatatcacttgagcatcaacacctttgtaatccttgggacctatttctttcattcaactcaataaaattattagtcccaatgatccggttgtcaacctccacatgttgaccaaccgatcgcatgtataaaaggatatgaataaatgatgagtattaatcaacaccacaagtgtcatatactcaaatatatgttcaaatgtaaagatcccaattaaatgaaggtgaataacttggatcgattacatgcataactaaagtataggatttgctccccctaaatgtatgcatacaaaatatttgtgtgaagcaagtatatgcataacaagatattaaacattgagagcttatcctatacaagaatagaaggcatttctcaaatatagatactaaaaaaataccttcatcatctccacgttctcaatgtaaatagactaaataagagataatactcaaacaaaacattagtcacacatgcatatgccaatcacgtggaaatattatatacgatcatatcaatatgtacatgaagagaaagagtgatacatatagcttgatctccatgcatttcatccttgtgatttaggtccaccaacactccactttcatatccacatgagactaggcaaagaaatgcttataaaaacattagtctcacataattggatttgttattaatcatcaaaccaaatcaatggcacttgaactttcagaaatgaaggatgaaaaagggtaatttggtccaaaaaatttacaatatgttttgaacgggtaagtagtggcatatactgactaactatataattacaatggcacgattccaaatagatgaatagtaatggtatttttcaaaaaatgataaaattataatgacatggatccaatgacttaaatttgaaaatatactgttcatatttttttctcataaatagtcttgatataaacttcttggcacaaatataccaccggtatcgctaaaccattgcgtgaaactgacgtgggctgacgacacgggcggtctcgcatgaagaggatgcgagaccgagcagtctcgcatggtgagtgtgcgagagcgttttgaaaattgaatgattaacgattaattaataataattagtgatcaattaataattgattaattgctaattaagataattaatcactaattaatcagtgattagcggcaaggatcggtatcgctacttgagtctatgagaccgctcgctctcgctggttgagcctgcaagaccgctcactcttgcgaacttgccgcgtgacaccgagcgatctcgcgttttcattgtgcgtgatcgtaatatcaacggtatatttgtgcaaattaaattacaacccgaatatttctaagagaaaaaaaataaatggtatattttcaaattttttctggatccaattaacccatttatgaacatagcccaattacattggggctgtgtttagttcacaccaaaattggaaatttgattgaaattggaacgatgtgacgaaaaagttgaaagtttgtatgtgtaggaaagtttttatgtgatggaaaagttggaagtttgaagaaaaattttgtaactaaacacggcctggatcttcataccataacattgactctgtccctcaatggttctataccacttacactatcatttaaagccacagtacctaaaggcaattttatggtccaagctcatcaactggacaaactgttgtctcagggggcagcaggagctattctgattgttcagcaattgcagtgttctgcttacaagctactcctaccccaccaagtctcttgccaattgttgataattaccatgatgtttttgctgaaccactacacttgcctcctagcagggattgtgatcatcctataccactagttcccaatgcaaagccagtaaatgtgaggccctatcgactgccccatcataaaaagaatgccctggaggatctaataaaacagttgctggattctcaaactatatgacccagtgtcagtcctttctcttccccagccatccttgccaagaaaaaggatgggtcttggcgcctttgcatcgattacagacaactgaattctcagactattaaaaacaaatatcatatccctgccattgaggatctcttagatgaattgcatggtgataaatatttttctaagattgatatcaggtcagggtaccaccagattcgcatgcacccagatgatatttagaagacagcttttagcactcacatgggtcattttgagtatatagtcatgccctttggattgactaacgccatgccacatttcaagctcttatgaacaagttgttagctccctttttgagaaagtttgttctggtgttttcttttttttttatgatattcgcatgcccccggatcctgacacacaaggggtttgtactgatctaaaattccaaacgtatttcttattcaaatattccaatctagactaggattgcttacttctgttgaacccagactatcagtgacaagcggcatggtcatgatcatatacttgatgatgcctatggcccctggctgattctcttctgactaggacagggtggttctgacctaatttgacagccagagataaatcaaaagtcttgccaaggatgccaaagcagtgcagcatcagtacttggttactggagtacctaccaactgtaataaactgttatattggaaacatagctctttttgcctgtgtgagcagcaagtgcatatagttctcttttaaactaggggattccccgcgctttgctgcgtgaattactaagtaattttcaatattatttttcgttacaattcagctaggagtaaaaagaaaaaaaataaaatcttagggcttatcaatatttatcatgaaacaaatgaaattcgcactttaatgtagaacatgttgataagtatatattaaatattataaaaatgatagagagatttgtaaaactattgtggaaatgatgtgagaggtggtgattgaatatgcttgcatgataatttgtagaattaaatagattgtagatgctcttgcatgcttgcatgatattgttagtgggtgatgatgtggcatggttgtatgttaagctttagagttagtgggttataactttatagaaagtatagattagtgggatgaaattatgttggatgataatttaacatgtttgtatttgaaaagctcttaaattataaaactataaagatatagcatgtttgcatgatgtttagatgtgatgattgttagtggatgatgatgtggtatcttgttaattaatgaatgattatgcggcatctttgcacgttaagtttaaggagttagtgggggataactttatagtaagatatgataagttcatctcaattttccccaacctttgacaagcctaggaagctaggtgtttctgctgatctggcctggaatgcccacttatatttcgtcgcagcctcataatttggacaccggagtcgctcaatggtcgccgtggaaagatcgagctctgttccgacctgatcggccgccgccattgttgctgctcccaccccgcacgtcctccgagacggcgttcaggtcgtcgtcaacctgttcttcctcctctcctcgagcatgagcacgaaggcggcggctgctctctgatgaaccccctgtttgaaccttttttttttttgttttggtttaaagatcaatcttcttggtgcaatgacttgacggctttgaattgataaacccaattggctcactttttttctggttcacctaatgatattgggtggaattattagatattagtacatctcaaagatagagtagaaactcaagtgaataggttaattgggaggtagggcttatggagacattgttctagcatcttatttctaaatttgccaaacagatcacaccatagttgcctcattcagatcttatactacaagaccacataaatttaggcagtacatatcaaacagaatcattatctaaaaaaaacatatcaaacaaaatggaaacacacttgccagatttgagcaaattattcttcaccaactactgacatgaagacatcatattttgcatagcttacaaaacaatgttcaggattccaaatttttagcatggcttggttgaactgaccgtttcagcagaacagcaccaataataaggtaaacgcataccgaacatactgatgttccaacttttctagcttaatccagtgacttgcctggctgtaaatgtaatgggctactaaggcttatggagacattgttttaacatctgcatcttctccaagacatgagcaaaatttgacaaacagattacaccatagttatctcattcagattttagaacaaactacgtaaatttagcctgtacatatcaaattcacagtatgtttggatgggcctgaatccacggtctacttgcgggaataagttcacccgaggtccctcaacttaacagcgagattttttgaggtcccttaatcacaaaaccagaaatttccacccctaaactatacaaaactgttctcaaggtccctaggcagtatatatgggtgatttcgctgatgtggaatcctagtcagcaaaaaaaaaataaaaaaaatatacgtgaggcccacatgtcagctgcacattccttcccttctcttttcttctccttctcctcttttctttcttctcctcttcttcttcaatgacggatcaaggtcagcggccggtgggcggagcagcggcgggcgagcgcgccggggtggcgaggagaacgacggagaaggcgagtgaggcgggcggcgaccttgctcccgttcgcgtgcgtggagttcctccgaccttgctcccgtccggcggtgcgtccagggcgcgcccggcgctgtggagttcctcctgtccatccactggtggagaaagggtttgtagtcccagttggtaaccctctgtagtcccggtttttcaaccaggattacgaatccgggactaaatatgtctatctttagtcccggttcgtaacaccaaccgggactaaagtttttttttcttttttttcttttctcatgttcaatctctccaaatcattataaaaataacaaataacaaatcacaccacaaatcacaaataactttctcatgttcaatctctccaaatcattataaaaataacaaataacaaatcacaccacaaatcacaaataacatatagcacgaatcacagatacacgaatcatagatagttcacatatcacatatctcctaatatcattcacaaatcacagatcgcatcacaaatcacagatcgaacaaatcacacagatcgcacaaatcacagtcatccacatcacattaagaagggaaaaagaaaaaaaaagcaaaaaattccatgccgggcggcccgaggcgctgcctgccgccgtcggggcggtcctccgcaactgccgcggggtggcccttcacgactccgctgccagccgccgcggggcggccctccgcgcctccgccgccggccgccagccgccagcgcctccaccacctgcctccgcgccggccggcgcttgccaccgccggccctccgcgccggccgccgcccgctgccgccaggaagacaggggagagaggaaggggaggaggagaaggagtggaggggaagaaaagctaaggataagactgaggaggagggtcagacaatggacacgcgaagagataaacatcgcgcacggcttggggtgatttttagtcccggttgttctaaacaaccgggactaaagatggatctttagtcccggttgtttataccaaccgggactaaaaataattggagcctgatacgacctgacaacctcttcaaccaggagtaaaaatgatctttagtcccggttgggactaaagatcaaaaaaatacccctcagcttttaaaccgggactaaaaatattttttagtcccggtttttattggaaccgggactattgtggaattgagccgaccgatcaaagatggtttctccaccagtgatcgtcaaggagcagcacgccaccaccgtggacaagacgacgtccacaccgctggttcgttctttctaggaaaatatgacgtgcggcgtgcaggattcggcgaaggtgagctcgctggaggaggcggctctgagcatcctgcattcacttaagctcttcgaggagagcttcaatagggtcttagagggcagcggcggtgaagatttcttggaaaccttggcgtgcgtgctgcggccgccgagctacctctcgtggccagcgaccgagcgacgcctccttcttcgcctgcttccgccgacgacgacctcatcacgccattcccacccgctgccctcgtctcctccgccattgccgctgctggagcttgagctggtcgtagtagagcgcgctcagcgcctcagcaccgcctaaccagtacaaaactgttagtggtgtgcatgcaatgcatagcttagttagctgattagttagagctagtcaatacatgcatgtgtcgcatagcagttactagcttcgtgcatgcggctagctagtggctgccaaattaagtggatcgcgtgctgcgtgcgcgtacgatgtggccaaagtttgtttgctttgctatagaagtcatgtagtctcggcttccggcttccggctccggccgttcacgccgcccggagatgatgcggcgcacgttgtcgacgttctggacgcgctcaccggcgccgtcgagcgcgatggtcagcaggtcacccgcggtggcctgctcgagcaccgccgccactcgcgcggggctccaggtcgcggcacatcttgggagccagcaagagatggcgccggcgaaaccacctgccgctccacccgccacccaccgaccgctgccgctctatgctcgcgccggcctccctcactgaagaagagtgcggctgatatgtgagccccacgtactttttttaattgtttttgctgactaggatgccgcgtcagcgaaaccacccatatatactgcctagggaccttgagtgaacggttttgtatagtttatgggttgtgatttctggttttgtggttaagggatctcaaaaaatctcgcggttaagttgagggacctccggtgaacttattcctctacttgcataattcgatgggccggggtagggaaaattcacggcccaatccacccagaagataatatatggactgataaaaaaaggaaaatccccccccccctctcttttctactccctccgtcccacaatataagggattttgagtttttgcttgcaatgtttgaccactcgtcttattcaattttttttt

SEQ ID NO: 44903 - DNA, 2626 bp, Oryza sativa
gactcaaaatctcttatattatgggacgtattatgggacggagggagtagcttgttaattaggttccttgtgtatattcttttcccagcttataataagtggtaaaaaaataaacgggtcaaaccgatcagaataagagtaaattgtttataatataaagacttattttcttttagtgttttttttagtaaagacttattgttcttagtaagatgtaccatggtgtttttttaatagataaaccaagacatttttttctcaaaacgtacaagaattgtgtttcatttcatcaataaaaaattcttaaaatcttaaatggctggagaaagagtatcctattggaattcaggatataataatttcataggtgaaaaaaaaggaggaaaaatggacgctatagcaaagtgcaatgcggtgtatcactaaccactactcaatgaacataacaaaatcaagtgcaaggggaaaggggataaaaggagatatttttatgcttctgttcattaatccacataattttctcgtcaccgaattccaatacaaacaccaaccttgaaatcctgctacacaactgaaccagcaaaagtgccaaaacaaaatgcttcttacaatatgatgcgaaatatgacacattcatattctacaaaaaaacttgtcaaagtgcagctattgcctattcccactgcttgccccacatgcatttccaaaagactgcatggagagttcagctcctccaaacaatatggaatttggtcagtatggatactgtcactgcagatatcatctcatcttcatcacgacgagccgacgggaagaagcttgataatggcagagatgggcatcccaatgaggccaaggagaacactggcaatccactgcagcctggtgagtggtatcgtgttcgcaaactcgccgaggaattgcaccatgatgaactggaagactaccgtgctggtgagaacacccaagaagacgtagttcttcagtatgcccctcagcacgttgatcttctccatctccctggagcttatctcattgaacacctgaaatagcatataccaggttagtttatcaggttggcagtgaaacaattatcatcttctgttggactaccctccttatttcaacaaattatgacagatgtattgcaagagaaatggatcttgaactgctagtacagagaagagaggattgatgttattctgggactaggggtgtttggttcactacctcactttgccaaactttgtcacactttatgagcctattgtttattttgtttgccacacttatggtcccacatgtcatgactcggtttttttgccataccctgcctaaggtgtggccatcaatttgttagccacacatctggctagacatctgttaatctactgactgaattccgtcatagtgaattgccctttttataagcattggccctaacatatcggcatctaaaacaatgtggatgctaactggagaaaagcaggacacttcttttaaaaaaatgttgattaattaagtgtgcaggtgatggactatgaactaattgaattagtgatgaggcctctgcatgcatagggcaactttgacaacacccgtactcctagccgaagaaaaaaagaaacatatttggtatggtacacatacctggcagaagacaaacgagttgaaaataattgtatttagcacaacttcagcatcagggccatcaaggccaaacatgcttttcccttgcgtctggagataccacataacaatgaattggtagaaagactgccccagaatgttcctccacataacatttgtgataaatttccctgttctgcccactggctctctcttcattaagtcatcgttaggtggctcggtagctaatgcaagggcgccaagggtgtccatgatcatgttcacccaaagaagttgaacagctgtcagaggtgcatttcctgcgattgcataatataaaaggtcaggagaggatatccaaattctggagttaacagaatcatcaatgatatgaagtatacctgtaaagcaagctgaagagaagttgacaagtaaagccacaacgttaacagtcagctgaaactgcacaaacttttgaatgttgacgtaaacagagcgtccccatttggcaacagtaacaattgtggagaagttgtcgtccagaattatgacatcggcactctctttcgccacctgaataagcaagcattagttactggatgacataaataaggatatttcagattaccaatatttaggttttgtatgggtgtatggtgctggataaattgactaaatgcatgacttgaataaaaaattataaatcatgaaatatctgctagttgattaataccatttagtccatccagtcaaaaacaaatgatgttttctaaccatatgtttctaacatctccgaatgtttatgttggatttacaaaaaaaatatgaataaaaaaatgcttacataatattaattctactgagttttatcattatcgcaatggaaattagtggtcaaagttgcatttgctacgccatgtcaacatccaaaaatgacacacagttgtgaccagagagaatagaactcgaagttttcatctcttcaaatggttaaata

SEQ ID NO: 44904 - DNA, 3374 bp, Oryza sativa
aagtggtgatgatcgggccattaccttcaatacacataatcaccaagaattatgtgggtagggatatggtaaaaacttaagtcaataaggtaatatatgcataccgaacctgaattttcaagaatcaacttgagtagttcatcaagacttttgtctctaaactagatccctcaatagccaggccatcttcagtaagtatgccacattcacgagcgatcgcttttgctgtatttatgttgtcaccagtgaccattctcaccataattccagcagatcggcaggttgcaacagactccctcacgcctgggcgaacaggatctttaatacctacaatcccaatgcatgtatacccttgcagtggtatttgttcttcaacagaaaagccttcttccatttcccgataaccaaggcacaatgtcctaagagcttcattagcaaagctttcaataatcccattaagcttgtcagcagttgttttatcaagggggacaacagcacctgtctcgtccataaacttatcgcaggcagccaacactatttctgaagcacctttacaatgtgcacggcatcctcctccaggaagcttaagaacaacacacatcctcttttttgttgaattaaagggttccattttcacaatcttagtttcatcacgctttgccttaaaatttccaccaagtgacaatgcaaattccaacaaagctgtctctgttggggtacctagaatctgatatttcccatcttggtcaatcacaacctcaccaccagtattgttaaaaatagactccagaagggttttgacaacagtttctggaagctcagaacacaaatcagatgcattcttaggattgttaacttcctttatgtttccacaaatgcaggccttgacaacagtcatatgattggtcgtcagtgttcctgtcttgtcactgcagatggtcgtagctgagcccattgtttcacatgcggctaagtgacgaaccaatgccttgtcattcatcattttcttcattgcgaatgccagactcaaagtaactgctaagggtaacccctcaggaacagcaacaacaacaatggtaactgcaatagcaaaatgctctaacatttccagtgcatcgtctcctgaccagcttaaaagcagcccctcatggtacttcttgctgattaacccttgagaaaggacaatgaaagttatgactgcgaaaaatagaccaatcttgcctataatagttgcaacaccattaagcttgacctgtagtggggtttcatcatcgccaccttcactgagagtagccattagttttccccattgggttcgcatgccaactgttgtaatcagcatcttgcaggaaccatcttgaactttggtccccgacaaaagaaaaggattatcttcatttacaacaacaggttcactctcgccagtgagactggactcattaatcagtagagaaaacccagaaatgaatagcccatcagcaggaacctgatcaccaattgctaaatggacaacatctccaggaagaagatcatatattgatagcctttgtctaaaaccattccttgtgacttgcacttgtattttctttttctccttgtccaagtccttgaactgtaaggattgccgatagtcacttgttgcggtaacaaacacgaccaagaggatacttgcaacaattcccagaccatcatgagcaccttttggccatccttccatggcaatgccaacaaccaacgatacaaaggcacagacagcaagaattataagagttgtatcttgaagtgcttcccatacaaacacccaaaaactccggacctcgctttctgtgaatttgtttagtccatatacatcttgcctgcgcttaatgctttcctcagctgtacttaacccatccgctggtgatgtcgcaagcttgtctgctattccagtaactccaccgtgggtgatcaactttttactatcatgaccctcaacaatagagcccagttcatcagcgcaaatctgaaaccctgcagccttgacttcttcaggaacaacatactcacttcgaagtgaaagacctgagtatttgtatttttgatggcatgtttattaggtactaaaaatggtcagaaatataagaaaataccaaaacaaggcacgttctacattatgaaacagcatccaatcattacatgattaccctgtataaactgtagtgcagctttcgataccagcaccgcaacccgcagtttctcctgttaaaaccatccacagtacgaaattcagtaacctcttagaattaagtgcgaaaaataagcttagcacgctctaggaatgcagcagcgtgagcaccgaaaaccttccaactataacttctcgaaaatccattcgtgagtgcgaagctactacatagctgcactctggagtcaattaaggaaaggatagtaggctctgatcgacgggcttgctacacaatgttcacaagaaaagcgcctacatgcagatgctccgatcttgcgaaccgggtttcctaattcccaaaccatagcgagtatactaaaatcaacaccaccgcaatacatgtcgaaagcgatgaagcaacaaggatcccctcctatagctcagcaacagccatcactatcagactccgcaatttctcgctgcaacagccgcatccatatccacaaaattgctactaatttgctactacttgctaagctcaagatcctcctcctacgcacacagtgtgcagctacaaacactagtagttggtggagatgagatcacatcacacacacacacacacacaccaactgcccccaactccagatcgctctgcaggatggataagaaaaaccctagcaacctcggcggcgaggtcccagatcccagagcgagcgagcgagcgggagtggaagaggaggaggaggaggaggaggagggagtacgtggttggcgtgcttgatggcctgggcctcgccgcgcttgtcgaggttggcggtgaagcggaagcggcgcttggggttcttgacgacgccgcagagcttgcgccaccgccggagcgcctcctccgacgagttcttcgccttcaccccgccgaaattctcctccaggtagctctccatcctcctcctcccacctccacttcagatcaaatccacaagaaaaaaaagaaaaaagaaaatcccaggttgcagcacgcagtagctggctggttgcggctgcggctgcggctgcggcgagctccctccctcccggcggcgtggccgctccggcgaggggatgaggaggaggaggaggtgaggtggaggtggaggtgagcaatggcggggtcgttgggtcaaagagacgacaagaggcttttcctcctctctactgaccacactattct

SEQ ID NO: 44905 - DNA, 14424 bp, Oryza sativa
tctgctactgcaccagcagtattacagataatccctgttaaaaaatataagttagtttctttattgataagataatttataataaaaaaattatatgttcttttagtataatgttatgtgaaaagtcaacgacgtcgttaaggacgaaactcgagattttagtttcttcattgataagtactgcctggacattttcctcacaaactcgagatttttctttctttcctccttctgtgggttcaactattcatagtcatctttaagcggaggatgtacataattttcgaatttttaacattcaacgtttgtgaaaaatattacggctctttagaatatcgtaatacaccaacgggcagcggctggttgagtaaaaatggaagcgatcaacagacatatttggatttccgagaccggtctagattaagctaagacaggttatcagatttgcaccaaaaaaaagagttagcggtcaagtggtcctggactcctggtcatgaattttatagttaagagggctaaagtttaagaaaaatcttggtgttgtgtgtctaattttcatcggtcaacacaaagtcgctttcaaaaataaaacctgttagaacaggcacataaaaaaaaggttactttttcccttgataccatccaccaattatgaaaaaggcaaaaagaacctagagattctattccttttccttttggaaaaaaaacacataacttttttcacaaaggaaaaggataggaaacttcatcgcaaaaaagaaaatgcatacatccaaaaaaacacgccgaaaaatcaaacttttggaattatttttattatctttttttaaaaaaaatatgggagcctgaacacgcatggaacgacaattaagaaagagcgcatcacctcaagatccggatcgctttgcactaaaaaaaatcaatcaatccatgtctttggtcgtgtgtgtgtcagtcagtctctccttttttttttactaataattataaaaaatcatcgtgtctttgtttttgcgattacaatttacaaatacacttttaaattataaacatgttcacgcgttttcggacacatgaccggtcgggccggccatgtgatgctcgccaccaatcattgatgcgaaaaatgccaaactttcgttgattgacagctctgaattatttattaaccgtattgtatacttgaatgacagtttaattttagtgttgttcttggtgaccgtgctaatggacttggttagtcaacaagatttgtacagatgcttgatggagaggcatgaaaggtattgggttaagagatgaaagaaatgtttcggtccaggaaaatgataggaggcctttttgtcactgtttagaaaatggcagaaattttaagacactgatactcaaatcttatggatagaaaaacatgtaaaaactacagaaatgattgtttgaatggagcaagaaaaatacatgaataagaaaagataggtagacgttaatcaatttttccaaaagattcgatatcatgttgaaaatcttcccgaaatcatctttgttttttaaaggattttccttaggagtacaatcgatcaaaagtcctataaaattcttttgttccaaaaaccctccgtaggatttttacaggaaacaactcaatttatgcgaaattcctcaaaaatccaacattccaaaagaggctgaaatttatagaataactccataggaatggcgaaaattttccatgttcctaatgtggctaaaacccgatatatacagcctatcggcttttatatttgaaatgcgggaattttagttatttttaacagaaattgagtactccagtttcatgtgaaactgtcacagaccgacggagtgtgacctcacatcacaacgaaaatggaactgcttgacttgacagaagccagggcccggttgatctgtacatggcctgaaacaccgcagaatgtcacggcagcagcatgtggcatacacagcctacacccgtgctcaaatgcacatgagtagaacacaaaaaaggtctaccatgccatacgccttgtttagaacctctggtctattaaatagcccttcagaatcttgctatttaagattattaaacgtagattatcgacaaaaccgattccataacccctaggctattttacgagacgaatttaatgatgtatattaatctataattagcggctgattactgtagcatcactgtagcaaatcatggattaatatacctcgttagattcgtctcgcaaaataacctaggggttatggaatgggttttgtcagtaatctacgtttaatactcttaaatagtaagattccagagggctatttaatagccctccggatctaaacagggccatagattcagatctctcattcttgatctcacaacagccagccacatgagcatgaattttcagtatctgaaaaccctctgaaaaaaaaagatttagtattactacaatccacataaattgcaacagatggatcatgcttgattctcgaagtaagatttttcgaagatgatctagtcggaatccgaagtaagatccatttcagggtgaaacgggcggagcaacttcgctaggtgctcccccatgtcctccacctcctccctcccgaagccccagtcatggaggaccagagacccgatggcgcctctcgcgacaccgtgcttctggaggctccccgatcgcctctctatgaaaggcaggacggcgctgcttgatcgtaaccgtgccgccattggtatcgattcgatgtcaagtgagccctttggctgggattcttctgtatggtcactaaggatctccccgtgccggccaatgttgcctctgaagattgacgggaacggaagggggacagggagggggcaaagagatgctgagagatgggaaaattttggctttgtctctctggcttcgtagactgaacataccgagtccttcacttgtgatatggaagtcctttgcccgcctgtgcaaacaaatttcaattgttaattctttgtacttctacatgtataaccaaaatttagccaccatgcctataatgttgttaaatgttcaatattgtaagtattaacaacaatagaaaaataagttctgttggcatgacaaataataggagttaatcagatcctaaggcaaaagataagatgtgcagacctctatcaagagctccatgaaccactagcgattcaactgaataaggatcttcgtcctcatcgctgatttcaggggtcaaagagtgcagcttcatctctatgttccccatagcatctctatctgcaaattaaagtgtgcaattagcaagcaagattaaatttccatccaatgttggtataacagtagggcatatgttatgttgtatacctgtcaaagaaggggcaggcatcgctacatccagagcagtaaccatgttctgccgaccttgatcagataaaatgtgcacaagttcgccaatgtcaagattaccagatgaatgtgctaagtctgaactcggtcccgttcgttgcaatctaaatggaacagtgattgaatgtattgctgcagcacaaacagcactagcatggaatggtttctcatcttgtatataaaggtacggtgacatgcaacctgatgaaacagagtgaaaggaaatttgtgagaaaatcattcaatagctttctgtatattcatgaaagtatttttttaagggaattcatgaaagtaatattgtatggaaatcaaatgtgaatatacagcttgaacaaaaggagttgatatttaatagaaacgcaatcaagtgcagtatcttaaggcacaatatcagtatacttgaagcaatcaaaggcaaaactaggcaaccagaaagaagtcctataaaatcacagaataacaataacaaaagataaactaaaaatgtggagttcaggcaaaggatagtatacttctacttaatgaaggcggtcctatgggtaccatcaggttgcaaaaggacgaaagttttgaaaatgaaacagcatcatgaagagctctcataatggactccctttgattcctcctggatggtccaagggtcattggatccctcacacagtaaagcaatacaagtgtatttgtgtaatcatcagcaatgttctccaaaaactgtgcagctacactggaaaaacctcctgaatcatccacaataaactggatgccctgtggtaaattatgaatcaattaagcttaaaataatggtctaaataatatgcatgatggcaaaaatgattgcataagtgaacgttagcttgttgcaaaactgtaagtagagtttgctgataatttactggggaaaaaagggtaggacctgaatatggtcacattcttcaacaaagaaccttagcctctcattcatttcctctatttgcgaccagtctgaaacaacctcttgtgcgctgccatagttatcgaacttgtcaaagtctgtccatgatccatataactcatacaaactctgaggatgatagtgaacttttgaataatctgtccaaaagttgatgccattctctaggcattcaatcaggtccttatattcaacacttttctgggagttgctgccaccattgctagtgcttggattctgcccttcttcaactaagctttgcagaaacaagttccgcccatgaggttttgagactgatcttgttacatttccagacctacataaacaaggaaaattcatcatggtaacctatgagcccgacacattattcaacatatatatatatagttactaatacattgaatgatttgcacatagcagtgcaaaacaagcaacagtaaggcaaaagatgaatgcaactctacgagaataataggcagatgcaatgcatcacttccacagcagctggatgagcatatgaatcattattaccagtttattactctcttattatcagcctaagaacagctcattgtttgctcaggctgcagaaatttcctagaactgtatcaatataacagtgctatagtaaagctgctgtatttgctatctgcttgctttgacgatgcagacatgatttcaccatttgtcagaattacccccagttatagatatgcaagcttatttaaacgatcctagcacatctgtaacccattcgcacaagcaatccaaaactaaactgaaacaacagccgccttctgcgcaggtcgtacatgccaaatcacagtggtcaattattcatggtgggcacaataagcaaaaccaaacatgaaaacatattctaaagaagttagagcgccacttgccatgtagcaacattgagttgatctgcagcagtactagactgaccgagattaccggatgaactcaaagagccaagagaccctgcaaatgataccaccgtgaacatgcagtatatacactaccaataacaaaataacagttcttagttcttatttcctcatcgtttcgcttatatacttattataagtgaaatggactggtagcgattagaaaatcatttatgggtaaaaaaatttaaatacgtgttcttactgatttaaaacaaaatgctggaaaataaaccatgatgaaaaaaaaaaccccataatcaaccctgaaattaagttctaagattcaaaattttcgtttatgcttataagttgaatgctaaacatggggttttacgcactacaataatattcggaccaaattcagcatcaaattacctcgagaatcaacagacaccagacgagggcagtaggtagcaacaccctagtgaaatcaagcagtgtatactagtagtcagtaaaagatgaacaacaacgccaaaaaaaaaagagaaacaaatacagaaagaaaagaaacgacgcattttgtcatgccagcgatgagcggcggctttacctggtgcgtctcgccggagcggtagaggacgtccatgtccagcgcggcgttcttgaagaccggatcggcgtcggggtcgtcggcgagcccgagcaactcatcctggagaagaagaagaagaagaagaagaagaagaagaagaagaagaccccaagaagcgtcaggttcttgcaccaggtggagcaacaagctgggggtcttgccggagacgagagagagagagagagagggcgactcacctggaagttccagaagtgggagccgacgtagttggcgaagccgccgacctgcaccgtcaccgcctccctcatcgccgccgccgccgctcggcgagctcctgaaccgcaaccgcaccggcggagtcgacgaagaagcttccctcgcagcagaaatctccacagacacgccggcgaggtttccccggtggggaatagcgccggcggcgaggtgctcagccaaacggcggcggcggcggcggcggcgcgagaaatcgtggaggttttcccctcactaccactgtggattgggctggattttttagcccaatttattcggctcaatcagaaaagggatggcccatttcggcccaggaaataaatggacctgcatttttttcagcccaattcaattcaaacccaataaaccggacacaaatttataaactgttcctgattcaactcgtacagtttttatttttttaaagaaaaaaactagtaaattcgtacagtgaagagatgaacaatgaaccctagaggtagcttcctctaccaattcccgccaaaggatgaaaccagtacgaaatgcacggcaaaagtcaagatccgaagttcataattataccatcttgcacgcagtaccaaccacttgattgattaagcattaatatgagtaggttagagtgaaccactctcttgatgctcaccaatgcacttaccaaaaaaagggttaaatgatcctgatcctgatccagattcattggcacaagagaacatctccaatcaagatccactgcaagatgcaagcaactaatcgaatgatctcactttcatttttttacctcagttgttaatttttcagttacattttttttattatcacagccagtagtgtgcctgatgaaattttacaaacaaatcaacatgcctttcacttataacttgtagtcaaatttgaattttaaaactcaattttggaatcattttacagtttttagcgtgttttcccataatttgttcacatatataaaagttttcttcgtaaaatactttttatttttgataagccattatggcttataatgtataaaattatcgttgtaaataaactttattccccttaataaaaagatgtgttccttgcatattcaaaaaaataaataaatttgcacaacaggaggcatcaaaggtggacaataatctagcaatattctcctcacataagaataattaatctcgacatcacaatttagcccaaagattatacaatgtgatgtaattaacacctctcatattctcaaaccctctacaacaacaactcaaattactcacatgggtaactcccgtacttaatctcatcctccaaaaaaaaagcccaaaaaaagctctcaaccactgtacagaaataggcctaagttcttcggtcactgctgctgtgcagcacctggagacaattaattaatggtgctcaagatgatgatgatgcccttgccccattctgcatctcccagctatagctccccgacttcccgtcctcctcttcctcctcaccgccgtcgcagctatcgccggcggtcactgacacggcgtggctcgacgacacggtgagctggagggggccctgcggcgagccagactgcgatgtgctgtgctgcgaggtggtgtattgctccggtggcagcggccatagacggccgccaaccgtctgatggtcaccgccaccatcaccgccgtcggatgcccgccgcgtgtgcagccggtacttctgcacaatttgctttgaggttcgtgaactttttataaaagaggcgtaccaaattgttgccaccgacatatggcaatattttttaggttgtaaaagtaaggagttgagactgaacaaacctgcaggtggcttttgacttcatcattagtgaggccatcaaccttcatcagctccctaatctgcttgggagttgcagctgcatcaacaataaaaaaacattaagcaagtttcagcgcaccaatcaaaaaattaatcaaacaattttactaggagcaatcaacaatgtgaccacaaattatcactcaatcatctaaacagttcagaaagaaaatacaatcatctaaaattatcattggaaaaaaaaatcgaatctaaaataaaatgtggcaatttgcacaatttaggttgatgagaatgagatgatcctcaccttgtgggccaccgaggcgctggagcgcggcgacgaaccggcggtggagctccggagaccagcaccgtctggccttccgttgcaccgcctgctgccgctgcgctacagcgacatccgtgacggcgctgctggtggcgctcggcgccgccggacatgccggggcgtcggccatcgccacccgggaggagagggacaggtctggcacggcggcgtcggctttctccagtgattttgcaaacgccggcaaggtggccagtggcatgaacgcattggacacctgatcatgatttgaaattgacagaactagttaggaaaaaatatactcttttgagaaaaaagttagcgaaaatacagacaaatatgcatgagattgacaacaaagctatgcatgctcaacatgtgttaatattttcttggtggaataacatagaaaaaattgacaaattacaagaaatcgaacaaaatgaatctttgttttttttttgttttattctgtatttttccatttctattctacatggtgatatggggaaaaagtttctcctctttctagtagaaaccaaaaaaagagagagaatttttcattgaacacctgaattgtaaagattcctattttttttttttggggatttgcaattataacacggcaaacattaaactttgctataatgacactggacccacatttcatacacacagatggacccatttgtcatccactcggagtgtcaaaacagcgaagcccacgtgtttgcagtcccaatattacaattttctccattttttttagtagcactagactagtagtagtagtatcgcataaatttgcaaattaagtttcttcaaaaaaaatctagtaggagtagcattactccttctcttcccttccaaaacaatctcccttcaaactaggacaaacttgacaaaacttaaccaaacaaaatattcatgtttttcccatatcttcccttcaaactagtataaacttgatttgttttataaaaaaaaaaactacaaaacttaaccaaacaaaaataccttgtgctgctgcttcttgacgctgccgccattgctggtgctggtgcttgtgtggctcccgcagctccacagctgcgccgagctcatccagctccgcttgtcgttcgcgtccgcctccgccttcaccccctccgccgccgccgacgccgccgacttcctcttcgccgtcgccggcggcgcgaacatctccggtggcggcgccgccgccggagcctccacctgccgccgccgtagcagccgctgcttctccacctcgtccttgagccactcgatcactggacgcccaagaagatctcagcgaataatcatccatgaaatctataggcagatcgagtgatcgagcaggtagagggtggaggtagagctcaccgtcggcgatgaggtggacgctgatggggagctcgcggcggaacacctccatcttggccttctcggcctcgaggctccggatgcaatcctcgaacctcgccgccgccgccgccgccgccgccgcctcgccgccgcccgccctcgccagcgcgcccgtcgccgtcctcgccgccagcatccgcatgtcgacgccgccgaggacgaaggccgccgccgccgccgcctcctcgtgctgcgccgccgacgccgacgacgaccccatcgtccacaacacctcgccggaattcgggaggagacggtggcggtggaaatggtttgcggcgtcgcgctctcgccgcgtttataccggaggaaggttgggggttccggttcaggcagaatggagggtagaatggtaatttgacgtggaacagtatagaatcggccgtggaagataccactagcttctgctattatctgtacaaccactggttccttctgatctgtgcatgtaaaagatactggtagtagttttttttctgctttattttgcataaaccttttgcaactaaaatgctctgagttgggaaaaaaaactttcctgcctaaatttatgtgtaacgatggtttctagacgtaaaaatctccaagttttttttttactgccaccatcctttaatatttgatgttggttggttcaaaattaaaatatcaaaaaagacggatggaatatttgataacgagacatctttagctccggaaattcatgagttgtaggtgatggttgattaatttcaataatacgaaatatttagttcatatttaaaattaaaataagaggattaatgcatgttaatttaatgtataagttcttttttttcgagattccaagagttgatccagacgtggagccatgccaaacaagaattttgctagaacttcacaagaaaattcagtttagattggaacaatgaaaaatcctacgaagtagtagtattagggttgttcgatactctgtcgttgcagcgatctagactatgctacgcaaccctagccattcgactgcaagtttgaacacacgctgctgctgcaattggttactacaaccggtatagttgtattgggctggctaccacagcatagctagctcaaccgaacaaccccattatagcatgaatagcctgtttttaaaaaaattatagcttgtttagaaaaaaaaaataatagtacatagcatgaatagtagtattattttactagtgatgaaatgaaggggagaggggagaggggtaggatggtaaattgagaggggaggggaggtgagagtcggagaaaagatgccgcccgtggaatatggatgggggatcagaggcgtttcgtcgcgtaacacccaaccatcaccaaacacagtcaggataccgcctccccacgaatctttcttcctccacaccaccctctcttttacacaccaccccctcacatttcccctcaatttcatatgggtccttttcaggtttttcattcaggtccctgcacttgcacttgctggtggagcaccaatattctacagctcttactatctctttttcttttcattcctttttctgtctcagcatctgttgtgttccaactagaaccaaacctaatttcattgggttttttataagtagagaaatcgtcctcgcacgtccctgcgtaccttgcagaatctattgtaaatggcacttcctcttttctttttctgccttatcgcgacggcgtctgttgtgttccaactgaaaccgaaccgagtttctttaatttgcttttcgaataagaataattgtccttgcaaagaaaaaaaaaagaaaagatggagaatctgtgtgtgtttggatgcgatgtgaattaataagaaaccaagggagggggacagcaagacaagaggatccattgctggaaagttgattcttcctcctttcctatgttgtcgttagcaaggaggttttgtgctattctcttcttgttgatgctagatgcttgagatcaggggggaagagttggtgaggggtaggtttcatcaagggatacacacggatatattcgtgtgttctttattactcttttctcgtccttcttcttccttttcttcgaagaagaattgatggcattgtttttttttcgataaaaatggtctatgtgtttagatcccacaatacattcctttccacaaaatttctaaacttaattattttgcttcttcttcatgttttttttgagccggttcgatgcggcaccaacaagctttgaacatacatgcttgacgattcgtcggtgccatctcgaagctaaagctacttatcatcattttctttgaaagatttccctcatgaaatagaagtttagttttatggaaattctgtctttagctaatggtcaaacctggttttctttaacaaagaaattgatatgttgctttgtggttttctggcaataaatttattgctgttaccatcacttgccaaccgatagatgctaaaacacaaggagtaacattctctaacctttctaccccgcattatattaatgagctagccaacacacctccttactcaaattatgtctccgttttacttatttttttatgagacttactattctgtcaaaaaaaatcctagctacgaacccggacgcacggtttgtcttttttttttattttgaggaggggtaggtctattgagaatcacattattattaccattcataaatagcatccttagtcaaagtacccaatgtaccaactataaaattaatgtgacctaggagatagatttcatgaggtttccatgacactcatgaccaaaaaagtgtgttggacttttgtttctacctcatgcagcacgccttcggtgcttatcggtaggaagagcatgtcaacgacatcatataaatgcaaattgacatcaaataaatgtgaaaacaaaagacatcctaattcagatcgagttcttctatatgttagtaatagctatcagtctatatatcactatttcatttttttttcactctttcatgcatcttgaaagtcattttagtactaatttttttagggaggttgggggaccagagaattgccatggtactgttttctctctctatctgctattggtaaatgttagattagtacttcctctgttttacaatgtaagactttttagcattgctcatattcatatagatgctaatgaatatagatgcatatatatgtctagattcattaacatctatataaatataggaaatgctagaaagtcttacatgtgaaatggaaggagtgcatgcaatagattaattagggatatctatctcgatggcattgatcccgtgaaagtgagaggttcacttttctattttttccaacaagtactgtagctaatgcaataattcaagcatctgacccttgtcaaatctgaaaaggatttgtgccttgacacagaagttacacatagtatagtgcacaaagcccatatataagagtaattaattagttactcgctcagtgcgaaaatatagctagttctatgttgagattttatctgatttctccttcatctcaaccaatcacaacaatctttcatgcatataacttctccacacattttctcatctcttactatcacaactatcctttatctcagtaaaaagtgtttatattttaggacaatagatagctttgtactccacttatccctatccactataacaatctagaattggatgcgacatattctagtactatgaatctggaaaggggatctgtctaaagtcatagcactaagataagtcacatctgattctaaattattatattctgagacggagagagtactaggtattacgaaattgatttctggtatctttttcaccatggaaaaagacatgtgtttttttttactttcaccaaattaaagttatgatcattttcatcatcacagccatgatgcaagtctctgtgcagtagaaccactactccaaagattgttcatcctcccaccaatggctgtcctccacgtggcaggtggtttgggcatagtgacaattgagattccctcatttgggagagaggtttggaatttattattggcaacagcaatttggcaaggggctaaggattccatgtatgagtgggccatgagagagagtgggccatgagagagagagaaagacagaggtgagatgagatctccatgggattttgctgccgccattgctgagatgacacgccaaagtagagagagagagagagattctcatcaaggagacaaaggcaacgtcaccgttcccaagctgcaaagattcttttggttagggtgaagtgaaccgcctcaaagattctataggctgtgttcttccccttctttcctaacttatcttgcttatttttataaaaaataattttcaataaaaatatatttttaaaaaaatcatattaatctattttaaaaaaaattaggtaatacttaattaatcatattttaatatgtcgctatgttttgtgtgcacaaaagatttactccaaacaccatctaacgaacccaaatattttctactcacttagttttttttaaaaaatctatgtttagattgtaatcagaagttagtttctttaaatagaggatatacatatttctgaaatcagaatatgtctagtaatctcttaaaaatatgtctagtaaaaagcgaagggagtatactgattgtactaaaga

SEQ ID NO: 44906 - DNA, 10020 bp, Oryza sativa
  unsure (1)..(10020): unsure at all n locations
cagaagaatctctgtgagatcccccagagattactccaaagacttgcacaacttgtcttctttctcctctagctttctctctctgtgtgtgtatgtgtgtttacattgcattatgcaacatattagtatcttatgttatcatgtcttaacccttgatgaattgttaattaagggtgatgtgagatcaaatcctaatcccttccttttggttgggctataagagcatggagatgccaaccatattcatcagatattctcctttttgtgtgaaggtgtgttgccatgggcaggcaggcaaggcaccttcttctcaagattctcacaagattgtgacagggcaccagctgactcatcagtcattactaatcaagtgtgggatgcttaagtccatagcttatctcctttttcttaattggcatgaagagtcttaaagaaaaggtaccaaacaaacgccaaactaaccacaaagttgtagcagttgcacttgtcccctgaccgaattttccctctcaaaattttaagccgagactttggattacgaattctacatgccatatatatacacaggtacgcaaaactcatgccgatcttaaaaaaaagttcaatactcaccggtgacccacaccccctagtcgcaccgagcaaacccactgttttcgcacaatttttcatatgaatttggtgaaattcactggtcatgcatgtagcaatgatgttctaaaaagggaaaaaaaatcaagatgcaggtgagactgcactaaccaaaattgtacataaagcaaagtataagcaaacagtagtagcatcatattggtacagtagctaagaagattctctagcactaaaaaatgattaataaattaataatgcagtgtgcaattttgcgtntttccccctgggaaaaaattagaggaggaagagaagagattcctcttgaatgtgtgtgtggaaaagaaaagagggaagggaatctcgcaccgcacgctgcgtttgtcggtctctccctggcagcgggtgctgacgtggcaggctgtcagtggcacaggttggcatcgaatcgccgcgtagtggggcccaccactctggcacacagagagagagagtggaatgtgtacacgtcagcatctgggaaaattgcactgaaatttcctgaaaggtgaatggtgaggttgtctggttctctgactctgatgctgtatgcagtgacctttacaaactggatgaatgaattttttttaactgaaattcgagtgaaaaattgttaggaattcctccatgtttgattcccagccggtgctctgtttcaaaaacctactgtattcaattctgtggactgataaaaggagagaaattcattctgatcttggtgctatctgaagcctagacattgaatattttttaactgaaacttgactgaaatcctagcatcagcctatgaactcttccctgtgtttctgccactaacatggacagacttattatgaacagaaaattttcatccgatcttctagactaacctaaaaagttattatcacataaaatcaaccgtgacgacgaggacataagagaaaagaaaaaaaaagaggaggagaaattcttttcttttctgatatggtgactttatttgcaatcttgttcgtgtggttgcagagaatattctgctgatggtggcgcacacagttcagcaatggaaatggaccatatatatacacacacacatgactttattcgtcttctttttttatcatcgttcgtagtatgagtatatttctttcctcctttccatggatctcgactttatgtgcactgttttctcttgtatgctatctgctggctttttcaggatcagagaattcagaatgcccctctcctcaagttctctcctggtggacaggctgactttgcagttggaccacagataagttggttctttgcagttgttgtacctgaattatggagaagaatctcttgccttacctaacaacataaacacattctggattgtgtttgaatcctctcttcttcattgaacgactacatcgtttttcgtaagcacgctttccaaaccaccggagtaaatgttatgtttcattgaaaaacttgttatatagaaatttattctgaaaataatataaatctaaatttggagtttatcataattaatagtcctactcaattaatcacgagctaatggttcttctcgttttgctcccacattactcgttttgctcaggagtaaataagttgtattccacacatagaccccttagtagaataataaatccctccaaacatcataagaatttcatgtattagcccacataaatccattatggataaaaataaattaatagtttaattttttttttcatgaattgagtaaaaccaaaagagtcaaagaaagaaaaatgttttgcgtgccatggaaaagatcggctgttctgcctaaatgaacacaagagtactaatacagaagccctttttctgaagaatatgatacgcttagctcgctgaaaaactctgctcacaaatgaaatgaactatcgattctctcaatctctctgtggagcaaaagattaattagctgtttgttgcgaactgcaatttgtgtctcgtggaaggaagaatctctgcaagttttctcgttctgctgatctgctttgagaggaaaatgacaggagcaggaggatgcatcgatcagcaaaaatatggatggagatgatatccgatctgggtgagaatgagatactgagatctccattggatagcactaagtgctgcaccatccatccttagacccgaattcaaattcggtttaccaatattcatgatataaaatcaccccttattttgttcactagaaagaaaactagtcaaatttataatctttcaatttaagcatagtcgagcaggtaatcacccgctatgaataacgacgaatcaatgaattttgtataacctatagctatatgtactagtattatgaaattgagaaattaaaaaaaacacagcacaaccgtagacgtttataatatgcacactcatacctataaacacacgcgcacacacatgtcacctaccatgaaaataattttagagcagaaccttttatatttttgctctgaatggtctaaaagaccatgatgaaaaaagaaaattgacagaatatctcaataagttttaaaatttaaaatttatctatgacttataagcgaacaatcaaacgagggtgagagaacaaagggtttgttcacttctttaccattatcaatcattccaaaatttagtaataccaaaatagccttatcaatagttgataattaactttctattcaaaaaacttttctcagtatttggtaatgcatcaaactaaacactactcacctcaattttaccctaccgaaacttgataatgccaaaatcgagtattactaagtgtttttttttcacaaaatgaacaagcccaaaattccaagtggtacggggccatcactggtccattgttcaactacatgggcccgaaagaaaggggctcaaaagcacactgatccagtacaaatgatgggcttttggcccattagtacaaaacctgttaaaatatctgggcttctcaaataggcccataatatgctcatcccaaattgggcttaaaatctacagtcaccagcccaattaaagagcagcggcagacgatgatgatatgactgaaataccctcaccgtccttgtggccgcgtagccgccaatccgatcgcagccgtccaaggaaatatcaacaaccctataaaaaaagtcaacccatgtacaccgtccgatctccatccgactgctccagacgcgcgagggcacgatggtaattaaccaccccttggcgcttttcggccccaccgcgagatatttccggccgctttttccccgcctccctccgtcatccccacccgccaccgacctgtgagccccaccatcagtcgggcccacctgtcagccacccacccgaggatgcgggtagaataagcatccgtcccagcatcccgggatgttttttctcacctgaacgtcgacgagcaatcacaatgacatgtgggcccggtgtcatgcgggacccacgtgtaagtgatagagtgggtaggtagttgggtgggtttaggattcgtatgtggataacgtcctttgcttcgtcttcccccactttcccgcggcaataagaaaaagcgcgggagcaaaaggagaaaaaaaaacaacagcgagaaaaaaaaaatcaagaacacgagcaagcgagaggggaagagagagagagagagagagagagagagagagagatcacgagatcggaggaggaggaggaggaagaagaggggaggaggtggcgtgttgagtcggatcgaggtttgcgtttgtgttcgtttggtcgccggcggaagcgatggagagggcggcggcggggccgctggggatggagatgccgataatgcacgacggtgacaggtacgagctggtgaaggagatcgggtcggggaacttcggcgtcgcccgcctcatgcgcaaccgcgcctccggcgacctcgtcgccgtcaagtacatcgaccgcggcgagaaggttctctttccttcctctcttttctttgctgcgagcttagcttagcaaaattgagaagaaaaaaaagggtaaaatcaaagctggtttgatcgaccgtggaattcgactgcagattgacgagaacgtgcagagggagatcatcaaccacaggtcgctgcgccaccccaacatcatccgattcaaggaggtgaccatgacacgattctcctcttcctcctctcttctttggagatcatgctgattgctgatgctgaatgatgtaaaaggacacctttgtttgttccttcttgtttcgttgcaattccgactctgacgaatcttttcaggttattctgacgccgacgcatctcgcgatcgtcatggagtacgcctccggcggcgagctcttcgagcgcatctgcagcgccggccgcttcagcgaggacgaggtcgatatcactgtctgatacactatgatcatgtctatttctttcaccaataattgtgtagtatctgtattgtactgttgtattggctaactctgaacttttggtgtactttcaggctcgtttcttcttccagcagctgatatctggagttagctactgccattccatggtacagtatcattttgatttcaaagttaccgtgtgattttcgcttgtctataactataagcggtttgctgcattgagctgaagcgattttgttaatgtgtttttgcattgttcagcaagtatgccatcgtgacttaaagctggagaacactctgctagatggaagtactgctcctcgcttgaagatatgtgactttggttactcgaaggtactaatgtttttctatttatttttgctatgcttttagttgggattactttgatcatttggcaatactatgtgatactgatttgatgatctgaaggtagatagtatccacaagacatttagggtgcacaatgtggcttaaattactttctgtagtagtgaaaagaagagagaactttcgctagatttttctcgatgtgattgctgcctggataatattgtactgttgctttctgattttgcagtcatcggttcttcattcacaaccaaaatcaacagttggaactccagcttatattgctccagaagttttgctcaagaaagaatacgatggaaaggtattatctatcccctttgtgctttaaaagttgccatcctgcatgcaaagatacactgataccagcagctgcccaacttctatgccttttgctcgacaatagaagctgccattgtgttgtaaaggtgttgatccatgtttcaatggcatgggtagtgtatggtcttgtgaagtaacccttttaatgcattagttagctcaatccctaataatttgtctttggatggagattgccgatgtttggtcatgcggtgtgacgctctacgtgatgttggttggcgcataccctttcgaggatcctgaagatcccaagaacttcagaaagacaattcaggtatccttgccaaccattcagctttgcagcaccacaatttacagttataatcagccagctaaatagtaatgcctaaatactttttttagataaataatgtctaaatactgatctcaatttgcagaaaatattgggtgttcagtactcaattccagactatgtccacatatctccggagtgccgcgatctcattacgaggatttttgttggcaacccagctagtgtgagtaccaattctattcctgccacacaatcttcaattattcagctctgatgtgagacaacatatgcaatcatttgctcttgcagaggatcaccatgcctgagataaagaaccacccatggttcatgaagaacatcccggctgacctcatggatgatggcatggttagcaatcagtacgaggagcctgaccagccgatgcagaatatgaacgagatcatgcagatactggcagaagcaacaattccagcagcaggcaccagtggaatcaaccagttcttgactgacagccttgacctcgacgacgacatggaggatatggactcggaccttgaccttgacattgagagcagcggagagatcgtatatgccatgtaatcatctcaacatttgcaatgaaactgcactgaaaatcagcttgtttcagagcaggtagagctccagaagagatctgtgttcaggctactaggaagcaggctctgctgcctattagttcttgagtctgaatttctgatgaaccatactgcagctgagttgcagcagattgtgtagtatgtaattatgtatgttgtgccaaaaatttagcaccggatgatatcatgcaagactgtttcttgggaacactgagaaatgagaagcattgtatggaacctagttctgtattgtattaaacagagagacagaagagatgtattggttaatgtatttgctatgtgtatgtaaatatgctttgtgccaagaagaaaaaatctctattaattctatggttctattttctcagcaagctttggctgctgctggagagtcagttgcatgaacactgaacatgtcaaaattgcagagtggattgttcctccatcctgtattagacagggaaaaatatacacatcatctgtacaaaggtgagcttggagccaaaagcatccaggaacatcagtctacaagccagtccaggttataacactcttctgctacctgaacccggaggtctgggatgacctgctcagcttccctccacagcaacgccgtctcctcgtcgcacacgacgtgcccgagggacttgagcgatgaggacgacctcgggaggctcctcagtcgcgagcattctcgcatgtcgatcttctccaggcttgtcaggtgaccgagctcctcagggaggtccgtcaggttgacacactgcgaaatgtcgaggtatttcagcctcttcaggctgcataccgaaggcgggagccgccacagagccgggcaggcgtatacccttaggatgctcaggcaatgcagcttgcccagctcatatggaagctctgtgaggtcatggcagtttgagatggagatgctctccagggaactgatttcacatatgctagatggtagctccttcaggtctatgcagtggtcaatggtgaggttggataggcgcgggaatgtcatcgagagatccacctttgatcctctcagactgttggtcagctcacagaggacaagggatatcttgcgcaggttcttcagtgggattgtggtttttggtagcggtggaagtgtgatcttctcaagccaaaggctcctcaggtcactgagcgtggtgaaggcggataggttatcaagggttgcactgatggtgccatagttgatcagcaccagggctttcaagttctgcatggttgcaatgaatggtgggagatagtatacacttgacgcgaagttgaggataagcacttcggccttggggaagctcatctggaaccagtcagattctttcatctcacctgaagattgaaaccaattggtcagattattttgtccaaaggggaaacacaaataattgcaagtaacactaccatagaactttaaataagggaaatatttcacaagatcaggtaatactaataacaaatggaactttatgtattaccttgaaggattaagcatcagttaaacaaattagatggtatttttttttctcatagcaagaaaaaaaaagatgaaagtgtagttaatagccaatgaatcacctgtatgaatggaaactatctgagcttcgaacggagtgtccttattcctctgccaatccttcggtagtgattcttctcttcttggcatcaccagccgtctccggttgttcagagcatcacgaccactcatgtgaagcgctagatccctcaatacatcatgttgtgtaaccgagaagtcatggtagctgctgtacaaatcgccggctttgttcctgcatagagtaaccaaatgtcaaatccgtccttttgtcgcatccaaattattaaaggctttgaaaggaaatacagggcaagctgtacatactgtgcatcattaactagggtgagaagattcttgtttgatagctcaaccaagatggcgaaggcatccggctcatcaagatcatgaatctccatccatatattgatcaacacatccagtgggatcttcttatcctccggaaagcaacccagatcaagaaacattctctaaccttccctgacaagcactcgatgcttgcggccatcctctccaggagtttggtctcatgagagtcagatatagtctctcctcgcgacaaccggttcttcgcactcaaccatatcttaggaggctgatcccgcaacgacgcaccgataaccttcagtgctagaggaagtcctctgcactctgcagcaacctgccgaaccagtttcttgtcagcggtccgaggaacggactcctgatcaaaggcagcacgacagaagacagaaagagccgcctcctcatcgagcaactccatttcgtaagtccgggtgaccaacgaggggaacttgaaccttgatactacaagtgtcttgcacccagggaacttgaagatgagctcctctagctgtgagagagaccagacatcatcaaggataacaagaacaggtcctttgtcccttggccccaacttgagttgccattctgggatctggttgtacgcaccgagcacaaggtttccactgatctgctcccatagcttcatcttgatagtgtccagatttgcggactgcgagatcgtctcaaagaagactctatcgctgaagtagcctacagaaacaagaacgaaatatgttagcaccatgaaaaacaataaagcatgcaaacctttccagagaaaccagcaaaggatcaaatacaactgtcttttgtgaacagatcttgatggcaaacaattaacgcaaaatccaaggggttgctcagatcaattaggaaaaaggcgaataaattcgaagaaagttctaatgttatgttgattaaaattggcaccatgaacacaagttgctacgttgagccgaatgagttcaccaacatactaattataactccctttgcacttacagatgatcataccggggtttgtattaaaccatgccaatgaacactaggcaaatctcataatttcaatctgaatctaagcaagaacataccatgccatgatttcaaggcaaaaggccatgaacagaaaacgagttactactcaatttggaccaaaaataatttttcacagcatctccaaaaaagttaggccgtgtggcgtaattgtgtgctccaccagcaatctaatcccattaggatcgtacacatcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 44907 - DNA, 5661 bp, Oryza sativa
  unsure (1)..(5661): unsure at all n locations
agaagtcaatattctggagactaccatactggaaggatcttgaagttcgccactgcatagatttgatgcatgtcgagaagaatgtatgcgagagtttaatgggattactgcttaacccaggtactacaaaggatggtctcaacgcccgacgagatctggaagatatgggtgttcggtcggagctacatcccataaccacggaatccggcagggtttaccttcctccagcctgctacactctctcgaaagaagagaagattgatttgctaacatgtttgagtggtataaaggttccatctggttactcatcaagaatcagtaggctcgtttcactgcaagatcttaagttggttggaatgaagtcgcatgattgccacgttcttatcacacagctgttgcccgttgcaataaggaatattttgcctcctaaggtgcgacacccgatccagcggttgtgttccttcttccatgcaatcggccagaagatcattgatcccgagggactagataaactacaggcagaacttgtgagaaccctatgtcatcttgagatgtactttcctccaactttctttgacataatggaacatcttccggtgcaccttgtgaggcaaacaaagtgctgtggtccagcattcatgacgcagatgtatccttgcgaaaggtacctggggatccttaagggttatgtacggaaccgttcacaccccgaggggagtatcatcgagagttacaccaccgaagaggccatcgaattttgtgtggactacatgtcagaaacatcttcaattggattaccacgatctcatcacgaaggaggcttgacggtgttggtactgttggaagaaagactattaggttggatcggaaggtgtacgataaagctcatttcacggtactacagcatatgactgaggtggtgccgtacgttgacgaacaccttgcagttatccgacaagagaacccaggccgatcagagagttgggtcaggaataagcacatgtcttctttcaacgagtggctgaagaaccgaattgccaggttgcagaacttgcctagtgaaacacttcagtggttgtcacagggtcctgaatggagtgccaccacctggcaaggatatgacataaatggatacacctttcacacggtcaagcaagacagcaaatgcacagtgcagaacagtgggttacgcatcgaggctgctagtgacggtggtcgtcgtgatcaatactatggtagagttgagcaaatattggagctagattacttgaagttcaaagtcccgttgtttcgttgtcgatgggtcgatcttcgcaatataaaagttgacaatgaaggtttcaccactgtcaacttggctaacaacgcgtacaaggatgaaccgttcgttctcgccaaacaagttgttcaagtgttctacatagttgacccgtgtaacaagaaagtacatgttgttcgtgaagggaaaaggagaattgttggattggacaatattgcagacgaggatgattacaaccagcacgtccacggcataggtcaagaaatacctctagaagaggaggaggaagaagatgaagttcaatatgcacgtgtcaaccatgaggaaggattatttttgtaatttatgtacgtagtttatgtctacatgtctgttatctgtatgactctaatatgttcgcaatgatcaatagtatattgcttatgaaatagtcaaataaaataattaagtgaagcacccactagaagtgaaataaaataattaagcaagtataagcattggaaataatataattaaagtagtataataatgaagtgcaattactactgttagtgaaataaaataattaagtataaaaaaatatgtagtgtatgtgaaaatatgttaaggaaaataaaagaactaagtgaaataaaataaaataaaattgctctaggcaaactcacctgtgacgggctctatctgtagggccgtcacaggtgacctcacctgtgacggcccanagtgttgggcccgtcacaggtggtcttacctgtgacggctccacggttggcgcccgtcacaggtgaggccacctgtgacggccacatagttggagcccgtcacaggtgagtttgactagggttgacctagggttggacatcttccagatcgatccagatccggcgcccactctcactcactcactctctcgaccgccgcctcgcctctctcgacctctctgccgccctctacgccctcctctccaccgccgcctcgacctctccaccgccgtcctcgccgccgccaaatccgccgccctctccgccaccctctacgccctcctctccactgcctcgacctcgacctctccgccaccatctctgccgccgccctctacgccgccctccccaccgccgcctcgacctctctgccgccctctccaccgccgccgcctctcgaccgccgccgtccatctccatcgacctctccgccgccatctccgccgccctctctaccgccatctccgccctctacgccgccctccccaccgccgcctcgacctctccaccgctgccgcctcactcactctctcgacggccgccgggacctcctctcagtcgccacgccaggaccgtcgtcaccgccaccgggatctcctctccgccgcctcctcctctcgaccgggactcgtcgtcgccgtgtgccgcctcctctgctcgtcgtctcctctccaggtacccctctctctctgatgcccatgaatggaagaattgattctttgataattaaggaactttattaggtttagggtttgaaatttagttcaaatggaagaattgattgattggccgcagatttaatgttgttccgaggttatcaaaccatcacagaatacaaaatgcatgggaaattttggtggattggtcagtgtagtccatggacggaaccgacctagacaccaaaattctccatgcattttgttttctgtcattctttgatgattaaggaactttgcagattatctaaacttgtggatttatataccctttttgtctatgaataggtgaattgcatgaattgttgtttatatacatgatttatatacccttgctgctgctgccacataaatgattgtgggctgttttattatctacacttgattgaattgaatggatgaattgctgtttacatgaagttagtagtactgtctcctttttttgatgaaatatatgcatatttgagatgtgaaatatatgaggtgatgaatttggactatttgtggatgaaatatatgcagtattagatgaattagtctttttgtattagatgattttaggattaattttgctgcattggttgaattttgcatgattttaactagataaatggccagtgatgttttatgttaatacacccctgccactgctgttattgtgggctacttgttaatacacccctattgttgctgcccctgtggagtatctttgcccctgttgctgctgcccaatgtgttccttgttaaatggccagtgatgaattgctcaataagaacaaattatctacacttgttctttttttatgcataagaacagattttctgtacttgctcttttttctggattgataagaggagactatatacacttgttttctgtcattctttgatgatttatatacccttgctgctgctgcccaatgtgttccttattaaatggccagtgatgaattgctcaataagaacatattatctacacttgttcatttttttgcccctacacttgttcatttatatacccatgctgttgatacccctgtggcatatatactcctcctgctgctgttttatgtcaatcatgcaaattctgtacccttgctgctgctgttttttaaatttgcatgattgattcagtggttatatacctctacacttgttctttttttatgcataagaacagattttctgcacttgctctttttttatgcataagaacagattttctgcacttgctcttttcttctggattgataagaggagtatatctagacatgttgttttagttaatttgcccctgctgttgctacccctgtggcatatatactcctcctgctgctgttttatgtcaatcatgcaaattctgtacccttgctgctgctgttttttaaatttgcatgattgattcagtggttatatacctctacacttgttctttttttatgcataagaacagattttctgcacttgctcttttgatgttatgatttcctctttttatcccttcatgcaaatgattgtaattgatgcatatttctcagcaaaactgaggccatatctttcatagtataccccgtattacattggatctaatgctatttagtctaatggtaggaaatttataatctttttcgcaaaagttaaaccatgtcaacgcccggcgcaaacccgccctccccaacacctgcgaggatccaggaagaagcaaacccagccacagaggcagttgccgaaggtcatcccgcgacaacggcggtccaacaacccgaaattcatggtaatttataggataaattttcaccacatgaccacataaattttagctagcaccccttagcaaatattgccttctgtttgtgctgcaaaattgccgcatgaacaacatacgtcgatgtcgggcgggacaagtgcaagtaggtctagtagaaatccgcggtcacaaaatatatggccgaccacagtgcaagttataagagaggttgacgctagtggtaggcccacggcgcccaggactgtcattggaagatggtctaactgctgcgggatagcggcacgtgagaacttcgggatcctccataaagatatcgggaagatcacagaagccgagaaagagcgagcttggacggcaatggagaaatggttcacatttccagccgaagcaaaggataggctcaagcggaaggcattccaaaagatgggcaaagcttggaagaattggaagtcgaagctcttcaccgagtttgtcaacccgcccggcaatcatacgccgttcgatgaataccctcaaataaccgaagcggtttgggaggaattctgctctctcaagaccacccaagagtttagggaatcaagcgaggcacatcgcctactgcaacagcggaatgagcacccgcatcggctaggcaccgcagggtacatcggcaaggaggcaatatgggcccaagaagatgcagccgctgcagcagcgaatgtccctaccccgttttcagacatccctgaacaaagagctcgcaactgggcgcgggcaaggggtaaggtcaacccggacggctctgtcacatttgagaacaaaagtgatgccgtcgtctatcaggaactggtgagttcactacttaacctaactaattttcgttcgtataaagtacaagttcgtataaacgactatcttcttttctagttgggcttggttactgaacaagcttcacaaagcgaggttgagtccgcgccgaagaggcgcaaagatgacatcctcacaaaggcgctcggaaccaaagaacatcctggccgaacttggggaattggtagcgatgtgccctggaagcatggactccctcagtacagatcccaatacaggaaacggaaagtctccaaggaagagagggacgctcgtttgaaggacgaacttaag

SEQ ID NO: 44908 - DNA, 22236 bp, Oryza sativa
  unsure (1)..(22236): unsure at all n locations
cgcaccactagctgcagtggaccacatcgaggtaattgttgttatccgatccatatctaataaaagacatgtacacattccaatattaaattcaaactttcaccttatgcagggcgcagcacagtgtgtcctactagcgagagtccacccaactttcgctcctgaagtcgctgagggcatggctttcaagccctcggttacagacaaggtccacggcgtagacctgctagctgggtatgccaaggtgtccatcgatacagtaaaggacacctggtcaggctatccgctgcccgtgcccccaaatgatgaaatcatgactttgggcgatgcacgcaagacgttcatacaatggcccaaagaagacatagttgtgaagatgactcctcgtccaagtcgaccgacggagcttacacctcccaagtctaagctatcaattgaggctccccgtggaccggcattgtcagtacctcattctcccggtggagctgatatggacttggcagatatagctcaaagcttggctccaataaagaccacaagaaaggctgatagctccccaccacttgtcaagggccagaagcgtgaacgcggcaaggggaaggtcggggagttggcgccggagccaaaaaggggcaaggctgcgacgtcgatgccggtgagcaaatcggggaaggtcgtgagggcgccagcccaatttgagctaggcatgccattggtggaggacaatgtgttagctgtgatgggtattgcttgccgagagctacataagcaatacatggagctaagcaatgccaagcggaaaatgagggagtcatccatagttggacatcacgaccaccagccgttcctatcgtcgcctgcctatataactataggctttgatgacctcttcgaccttttcaggatccggaagttggacactggtcttctaaaatgctactccttgtaagtgcataccttctatacttgtgatatgactggactatatctcctaattaaattagttctaatacgtacatattttaaggttgtgttggatcgagagtcgtcgccatggtaatcaggttggattccttgatccatccatggtgaatgaggttaatttacgacagagcttcactgaggtggttgactatgtcaaccggtgtttatgggcccatcaagacaaggagtacatcatgtgcgcacagaaccaagaataagaggacaatacccttcgtgtatattgtttttgaagttaaggttcttagtactaacgctacataaccactgcgcaggcgacattggattctcctagtcatcgtacctaagtggagtcgggttacctaccttaactccaataagtccaaagattatgatttcagtgaaatcaccaaggccttaaatatggcttggggcccatatgtggaaaagggtggtaggcacaaggagggcaagaatgaactttatcatgacaccaagtttgcatgcgcacaacagatcggagaccaatgtggttttcacgtgtgccacaacatgtcaacacttctaagagaggtgaaagatttcgaccctgaggttgttgctaatggcgaataagctcatttcaatatctacattgctattcaaaacgtgctaattaacctcttatttattaaacagaaaggtagagctggcttcaagatctcacccatcaacccccccgctatcagaggcgaattgtgcgcctttattcttgcagaaataatgaacaagaaaggacgttttcatgccaaatagactcatgaacttggctagataatttattgtgatgtaaaaaagatgtttttataatttctggcgatgtaaaaaattatgtttttatagagtgcaatgtaatttactttcatatgtgcaatatttatggtactttactaaattgtcatcacatttgatcaactacgatttatgttggactattcatctggggactcctttttttttccttatagacaggttgggcaggtggatgacattatggctttaatccattgggtaagtatatatgtggttctatgacaacgaccgaaattgtggctttcaaggggtgtgaatttatagagcaaattgtggcatgtgtactgcatatatgtgttgttgaggatctgtaatgttatattgggggggtgatgtatctgtgatggatctgtgactagaatatatctgtgatgtttatattgtcagagggcatggctagcaaatcctgaggctagccaatatttagcatttatttttttctggaattaactcatcagtgacgggtcggaacaaaaatccgtcaaaggtaacatcacctgtgacggactagcaaataaaggcccgtcagaggtgacctacctgtgacgggcctttacttttgggaccgtcacaggtagatcacctgtgacagcttctaactacggagacctcaacctctgacggcctttatttcaagggccgtcagagatgagtcacctgtgacgggtcctaacttgctcaaggctagcggagaccaacacctctgacggccttctagtaacttgcccgtcagaggtgggtgtcacctgtgacggccggccacccgtcaaaggtgactggactcaccagtgaccactgatcactgaccatgcgcgaagccgtcaaagatgagggtttgggcccgtcacaggtgaccttggccagtgtagtgtgcgtagcatagatgagagaagagcattaggagacaacacattggcagccatgatcatgccatgctgggatgtgctaggtgcattcctccctcgattaattaatgtctcagaaccaagccgaatggctctgatggactgcagtgcgcatgcatctgagttgagcccaacaattcactaacagtctttgtgcatttgaacggcagaaggaggaagtaatataagcacggctgcacatcaagcacatgctgcagtgcttattacggagtaaaaattaacagagaacgatgcatacaaaagcatcggttttatcgcatattgcatggtaggctctatgatcatggccatcttccatcgttaattaggtgtccggaaattaatattattactgccagccgccagcgtgttaattgcacaaactacatggtgcctgcgcgcaagcacaacgagcccacatatgtgtatatatattgaaccggccatccatacattgatgccatttcatgattttaatgagcaccatccaattagtgagcaaatttgaataatttaacgacgaccatcgtagcgtagcatagatgggaggagaatcaggtccgctgggcgtgccattttgtttgatgaaaacaaaataacgaacacacaaaaaatagggaaaccttgtattttattaatcacgattcattaatatgaatgtttacaaatacatcagggctcccacaggagttcgtcttttgccttcgcgaggaatacttaatggaaatgtatgctgactggagattgcatgcagtccgctgattccccgcgcctagcaatgaggctaccggttaattatatccataggacgagcctatggaacacctccgattaagatgcgctttgtgatcgtcgtcttcaaaattaattgctcgccgaaggttgaggttggtgcagaaatttaatgataactgtgatataggtggctttgttttgccgaaacctggtcacaatatattatcaccacgtccatacatgaatcaggtatcataataaaggggatgacttttgcctcgtcggtgcccagtcatatatgccggcctttattagatatagatatatcgttacttttgcctcgttggaacctagtaacgtgtatccgttcctatatgtttggacatgttaataatatcgtgactccggcctcgtaaatgctcggccataatttttatcttccaaagatcatgaatagctcccatgcgtgtgcatggtagcaaaatatattttgtaaaacaccgcttagattgttcaatcaccaatgaaagttggacatatctagcaccgttgttattggcatcatagtaacaaatagatgatccaatctccaataagggtcggacatctaattttgagcatagaaaatatcaaatagtattcggataatccgatcgccaatgaggaccggaccagccttataccattgattgtataaatggagtttgatgataaacgtgtttcggctctcattgatctggctttaatcatcaagatcaagatagattaagaacacgcagatgttccgatcgccaataaggaccgaacatctattgtgtttaatctagaaaattaatatttattcaatgtgctcaccatccagcgcaaatatcttgaatggcggcatgttgtcgataaatgactcgacttgacgaaggacgccggctgcggtgtttaattttctccgcagtggcagcggcaccggtttgctatcaccaggcgacttcaatctcctctcctgattttcctaatctactaagaagaatgggatgaatgaaaatgggcagatgggtgtctcctgtggcgtcctcggcgtcccccgctctagatgggttctgctccttatataggcagcggtgacggaaacagcctccgaatttccagcgccccgtgctaatcctcctgataaaccgatgcagggacgagccaatgcgtcgccgtgtactggagataattatgtgattaacatgcctaatgacggtgggcccatgtgtttaatcgcctgtcaatttccaaattggagataatgatcctcacgtagcaaagcaagtaacgatagcacttgcttatttcttttcttttaatagctccaatcttttgaatcgtacatcggatttaaaattcatttgaaccattactttctattcgaattatacatcaaaacgagtccaatatcgaatatattcggacaccgtgatatttaaaatttctgggcccatatgtcatatagacacgtctcgtatatatttaataaaattgggtggcagataatattttcgtacaaaattaaatgcccaataatttattatatcttatatgaatttttttgcacaaaaactcatcaaagaaatgccccccaccgagtatagtctgtacgcgaagtaggacaggctaatactcggtgaacaaatcatctattcagataaacctctccataaacgattaattttgctggtaactatcaccagtatatctccaacaagtccgagacgtatcaaaactgattagtgattaatccggcatggactccatatcgccgggcatatatattctcagcagccacgcctgcctagggtttcgaatttgtcgtccttctattctgaagtaattttctctaatctttgttcgtctcactagtcgggacaaacgaaccgatctacgtgataaagaccaggtttgctctacttgactatttcttgctttacatatcttgctaataccttgaaaccctcacgatcaggcatgtacttttcaataatcttgtcagctatttttgcctcccacttttgatagtactttaagatggggagagagagcaaagaaaacgttcaaatccgtttcagggcgagcgagccaaaaagaaacaaatcaccggagatcaacacgatcgtgatcctgaattgattaatacggaggagcaatgcgcccctactgatcaccagcgaaactccatggaatctggcagttcagaaggttctcgtgacatgcgcacaggataccttaaaacaactgctcacaatgtatgatcaaccttgaaccactttattgttttaaaacataagcgtgaccatactacttgcttgatgagcttcctgaacttcctttattatttctcttttattcttacagaaaatgccaatctcaatgtacatattatttagcgggtatgaaagagaagcaccgccgcaagaagaaaacggagaagcgttattgtggtgagaggattttgatttttttaaggatgcagagccaaccggtaatttacccgaggatgcacaatcaaccaacaatggtgaagcaaagaaaacagatgatttcatgagtcaggttgcttcatgtttgaatattaagtggggtcaacaacttatacgtgaagcagagtggatgtcgctcacgcagagtcgtgactgggcagcattccgtgtcccgacaccatttcaaaaattacttgccaattgcaaggatgtccttgtaggtcatcaagatcaaccagggacacagccaagagggaggcctggcagcatgtgtctcttgaagccggttttatttaatgactccgggacttttgatgtgccacgtcatactgctacattggcacaaaagttcattacctcaagaaccaagcgatggttggaagatcagccaatgcagttaaggctagaaatttctcccaatgacaagctaatgctatgggctcgtatgctaatggtgaatccgtacgaccgtacatatctcaagaaggccggcgtactccgaggcataatggcgtctatttataaatgcaagatagatccttcattagtggccgcctttttaacttattggaatgtggatggacacactttagtcaccagccagggagagatgggttatcctctccatacaatgtacgatgccatgggcataccaatttcagggcgcctttatgaagaatttatccctttaccatccacagctcgtgggcatgtgcagactctgcacaatatatatgttgaggagtgtcccctacaactaaatgagggtcctggaatagtaaccatcgcgacatgggtcaatcacttcttcggcgaccaccctgtgccttttcagtcatttttacccaatggttttgctgatccaaaaaaacctttatatgagggcccaaattttcgtgttgagattcggaatggccgacccactgctatcatgtgtggtctcgaaatgacttacgtacacacctacccattggtggtgtaccgggcagcttttatcgccgcatggttatgcacatattgcgttccagtggaggaaggcaactttattcgccccgaggtttttactatggcaatggaaatcgctcaaggcagccgctgggccattggtgttacaagcatggcatttttatatcgtgccctggacaatgtctaccaccaagtagctgcacgtcaggcttctgcgagtgactgttcttcatttgtgccaggccattttattatgggctggtttgcatctttttggagagggttcctacgtcggcaactttatcttgcccggtgatgaacccgccctttattatagacttcagagactatgagtctatggatattaagagcgcacatagcttattttgggattttaatgatgctggaacggctttacgttcactggacttcttgggacggtccagcatccgttttcccacatccgaccaggaggtcgagttatttgatgaccgttctcccaaggcacacagggcaatttccatggcagccgtggatttcttggtcagctgcactgttggcggcgtcacctataggagaggtgaagtttttgacaatttggtttactgtcctcatcgattcgctcgcatgttcaactatgaccagcatgtccccaatttccttatgatcaccattaacaggacacgtagccttgattttccaagttacctaaatggcaattctagggatgaatcgctgcaacttttgcaacggcgccacctagcttttcataggccgaggggtcactcaatatttattcaacctttcgcccgggacaccatacgttcacttgattacatcaacgggtgctctcaagctttcaattttctaaagcatccgagcctattctgttcacggtcaaaacactccaccaaagctgcaactacgaaaaatgcacccggggcagaaacatcaggcatgcagtttaccaaattttttttaaagaaaaatatatactctgttatcaatatgaatggtcattggttactgtttcctctaatttattttcgtcccccttcttttttttaggaggttcaggaggtagggtgggcacacctaagcaaagaacagccaagtctgtctcgatctctcctgagcaccaggaggagagcgctcaaaccgagatcaagacaacgttgccattacccgcctcgagtgcgaaccctacagagattgtgagggtaggacccgaccggtctggaaaagacatcaagaaaatcagaacatgcattgccaacccagacaatgtcacaactcatgtgtctgcccaagcctcacaacaggagttattagtgttacctcctcgaaatgagactgtactcaactcgtcagccatgacgcatatcgacccctacagtgaagggttggctattccacatgatgatataggcactctgcccacagatcttcttacaggcgatttttctgatctagccactcttttggatggaggggcaaaccctgaaaccagtctctgtttagattcgcccatttttccgggtgctactcagaaggacaacgttaattcgcatctcctagaggacgacgagacgcgtaccgaggcttgtgctgatacagtaaaagggggcacctctcatcacggtacaactcatttattttattttatagacatttctgtttgttcctttttttatacaaataaccaatttcatgcactcccttccttcttatgtgtttcagcttcactgactggagttgaagagttgtccaatgaatccaagaagttatctatggatgttgagcaaatcgtcgcacaaattctaaaggcaccgaacgtagaccctggtgcaggggaaaactcctagttcaagggatttcatgggaacaactcggtgaccctgccgaaactttcagatgatgtttcagctcgtggtcttaaacatgtctggtctgagatcaaagcgtttcaagaattactcaaacaacgcccgatacagaaggatattgtgcttaaagagataagcatcaatctggatttgtggagtaacttcttctcaaaaccacctcctgaaataattaggctaatggaagggttacgtgtgcaaaagggagcgctatcagaggaagcgccactgccaaccactaagattgaccatcatattgatatgctccgcactgctcaagacaaggtggagtcatcgtgcgtcgctttggcagcactaacgagtcaatataacgtagaacgggctgtagaagaaggcaataagagggagtgctctcgacaagcccagaaaatcaaagcagagatagcaatgttgcaagcaaaacttcaacaggtggaagatgattattcccgtgctcaatgccaccaagatgttgtaatagagaacttgaactcccatcttgagcgacatcgacaagctaaggatcgaggatatgagattgcggcacagttagagcaggcgagcgtacaccaaaagtctctccaaaatattgaagactttactaagccagacgagtttggtctgtcccaatatgtctacaatatatttgattttttcataggctgctcattagatgagtagacgctgttttaaaatcttgtttcaggcttgtaatagctcttcagatattttatttgtttctgatataacagagtgaactcctttatttgctattatatactttgatttgcaccagaacaacggagtgaactccttcaaatttaataggagcgttgcattgttaccaaccgtctttgtgcactggcttcttccttttttttctttatatatatacatttcctcacataaaagatgctcacgttcagattttttagtggctttactactgtagcagtaacagtaacgccactaattcttcacgattctggttcagccatagattttttttattcaattttttttactggcttttaaaagaccagcctccccgctatagaaattatagcgaaattcatgcaacaatgcaaatgtcgataaatataccatagcgaagattcatgctatgacataaaattccttgtggcgaagaatcatgccgcggcgtgagaacaaaaaaaaatttaaggaagaaaacgtagcgaaaaattcgtgccacacactgatgattatatggcgaagtaatcataccatcttataaaattctattgcgaccaaaataaatcggtgccaaccaatagaaaattaatcaagctagacgcgaccgttaaaatggttacggtactaggcgtctaaactcgaagggtttcacagtcctgcattgaccgtactggcatgctttactgctcccaaatattgactgaccatcatccgaaaatcatagatgctggttcagtgcaactgtacgtaattgactgggccactgtgagaacgcgtcccagtataaacttgataggattaattgccgtccgaaaatcatagacgttggcataatccaattgttcatgaaataataagatcactgtagaaaaattcgttacagtgcagaattgttggaattaatcgtcgtccgaaaatcttggacacgggtgaaacccaattaaataataaaatcactgtagaaagcacattacactgtacaacttataatattaattgtcgtccgaaaatcatggacattggtatgatccaaccatatattaagtaatcatatcactgtaataagaacaccacagtaaacttagtaggaataatttccgtccggaaatcatagacgttgtcatccttcttttcttttgccacgtgttttttttgccacgcgtcataaaggccttcttcacacacatcttgtaaattcaggcttcaaatattattagcatatgagacggatgcccccgccgagtagagttcatgtgcaaagcaacagggactcgactcggggaaacaataaatgagttgtcttgtttccaaggaggagagagaaaaaaaatatgtgggatttttttttgtgtgttggcttttcttccggtcgccaagctatgaggtaacgaatggcaaactgctggaggatgtaatatgccctcaatttctgaataacgacgggatctcgcttaatgcttcaactccctcgtgtaacttgtgataatgagctcacgtttcatcaggatctcttgaaaacaaaggggtcttttctgagttttccttcaattatgtgcctcatattttttacctttatcccaggaaggaggataggataaggctatatttcaaaggtggtttgggtcaataggctatgaaattgccattacttttgctgagggtgggagatgactacttcccgctttcagattgaagaagagcaaccaacccggctacaggctgctgccaagacattgccatactttcgctcattttcttgacgatgtcgctcgagatgggagttcaagttctctgttacaacatcttgtcggtgttgtgcactggagtgggcatcttccacttgttgaagtcttgcttgcaacactgctatctctgctctaactttccgtgcttgtcgtgagcactctctcttgttgccctcctctactgcttgctctacattatattgactcgtcagtgcctccaaagcgacacacgatgactccaccttgtcttgagcagtgcggagcagatcgacgtgttggttaatctggtcctgttgtgcgagaacaagattagtagttggcagtggcgcttcctccgatagcgctcccttaagcacgcgtaacccttccattagcctaattatttcaggaggtggctttgagaagaagttactccacagatccaggttgatgcttatctctttaagtataatatctctctgtaccgggcgttgcttgagtaattcttgaaacgctttgatctcagaccagacatgtttaagaccacgggctgaaacaacatctgaaagtttcggcagggtcacggggttgttcccatcaaattctttgagcagggagttttcctctgcgccacagttcatgttcaccgcttgtgaaacttgggcgattatatgctcaacattgatagacaacttcttggattcactgaacaagtgttgaatcctagctggagcacatgagaagaagggtagtgtgtgaaattgattacataaaaaaaaggaaaacagagtggacagagaagtataaaatgaaagaaaccagttgtaccttgcagagtggtttctcctgcccgcatgacagaattatccccattacaatgcttactagtggcttcggggcccactgccttgttagaaactccatctggtcgtcatcaagaagcttactagtaggttgagttgggggcatggtgcagatagtatcacacggcgtgtttgatcctccgccggaaaaatcaacatatgttgcggtatgatagatatgttatgtttccctgtgaggaagctgtgatgatccacatgaaaaaataagtcggtggccctgtttgatgttcaaacaagaggctactttagacaaccacatccacttcttcgctgtcccgattgccgttacatcttcgggtgagatattttgctggtcaatgtgatagaaaaatttgaagtcatcacaccaaagaaacatctcgccattatcttctcttggcgccttcttggctagtccactgtataatgtgtagattgaggacgcctcaacataggggttccccttttaaaaaaaagaggcacttataagatggatcaattcacggaagagtttaacgattcagaacctaacttctgtcccttttttttattatgatcttttcgccgtgagatttttgcatgccaaggcccctcccttgctgggaagtttccttgataccttcatcactatcatggccaggcaatggtgggtcatctgggatctcctgccaagtataagtggggttgcacacgctggtatgatcggcacgatcactagccttctgcattttcttgtcttgaacagtagcaaagaaattcgatcgactgctttccccagtcgatcaccgttaatttgcagtagctctgatcgaagattttaacgatctaacatgagctctgttttaattactcgattaagaagctgtacagactttatttatatatataggacatacggccatgagcccgtatgatacatgaactcggcttcaatatatatcagatcatgcacgtcatttgccgattggcagccagcttgtgaatcaagccatgtaccacacggagatggattaatccttcgtaacaatatactactgagtatttcaccgagtgaagtctgtcctgcttcgcgtacaaactacactcggtggggggcatttgtttgatgaatttttgtgctaaaaattcatagaagaaataataaattattgggcatttaattttatatgagaatattatttgtagcacaattttactgaatatatacgagacgtgtctatatgacatgtgggtctagaaattttaaatattatggtgtccgaatatattcgatattggactcgttttgttgtataattgaatagaaagtgatggttcaaatggattttaaatccgatatacgattcaaaagattggaactattaaaacaaaagaaataagaagtgctatcgttactacgtgagcatgcatggtcattggctgtggcgattaaacatatggggcccactgtcattagacatgttaatcacataattatctccagactgcagtacacgttgacggattggctcgtctctgcgtcggcttatcacgaagattagcacagggcgctggaaattcggaggccgcttccgtcgccgctgcctatataagaagcagaacccatctagagcgggggacgccgaggacgccacaggagacacccatctgcccattttcattcatcccattcttctcagtagattaggaaaatcaggagaggagattgaagccggccggtgatagcaaaccggcgccgctgcggagagaattaaacaccgcagccggcgtccttcatcaagtcgagtcatttatcgacaacatgccgccatttaggatatttgcgctggatggtgagcacattgaataaatattaattttctagattaaacacaatagatgttcggttcttattggcgatcggaacatctgcgtgtttttaatctatcttgatcttgatgattaaagccagatcaatgagagccgaagcacggttatcatcaaactccatttatacaatcgatggtataaggctggttcggtcctcattggcgatcggattatccgaacactatttgatatattttctatgctcaaaattagatgtccggccctcattggagattggatcatctatttgttactatgataccgataacaacggcgctagatatgtccaactttcattggtgattggacaatctaaccgatgttttacaaaatatattttgataccatgcacacacatgggagctattcgtgatctttggaagttaaaaattatggccgagtatttatgaggccggtgtcacgatattattaacatgtccaaacagataggaacggatacatgttactaggttccgacgaggcaaaagtaacgatatatccacatctaataaaagctggcatatatgactgggcaccgacgaggcaaaagtcatcccctttgttatgatacctgactcatgtatggacatggtgataatatattgtgaacaggtttcggcaaaacaaagccacctatatcacagttatcattaaatctctgcaccaacttcaaccttcggcgagcaatcaattttgaagacgacgatcacaagcgcagcttaatcggaggtgttccataggctctttcctgtggatgtaattaaccggccgcctcattgctaggcgccgggaatcagcggactacacgcaatctccagtcagcatacctttccattaagtattcctcgcgaaggcaaaaggcgaactcctgtgggagccctcatgtatttgtaaacattcatgttaatgaatcgtgattaataaaatacagggtttccctattttctgtgtgttcgttgttttgttttcatcaaacatctggcttggagtgagattgcattgcatgtgacttagcttctttttaatattccggtgcagtctgcaacacagaaatgacgcagaaggaaaatcaagagagggcaacgcaactgaatggatccaaggctgaatcgaataagttgtctttgtttccttcttttcctgtacctgggagttggttgtataccccctctgactttgcttctttttatgcagttttgtacaaaacaaactcaagcagaaagcgaaacaaggggtggaatctcaaaagagagaaacgaaggctcacttgagcaagatgcttgctggattgaagattgttgaatttcttcatgctgaagggtggattggagggattatctaagaggttttttttttcattttaaagctattctaatgcctacattgtcaactacattccccatatttagtatgcttgtccacatgtcaatggcaccgttggagcaaatccataatgtgcatccttattccttaaatagtgcggacatccttaaataatcctttgagaagaagtatcctaacctttacaatctagttagaaataaaaatgaggtagtggccaaggtaatgagtagaatcccgttaaatgtgtctttcagaagatcaatactgggaagaaacttgaagcctggtatgagctagtgtcgaaggtattaagctagtgtcgaaggttgttaatactgttttgacagattagaaagatcgcttcttttggaaaaacaataaagatggcctttccacagtaaaatctatgtacaagttgctcatgtatgaaggggtggttcctaagaagaatttcatttggaagctcaagattccacttaaaatcaaaattttcttgtggtaccttaaggaaggggtaattctcactaaggataatctagcaaagagaaggtggaagggtagtctaagttgtttttgtaactcaaaggtaacaatataacaccttttgtttgattgctcaatggctaggtatatttggagtgcgctcctttttacatttgagattaggcaactgtgtagcatgtctcaaatgtttgggaattggctgaattgtgttgaaccaggctcaagagaatattgtttgtgggcatagctgcatttctttaggcaatttggttatatagcaatgatgtggtctttaattgctccaatcctacatctttcttgcaggtcattttcataggaacgcattgggcaatgacttgatctttgcttcttaagggaggcgatgaagaaatagttgagagcagcaaactgctggagaagcgtgtgttggagttcttctccgtgtatggctggaaccttacaagaagattggaagcctagtctttttcttcgtttgttgttcttaaaactctttgtgctgtcatctcttatgcaaaatcattttatatttaaactgacaaatagaacctggaatcatatatttctccccatcgaagaaaaaaaatgtacagatgatggccacgaaatatcaaaatccaaatgagcagattgatcgactcaaacaaatccagcaaactcggcaaaggaaacgaagacattttaattaatttatagaaatcagtcaaatgagatataggagtaattgatatgaccaagtccttatgtgtaactattttcttccaacgggaaggtgacaggttgtgcatctgccgattgatgacttttaatgcatatgatcgcctgacagccgtgaatattgcaacagaattttagttgtccagcaaaaagagatttgcagcttgcaggttcatctagaaaacctacaccagtaaaaaaaatgccgagatagaaaaaaaaaccatctagaaacgaactaggctggctcaagaacggagtgtggagctattccaccgtatcccagtcatagtagaaaaagccgggttgtcccggtggagtgctggcttcaccggtctatcggtccaacagttgggtcactggatgaaccgcggtttattccctatattttgtgttgccttccagtcacagcggctaagttatagtataacttagcctagcggttggcaaggtttgcatctatcctagcagcctgggtcgaatctcatccctgcaccattttttctcccataaaaatcaagttgggctcataagaaagatgctatcaagtggcccaactagctttgctcgaaaaccgcagccggttcacaccgggtcgattgtgtgagcgatcctttgagggaaccgagccatgcgatcctttgagggaaccgagccggtcagggagctggttccggttttttctactatgatcccagtagatcttttttttttcggggatgatcccagtagatcttattatatacttcttctgttttatactatataagtcttattatatacttcttctgttttatactatgtaagtcatttgcttttttttcctaacttcaaactttttaagtttgaccaactttataaaaaaatatattatcattttcaatacaaaacaaacatattatcaaattatatttaatattgaatttaatgaaactaattttgtattgtagatactattttttttaaacttggtcaaatctaaagaactttgattaagaaaaaaagtaaaacgacttataatatgaaacgaagggagtattgaaaagaaaagtttggtcaggtcgttatccgtcatacatggcacatttgcggcccagcatatacatacataaatctgtttccaacacacagcatattctctactctctacttatactatactactattgtaatggcaaaatctaaaccgagaagcctcttagtttagtgtaaactagcgaccaaccggttgtgagaataagtactactacacgtgcatgctttttttcctcttagacatgcatgtctttttcttccttcttataaagttttctcaaattacttatccaatctacaatccgattacaccattgtattcgttacaattaaatcttcacaacaagatcttacatgattatattacgatgaaaaatatttatatttgcaaattacttttattatatacgtaagttacttttatcatatatataagttacttttaaatttgactaaattacttcttagatatataaaagtaaattcaataaagtctaaaagtaatttacatatattataaagtatctttaaacaaaactaaagtaactttgtcacaacattagaagtaaattcgttgtagggataaaaatatgactttatctagaaattaaatttaatcagcacagatcaacacacgtaagtttaacaatttttaaaagtaacttcaatgttaattggaagtaatttttgcatggttcagaagtaactctctataaatcttcaatgttaattagaagtaacttttggatcaatgaaaaaaggcatgcattaaagttactttttttttcgttataagttacttctataatatatctaaattacttttaggctttattgaatttacttttatatgtctaagaagtaatttagtgaaatctaaaagtaatttagatatattataaaagtaatttattatttttcatcaaaatataatcatgtgagattctgttataaagatttaatttttacgaacatgatggtgtaatcggatcgtagatcggatgagtagtttaagagaaaattttatttaaagtataggtggatagagtctctcatagatagagtggtagttggtttagacaaaccagctaccattagtagctatatatatatatatatatatatatatatatatatatatatatatatatatatatatatatatatatatatatatatatatatatagtcacgtcctactataatataatataattaaataaaaacgatcgtaatgggggtcgtgatttctacaactattatttctgaccattagatccgcaacaatcaatggatgagatttatcttgcgatccttccacgcccacgcgcgatccttcccttggcgtagaaaaagaaccgttgccccttttccttggcaagtccgcacatcgtgccgcccctccgccgtcctcgccttccccaccacgccgtcgtcgctcccccgtcatccactcatccactgcgctgccgcaaaaagcgatcctcctgcatgcatgccgcttcccgccggagccgctcgcctcccgccagagccgctctgcctccctgctcgcgccgcgacggagaggaaggatagctggggtctgctcacaccgccccacggagaggaagtattttggtgtgtggtttaaggattgttgatataacgatttcattttgcctaatagtgtttgatgaaattttgttcacgttttattaattatttttcactaatgtgtctgcaaatacttgagtcaggataagagggaggatgccatattcacctgggtgctctctgaagatgcataaccgtgtgatgtctataaatttcttctagtgcctgttgttgcagggtttatttctctatctgtttagttctgcttattcatcaatataatcaaagcttctgcttattactatagttttgtcatgactgaattctttactaatcatgaggcgctacactttatactacctaaattgattggaagaatatgccttcaatggaataagtgggactatacttaatcatccagttgtattactgccaaaaccctattccttaatcatccagttgtacataaatgttagatgcacaggttgcatatataaccctattccataatcacccagttgtacatctatatgttcgtgcttcataccagccttctgccttcaataccattaacaatatgtatacttatgattttttccccgctaaccatggctgctaggagatcttccctgttgtgcttcctaaggccgtgcccaccatgcaaggagcagagcaatgattactgcgttgataagattgactgattgagagggtcatggtgagcctaattgcaacattcattagataaaatggttgtttgattgctttagtactcttgtcgatatgtgacaatgttttgcactactaatattgtaaatctcccgggattgtcctcaatttcttttcactttgtctacccaataggagaaacctatgggatgtgctccgtgacaacatctgctcactggatgctactaaaattatgtcatttaatatccattttttactgtgatttttaattgaagtaagtaaatatatactacagatattttactgcctacctgcaaatatttggtttaatttgtattttctaacacatgcattttgatattcttacattggattatattttcattccattttgagctgaaaaagtggtattcagatattatgtttgacataactatttggacctttttccctaaactatacttatgtgtttcttaaattttaactgaagatggttctcttaggcaaaagttttttcctccttctgttagacaaagaaaagaaaaatgataagcactggataatgcatacatgtgtgcttgattataccgtatactaattgcgcggtgtgatatttgttttcagctgaagtgatagatataactgtgattgcaaggatgctaagagaccatggcaagcccaagggatgtaaggatgccaacgcgaaaccatggcaagcccaagggcacagctatcacggcagaagggggtgggcagtgttgatgttagaatagagcagagctatcagggatgtggagcaggtaatctcagcgtacaatagactaataatttttggggcaagagaaatgcaaatctcagattgattataatggaatgggagcaaaagcaaagatagtaccagatccaactctcctttccaggtttattacactattctcagcattttagttggtttccctgttagttgagtgacttagagattatcagattaggcttaaatagtctctaacaacctaataactcagattggatgaccattactactatattagcaatttcactgcatcaattgagtgttaatttatatctttgaattacgcgccattttcacaaattcaagatatcagaaattacgtggaagtgtaaatgaggtcttcaatgcattgtcttatgttacatctttcctgctcccctgttttcgttggtatatgcctcttacatccagtgttatgatgccataggaaggtcagaaggtgaatgatgaactgatgatgctatctgaaggtgagtgacgatgctgtctgaaggtcagaaggtgagtgattgcaattcttgcaagggaaaatacattgctccatgagtgtgactcctctagaggtatatgatggaatctcatttctacggcaaccttaagtgctatgtgtctgttggaggagagggaatgctgatgaaacctgaagttattaggtagtacaaggttgttagattcttacaagtttttagaagacatgaaagtactattcttaacgacctaattcttttggcacagacgacaggtccatcaaacatatatatcaagcaagacaaatgattcaagtgataattcaagatttatgctggtatcatttttgtggaatttgtattggttgagataggaataattttagctccattggcttttgtgggtcaatatttggattttttttttgcgttggacaatttatttctcactaatacagttgttagtttctacctatgcataatttagataaattttgaaagtgattatatatccctgtgggaggtgtgttgagaaaaacgtgcaatgtaggtgtacgttgaagagctagacaaataggttcgccacttcgctggctggtggatgataacttgaacctcaagatcacatcactaattaattctgataataaattattactttcgaaatgttgtgatttgatcattcatggatgaccacttgttctgcttggacagctgaaacaggaggtagctgcactggtgatgcctacaagagagctcactgcgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 44909 - DNA, 3136 bp, Oryza sativa
gaaacagcatgttgttcagcaaactaggagaacatataaataaacaaagatctgaagtgtttgttccctcactagggtgaccggtgctgaatttaaaatgtttttttattgcatagtcacatttggaaactttctatgtaactggcatgtgcagctcacattttttaggccaatgttcaagcatcaggagagatgacccgaaccgtatgataaataaacaagagatataacgaatatctctcttaaaagtaatgagaatcatgtgaaaagaactcacacgcatagtagtcctttgattaatattttgttatctgagaagagtttttgcagcctcgactattttcaatcagatttcttcttcaaaggcatgcaagcagcgcatgagcgacactgcctggcttgctcaattgcaaggcttagctttgtatttgatgttaactcatgaatgagtctggaattactccgttgatatcttagttagccagtctcaccgcagaacatagccggtagaggagaaaagtgtagggatactcatgaatggtacaatgagtaccaagtagatttggatcagtagatcacacatcacttgaaacaggttgcattgcttcattacataacttactgaagccaagtcgaataaccttgcatatatttaatttgatgccacagataaaaaaaatcttttgaatgtttaatttgagaaagagaggaataggatgtgcttgactgcataggatatatatgcagcagccacatataaaaattaatagaaaagcaatgcttacaaaagcatcgttcccatatatgcatactgcacggcaggcttttgtgagcctcttgttatttttaaagaaattaattaatttttttatagatcactggattatttttgtttttacaggaaatagatcgatacctcctgaaaactgccgcatatagacgttcccaataatttgttttcagaacagcctgaattaatgtctgtgaggtgactctctctctcaagcaagtgcgacagcaaagcagtgcacagttactatacttttatagaaaatgtcattcaataaactgaattggaaatacttgaacaacagccatataagtgcatatatcttgcacttttcaaactttttttttaaccagcgacatttgtcagtagccagtttcaaaagtatatatattagtatatgatagctaactcttcttgatgcagagaattacggatcagcaggaaagggaagacggcagcaatgcccggcgtggagcagtcaaataaataaaaactaggaggatgcaattgcccccggtatttcagtatttggaaatgtgtatatggatgtttgatccttgggtgctgccactacgccagatcctcacacctctgacgggatacctgtgacgggcaaacgaattggtcagtattgaccattacctttgacgggttatacgggatgccgtcaccggtgagggatctgcagcggcccgtcacaggtatcccctcacctgtgacgggccgaaaggaaaacccgtcagaggtataccagtgacgagtttttcttccaacccgtcactggtatcccctcacctgtgacgggccgatacattagaagccgtcagaggtgatgggccgccacctgtgacggctttcatttctggcccgtcacaggtgagcggataccagtgacgggccgttgaatagaagcccgtcaaaggtatgagcaatacctttgacgggcttttttttatctaacccgtttgaggtgtgttgggtctataaatacccccaaactgccaactgctttccatcccgaccattgtactgttcacaaatcggttgggagggcaaggggggcgattttttactaaaattcaaggtaaaaaacacattattctccattcattctcaacatatcgatcatcatttatttttcctcgtatgttgttgatttcagatggatcgtagatggatgtactatgcgcatcgttcgtctaccgagtatagagagggggtcactgaatttgtcacatttgcggataatgacagaaaaagtaggatgagcatgcacatgttgtgcccatgtagggactgtaagaatgaacagatgatcgaagacaaggatgaagtgcatgctcatttgataatgaatggattcatgaagaaatatacctgctggaccaagcatggagagcaagaggcgcctgatgtcgcagctgaagaagtgttggatcagggtgtagagaacaccgccgcagctcgagaaggcatgttcgtaccttctcctttaggtggagagaccatagatttggacactcaatgtctatctacaatgttgcatgacattgaagacgcagaggacaacgacagagattatgagaagtttagtaagttggtggaagattgccagatgccgttgtatgatggatgcaagtcgaagcacagcaagttgtcatgcgtgttggaactgatgaagcttaaggctattaatggctggtcggacaagagttttacagaactccttgagctgttaaaggatatgttgccagaggggaacaatttacctcagacgacatatgaagcgaagcaagtattatgtccgttgggcctggaggtcagaagaattcatgcatgtccgaacgactgcattttgtattacaaggaatacgctgacttggatgtctaccctatctgtgggggatcaagatacaaacgagcaaagagtgaaggtgaaggaagtaagtcaaagaggggaggcccagcaaaggtggtgtggtatctcccaattgcggagcgcatgaagagaatgtttgcgaacaaggaacaagctaagcttgtgcgctggcatgccgaagaacggaaagtcgatactatgctgaggcacccagcagattcagtgcagtggaggacaatcgataggatttaccaggaattctcaaatgacccaagaaacatgcgtttcgcaatgtgtacggacggcattaatcctttcggtgatttgagcagtcgtcacagtacatggccagttctgcttgttaactataaccttcctccctggttgtgtttcaaaagaaagtacattatgcttgccatgctcattcaaggaccgagacaacctggcaacgatatcgatgtattcct

SEQ ID NO: 44910 - DNA, 16970 bp, Oryza sativa
ggtacactacatgagaaatggtgtattttcttagtactaccacatttttgtaaacatcacagctaacttcatgagaaatataaagcagaactggaacattagctaagattcatggggaaaagagacaagtgggttcaccctaaactcttttgcaccaggatcaagcatggttgcaatgcaagtttccatcccatggctatgaataacagccccagctcctctcatcagataagcctgcaaaataccaatgaaaattagacaatttagactaaaacaagttgaagcggacaaattaagcaaaggatagcactgataaccttcatgaacagaggagcacagtcagtacattttggaggcttgtttggccatggctttgatacaggtgaggagagcaccttcccatctgctgcagcacatacatgtcctctgccaccatcctctccttgtgcacacctgagaatgtgattaaaattcttatatcgtttcttttggttcaaatcgcaaccttagtgctcacagaagttatggtcgactggtagaaaatcacgttctgtttaatgattcaggttattagctttgtttcatccccatgatagattagtggcgctcgacaaacctctttccacatcaataggcatgtccaaaattgcaaaagcatgttttcatcaaaagaggataacattggttctttatagcaggcctagataatgaaatgctcaaggtggtccaatactggacattacaactacgcacaggtttacacaagtatttttaaagtaaaaactgtaatagtaacacttcacatgcatcatgcactgatgctcaactgcattgagacataagctaataagcataatagttcacacttgaaagctagaaatattttaagttactagtttgtaaataaaattgatcttggctccttagcaacttatctttgtcatagaaattattaacataacaagaattttttttccttagtagtgtacaattattattgcatgttttattctagtctgactttgtacagaaatcacttggttttccagctcccataattcaaactgttaattcttcttggccagtttctgacttaacagtgaaatatctgagaacgttccagactattaaccacactcggataaataaagttgaccacagtgttcaaccgctactgcagtgcttgctgagccatttcacaaaaactgcaatcagtcaaacatacgaggggtgggccatatcaatatgaaataagcacctagcctcctaaatgcttaagtctattccaactgtctggacaagcagcctacataagaataataaagcaaccgtagttccaatttttttagtaacaagcccaaatcaacacccaactaagcttatctgatacttaggccctgtttctttcagcttaagattattataatctagattattgagttagattactataagctagattgttataatctgtagtagaataagcggttagttgtttctttcctagattaatagagcctagattattgggtttgcaaatctaaagagggagtggggtggcatggtgggtaattttttacccaataatctggaaaaagctcacctaaatgagcttatcagattataataagctgggcttcagattataataagctacttcaataagttgtctgtttctttcagcttactcccaataatctggattataataatcccaagctgaaagaaacagggccttacacccccacaatcttgtacgttaatacagatcacaataactaacatgagcagcagagcacaatcttcaactgtgcatgccaacgagcaatccccatatgcaaaatcacatcagtcagttcgtccagcaggagcagagcagtgcaagatagtacaggagagaggtggtccttcctgttcctgactccactttgtattgccacagagcaacacaacgcatgagtaaaccaaattaaacaatacaaagctcgactgctctagatacgtagtagcagcacaagagtgatgagacacaggcaagtcaatgccatcgaaattgttaatttaaccgaactccacgcagcagactacgttcctacccacccacccacccaccctcgtcgatcccggaataacatcccctgccgccgtggcaattcatcgaacaggtggagggagggtgtgaggctgaggaaggcggaggaggaggaggataccggagggggacatgacgatgagctgatcggcgagggggagcgccgggtcgttggccttgacggtgatgctgccccccgttccggtgacccacccttggccgtagaagtggcggcacagctccgccaccagctcccgcgcctccctcaccgcctctccctccaggtacgcctccgactccgtcgccgccgccccctccccccttccgccgccgcagcacgccatggctctcctccgccgccgccgccgggattcgagctcgccttgatgctttttgtggtgatggtttggttttttgtagtaggaagagtgagagtagcagtagggcggctcgattagtgcctcctaattaatcgcgcgattctgattaactaatttttttatgtgggaccggcatgtcagtgacgtgtttggagggaatcgcggaaagcagagaataattgttactagtactagtcctttttctcactggtgtgtgagcgagctcgctaacacgtgtatcagcaggtagggccagtgatcgttgtgggtcccacatgtcagtgaggggatctcatgcgggtaaggcgttcatggcgtagctgtgagaggaggtcggggtcacggggcggccaggtgagtcgtgaacggcatatttcgtgatggcatagcatctgatttttttttttgtatttttctcttgtcgtattcagagacaagttttgatgtcgtgcacaagtgaatttattcgggtttatctccatgagaaaggttcaaactgggagtactgaagaggatgaatttggcagctgtggaataaattctatttaaattcccttcttttttgaaagggatttaccaacaatgctttaaaatatagttagaaataatatttactgaatttttagaatagttaataaaagataactacctatgtttcccgttttaacttttttataaatcaaacttttttagatttgattaagtttgtagaaaaatataacaatattttcaacacaaaacaaataaattatcaaaatatgttcaatgttagatataatgaaaataatttggtgctacagttgttgctatatttttctataaattttgtcaaactttctaaaaaaattgacttaaaaaaatcaaagcgacttatattttgaaaaaaggagtactttcatatgtttccaaaaataattttatgtggatatttcatttatcttttcaatgatctttaaaatggagccagataacaaaaacgacgggaaagaaaacctccaaaagtaatcccaaaacaaaattccaataaattcaaataaacttttggatctcataatcgaaaccactcgaaataagttcactagaggtccctcaatttaacagcgagattttttaaggtcctttaaccataaaaccagaaatctttacccttaaactatacaaaaccgtctaatttgggtcctaaggcagtatagatggctggttttgatgacgtggtatccttgtcagtaaaaataataaaataaatatgtgggggcccatacgtcagtgagagaaaatgatgtggccccacatctcttttttcttttctttttctctgctcttctcaacttctcggttcgcatgcgcaggcgagcaaatggcggccgacggcggcgcgctgggaagaagcaggagaggggagagaggaggcggccgacgccagagaaggggaaagaggcggccggcgcgaccgcccgtgaggccgcaacggcaggagcggcggccggcgtcgcctctccccatccggaggcgggagctgcaccggctccgggcgcgggcagcgcgcagccggagcaggcggtgtcaacggtcgagcgcggctgtggcggtgggcgagcgccggctccgggcgcggccggagcagtgcggcggcggcaagtggcgggcgagcggccgacgaggtagtcggcgacggagaagaatacttcaataagcttcactagccgccgcctccggagacggagagctcctcgtcggagttctaatccaacgtggctgctgcctcacaatttatatatatatatatatatatatatatatatatatatatatatatatataactacttgtctataaacgattgattctgttgtgtttgagaattaagatggtggatccagtgagtagcgtgaagcatatcacggagatggctctgaagatcaagcatgcggtggggacggtttagagaaacaagtaggactgcctccagatcagaaggcgagtgatgagagtgagcgatatactgtcgctgctgcaggaaacggagaacatcttgagcaacccggcaataagcgccgcgttggaggatctcgccgacacaaatttctcactgtgctcctaccttttttgcctctgtaacagcggggagaatgggcaaaagtgggagcggcagcgatggcatcggcatgcggtgggagcagcggcggtcgtggcggcgcgtggtgggagcggcggccctgggggggggaggggaacggcggccgtggcaacgtgcggtcggagcagcagtggcctcggcgacgacggggaacatgggtgacggtaggagcggggaggagtcggcccgcggcgggagcagcggtggccgtggcagcgcgtggcgggccgcgacggcgggagcggcagaggcgtcgactcgaggtgggagcggcggtgacggcatcagcgcgcggtgggagcaggggaggccgcggcggcgtgcggcaacgtaactgacatgtgggccccacctaccagtcatcaatactgccttgggacctaaattagacagttttgtatagtttaggggtaaagatttctggttttatggttaagttgagggatctccggtgaacttattccaaaccactcccaaccacaacgcgagtccattgaactgggccagactaacgtaaatgggccgggccgaggcccaaagacatttccatccagttttgggcttcccccccgaactcaccagggcccacctcgcctgccacccccacctcctctgcgcgggaaaccgttgctcgttggcgccaatttttcccgccatttcgccccccgcgccgcctccctcttaaccccacctcctcctcctcccccaaccctagcagccactcctccccaccttactcccccccgcttccactcccccgaaccttccagaaccttctcccgctcccccgccgagatggtaagctccccttcctcttccttcagcgcggcggcggcggccggatctgacgcctcgccgtgtttttttttcttttttgggtaggatgactcggagaacaacgcgccgtcgacgccggggtcgccggggttcagcacagacaggctgccgccgaacaccaccaccagccgcggcgccaccgacccgtcctcctactcggacgacgacgacgacgacgtggttggcgcggaggaggcggaggtcgaccccaacgtgctccccgaggacgacggcgtcgtcgccgccgaggaggaggaggacggggaggacctcttcaacgacaactacctcgagtaagcgagaattcccagatctgatgttcattctagttcggttgacaagtgagatctggtttgattagaagtttgtttttgtggcttagtgggagaattagaagttttagtgtttatgttaaatatttgctttagggattggcaaatttggccgttgactggctcatataagagggattgaccaattacttgactaaattgtgtactttttggtcaaagaattttaagtacaattttttactgtagtggtgctacaaatacttcaatggtgtagaagcaaacaactcttatcctactgtgttctgtcacattgaaatgtccacaaagttctttcattttgattagataatctcttgctctgtttaattacctataagtttattaattttggtttacatgtataaattagttgaaggatttattgatcacttcgcctgttgccttgatgcttattctgttaagttatgtagttggcacaataaacggatacaatacatttggctgttaatttgcctaattgatattgtttgaattaacggtcctcttgctacacagtttcttttagcagttcagtacaaagggactacctgtctttataaatccatgaaacattataaaactctcaagtcaatgcaaactcgtcagatgttgcaagttattgttaaattccacagttttgattaacatattgcatcttttccctccttttatagtgattaccggaggatggatgagcaggaccagtatgaatcggttgggttagatgactcgatagaggatgaaaggaacctggatgagatcatggcagatagaagggctgctgaagcagaacttgatgcaagggatgtgaggactggtgcagcacctgataggaaattgccacggatgctacatgatcaaggtaatggcattgtgaaaaattgcatttccatgagatattagaactgaaccccacctttctgctgttgtactttatattcttgttacttgagaatttgagatatgttaatttgatatggttagctttagtcgaatgctatgttttaatgcttcttgggtcaactatatgtaactgaggttgtatactccatttgcatttgcttcttttaagtctgattcaacccgtagtgtggttgtgaattttgagttttggacttcagtgatgattttttcttaaatattcaatatggagcatcacattactgaatatattatctgagtttgacattgtggtatggttgtgaacttgcagtagtaatcctttctatatttactaaaattagtttgcttgaaacttgtttattctttctatgagatattctttctggtcagttggtcttggtaattgtaagttgaagatagtgtttcttttatggtgcagacacagatgaggatatgagcttcaggcgtcctaaaaggcacagagctaattttagaccaccaagggaaccaagaacaccaagaagtgatgatgacggtgatggtgccacgcctagttcacctggaagatctcagcgtggaatgtattctggaggggatgtacctatgactgaccagactgatgatgatccatatgaggtattgatgtttgaactaaaattaccttaagttcctttagattttccaattggtcgccgtcctatttgctgagcatattttatatgcaggatgaatttgatgaagaagatgagatgaacatgtaccgtgtacaaggaactcttagagagtgggtcacaagagatgaagtccgccgctttatcgcaaagaagttcaaagaattccttctaacatatgtaaacccaaagaatgaacaaggagagtttgagtatgttcgactaatcaatgagatggttctaggtatgattctcttttcctttttgcatgaaaaaaggccacatttgttggcattgtaagaaatgcttgcttacctaatgtttcctctcctctttgcagctaacaaatgcagcttagagatagattacaagcaatttatttatatacatccaaacattgctatatggttggctgatgcacctcaatcggtgctagaagttatggaggaagttgccaaaaatgttgtttttgatctccataagaactataggaacattcatcaaaaaatctatgtccgaataaccaatcttcctgtctacgaccaaatacgcaatatcaggtcagtacatgctttctttagtatggtatttagaagtcaaattgattgattgtctgtgcttatatgctacttgccaaatttcaggcaaatccatctgaacacaatgattcgaattggtggtgttgttactcggagatcaggtgtttttcctcagctacaacaggtcaagtttgactgcagcaaatgtgggactgtcctgggccccttcttccagaactcttacactgaagtcaaggttggatcctgccctgagtgccaatccaaagggccattcaccatcaatgttgagcaagtaagttgcctgggacgatggtagttctgatacatttgggctttcttctctgtcttaatgcatgaacatgtttttggttctaatattcaaactgttctcttttaataacagttgatttatttgtctcacagaccatatataggaactaccagaaactcactcttcaggaaagcccaggaattgttcctgctggcaggcttccaagatacaaggaagtgatacttctgaatgatttgattgactgtgctcgaccaggagaggaaattgtaagtcttctgcatgtaccttttttatttctacatcttattgtagaaagcatgttctaattgactatctgcccatgttcaggaggtcactgggatatacaccaacaattttgacttgtctttgaatacaaagaatggtttcccagtttttgccacagtagtggaggcaaactatgtggcaaaaaaacaggatctgttctctgcttacaaattaactgatgaggacaaggcggagattgagaagttggcaaaagatccacggatcggtgaaagggtttgtgcttaatccttaagccccttgactcaattataataagctaatcagtattgtctgacaaatgacttattgtttacagattgtcaaatcaattgcaccatccatatatggtcatgaagatatcaagactgccattgcactagctatgtttggggggcaagagaagaatgtcaagggaaagcatcgcttgagaggagatatcaatgtactcctcttaggtgatccaggcactgcaaaatcccaatttctcaagtaaggaataggcaatcagtttcatcatctctctttttattgctccattaactcaatatttcattatctaaaaaattaactcactgttttgtaggtatgttgagaaaactggacacagagcagtgtacacaactggaaaaggagcttctgctgttggactcaccgcagcagttcacaaggatccagtaacacgggaatggacacttgagggtggtgcactagtgcttgctgatagaggcatatgccttattgatgaatttgataagatgaacgatcaagataggtatgtgtaataccatttggataatgtgtgcttttaagcatttatgttctattgccctaagatatctttctcttattgtttcagggtgagtattcatgaggccatggagcaacaaagtatcagtatatcaaaggccggaattgtcacatcccttcaagctcggtgcagtgttattgctgcagcaaacccaataggaggaaggtgatgtgatctacttgctcaggatgttttcaaacaattgttttgagcaatatacttaattttatcatgttattgcagatatgattcatcgaagacattcacccagaatgttgaactgacggatccaattatttcacgttttgatgtcctttgtgttgtgaaggtttggagctgattttgctgtgtaatatatttttgcagtcctggtatctatctgtactgattttttctggtgcaaatgcaggacattgttgacccatttacagatgaaatgcttgcaaggtttgttgtagatagtcatgcaagatctcaacccaagggtgctaaccttgaagatagggttccaactgatgttgaggatgatccattggctgctgccagacaagctgacccagatgtacgaaccctttgtacttcgcacaacagaaacatttttttactaaatttcattgtttttaacaaaatcctatattttttagatcctttctcaagacatgctgaagaagtacataacttatgccaagttgaacgtgtttcccaaaattcatgatgctgacctggacaagattagccatgtttacgcagaacttcgtcgtgagtcatctgtaagatatccttgtttcttgtccatatcaaatgcatcttatcaaatacttaaatatcttgccgaattggatattgatacctatgaaaactggaaaccaacatgatatccaacctattttcttgtttcagcatggtcaaggagtccctattgccgtaaggcatatcgaatccattattcggatgtcagaggcacatgcaaggatgcatttgaggagctacgtgtctcaggaagatgtcgacatggctatccgcgtcctgcttgactcatttatttcaactcagaagtttggtgtacagaaagcacttcaaaaggtaaattttgattttgctgttgtattgctattctatcatcttccaactgatgcatacctagcatgagtttgaactgttgtaagctgccttagttttttagcaaatgttacttgcattatgcggtctattacttgctgaactcattccgagctcaaacctatgccccttcctttctttgttttcaccaatgtaactgtagttcctcaccatttctgcaaattttaaagtatgtttcttctgcctctacagaatttcaggaaatacatgacctataagaaggattacaatgagctgctcttgcttcttctgcgcaccctggtcaaggatgtgctgcacttcgaagaaatcgtttcaggaccaacgacgcgcctgactcacatcgaggttaaagtagaggacctgaagaacaaggtatgagccaagatctccgcctcacccacacgcctttctaaccaagcttattgcgcaaaaatgcttcgtcatccagatttcgctcttgattccggtacatctgtctgatgcaggcccaggagtacgaaatctatgacctgagaccgttcttctccagcgcccacttcagggacaacaacttcgtcctcgacgaagggcgggggatcatcaggcaccctcttgctgcctaactacagaagatcatctgtgacccatctgacaatgaacaatttgagctacctcatgggattatcagacatagtgtaatcatcaaatggcaactcctttgtgctttttagagactgttgcatgttatccagctgcatttggatagggtgtaccgtgtgtactttcttaacattgtaattctgcaagtatggtagaaaatgataaatctgtgtcaatcaatgtatcattgttttgcattattgttttcatttttttcctcatccgatgaagctataattttgcacatgatataactttgctgggatggacatgacatggtaggcatcttcatcactgcgattaacatggtaaaaataagtcagctacagcagctacggtaacactagctccctaattaacataactccaccaaaacgaatcccttgatattaacatggtaaaaataagtcagctacagcagctacggtaacactagctccctaattaacatatgtatatgtaaaactatatgtatacataaaagtatatttatttaataatgaatcaaatgataggaaaataattaataattacttaaattttttgaataagacgaacgtcagacatatttaaaaagtcaacggcgtcaaatatttaaaagataatatattctataccactgactttattcgagttcaacaatttgctatcgacattgtctctttttataatatactggcgacctggtatatttagtttttataaaaaaaatatttctatgtggtatatgcaaaagaatttgcttatacaaaagataatagcacagaaatatctgtagtgtatgaaagatgatttatattaaaaacaacaataaagaagtattttatatatcatatcacatacaagttacattttttttaaaaaaaataaaaatgtaaaaaacctgaaacttttatataaatttccatgttatataagaaggccacataaatgagataaatcaataattaacattgtatgtccataagggtattttgggtatttttgaaaagaagtcccaacccaattacgtattgtagaacaattgattgataaagttgccggtatattatagaaaatgacaatgttgatggcaaaccattgaactcaaataaacttacagaatagattctcttagtatttagggatggagggagtagaagttttgtaaaggatcactaaaatatttatccaatcaaaggatcctacggcctagaccatctggatccgaaatcggacggcctatgtttattggatgacgtggcccaataagaggtattacttacttccttcactactttcaattcgtacaaaatccctcaaaaaaaaaaggaaagaaaaccccccttttcacactaacctctactctcccccgtctcagttcccgatctgcagcggcggaggagagagagacaccgccgccgccgccgccgccctccggcgaactcggccgggaggcgcacggcgtgggacggacaccagcaccaccctccctctcttcctctccttcctcaccccccaacccccgacccccgacccccgacccccgtctcggttcatccgcgcggcctccattccatctcggcggctcgaatccaaccgaaggtacgccgctcgtctcccccccctagccctccctctcaatcctccggcggcgccgccgcttcgtgaggccgtgcgcggcgtggattgccttttgagttgggttggttagataaacccttccggatttttttttttttggtttcgtgcgcgtggttgcggtgctaatatcagttcgtttatttcattgaggtttgggggttcagatgaactcacatgtaccgattaatggtgaagcttgttgtggagtggcagtggcggggatttatcattgtgggaaaatgtaggataatttcttagctttcccttgtccgtaatcactttatactactggagtagaacgtagaaatccgtgcacttcggatttcagagcgtttgccttgcttcagcgaacaattttacttgttcatacgtgttcgattgctcaagggatgataacgacccattgcaggtgttatcgttagttcagatgttagattgttagggggataaaaggtgttaggtgcaaggtcatgcatatctaagttatgttttcgtgcatttgaagtatatatatatttatgcaaggtcatgcatctctacattaagaatgcagtggtaatcttatagatatttatttatgataatggcttttgtatgaaattagactccttcactgtatctttgattccagtagagtatgtgttcacttatgctggaatgacaggataatatccactgagaggctcaactgcatgtatttcaccagtagagtaaactagcaatagttttttttttttttttagaaaaaggcagccgcccagcttttgataaaaagcataaagagttcgtacaggcaatagtttagttctggcatttgggtaacaccacatcttgctcttcgctttatctctcttcataactttaaccagtccaatgttttgtgctccttaagtagtgtcatcaactatggtaatttttgttattcttagctcaggatccagatgttagttgcagaggtgttcagagcaggagcatacatctctagattttcgcgacatgcatgccaagtatatactgctaccgaaactctttatagggacagaaatttacttgtcaatgcttttccctgcattaaagtacagttacttgccttgagagaggggtactatgtataatttctggaacaaaattgtaggagaaaatcgcttcatagttctgtttttatgattttccttgacatgggatcctctctacttatttatttatttttatttctgtttagttctttattataaaacttaacgcctgttcatttataagttatagcactcactgcgattataagcctgcttaccctttttttataattaatttattttctaatatctgagcgaattttcatctaatatgttgctttctggaattcaggttgcaagattttcgggcattagctgtgcacccatttctcaattcagaagacctcaatctctggagggcagcagaaaactaaggtcttgctgctttattcaaacccgactgatagccatggctacaaccctctccaatggtgtttcacagaatggccctcagaggaactatcaggtagttgttgctgctactcgcgacatgggcattggaaaggatggggtcttgccatggaagctccttggcgaccttaaatttttcaaggagcttacagtgactacagctgatcctgtgaagaaaaatgctgttataatggggaggaaaacatgggagagtttaccccttaaggctaggccattgcctggccgtttgaacatcatattgactaggtctggtagttttgagtttgcaacagtcgaaaatgttgttatctgtggaagcatgaactctgcattggaactactatcatcaactccatactgtttatccattgagaaagtttttgttatagggggtggacaagtactaaggtgagctgttaacttttgccaaagcatctagtatgtaaattgtgttgtttctgtatactccacctcaactctattcacctttatctgtaaaatttcactgtagggaatctcttaatggaccttcatgtgaggcagtccatttaactgacattcagtcaagcattgagtgtgacacctttattcctccgattgacttatcggtgttccaaccatggtattcatctttgcctgtggtagagagcaacattaggcattcgtttgtgacctatgttcgggttagaaaaacaatggcagaaacacatgactcaaatggcaaggaatcagctaatgatggtatcaagagtgacaaatttgaaaccgagaatttctcttttctccctaagttgatatttgaccgccatgaggagtatcactatctcaatcttgttgaagatattataaggagtggtgctcagaaaaatgacagaacaggaacagggacattatcgaaatttggttgtcaggtattttctctttaatgttgtgaataattaatttgaataaccagaaataacctgtctttaacttgaataaacagaaaatataacatgtctttcttttgctcatcagatgcggttcaacttaaggaatagcttcccattgttgacaacaaaggtatgcatgttttgcactaaagcacatcagtttgcatctaattgatttattttgataatgatgaacaaacaattctgtggaaatgagaaatgggttttccttaaataaaaagatggatttaacagaaaagaagcatgcggggggaaatgtggttatgaaacttatgtttctctggtttggatatcttcatagtgcttcagaccaattagttttcaatacatgtcaaattggctgctattgtgtcttattggtttactttcaatcttttttcatcacacatgcccttttctttgcctattatttgtaactaaatagctaattgttgcatggtctgaatagtacagtctttgtaactggctatcatctttactaaggcaaaaataagatgctcagtgtgatgttggtgctgagttcatacttgtaacttgggacattcttctgtacacagtagaaaaaaattgggacattcttctgtacatgggagaaaaaaaatattcattttctactgagtttccacacctccggatcatactattaattgtatcattgtgtcctgggttactgccttcttttttttccctaccagtctattttactgatgttcgtatatgatttggagatttagtgccacattttgtagaagcatagtacaattttgtaacgcaacttcttgaaaaatgtatatgtagaaactagcccctcttaagctgtataatgtgagtgttgggtttccttttctttattattgaaatataataacatgatgctctttaacagaaggtattttggaggggtgttgttgaagaactcctgtggttcatcagtggctcgacaagtgcaaaggtgcttctgcttaaaatttaatatttcattggaaatgttatatccatacgcaatctatatactgtctcgatgctttaaattacttatccagacgagccatgaatgcttatcagcctaaaactggatcctcgtgttctttttcatcatatgtccatgcacaaataaagcccatgatgttatcttgtctatagcaactccaacatgtaattttgcagctctaacaatcttagagtaattttacaccaggaaaatctcatatgaccgattgttcaaattcagtgcgatatttatttacctgtgcagtctggtctatttattcagaagggcctcaattacaagcttggcaaaagcctgatggaagtttatgttgtccctagatatatgaatattttctgtggggtggaaaacttttcttttcaattttttgagcgttgaccatacttaaatcacagttttcttttctttttctgttatgtaactactttctgcatcagttatgttgggtgtatccattaactattgcagcagatgaggcataagtgaatattgttagattttagtttcttcacatgagctcccatgcttaccactttggtacaatgatacatttttctaccttcaggttttacaagagaaaggcattcatatttgggatggcaatgcttcgagagagtatcttgacaggtatttatcttggatccacactagtcgagaaacaatggatattgctgttcttggttctcgtgctctgatccatttggcaaaattttactgtgttctagtgttggcttagcacatagggaagaaggtgatctaggtccagtttatggatttcaatgcgacactttggtgctgagtaagtttttctctcacccc

SEQ ID NO: 44911 - DNA, 1722 bp, Oryza sativa
ccacgtaagccagtcaacccagtcagaggcgctttggacctaaatgattcacttaaacaagatcgcggacccgaatgacgattttcctagatcatggacctaagtgacacctcgctccaacatttaagggaccggccgtgtactttactcttctttttttatgcagttacacataaatcttcatgaaccatgctgtttcctgtactgtaaaataattggctgtgccttgtgattatctagaatgtattatgggaacatttatttgatgcaagaaattaatgcccttcagttcatacagtacttttcagttaatcagtagttagaaatatctccattatggaacagtaccatcattaatttgaagatgctgaacatccttttccattctgacatgactcctgaggcatatcaatcgtttgtctaaattcaggtctttctcctggagagtttgtccatgttattggtgatgcccatgtctatagaacacatgtgcgagctctggaggagcaaatccagaagctacctaaaccatttccagtaagcaactcaataatttaaatttatttcattcaaaagcatggaacattcagatatgaaacagcactcctgagttttgtgatgattcaccttacttatcaatggtgatgtctataaatccgtttaattatatgaatactatgtgcaggttttgaagattaaccctttgaagaaggatatagattctttcgtggcatcagacttcaagctggtcggttatgatcctcaccagaagattgaaatgaaaatggcaatataatttggtattcctctagcatttatactcgtactgacgcttttcatgtttcaatatttgcttgctgtctgatagaagattatggtaccagtacttatgatgcacgctgtactgttgatagagctcgcccatcagttttcaacattgttctggtgtccatgatacaacctttctgttgcaatactgctctcttttatgtccatgctaactagataaacatatgattactgagctgcaacggatgacaagtggggtttttgtgcataatattgctttccctctgactcgtgtccataattttgcaggtggctaagctgggacccccagtcactatgtgagcttggagaaacttaagcaggaaaaccttatgcgaacatcgcactagcttacttttttttttttagtggtggtgctggatgttcatttggacctatgttctccatttatccgcgattgtacttttatctcggtcgccgatctaaaccctacgaaaacaccggtcactggctcccccttttatttggacccagtgaatgatgttagagcttgtttcgagttgacaccatgttggaagaggccaaccgggcgttatgtgtagctcggcgatggatgtcatgtaccctgactgcgacacacattttggtcattttggtgaagcttcggagtgcctctggtgttgctggacgacacctactaattgtctccatctgagatttttctttccacatgtttggaacaccagatgatgggtgatgatgctgacctgtggatttggagttgttcagcatatgttggcactttttctgatgtttgtgaaatgagttgtgttgcgtgcttggaaattgcgcttggtggcggcgcttgcaggcaaggactgaaaatgagatcttttgacattgacgttaccttgttatttttcttaaaaaaaa

SEQ ID NO: 44912 - DNA, 2901 bp, Oryza sativa
cagccaacggtgttctatagagaacagacctgcggtctgcgactttggcgcagccaacggcaacagtgccgcagcggcagataaaacaaccagtgtggctttccgaacacatcccatatctttaatcagatgcatggaaaatcatatacacagtagatattttgaattatatcgtgtaataaaaataaaatgtactttctccgtttcacaatataagtcattttagcatttctcatatttatattgatgttaatgaatctaaatagatatatatatatatatatatatatatatatatatatatatatatatatatatatgtctagatacatttacatcaatatgaatatgaaaaatgctaaaatgacttacattgtgaaacggatggagtagcaacaaacagtaatggtcgaaatcacattctgaacactcatggctggacgacggactaccatgttttcatttgagaacttattgggttgattcccaacggaaagaaagaaattgaggacgattaattccatatctttattatctcaaaatgttctttactctgacctcaactcctattacccttttttttttgtctgtacgcttcacaaattactaaacgacatgcttttttttaagaaaagaattgctacaaaaatattgctttaaaacatcatattaacatgtattctttaaacttcttttaaattaatatttaattaatcatgtgttgacgagctatcccattttttttcgagggaaagaagtccccaaccatcatgtccaaacaaacataacctcaatcttcatgctaaaggtaaaaggtattaggccatgttttccatgcaaaaacttttcatcgtgtcacatcgaatgttttggacatagattgcatgtaaattgcgagacgaatcttttaggcctaattgctctataatttgacaatgtgatgctacagcaaacatttgctaatgacaaattaattaggcttaataaatttatctcgcagcttacagacgaaatctataatttattttattattagtctacgtttaatactttaaatatatatatccgtatattcgatgtgacccctaaaactaaacatggccttattattacctgaacaaggcctgaatgtggtcggtaggactgtccaaggatccagaattccagatatatactactacctccatcccaaaaaaaagtgcagctatagatatccgcgtttagcgttttgaccgttcgtattatttgaaaaatttataaaaaaattaaaaaaatagtcacacataaaatattattcatgttttattatgtaataacaataaaaatactaatcatattttttttaaaataagacgaacgatcaaacattggatataaacagtgtcaaaattgtacttattttgaaacgttgggagaaccactagtaggagggaggaggtgtcaactcctattttgcaaccgccccttgttggctggagaggcagaacataaatacatgcttgctgattgctctgacctcttgttggagccggagggcaaattacttgagactagagagtagagactgatccactcgattggatccaacggccgccggctcttggacaaaccgagcggccaggacagcagggagccagggagagcctctcctcttaacaaattataatattaaagtttttgaggggctggagtgctaaataacccctcaccctttggccgcctcgacgagtccgccccgtcccgtcacggagcggccagccagcagccagcgggcaaaaccgacgaggcaagacgttttttgcggagacccccctggagttctctggtttctctacttttaggctgcgttcgagcgcaggagaaagagagaaagattgtttcgttttccacgcgcacgcttcccgaagtattaaactatgttctttttgcaaaaaaattttataggaaaattgctttaaaaaatcatattaatccatttttaaagtttaaaataattaatactcaattaatcatgtgctaatagctcacttcgttttacgtatcttatcaatatcctcaatcccctccttctctaacacactcttagcctctcgacctaggttctctctctgaaaaatcaatgtaaccgtagctctaaaagtcccaagagcaactttgtgttattattgtttgcgagacctttttattgcagtgtgtaagaacttgttttgaaaatgcacgaggaacttcacctgggatactttagtctcatttgattcatcggaatttcaacgggatatttcttcgtcgctattagtatatgttagaggatggttgttagttgttggattcaagatgagcactcagcaccatatgtttcacaacggaatgcacgcctttatcattctatttcccaaccaaatggctcgagtatcaagtcctcgtcttcgtaaaaaaacaaccgcacattttactcattttaccactatcgtcatagctaaatctctagtttaaatccaaacataattgtttcgatgaataccacgaatcgctcctcccgattaatgtcttcatcggttgctcatataccctaataattagataagacttttatatatttatttttagggatttaaaagttaatattgaaaaagaaaccacattaaaatatcttaaaatcaacattaaaattaagtttcaaaatttaaattttagcttttgctttagattattacgccaaccgatggaaccataaagtttgcacaaaggttttcttcaaaaataattttgcacaaaggtccattttcaaaattacctaaaactcaagggaccccatccaaaaccccaaaccatatttctatatcccctcaacctctctctctcctctatctcttcaccattctcaaccccccccccccccca

SEQ ID NO: 44913 - DNA, 3958 bp, Oryza sativa
cgcaccgccgccaaggtcgacgccaccgtgtcccgcgccgaggccgagggcgcgctcccggtgctcggccaccgcgacccgcggggcttcgtcctctccctctccaggccccgcaccgtcgtgctgctcgtccaggccgggcgcgccgtcgacgccaccatcgacgcgctcgtcccctacctcgacgccggggacgccatcgtcgacggcgggaacgagtggtaccagaacacggagcggcggatcgaggaggccgccgcgagggggatactctacctcgggatgggggtctccggcggcgaggagggcgcgcggaacgggccctcgctgatgccggggggccacatcgacgcctacaacaacatcagggacatcctcgagaaggccgccgcgcagacggaggatggggcgtgcgtcaccttcgtcggccccggcggcgcgggcaacttcgttaagatggtgcacaacgggatcgagtacggcgacatgcagctcatcgccgaggcctacgacgtgctccgccgcgtcggcggcctgtccaactcggagatcgctgacgtcttcgcggagtggaaccggggggaattggagagtttcttggttgagattactgccgatatattcacggtggccgacccgcttgatggcagcggcggcggtgggctggtggacaagattcttgacaagacggggatgaagggaaccgggaagtggacggtgcagcaggcagcagagcttgcgattgctgcgcccacgattgcagcatcactggatgggaggtacttgtctgggttgaaggacgagcgtgtggcggccgcaggggttctagaggcggaggggatgccatcagggctactcgagacgattaatgttgataagaagatgctagttgacagggtgaggcaagctctgtatgcgtcaaagatttgcagctacgcgcaggggatgaaccttctgcgagcaaagagtgtggagaaggggtggaatcttaacctcgcagagcttgcaaggatttggaagggcgggtgcattatccgggcgaagtttcttgataggatcaagaaggcgtatgacaggaaccctgagctggccaatctgatcgtggacagggagtttgcaagggagatggttcagcggcagaatgcatggcggtgggttgtggctcgtgctgtggaggctgggattagcactccagggatgtctgctagcctttcatactttgacacctacaggtgtagtcggctgcctgcaaatctgatccaagcacagagagacttgtttggggcacacacctatgagcgcattgaccgtccaggttcgttccacacagagtggactaagctggcgagaaagagtaatggtgcggccatttgaggacttgaatggtatcagtaactctgtgtggtgtctctttgtgggttctctttgaattcactactgttgtctttatgattctaggtctgaattctgtactttgaataatgaagtgtcatgtgcggtatgcatggaaggaacattcatgtagcttgtgcttttatatggtctaggtgcacccattcagttttctcataaatttggaatgcaatggttttaccctcttatcaaatccctgtaattttgatctggcatgtgtcattatagctagtaagacacgtgatgtttggccacctttatgaatctgtggtagaatgttgaaggtatacctcaaaaattgcatgataagtcaaacagcgtctctccagaaagtagcagtggaagacctgaataccggattgcttgggcatgatggaatctctctctaaatcaatgttctgcgcttatttattttctcactttctgtacaaaaatatgagtgacgtgaagccaaagggtgatacatttatatgctttcctgcactgttcctggtattgaacacatatctttgattattagtagtgctgacttatatatgtatataagcatttatgtcatctgtaggagatctaattgttaatttgtgacgttaagttcttggtctcagtggtaagttattttttttacattgagcctgatatttttcctctttattggttggttggtaaccctgccgtgatctgttttgtactccctgtaaagtagaagcactcctcatgaatgaaatgacatactcatttatactagagctgtcaatgggttgtgtggaatagggttcatcatgtcatgctgtcaggttttagtgctttccttaatgaacctggataatattgcctagtttttccatcagggtggtttggtcaaattggttcatgcaatcttgagctactaagttctcatgtcagttttctctatcgtatggttgaaattgtactcttaacaaattcatttgcatggtcacctccagcagcattatggtgaacctatttagagctattgttgccatttgtattgtataactggttaacacagaaaatggtgtggagacaacatggtgtttatggcattccctgatgcaaaactaacagtaagctcatttcagttttccaggagcggagttaatgaatgttaggctaaattcttgcatcaatcagcaagtgattgaaacattccctaatgccatagttctgcaaactaagtgatacaaaatcaacaaaatgcgtcgaacaaagtcctttgcacatttttcatattagaactttagaagttccaattcgaggttaggttgaccttttctgctcattgagaaccgtggttagcactagcatagctgtcacgcaaagcttgcttcaatcattgcttacagtttctggctagtcaatttgttgtcatttttttattgccattaagattttgactgtattttttttctttaatctcgtattgttgctccaactccatttgatgcacaggttgacatgatattgtaatattatcatttatcttctggttaacatcgtgcatttcatataagactgaacttgagtatattaggatatagaagttgagtgcgatgttaattaagtacagatgaaattgaaaccttgggttagatttgggcctcaaattggtcctcgtgtcacatgatgaaattggccagcccactgttgtgcaacatatataaggatgtgccagataaagaacctagttgggctaatgggcctatagcactccacatttgcatgattcttacatggaaatatgaagcttgcatgattctcagtttattgttttccttttttttttcctttctagatgacgaaacaatcaataagaaaattttcttttgcagtttattttggtctcaactcttattttgattctagtgctgcaacatggtcaacattcttgaatgctaataataggattatatggtaccacagaggcaaagataagttctcaaatctctgctgcacttttattttgttatcatgtggtttccacatggtttgtgtactgatgatgacagattatctaatcgctcttttctctccaggaggagctacacaatattgtcaattgtatgactccaattgaattggaatacagtaatacacaacagagattgtttattctgatttcagtggctttaatggtatggagctaactactgcagtccaattatggaggtgctgcaacttttttttttttcactttgtatgatatgatcaaaagaaaggctaattgtcgtgatttggtttgcctctgaaagatatgattttggggatgtaacagctaacgcatccattcatttactttagcctgtggagatgttgacaaaaacacatggagtctggtttacttgtatttcccataagcaggtgataactgataacccacttatgctttttctcaagatttatcttttcaaaaaataaataaataaatgaaagcatttgccatttgttaaactgttcgaaaaattgatttattttttatgattgtggaaggcatgatggcttatctaataggtaggatcgtcag

SEQ ID NO: 44914 - DNA, 5421 bp, Oryza sativa
tggtttctaaaagaatgaaaggcacatgatcctatgggactcttgaaatggctaatggagtcaatcgatgtggagaaagtggtggagaccaattagaatgcataatcttgcttttgcatgacagccatttttactcaaaactattttcatttgtttttgtttccttttgtaagatcagtagccaaacattggctcccaatccgggtgagatgggttcacaaaactgcctgaaacacataatttttaagagaactttttattattgtttccttagagttggttgtccttcatccttcctgaatattcggaggttttcaaccagaggttctctgcatcgtgcttctacaagtttttggatctaatacaaggcattcacagtttgcaatgcacatattggcatacatatatttttaacaaatgattcacatttttgtaagattgaatcctttcttatatccttgcaaatttggctttcctaattctttcctgtgatctattattatgcatttatggtctgtttatttttttccttttttggttggtgttctatcttaattcgttttcttttttctatcagtaaattactatggtgaggcctctataccgatgcataccacataactaactgtttgacccttaggtttattgtcttcggacctccaaattttgtataatctaaacagtacataattttagttgcttatcaatagtgtggttttgagttttggtttgagtctcatactttattcaatgcgtgccatctctaccactatattaggagtttggcttcttgcttagttttgagttatctggtactgtgcctgggatgtgaccacaaaaacaattatagtacattagcgcatttatttatttatcgctatatctgttggcagggtttgggaatctgtggatagatttcaatcagcgggttattaactgcatcttgttttcttacagtcattaactgctttgaacgaggaaaattttggtgttacggttaggtgatcttgtttctacttatcacaaattactgatctgagctagtaaggttgttgctatgaacaagttattctgcaatgtgttgtatgtttaagaacaaaaaggggatcatctctattgtcaccatgccatgctatctgagagtgacttaatcaatactagacgaattattattgtgatgataaatggatagagcaggatgtgtcactaagtaattcttatttgcctcagccctcagtatagtagttatatgaacattgattgtgtctgtgcttgcataattatgtctcaagctgcatcacattttccatgtctcacaggatgagtgaccactagatcattcctatttgttcattgaccaacagcagtagagcactgtactcccacgacatgtacataattcttctctcagttgctggtgtgcatgtttacattcttgctatgctgaactcaacaaccacagctagtcagctacagcctgatcaagagacagcagggctacctagccctttgaaaggaaaaggatatccatttacacctagaatctccttttgttggtggtcctcacaatggtggagctggttctttccctttcagattcacacgtgggagtgcagtggcagtgacctcgtgaatcacttgtcggtgagggccccagatgatcagcgtcttgctggaaacaaaggtaacatcgactgctggtcactattacattatgatatgattattattcagttccttctgatgctgcttggtgttagttcacctttagtacaatgtcgtggtaacgctgtattatacggtagatttattttttaaggtttgtcctttcactggattcttcttctgtttattcttataatgtgatgtggtggtggaagagtatcagccacacaggccttagttggctagacttttctattagtggaagtgaatctcatcaacagactttaacataaaagaacaggaagccatttgttgagtgggtctgtgctcataaagagctagagatcatcacttcccactctgagtctaagaagctagctttcttaggtccatatataaaccatacttgtaattatcttacttgatatatatattttttatgtgcaaaagagaagcaacttttgcaccttgtggaagatgaaataaatggaggacagaagaaccaattaggtttgtactaattcgttggcttgtacgatgatgattgattaaagtttcttttggcctgcacaattgattcgtcaagcaagcgtgtgcacatactttttcatgctcgccattatctctaatgattcttttaagttccataagaaatcaacctcgagtccttgacttttactgtgaggtgatatggactccaaaggaagttactggaacaattttgttatattttggtccagattactctttgatgtgaacatccattgtgtttcttttatttttggattaaagattgatcaagagatgaacatccgtgtgttactaatgacggctactgtttttgcaaatatccacactagctagggcacgccttttctcatggagggttaggtttacttgtattcaatctacttaatgcagcttcttacaacacggcagccccgcaatggtttcagatatcctgtacagagatgcacacaaaaatgttttccaaattgtagcataatgatctgaacaccaattagttacaagatttattctctgatttaaaaaaaaacataatagtttttatttgttgggaagtataattcgtcaagcaaattaattgaggataggagatcactgtctttccctacttgaggctttggagactgttaattggattgaaatactaatacttgacaagctactcttgcactattactattacacacaaacaagtcatgaaaacccctataatagttagagcatgataaattgcacacagcaaagcttatctatactgacatgtttttttggtgttaagcttcgaagcgaaaatgcttggcagaacaccattgaggtagacggaatttagttttgacaaaatatttggaagttaaacagtgcagtttgaattgtggtattttagcacaaagttctgacttctgaattagcagtcaatatcaatttggtattcaaggcctcatttgctgttgttttagagttctcagcactggttgttatttctcagtaacaaaggtattcttttcttctggaaagaaagagagctgaagctttattctgaaaaccatcaatattggcaaccaagtacaggtagaaactactaattattaacatcaaattgggatatcgtaaaagccaggcacgatgatcactgaccaacatctggtagtggtactggccttgatcttattagtattttcatgatttcttgttttccttttatccttgaatacataacagtataacacagtcaactaacaactttacctgtgtgacagaccaacacaaacttgagcaaaattagtctaacctagtgtatatagatcagtaggagttggctgaagtccatcagaccactatcaggattgctatcagtgaaatcatcgtgcttgcttttcatatgggggtttatattctttattcgtgtgaagtatatgatgatgcaatctggcatagcgcactccagtctaaccagtataataaaacaagctgttactggtggcagctagtcaccatccgtttctcgtatcctacatgtgtctatcttggccagtgtttagaacctggtggttcctggccagtatagtttaaatttgaacttgtaaattgcattatatctactctctggcacttcagaaaataagtaaaaaaagaaaaacaaactctcctcggattattccattcagcccatattctttgttgttatccccctactctgtggatgattatattgatcaatttgtgatatattaatgacttatgtgttatatccattcagatctatgaaaaattgcgctttagccgtgcccaattcttctagccagtagccaccagccaggcgaccatgagtttttgaattaaaaatttggatttgaacacttttctggtaaaaaccggtaaccggccagtaacctcactggcaatgcttctgatatttttgccaaaaccggtattcataaccttgatattgataggtcacatcaagcatgcatccatgaatgtcagcgctggacacctagatgataatgaagtagatactttttttgtggccatctgatggttacatcctgctacttgcagccaatatcactctgtacaatgtctcgattgttgagatttttaatttttggaaaaaaagaagtctttgatcagattttattaggtgggcattgcttagtagtgctgttgtgctaactaccttttggatgtcctcagtttgcatcatcaatttatgttttgtgaccaatgtgtgttgaatacttgaatgttatctgacattttgacaaatccataactcaatattgtaaaacagagtacattcttaaatctgatggatccaggccaagcagtctgctacatgttgattctagatagaactggagtgaaacccaggtttggtttgttaccatggttttctgaaggataatctggacaccagattccggagtgagcttttgttatctaccatgcaagtcaatctccgtcgggaattcctatccctgttgattttccatggaggcgtgccgttaacgcagctttgatgcagtcatttcatgacacaggtgcaaatttcgaattggacgaccttcatgaatcaagacagcagctgggcattacaaggaccgcgacacccggctaccagaaagggactcggcgcactgaaattgctcctgggaatttccacactgtgaagaccaggaggacttgagccacaatcttcacaacctttggtccttgccttttcaaacctttgtctcaagacctgctactggtgctgctggaaagctgaatcattcccctctgctgtagtgttttctgcaatcaaggtgcaagatttagtcaaggatacaccatcttgttttggttgagaagatggatcatacatgccaaaggtggctgcacttggttgtttgtgcttctgcctacagtcactggtgtgaatctcatcatgccactcatgatcaaattgtactccgaggaaatggactggaaccaagatcaggaacaggtaatccactcatgttaatgaaatgtcaattattgaagacaatactcgatgaaactgaaaattttcctttgcagggggatccattggatctaattacaatttagagctgcgaaaaaaaaaatctcctgcactcattattaatttacggtgcatgggataatcgttgacctctatgatgaactcggagtcgtgctggactatgatacaaattctccataagattgatattagcctaactgttt

SEQ ID NO: 44915 - DNA, 3583 bp, Oryza sativa
gcataataattcactaatatattagcgtaccactgatgtcttgctattccgtcctgatcctttttctttgtcccctgccagaatggacaagcatttcaagcatggtggcctggtgggtgcagtgcaagtgcaaccgtagggaacatttctgctgaaaattgttttctaggtttgaaaaaatgctctgattttgatgttaggtttcaattggtttgatcattggcagcactctatattttctaatagcctttctaggttgaatatgtcatggtttttagacaatacagcctacattacacgacaacatatttatacaatattaattggccgttttgttaggagcttcggcttcatcttagatccctcgctctagtcaggcctatgtattaagttgcttatgtataaaaacttattggcttgtcctggactataagcctggcttgtatgttgccatccttggtttttcatggatgactagctagcttattgttgaaaaatctctagatattctgaggttctatgggctactttgtgtggaagtacatgtgtagggatgaaaacggttggaatggaaacgatatgcctagtattcttattatttttattgaaacggtattgatacggttattttttttcatatttatgaatttaccttcttagtggcaactttaataaggtgcagatagcaattagaaatactaaatttttacagttagaagcaattggaaacaatttttttttattttctttacggaaatgatagcagtatggttggaaaatttctgtcatgttttcatccctacatgtatgtctgtctgggattacatacaaagtgtttcaaaacttgaatgatgttatagttttctttttggaattttgtacatcgtttttaaatttccatacaactttgtgattttgatctttttatgtacatggacagtccgagaccaaataaaactttgaagtgaacgaacagaaattaaaagacacggctgtagacattttgtttttaccctaagtgccaaatgaatgctataaaagtatatggttttatggaacattttagagttgctacctattttctttgaaataaattgcaaaaccagatattttgtatcatggatgctctaaaacttagtttttttttaaataaagtttactcttttgagaattaagtgagctccctgaaaaataaaacaactgatgtccaaacctacattaaaaaaaaacctttgaaaggcaggaacgataaaacataaggataagaaatacacatgattttgttctgaatgtatatacgggatattggatcttaaaacataagaaaaaaataagcataatgtaaggaaaccatggaattagatgagagaaagagactcgagggaaaatttcaaaagattggattcaatgctaactttcctccaacgtttccattacattaattagtcaatccaaaggaagtttatacaattttgtagatacaatctcctgtttcaaggactaaataggaaacatttttttcctaggatttaaattctgcaagttcacttcataaaccatttgttccaaaggagacgaaaaaaagaatttgtatggattggcttgcagtggcaaggcggcttttaatctttgccaaaaggcaagttgagaaagcatgcttaattcttaaaaaaagaaactcaaaaatgtttgttgcttttatgctgagtcttgagccattgtttgctggtccaaaagacattgagaatgagcatagagcggttgagtataacaattcttttagtgagatcattcatttacatggacatactaattccttttgttagaacttgacttttgtaaaaccatccctaacaatcagggccgagtcagccgagagccatgaaaattgactacgcgtaatgctgaactcaagctctctgttatgtcttcaatgtttcatagacttattacataatttgaaagggtttaaggagaccagatctaattaccctatgcttatctctgccactgtcaacaaatggaatagtatatggaccgtcacttcgtgccaacggttcttatgagaacgaaaaagtactcactccgtcccaaaatataactacatttagctctaaggatttatcccaaaatataacttctttaccaatattctcttcccaaccaatcataaccgttgaccattcacttttcccacttaccttcactaatctaatcataatcctacacctttcacttctacatactttcttagtaaccatgtctaactctaaaacttattatattatggaacggagggagtaccattttttattacaaaatgcctgttagaatatacctgtaaaaactctaaacctacaaaatcacttcctaatataaaattgtgtacatttatatgtggaggtagcggttgtgcacaacagtggggaattgatcacagttgaccccttgcatggatgccaaaggtttccatcagctaatgtaagttgcatgtcttgaggtcaacattatcagtagcggacaaatttaaccaagttggagcagcaacttacagtgctgtaacagggttgtcgactctgatgtgcttcacctcttttgtggttctcatccatgtatctttagctgtataaaggtaatatcataatcatattagcaaaaagaaaaaaaaataatttcattatctttcatgtggcaataccgcacttctaacatcggccaattattggcacgtaatgactggactatcggcaactagtagggtaaattgaaagcgcataacttatctgtcccttctctaattataaatatttgatatctatgatagtattcactcaaagttttaaaactctgaccatcaattttataaattcactaaagtttataatattatattataacaataaaataaaaaaatattgaaaaaccaacttttaactcaaaaagggtgccaaaaagttttttttaaaaaaacatgagaactatgattcaacctcactctagctagctattaattccaccacttctagttgggggttctatgtgacagcatactctgttctgcccacagctcaagcagcctggtatcctcttgtcagttgtcatgatgctcccttatgtgtacaacctcatcattttattaccatatggccatagcccacattgttgtaatcacctttctctcaaatcctccaaggaccctctacataattaagcagcaacctatagaaaacatgctgtgtcaaccatgaaatagcagcagttaattactaattaatgtttaattacatataagatacgcacatgcatccttcaactaaacaatacagtgtgttgatatgaaaattggtcatttaggtcatctgtagtacccaatatccatttttctatttcaaaactgaatgaaatgacaaggttaaataaaatcaagaggcgacttagtcgataagaaatcatggataacttacagtcggtgcggtatctgctacgatctacctttaaaaagtaagaaaaagacttgcatacatatataccaaaagtaaattttacttccaaagcaaataacactagagaaatatactacgca

SEQ ID NO: 44916 - DNA, 4389 bp, Oryza sativa
cctgcagccctaaatcctaattaaccattcattctccctctttcatttagtcctaaccctacatttattttcaattccaatcccacctctcatttccaattatccaaacatagcctacattctcaaaaacattttttcatgcataatacctcagcacaagcaagccacgccgtactacttcatgccatcacctcgagctgcgacgtcatcgccgccacgtccttcccgcgcggccgccgccaccggtgagctccgaggcagaagccttctcttttcgcgttgtcgcttcccccccccctctctctctcttcctcaactccgacagatgccgcccgtcgtcgagcgccgccttcccaccgtttcggagctcggtgccacgccatgagtccgcctctgtctcctcatgccagtgctgccactcgcagatgccgccgagcgttgtctccgccgaatgccgccgcgccggagcgcacccacgacgcgatggagcgctgccttcaccagagagttcatcaccactggcggcatctagaagccgagcagccgcggccatgacattagaaaggggaaataaggaggaacaagagaatatgacaagtgggtcgagggatatttttgacctttcatgctctttatctctcatattcaactggaaattaatattttaatgtgtgcggtgtctagcagcaaataaccacgtttagagaaagttttccccaagagtgagtttatggtatcctatagctaaaaccatagagtcgcgatgttatgtagcaaaatttgcctatagtcataggttcatattacatattgtcccatacaacgttacgtgataaggaaattaaaaaagcaactcaagtacatttacggtacgatcaattcaaatgataaaagggctattaactcattagaatcggatgagaaatttgaaggcgaattaaacaactgatggagagcattagtgttattctaaaattgcaggcgtagttattcttatttaatcaagagtaaagtgtattgctgcggttccttaatttaacttgttcgtttatgtcatctagattgccaaactctcatatctctaaacttattgattattccggtttcatattgccatggccatttacgtggcatgttacgtggacactaaagtgacacgccacataaacattccagtcccatattttctttttcttcccctctacgttttccttttttttctttttctcacaccgacggaaacaaataacagaagaaataggggagtaacaaaagaaaatgagtcagcatccatgtgacataccacgtgagctccacgtatgatctcggagttgtggccgtttgaaaccggaatatcatatttagacaagttcgaggatcgaaaatgcaatttaagtgtttgggggtgctgtatgacacggttgaacatgtttagggacgggcattgcactttactctttaatcaatatatggggagccatcctttttatttattaaaaacatacatggagccgtactcataagcatggacggaggattattcaacaacgacaattgagatgaaacaaactaatcagaacgaaatatcaattggatgatgaaattcgaaattgacgggctcccaaacagcattttcatgctcgatcttcgatcatcagcagcaatgaacgcatctttattgattttacacgaccggaccgggaacgtgataacctgaaaaataataataacgtacgcattacaactgatcaacagaaatttccagaaagagaagatctgtatatataggaaatgaatactatgggcggttttggctaatttgatgcctgccctaccaaatagttggcaacttaattagatagcatttgcagacacttagtttgttgccaatatttactaaagcttacacaatatttgcagacattttttttttctctctcgaaatctaggaaaaatatgtttctcttatctttgttttacagattacaaatgtggcttcgaaccaaaaatatattatcgagatccaactaattaagcacggaacatgtatacaacatatgtttttggggcatgcatagttgttgattaattttcactaccacaaaaactatttttcagctgacatcatctggatctaaacttctatatatggtggatacactatcgcatataggaatcgatttttacatacgattaacctaattaagtgaccttatctgaatatcatcatcagcacccacggtgtgtttctacatatggctcttttgtggtccatctgtaaaaataaatatgggtgttgccgatgtttttttcttcaagtgtctcctgacctaattacgtatgtaacaactgatacatggaacatatcatatatatgtgcacaagattcgcgtgcacaccagttaacaaatgccacgaaatttttttaaaagaaatcgaacatttactctgatatatatatatatagaagtatatattgtgcaatgcatgtcacacaagcttactgccgcagtaggagccagggaggagtgggcggtggcagtaggcggcgacgtagacggccttgtccatgcacacgtactgctccacctccggcgtcaccattccgcacaggcaccccacgtccaccctcctcaccgcgccgcagcacgccctcgacggcgccgccttcgcctccgccgggaaccgcaggtacccctcgcagctccccatcagcaggtccaggtccttctcgcacttgtccgccgccgacggcgacaccgtcgccgccgccgccatggccatggcgatgatcaggaggacgacgaagcacacggcagctgatgaagacgatgatgcaattagcctcgccatggctgaaaggaaattagctagttaagcaagatttggttgctgagtggtgtttgtgagtgctttggaatggccgaatgggggctgtatttatggagagattagcatggaagttttgtgcaagttgcctctccatgcatatgcgtcttccttgataattaactgactagttaaattagtttgttcaatgcctacccacttctagtaaactgatttaattaattaatccatgtttgatatggcatgttactagctctgtcctacagcaattaattgtttaggcgttccttaaaatcacatgatgtatttcgagcttgtttggttggtgccacgttttaccacacttgagatactccatcttataatataagggattatgctataaatagtacaagagtttatatatgagacataaagtatgatcttgggatcataaaatctcttatattataggataaacataattccttatgttatgggatgaagtagatgagtctaaccaaatgttgctaatgtttggtttgttcttacaacttctacgtgccacactttctttatgttttggttcagctagtgatagtccctttttctagccacagtttgatggcaatgggggtgcacgatcgtccgtcaggtgaagataactattaatttggcggacacctgagacacacggtccagctttcaatcaacacgatccaaactctgcaaccacagtaacatgtttcctctggttctcaaccatgccaaaactcgattgacctcgccgagaaggctaacccctccatgcccatcgaagaatacaaacaagaacaagaaagattagaagacaattgtagataaattattaagaactcaaagttgggggttccacaaaacgatctagctagcggcgaaactacaatgacagaaataatctaagcaaagttcagctctaaacgatgatgactactgaataaatatgggtagtaacatcctagggttaggcctagggcgctcacctccttgggcttagtacacggcacaataacaaggctcaagatccaaatcagactcgaactaaaagatatacgtgacttgtgatctctgactgctaagaatgagtttttatgtggaactagtatcatcttaaaatagaatccattacctttccaactagtactcatgggcccaaaagcccttctagatcagcggccagattcatttgaagttgatgttgttatgaggtccaaattcaaattcaaattcaaaacatgcaaaacttcatctcttgacttctagcagtaaacttggtgtaacaccttgcctccaaaatccgcattagtccgctctacacgttgagcggacccacgttcgcatggtatcccgcttacactttcgtcctcgcctcgtgtaaaaaggataacccggggataccatggttggagcaccaaggcttataagcaggccctcacccacctaaacttccaaggtggtactaaaccaccactacacatccacttctaggccacatgggccaaacacacactactaggcttc

SEQ ID NO: 44917 - DNA, 1017 bp, Oryza sativa
aaatcttacatagaaaacatgcatatttggttgatgaatacataaggtagccatggtcatatccgagctagtcatcattgtccctttcttgattggaaatcatcatcggtttcaccttgtcattaagactgatgaacatatctttatctatcacaatataaggcgaggtggacttcttgatggacatggtgattcaaatatagcaaataatttcttctataaacagttaagtgaataaagatcattaaattgaatatagtccaagtatttaaataacatagcggtctaagctaagtttttcatcaaattgaatttattcaagatagtgctcgttaacaagcttaacccagtacaaactaaatttggctattaattcattaatattaacaagcatatgtgtgtcaagtcgagtcttaaggaacaaccctagctactatcacccatgtaacactactacaaaatggatttttccggacgagacccctttagattgcaggaggaccataactgctcacacctgcaaaaattgatcccccatgcgcaattcagggaccacgtacaaaaatctattttcacaagctggtctcttaacaggcctgtgtgcgaaaataccacccctctctctctctcttctcaattttttttctcccctcctctctatctcccactacatcctctcactactagagaactgatctttgctgggtcgacccaaaaccacaatagtcctggttccaaaatgaaccgagacaaaaaatgatctttagccctggttgaaaaccccacagccattctacggtgtttactctcggttcatcccttgtcagtggcctgtcagggtgccaaggatcttcagagatcatcactttagtcccggttggtagactaaagatgatctagatctttagtcctgattgatataatatccctcgcacttatcctctcctccacaatcgcagccacttcctcacatatccccttcctcctcccctcctcctcctccctctcctccccctc

SEQ ID NO: 44918 - DNA, 20018 bp, Oryza sativa
ttagtcccagttggtactaaagataccctctttttagtttcggttggtgttaccaaccaggactaaagatggatctttagtcacggttatttcaatcgggactaaagatgggcatctttagtcctggattcctagctctggttggaaacccgggactaaagagtgttaccaaccaggagtagaaacggtttctccagcagtgtttcccatccatcccactcgttcactctccccactcctcacactcaatcatctccccactcttaacactccctctccaacttcaccactcatctcctgtctccttatactccctctcttcccaactacgagcgagggcggttattgagggtgagagcaacaggcttcaacggcgggctcaagttagagtagaggctgcgggctcgagcaagagggatctcgccggcggcggcaatgggagagtcggatccagcgccccctccccttccctcgcggatcccggcgcctctccaccccgccttgcgtgaggatctgtcggcggcttcgagcgacaaggacgacaacgacggcagtggcgctggtggcttctggattctagggttagggtttcggggataggtttttgttttccgatttttttttgcattttttccttttcgttatcggatggcttaagtgtccacatgcggaaattgaattttcatatgggttgctctacccgcatgcaaaaatatggttttcgcagccactgggcgccggcggttgccacctccgcctgcgaaaatatgatctaaccatatggaaaaaaaaccctttttctctaatatagtgcatacaaattagctggccatttgtcaatctatcgtaccattgaaatggtcagacaaattgtaaccctatacacctcttctatatgtgcgtgactcggccaccgcacctcctcatgtccaaaaacaaaacttaaccaaatcagaggatgcaccacttacagccggacaaccagcatcgaccgtacagtgaggtgatgaatctggtcagttaaccaaggaacaaaccggatcttgaacttaacacacaaatttctcgtcaaaatcaagcgctgtgttcgatcgatcggcgtgtagcatgcatgcatttgcgtttgcaaattgcaattgagcgcgtggaattagcggaaaccgggtgctacgtatacgtaattgcgtgcgtacgtccatgcatcagctgcatgcaatatgcagagtcggtgcgcacatgcgcaatatgcaaagagctaattggctctaaattacaaattaattaattagctccagatctagctactatcagatcactctcggatatactccctccgtattttaatgtataacgccgttgacttttcaaccaacgtttgactattcgttttattcaaaatttttatgtaaataccaaaatatttatgtcatgcttaaaaaatatttgatgacgaatcaagccacaataaaataaatgataattacataaattttttgaataagacgaatggtcaaacgttgaaaaaaagtcaacggcgtcatatatttaaatatagaggtagtaattaatttgatcgaccgtaccgtaggtacgtactttgaattcgtcatgcaaatggagctgatcaacagaccaagggatcattgcattccccaagctagctgccggctgatcgatctggccgaacactgacctaaaaagagaagagagggcaggcccgtagatggacagggccctcatatatattttagttttcaattccaacggaatgtgtgttttggtatgtttgatgacattcttatcattttgtttacttccgctactactactccttcactaaatctcgctaaacaaacatgtttttcttcatctatgctttctatataagtgagaccacaaacagacaccacgtttagccacgtcatcaaaaatagtttcaaccgttagattgataattctttcgagtattagccgttagataaaagtcccctctacttcctcaccaattaaacaacgccattaatcaccaccccatctaaatgctatctaattaatcaggtagtcaattggacaataatacaatcaagatatcatatcatatttactattccaaccatcattcaatcaattggatccatgccactacaaatatgccaaattaaaaaaatatcactattattcacgtgccactgcaattttaggaaattggatccatgccactccgtcgcattttccatttgacgccgtctctctgcgtcctccgcccatggtgtgccactgatgtggctgaggtgctctggcgtggccaccgatggcggcagcagcggtgcagccgaccgtgcgaagctccacaggtcgtcgtcgccgccgatggcaccgccgagcagcctcgtggcagtggcggagtagtaagcgaggccgtcggctgctgaggcatcggtggcggcggcggcggcgtcgaagcagacctggtcgtcaagagcgtcggggtagccgttgaggtgtgcgacgcgacgaggcggtccatcatggcccagtccgtgtggtggtggtagtggagcagcaggtggtcggcggcggtggtcgacgaggccgcatcgcagccgtgcttggagtagacgagagcgttgtggccgccgacgggctctcgagtggcggcagtttcatcaagccgtggccgtcgagcacgatgtcgattggccggagataccttgacgccggcctgctgctgccgccgccgctggcctgcggcgaggtgagctcgtgctcctgcttgcacgacctgcccatgtactgcaggatctcgtcggtgtatggtctccctgaggcggcgcgtctcctcgtcctctgcccaaggcacgccgccgccgccgcagcatgagctccagcccggcgtgcacgagccctcgaggacagccagtgggcggctgtggatggcattgatggagtggttaggagcctcggccgatccagcggggtaagccgccggagatggggaggagttaggattactgcaacacaaacttgcaagtccatcaccaactagaggagatggggagaaaaatgtgtgtggggcccacggttggccaagtttggctagtggagggaagattttgacaagctagatggcttagagcatctccaacagcctctccatcccaccctccaagccaaattttagcaactttggataaaaaatgcactccaacagaatgactatcccctagccaaaaaatagcaatggccaaagatgggctcaagctagtcaaatttggcaagccgttagccatcctcagcaactagccatatgtgggcccgactatctttttcccttctctttccccaccatccgcacatcccctgctcgtgctctccctccctcagcctattgctgctgcgcccctccttcctcacccgtgcctgccgccgccacggaaggagtgcctctgcttcgtcggcggcgggatgggagaccagcagtgaagagtgtgaccgccgcgcgcctcctcccaatccctctactccatgggcgccgacgagttcgccgagatgctggtgctcgacggctgcttcctgctcgagttcttcctgagaagagtgaggggcagctcgccatgcccggcgttgtcgccggccatctggaagcagccgcccgtcccgtccccgcgctccagcgacggcgctggcgaggaaggctacagtgacattcaaacaacaaaagtactaattactaaacatactgggagcagagcatattttattcaatcaagtggagaatttataataaaaacaaagattgttttcctcgttgtgctatactcctaatcttgtggagattatgggtaccccatacctacacagcatgtacatccgattgagtatgtggtgccatgtatagatagaatatcttaaaagggactcgggttaaattccaaacttgtatgtcaaggaaatacccgggatcctagtcggttacgattacatcatatctgtaactacctattccgttagagatatgggctgtactttgtaatacggactccttcccctatataaggaggggtccgggtgcctcttggggcacgattttctcccagatcatacgatcaataacatactcggcggatcaatccccggacaggagtagggtattacttcttgttaacaaggcctgaacctgtataaaattccttgtctctcaacccatccacttttctagcttgatagccacccccttttagtattgccgaaatcttgtttcaacagttggcgcgccaagtaggggtagcgtcaagttcttcattgattagtgcgatgggtttcgtctccggcatcgacaactttgtcttccctcccgggcaggcgttccggttcggcagcctcgacttcatcaccaacaacttcggcaagatttctctcctcgactcggattcgaaccagtcgggaagaggccaggtttccgccccgttcggtatcccgaactcggccgagatctactccgcgatcatctcaaccgagttagctccaaaccactcggacgagatccaatctactccaacacgacccgatcaagacaatagagcttatcccttaatcctaatgaaactccccgatgacttggctgccgtcttcaccacaagggcgtcctctccccgaggcctaggcgggatctggcctcggccccgatccagtctagctccagggaagtcggcgtcatactccagcctctcggcacggtttcgacggaacaattggacggctacctcagctcccccggtgtcgactcccgaccgacaaagatcgtagagtacgacgacttcggctaccgctacgactaccgcaacctcgacgacttcgacgaaggctacaaagataactacatgcctctctacttcggcattttcatggccgacaacgagacggaagaacaacgccaagcctgagaagcagaagaatagcgcgtgcgacaagaagctgaacgtcgccgactggaggaggagcgtcaaacacaagagcgagaacgactgtagcgtgagcaacaggagcgcgaacgggctgcaaaggaggccgaggaccggcgacagcgcgccttggaggccgggcgacgagcacgagaactcatcggccaacaagacgtcgaggggacggcggtttttcgcaccccccagcagaacgcggttgcagcgatcacccttctcgacacccttctcaaggaagacgcactcaatcaggccaatcacgtcgtcaacatcttgaaccagactaagaccatgatcgccgcttcggtcccggtcaaccccgcaagcgtccatacgccgactggcagccgagttccgcctcttcgatctcaagactatcaccaaccaagcgtcagtgtcgtcggcgcaggatccaatcacaggagcagggatcacggtgaacgatctgtccactcgcctcctgaccgacgcagggagcatcgagccgaacatccccactccccacatcgcaggcgtcccgtcgatcttcgcgaaactatcaaccagcgtcgcgcggcaagaggctacatcccccaccattcaccagatcgttacgacgacgatgtggatggagttgctgccttcacaagcgacctgcgtcgagtggattggccggccggcttcaagccgactagaatcgagaagtatgacggcacgacaaaccctgagtcttggcttaccgtctacagtgttgcaatccgcgcagcaggaggagacagcaaagccatggcaaactatctgcctgtggccttagcggattctacccggtcctggcttcacagattaccccgtggcacaatcggatcttgggcagagctttgcgaccacttcatcgccaacttccagggcacctttgaatgtcctggcacccaatttgatctctacaacgttgtctagtagtccggagaatcccttcgagattacatccgacgtttttccgagcaacgcaacaagatctccgacatcaccgacgacgtcatcatcgccgccttcaccaagggcattcgccatgatctcttagtcggcaaatttggccgtaagcctcccaggacggtcaagcagatgtttgaaaaagccaatgagtacgcaaaagccgaagatgctatcactgcaaaagccaaaaaagccgaagatgctgttcatattttaagccgtcactgataatggcactcaattcactagcggagtatttaaagatttctgtaaagacttcggcatcaaaatttgttatgtctccgtagcgcatcctatgagcaatagacaagtcgaacgcgccaatgatatggtacttcaatgaataaaagcacgagttttcgaccgactgcatccctatgctggcaaatgggtagatcagctgccatctgtactttggtccctgcgcacaacacccagtcgggctacgggccagtcaccgttttttctggtctatggcgcggaagcaatgttgccaagtgaggtagaattcgaatctttgcgatttcgtaacttcagggaggagcgctacgaggaagaccgagtggatgatctcaaccgactggaggaagcccgtgaagcagccttaatccagtcggctcggtatttacaagggatgcgacgttatcacaaccgcaatgttcgatcacgagcatttttagtcggagacctggttttgaggaaaattcaaactacatgagatcagcacaagttatctcccttgtgggaaggaccgttcataatttctgaagttacttggccaggttcttactgacttaagcgtgaagacggtactcatattaacaactcgtggaatattgaacaccttcatcgtttttatgcttaggcattacttttgtatcttcctctttgaatgctaacatcaagttactccttgagttatcagtcgggggctactataataataatggagtgtgatttttatcaattcaatttgcttactggatctatcattgctctgttcgattttttggcttagtcagtgaggactgaaagtttttaagaacttttgtggtttttaggctcaataaggtttgataaaacttctaagaaatcaggagctgagtttaaatcatcaagcacagcataaattcatcagtattgtacaaattgtgcctccattatcatcatcagaatacaaaatcaatcagtttcagttttttcatcatcagagttatcagacccaatcggccttaggtcgttgtcctggaacctctcaactacatcaacggctatcttgtcagcagctttttgcgcatcattgatgaggtcaagggcggcttcttcacttgtcccgtctgcaaagccatcaacagcatcaatgtcaatcttcgggtacaaggacttggtcatcgccaacgccagactcgctcccatacttccagcttctttgatgttcttaaaatatgtatccggagcaattctcagcttgtcaaagatttcggcagcatcaaatgaacttggaccattgttattgaaaaacatggcttggacgagtggtgtagtagcattggcgacttcatctctagctccttcaagcctcttgattttgctgaccaagacgtcgaattgagactgggatttgattttgcgatttgcacaaatagattcacatcaacgaatgagcaagaagatgagaatggtttcaaagtttcagctacaagtaccttcgacatctttcagaaccgagtccctttgcttcgtcagttcgcccttgtctttctccagagccttgattcgcttttctagctcggatatcttggcagcttgcactgtattgctttccactgattaatcacatatggatagcagcgcgaaacaagtcagacaagaataagagttacctttggatgaaccactcagctcaaagttggagtcttgaagctcggcaatccggtccctaagttcatactcagtctttctggcaagctccttagcttcacgaagttggtctctggttgcttccagggttccaagatgggggaccaatctctcgagagtttcagtctttgcctcattcctaagatggattctctgcaccacaaatttatctttgcttaagtaaagtggccgacaagatgattgaggctgtgtgtgaagagacatacatttacaagacgagtggcctgactgagtgtcttcttcagcagacatacttcctcgtcttccttttgtttatttatcacaattccttgtggttgcatttcgtcatcccaccatttaactaatatgggtgggcgagaatcttcagccgaccgtatccggaggacttcttcttcatcaccaaccattgggccttatacattcatgaacaatgatgaagcaattgaagaaagtttgttggatcagagtggatttagaagaattgcttacctgttatgacttctggttggggacgagcaggcccttccaccctaacaggagagctcgatcccggatcggtgctggcatccttttgaggagggctgctagtttgagcctccacttccgggatgtcttcattttgttctgtacccgattggtttccagtcgggggctcctaatcagcaccgactccaacttcggctgactggtttccagtcgggggttcgttgctggcctctacattgtcggttgctggttgattactactcgggcgatcttcggcagtcagcccgatttccgttgtaggaccagtctccacgccagtcggctcaaggtcttttccagaaggatcgatgtcagatggcttcctgcaaatttgaaatatgctatcaacactacttcaatagtgagtgaccagcgaaacaggggaaattgctaaatgacttgtacctggatgacttcctaatttttggtataggacgactggacgttttcttcttcaggttagcttgtcttggctgtttcccagtcacccctttcttgccagccttttcagcatcgtcactcagaatcaatttcctcttacgggagtctgactggttagttgactgtgaggtgttaggttgagtatcggaccggatttttggcctccactagcctgaccggtttgccgacagggtgagcggcgttgagcaatcggaggatctgacttcatcaaggcaaattcctgtgcatgatattccaagttttcaatcaaccttgtagaagataaaagcatgtttttgaggaaggctgagatgtatggtacataccggtggagaagggttgaaagcgttgtatggcacaactggcagcaagtgcgagtagctgactacgatagcatttgagaagattttatacactctccttcatgattttgaattcaagatattctggatcttcacggttagggtcatgcttgccatcaaattcgaaggctgtgcgagatctctccttaattggtgctagccggctcttgataaaatgtcgggtgatctgttccccttgaagcccctgttctttgagcttcagcatatgatccatcagggcaagtgcttgagcagcctcatctcccatgggaagcgagttccaggtgtcctgataaactggagaaagacaggagtactcgggaagtgcgggctcggggttttgcacatagaaccaatttgcatgccaacccttgttcgaggttttgaaaggcatggagaagtacttttggcttaaagttccccttagttgaaaactggctcccccaacaacgcacggtttactcttgttcggctggggcttgaggaagaagatgcggcggaatagagcaaaatgtggtctgatgcccacgaaagcttcgcaagcatggatgaagtttgcaatatggactatggaattggggtttaggtgatgcaaactgataccataaaactccagaatcccttggaagaatctcgaggttgggagagaaaacccaccgtataagaaatgagagaataccatgacttcatgtgtgtcaggggtcggaaacgcttcgccgcatgccggatgctactcgatgatctccttcgccggaagaacaccgtgcgccaccatctccttcaaattttcctctgtaacatcagaaggcgcccattgactctcgaagctttctctctcctccgccatggatacgaattggatgatgcgatttggtgtgaaattggccgggaatggatgggagatcgatgcggtggttgcgcggaagattttagtggagctctggaggacggattggagtggatttgtgaaccctagctttcgccggtgtggcttcatactatagcagagagtggggaaagtggcaagagtttcggcggggaagacgaaacgacggtttgttctcggcgtttatttcgctagggtatcgagagtactaatgggcctgggcctaaatagtacttcaacccaattttgctatcggcgtggctagttgtgatccttaggaacttaggcatttgtttttgctttggcaacacttgctcacgacagtatagctcaatgctgttaaaatcctttttgacgcagttagataattctttgggattactacaatgcacataaaaaggtgcccaacagaaaagtgttatactaattttataggcctttttaggctacaaagctgttcgggttttgttgagatgactggtttttgaatagtcattctcttagcatgttatatgcttattttgatcgtggcgtgagtcatagcttaggctatttagactcatcgtttgtcatgctttataccacatttgatggatctttttcagagtttttactcggattcttatcatatgtgttgatttatagacctttggagtgtttctcactcgggcctttttatatctccttttttgtgtattaaagctaaagtagtcgactgaatgttttattaaatgtcgcatatgcttagctatatgataccttggacgattcggttgtaaaaccactcagatgaattcgatgcacctgattttctctattttcagcccttcacagtctttgaatttggtactcgggagatcgaggcagagtaagttgaagtactcggattattgttttgaattatgagagaagactattttgtcgactgtaaaggtctcaggggctactgtggagattatggtaccccatacctacacggcatatatatccgattgagtatggggtgccatgtatagatagaatatcttaaaagggactcgggttaaattccaaacttgtatgtcaaggaaatacccaggatcctagtcggttacgattacatcatatctataactacctattccgttagggatatgggttgtactttgtaatacggactccttcctctatataaggaggggtccgggtgcctcttggggcacgattttctcccaaatcatacgatcaataacatactcggcggattaatcctcggacaggagtagggtattactacttgttaagaaggcctgaacctgtataaaattcattatctctcaacccatccacttttccagcttgatagccacccccttttagtattgccgaaatcttgtttcgacaaatctgaagcaatcttcgattgatacgataattttaaaaagttgtttcacaaacttcaatagttcaatcacatattcagcatagggacttatttcgaacccggacattcttttgttcctgctattcaaactgtttccaattgaaatttctgcaaaaagatgtcgtgaaattcctgtgttccaaatggggcttaaagtggatatgcaaccttgtagttaaattaagagggtaaaagatgattatctaaattttcctgttcggtgctgtaaggagggcgcggcggcgagggaggctcgacgaggcacgcctgtcggggaggaggaggccggcgaggaacggatccatcgtcgccatcgccatattttgttccgcatgagaggatgaagcgtagggaaaaggaagaaatatgaggaagaagaaaggattgcagaggctgacatgtgggtactactgtcgtagactcctagtagggaggactacaagattcctaacttttaccaagggggtttaaaccgtcggccacttattaaaactgtcggccttacatattactgagtgggtaccgtcggcaaatccctttcagccacatgtggtcggtaattgatcatattaccgagggtacctcggtaaccatgtacccgagggtttcgtcccgagggtttatggtcggtctttttttcagagaccacgcatggttctttcttgccgaccacatttcccgagcgtataccgtcggttattcttattctcaccgagaggtttttatataccgtcatccattcattacccttcggaaatagtatttgccataggtttttatataccgtcatccattcattaccctcggaaatagtatagctgagaggttatttaggtacttggaaaagtaaataaaaccctcggtaatttgatattttctgaaaaaaaaaatgcaaatttaaattgtacccatttttaattaatcttataaaagtaacttactgcacatagtcacatcataacaaatttcagcttaattaatctataaacagatccacgggaagttcaaccatagatataaataaccaaattgttcaaaatatttatcatccatcaccatagcaaaactaagtaattcatgacatgtcttgcatgaaagactttaattgaaacaagtctgtaacatttaaaataagatagattgagaagaaaaatctctaaactacaagggtggtccatcttctattgccctattcttcaggaatctcatttccttcctcaagatcaaaatcattgccttcatcatcatcaatctgatttcctccctcttgatcaaaatcactctgcatatatgattgtatcttacacattaggtattgcactttatttagataatgttaggtactgcactagagcaaacttgtattcgctatcacaagaatactttgaaagaaacttattttggagggtttctaaattggcacacatgggggagttcctgatgaaaatttccaaatctaggaggcaagtagcatctatgtctaagtccaaacttaagctagtaatttatcattagaggttcaacattgccgaggatttggctctcataattaagcagcagtctttaaaaagtaaaattacagagcttacccaagcttcttctgccctctggttgcatagctgttcattatttccttgttgcattctgtgtgtgtgctgccaagcagcagcaagtccttgttgcccaccttttttatgttgctacattacaaataaattagtatatgcaacttttttatataggaacaagctctatggattgctacaaattaacaaagtactagggactgcttcgtggcaaccaagcctcgcgacccgccgcattggtatacagtatcacctccagcaaacctgtttctcttcctatataaagatttcttcctaaattcaggtgtactccagtgctcacaaagtaaatgccaaccctcttcagtaactgaaaaatcatttggtttagcagaaaccaaagcttgcacagtaggccaatggttaccatcctcatcaacatcctctgctggtactttgcattttttatataacttattagtagctcttttcttctcttcgaacaacatttgtggcacattcttcttgaaattttgctccaagactttatcagcttccactttgtcagtgggatcacatttaaaacaatactgccaaatcaagcaagaataatattatttttccacactgttgagactatcacaaatctgaggaaatcttacccaaaatcctttaagaactcggtcagctggtgacatcattctttcatttgtagacctcttgtagtccctccaagtaagtgcaggtgtcctgcattctgggagaccaatagcaccaggatagaacctatgcaacagtgcaccttgcactgtcgatggtctacgagatgagatatgaggatacacttcaaaagcgctacaaacagaaaagtaaattattagtatatccacaaataaagctttttgttaagcatacacttgaagaagtcaaaatgaaatttatttaaaacttactcgccagctgggactattctaggacgatcatcctcctccattagcaggttgcctgagagtgtcattcaaaattttatatactatattaatccagaagttaaaaaataagtatatatgggagttttctagattcaacagccatgggcatgattgtgcagcgaagaatgacagtgtatagattccgaacagaaaaaaaatggacaatctgcaagggaagtaaactaaatgaaaaaaaagtacatgtcttgaagaattctacagtgtgccagccagtgtgcaagtaatatggggatactgtgaagtgaagaggaagttcgctatatccctagataaaagggggaagtggattgggagatttgagaagaggagtaaattcagaatttttaggatagagcaagcactgggccacctaggcgaagggcagaggccacaggacaacagcatccactacagatctttgctaattatctgaatttaacacatagttgttcatccactacagatcgttgctagaaaaatgcactcaacaaaaatcgaaaatcagattaatgtagagaataaggccattgcaggaagaaaactttgagggagggagagatgaccataccttgacgtggagtggtgccctcgcgtgtgcccggcgaacaaattccgccggtggggagaggagaggaaccagcgatgacgtacggagaggaagggaattcacagattcaatctaatgaatcagttttgcttccaactatttcgaaggagaaaagacgcaagagtaggagtatatacttatcgcgtgggcggctaatttgcgcgcgtattattttaggagatcggaagtggtcgcgaaaaaggaaactgtcggccacactctgcgaattggaaatttttaggtcgctaacgcgttctttaatattttggtgcctctttgttcattgtacaaggctgagcttagatggtttggaaccattatttatgtgttggaggtcttgagttcaaacccaagatttgacatatattttttaaaattttggattgtatatattacatcatgcttacaaaatagtagataatattaataaaatatggccacatttttatgctgttgattttttttggcacaattttaatactattgaataatgttctcttcaatttgacgtatatgcatgccgtttcataaactacttatctggtcaaagttataaactcttttaatgcaaacatacatgagcatgcatggtttaatcatgtgaaaaataatcttataccattgcatttgtaaagaaacgagataataatttatgagattgggtcgcaactacaaaggtgccatgaagcgggtacatacactgggcagggggccgagaagaatgaaatgaaaaaggagaaaattgactatgagaataactcgcacgaagaggatatatgagaataagatggataagcatatatactatctttgatgctaagcacaagatgtcttatatatgaaaccaatcaaattgaagataacaactatgtggttaatatggtaaagactagagagtccattaatatacccctcggttactaatataccccgtcggtcactaataataatttccgagagttatattaaacccctcggttactaatataccccatcggccactagtaatcatttccgagagttagattaaacccctcggttactaatataccctgtcggccactaataataatttccgagagttaaattaaacccctcggttattaatataccccgtcggccactaataataatttccgagagttaaattaaacccctcggttactaatataccctgtcggccacttataaccatttccgagtggtatcttataactctcactcactgatatatcccgtcagccacatgctaaatagccgaatgttctcgtaactatcctcattaaaatttcaaatggtcggccacctaaatcttcctgacggtctgtaggattttttgcttggacgcttggcaaatcttaggattctagtagtgggggtgaatggagaggatgttggagtaaacaacgaatttaacttgacaaattagatagagagttggccaaatagacatttggagagtgagatttggagagactgttggagatgctcttagccattcggttggagagaatgttggaggacgtttcttttggctagaatggttaaattttggcttagagagtgaaatggagaggctattggagatgctcttagagctaactgcttactctaaaacaaacacaacagcaaaaactattgtttaaatataatttataaactactcgatctatgcattgttctttaaaaatacttttttgtcacattatattatctctcctgacttgattggcagtgagttgctcatctgcataggagcacacaaagcgctggcgataatatggaactctgctcaatggtgctttctctcacctccacgtcactgctatagttgatatgaaaggtttataaccagttattgtagcttctagttgatatgaaaggtttatagccagttattgtagtttcttatggaactctggtcgtgtttagttaagtacttttcaaattttttatgaagtatacggacacacatttaaagtattaaacatatactaataataaaacaaattatatattccgcatgtaaactacgatacgaatctattaggtctaattaatccgttattagcaaatgtttactgtagtaccacattgttaaatcatggcgtaatcaaaagattcatctcgcaattgatgtaacggaaaaattgaaagtttgaagtgaactaagcaaagcctctggtcttagtctaaagtgaaatatattcttttgtttaatgacatttcctgagaacaatgcatgtctcattataggttaagctggcgttggggcttcttatttatgtatgtacggccctaagaggaggtatcaactatattaatgtaacaataatattaaaacactaagcttaattttagcatggaaaataaaaggttgtatatattgtacgtgacaattgactgcaactatatttacatgcagtctattgtcatatacaatatatacggccttaatattttccatgctaaaattatagagaatatttacaatatgtacctttataacaatgtcagctactccctccatttcacaatgtaagtcattctatcattttctatattgatattgatgttaatgaatctagacatatatatctatctagattcattaacatcaatatgaatgtgggaaatgctagaatgacttacattgttaaacggatgaagtatatgatatgcaactatattttacatgcagtcaatcatatgtttaccatcagtgatggatctagaaaatcgatttgttggtgtcataacgtgtctatcggtgtcataatacgctaattatacttagatcatggtgttctaatatatccataagcagtttcgctatagttttagcggaaagtcatcagtattgccagacgatggccattatactgtaatccgcccatgttatcatctattattcacagaatggtgttgtaacatgtagagtttcccatgttaaaaataggaggcccataatattcactcattctagttctcttatcattctccgcgacattcaggaattcagcaaccccattattcctatacttttgggctccaacgagaaatacacgtatatccaacttcaatccatctacaattaataagatagtaattatcagaaaaatacaaaatacattataaaagtataagacaagatagcaattatcaaaggtatctttttctttatacctccaaattttcaacgaagaaacgccccatagtccttgcacctaaaatgtgaacaatgcagagggttggaatgacaaacagttatatgatagaggtatatatagggggtaagacacctctaatgggtaagtggataaatcggtctgaaatgagtattagtcatctttaatgggttgctagctaccttggtacctgtcacaggtgaaaagtcatcttgtaatgggcaccatgtacgccttacaaaggaccttttgttgggtgcacattttaggtagggagtcacctacgatgggcctcggcccaaggcctcatctgtaacaacatccagttcaacctatcacatatgtggtcatccgtgacaaggcactagctttgtcctatcatcccacaatgcatacaagaccatcacaaagttcagccatgtactatctccttcattgtgcaattccaccaatctggtctcaataagaaaaattaagtgattatccagtagttccggaaatttcttaaattaaccaatcagcaccataccaactatccatttgcaatgtgcacatcactactaccttaatgttcttcccaatttcatagctattttcttgcataattaaggtgcagcaatgtcaaccattaacgagtttagatggcaatgtagtatagaatattaagtgaacatttaagtcaatcgttgtgtagttggccttgtttgattatgatggcccccgtatacatttgaggctagtgttacataatcctaagagatgataggctttgggccatgctacatgtttaacaacttatgaaaccaaaattaacagtacagattgtaccgcacaaatccaaatggaccaatttaaggaccagcagagatcgatgaaccatccaactttggaattgatcaatgattagttaattcaatgagtcacagaaccagatttagcagaaaagtataatatgacaccactacaccaggaaggagtgatagctactaattaatcaatcacttagtcatgttgcagctgtttgcaatccaacgaaatgcctctttcagggttacctgttaactactctttggcaaaagatcgaacatttggtgtgcgtcaattaaaaaaaaaacaaaagggcaacaaattcggtgtccagttgactgcttcggtgcctagcctgattgctaggatcgagttaaacaagtgatcaatcaccggtggtgcaggtacttaccggggacgggacgtcggcaagcgatccagaaccaaaggctgctgcgacgacgcgcgcgcgcacgggagatggcgttgggatgcacgcgtggccgggccttggagcactggagcccgatgatgatacgcgcgccgagagcaatgtccgtttcaagcgaaaaagataggaataagttcaccggaggtccctcaacttaactgcgagattttttgaggtctctcaaccacaaaaccagaaatgttcgcccctaaattcattcaaaccgttcacatgaggtcccttggcagtataggtgggtggttttgctgacgtggtatcctagtaagcaaaaataaataaataaagtacgtggggaccacatgtaagtgagaaaacggtgcgggcccacatcccttcctttttcccctttcttctctcctctcgtcttcttcgacaagccgagacgggcagggtgacggccggcgagagcggcggcggcggcggcggaaggtgagcgcagccgcggcaggcgaagcaggcaggagcagggcgacggccagcgagagcagcagcggagacggagagcgagcgtggccgcggtaggcgaagcaggcaggagcggggcgacggctggcaagagcagcggcggactgcgggcaaccgcggtgggaggtgggggcgggatccggaggtggcggcggaaccgcggcgcgttagggtccccgaacacgaggtcatccttgagcccgctgtccaccgagcggggtctgtgggcagaacggaggcgggcggcgcggcggcacgcggagcggcgttggacggcggcgggcaaagcggacggcgggcgtcgggcgagcagatgagcacttcaggcggatgaggggccgcaatggcggaggtggccgaaggagagcgtggcggcctactccgccattc

SEQ ID NO: 44919 - DNA, 6124 bp, Oryza sativa
agcccggcgtggtggcgcgccgcaacggcgggagcggacaaagttaggggagatgaggccgacgggagagggggaaagaggcgacacctcgccgccgctccacctgctccggccgcacaccgcccacactcggagccgccgcttgcccgccatcacgctcacccgccgcttgccgtcgccgcagccgcactcacccagagacaccgccgctccgcctgctctagcgcgctgacgccgcccctccacctactccagtcgtgcgctcgcccatcgccgcccgccgccggcaaagagggaggagaggaaagagaagaggagagaaaagagaagaaaaaataaagtgcagctgacatgtgggccccatgaaatttttttatttttttttttgctgactaggatgccacgtaagcgaaaccacccacctatacttccaagggaccttctgtgaacggtttaaatgagtttagggccgaacatttctggttgagggacctcaaaaaaatcccgctgttaagttgagggacctccggtgaacttattccaaaaagatataaaagggaattcggcctcggggttcgcaggcccggcccgggtagacatctatgcacatgcccgctgctttggctgggccgagcgtatccatgtacaagcgtaggaaaaagttcactagaggtctctcatgtcgtcgccgagttacaagatcgtccatgaactaaaaaattagacacaacttatcccttaacttacaaaactggatcactttagatactaagacggtattgttcccggttaattttggctagcgtgacggttgagtcagcgtgagacctatgtggctcccacatgttagcacctcaatcttccacctctatcccctctcttcccatctcaatccaagattccaggtggccagcgaccgaaggagataaccggaggagggtggcgctcggcgggagaggcgtgcagcggtcggcagtggcactcactggcggcagcggtgctcgctggcgaagacaacgatgctgagccgatcaaagatgaggaagcagaggcagcgttcgctcacaaagatgccacgtggatccagcaccggatcttccactccaggacaccctcaagccgaggtgcttgggatgcggtagcagggacaggtgacgggggatacggtggcctcttgagatgcggcgacaaggacagtggctgggatgtggcggtgaggacggtggcgggggattcggcggcctacacatgagatcgagcatctgatgccgtgtcgcctgctcatcgagcaggatgtgatgtgagagcgagatcccactattgctactatggcttctcagtgtcttggtatctcgtccgttccgcctacgatggctccgcagtgccgcgatccatggcggccttggctgcttcggcctcacgggcaacttcttcgagcaccgcgccatcacacgcaaccatccccaccagcaagtccgtcaatgttgggcaccttttccatgcaagattcctgcttcgccacgcgcccaccctggctgctgtgtcaatggcgcctccgcctacgccatcgtccttgtcactagcgtgggagaatgacaagtccatctagggaatggcttcttttcacgccggggacaggcgccgcttcgcccgcatcaacctcgctctctggagtcgtgctctccatgtcatcgatgagggtggtggcgcctcaccgcctgtgggcctcctccactcctgccggggctacctctctgcagcattgaaaagggaaaggggaaagtgaaacaaagggagaagtaggagagtttgtgtcatattgacatgtggtgttcactaatttttattttttcatttaaaatgcactgaaaatgtaggtctcacgctgactcagccatcacgtcagctaaaaccgggaacaaagtaccttagaactcaaaatgacccaattttaaaagttagcggatggattatatttttaggttcagagaagactttggaactcacggacaaataagggacctaaggtgaacttttccacaactcgtggtgcatattggacggcctttggttcaatatgggagtttaagattacgaggaattgttagcgagcttataagaatttagagttttctgtttctaatttattttttatcctgttctcataatatggatgaggaggtgcttttgattctgcgagaagctacaattatcattaaaaaaaagagaatcaaatgactcgtgattcagttgcactggaagaccgagcatgctgccattattgtcgtgcgagccgccaacgaggagggcagtcaaacactgcggcgatggatgcctacccttatgctcaccctcgcagcagagagggcctagccgtggcccgtggtggtggcagtgagggagaaggctgacagaggaaagacaacgaccaatggatcccacaccgatttttcaccttgtgttgccacgtaggcaaaattgacaaagagataagaaaccatcaaaataattgcaaagctaagaagcatatttggactattgtcgaacctaatacttcgtccgtcatataatatagcaatctagtattaaatgaaacattctatattacatcgaatctggagaggagagagtatatagtagtagcaaatatttaaatttccctttctcacgggtgtgattatgcagatgggttaggttgcaccgacgggtgtgattatgcagatgggctgggttgcaccgacgtgaggttgggcaatagtggtccagtccagagtccagactcagcccaaacaaaaaaaaaatgaaaaaactcccaccgcctgtttggttggaggtagtgtttagaagggattatgagtttagagggatgattaggatacatgggaattttagtggggataggatggggaattgaggaaggaactccctccttttcaataccgataggggcaggtaattggaaggcaattcctcctttatctaaccaaatctcagccatctgtttttattaatgacctaatcttcaactaaactccctatcaattttcatctcctctactaaataagatattagaattaaaaatcaaattcccatattaaactcatcattaattccctttaaactctccatctccgtccatcaagctaccaaacaaccgccagcgtaatcgaggaaagaaaagaaaacccagcgtataaaactggcatccgacttccttttgcctccgctgcgtctcctcgagcagagcagagcagcggcgtcgccggcgttgctgctcccgcgccgccgcatcctcgctcgccggtgacggtgagcatccatctccctcctcctctccggcgacacttctcgaatccgcgctaaccctagcaattcttctcctgtagatccggaagattctctctctgtgccttgaataaaccctcttaaaccccccatgtcacgcgagcctgcggcggcggcggaggcggaggacgtcgtggcccgtctcggcaccgacgaggcgactgggctgacggaggaggaggcggcgcgccgcctcaagctgtacgggcctaacctcgtggtcgcccatcacccccaggttcgctttgttcctccttccctccccctccctgtttcttttcttttgccctaattgatttcgacgactttcgtggggattgcgctcactaacgcctcacaatcattctatactgttgcagtatgtgtgtggctttgcatctgctgtatgtttcactatctcttgacttcaattggcgagtatatgccctccatcatgtcgaaactctagcaagcaatgaatcgaatgccttttgagcttgtgtattgaactataagcctcatcttttagcttatgcttatgcttataagctaaaatttgaattttcaaccttaaatttggaattgattttgaggtttttcatcttagtatattttcggtttgcaaatatgccgtttcgcttattccgtcaataagcgaaacgatggagtcgtatgatgtcctgtgagagaaaaaaaagtgagaaaagatttttttttttgaaatttttaataaaggttacatacattagcagtttgatgttggtggccttcaacattgtgcttcaggtgggtggcaagcttcttgctacactaaagtgcatcgtcctgctctggggatgggatcactccttcaccgagtacattaaatacgagattggatgggagtcatgggagcatcttatcttcccctgctccagggagatgttatgtgtcatgttcatcaatttctcgtcatgggcggcattggcggctgcacttgtgtcccttgcccttaactcagctggtcagacaacctatgaactgatcgttatcgtctccttacttgtgggaagcctgtgtgcatgctgtgttgccaagctccttgccaatcgtgctaaggcaccgctggaagctaaagcttttgcgcgaaggaccaaggttctgagggatggaatatggaaacatgaggatgcgaccaatcttgtccctggggatatcatatatctcaagtgtggtgatattgtgccagccaatgcttttgtcctcaacatggcacagatcgacaccaaaaccatccgtcatgaaaggagtgttaactatgtgatgggctcccttatatactatggctgggctgtctcctgtggcgaagggactgctgttgttactgtgacaggcaataacatccccatgagcactctgaaacagctttatccaaaacgattctctcggcctgggcagcttaggaagggtgtcatggctgctgccactttttgcttctgcttagtacttgttggcatcacaagtgaggctcttgttaaattctttttccatcaaagcataggcacgctgcacagtggccactttatgccacttattggtctaataccaatgtcgattcctgctgtgctctacctggcattggcattggactctcagaggctttccaaattgggggttgccagccggggaacttttgctcttgaagacttggctagcatggatgctatgctcttcaacatgactggcactttgacatgcaacaagccctattttgacaaggacaagattgaagtgcttacagaaggtattgataaagatcatgctgtcctgttggctgcgcgggcttccaaagcacacaatgaactgtataaagaaccgattgatgcagccattctaggccttatggatgatccagaacaggtaccttcttattaggatctatgtgcttttccttcttgttctttttccagaaggcttaacaaaccaattgatgcaggcacgagttggcattaatgttatagagcaccgctcccgtatgtttgttgcaatgacattgatgtacatgactacttacatcgatgaaaatggctccaagtgttctgtgctcaaaggtgaccctgcattggtaagcaaccaatccactgtcagcaaatccaatgaaactgcccctcctttagtaccacatgcattacttgtttacatttcctcacactagcttataagacatgttgacccaaatcatagcacctcccagctcattctatgagaaagcataaacgcaagcccactgcaaggttgctgggctgagtggattttggctgagcttgtggaagcaaaggaataacatagatgtattcatctcaattatcttcttttcttggcacagatgcttcgtgactgcagttgtagcgaagaagtcagagagcatatacgcaaacgtattgataagctcggtcttgatggatatcaatgtattgctgttggacgtattgttaactctcggttggacatcattattcttctacctttcatagatgatctcagaagcgatagtgcagaagctgttgataatcttactgatatgggtctgagtgtaatagtacttacaggtgatctttgcaatgtctcctatgtttatcttgattttcatgtcattttttatctgcattttatctaagtgttctcacgtttgttttgctatttcagaaagcccaatgacaattacaaagcacgtatgtggaagacttggaaaactgggcttaaatgtgttacatgctgactctatgcgggagttggtaagcagcaaaaatgagcttttct

SEQ ID NO: 44920 - DNA, 12226 bp, Oryza sativa
atgtgcttcaattgcaggtttatgctgtttcatcaactgtccatgctgtgagtagacatatagaattataatttccttttatacttttcaaaattgactaatataaacttctgatgctaataaatttgtttatctgttaaagtttgctgtccgtcttattttactcctatggagactcgagctaccctgtttcccgatgctggtgattgctgcttgcaactactgtgagtttgtaacttcgtaatgttgttgtagccataaatttgcaatatataatactttgttgtttgtttcatgatttactatctgccttttattgtaattcccaggcacatcaactgcaatgttatttgaaagggtgaaaccatcccagtcaccagatagtttgaaagcaaacaagattatcgcaactggtgctgcttttggaagctatattgccctgagtacagtcgtttttttcataatgactactaggactgacttcatatctgtaagaacttgtcacccttattatttgtgtgattttctagtaccaaacctaattaacagtatttgacagcacataatcaaagctagattgcttgttggccatgatgaggagattaaatctgccttattccttcaaatgagcattgttaaccatgctattggacttttcgcacattcacgcgatggccactgctctgggcctattgttacaatttcttctgttctatctcaactggtgagttattcccctgctcaatttccaccccaatgtgatatgtggcttttattgcaattgatttagacaaccacctgccaattctcgagtacaatgaacttgcaatattcttgttcctgtgtcctcagtcctaaattggctcagtaacactgatactataatcagaggcaaattatgtttctgaaacagatttgtgatgtggacataacatagtctggtcactgatcaaaccacttgacatgaacaaataaccatataaccatttctctttgtgtacaaagtatttgattattgcttgcagctgtagtaaagtatcatgccaagcttaatttttaagctcaatacatgcatgggttactgaacaaacttattttcaggtggcaaccgtcattgctgtttatggtgacgtgaactctcctctaccaaagggcattggctggggctgggcaggatttatctggctctacaactttgtcttgcttttgagcctcatgttgatctgtatgtatcggaggatattttatttgattttttttatttacatcttttgaagttggtgcatcactgcatgaacctaaaaacttgatatattgtctttcactgcttcatctgaatgcacagtagtgaagccttattgtcaagcactcaagcatgctcaccttttacaatcgtagtagtgaaatttgggagttgcatatctgtcaagagttcaatttagtctaatctagttgtcacgttctttggcaggtgacctgtgtaaccttgcaaagttcaacatatttgggataacctgcaggaggctgttcactggttggaccgagtggatggagaggtgcaggaggctgctcaacaggggtaaaacgtggatggagatgttgaccttaactgctatctcaggcttgattcttgtctggtcgatatatgcatatcatgtcatgaaggtcccgcagcagtagggtggcacttgacaggtagccttgacattaacatatagctttaggtcgcaaattagtgactaagcaatgtagcaatgtatattattaacccgtgtaaagtaaatgtcatcgacatggttttgtttctgtctttttcttttttcttttcttgggtccgggcttctactgccgtataattttgataagagggaagtatatgggtggtcaacttgtgcggatgtgtcattcgaatctgaactctcaaaatatattttgggtatcaaacttgttttgggtgtcatgtaggcccaaacgagctctgacctgttttatgcacggatgtgacacaccatactgatgtctattgtctacgtgttagtgggacctatatgtctatcatatatatatatatatatatatatatatatatatatatatatatatataaatataagtataagtaaagtcatattttctcctcttaggtaaagagggaaaaaggtaaacctaaaaaaataattctaaggtattgaggagaaaatatgttttttaaattttatttttttttctatgtgactgacatgtgggtcccattggatacgcaagcgctactatggcatgccgcgggtcaaagcctgtttagacctatatgataagtttgaggattcgaaaatatattttaagagtttaggaatccattagaccactagtgcacttcacccttttgagaaaatctaagaaatttggatgcgattaggcattagacgtctgatctagaccaaaatgtcagacagttggatacttggatgatcaaatgtttcactagattgtcaaaatggttcaatgcaacacatgtgaaaaataatagtgaaatattacttaaaatagtataatcctgccacatttacaactaataagttgcggaacatcacaaaaaaaaaatggtgtggaacatttttgaaaagaaaattgtgctacatctctaaaaataaattggtgcaatataaaaataaaatgcagtgaaacattccaccacaacattcaactagttttactcctcctgttccaaaatataacgaccttttatgtgagtagggccctagatgtgagtgagacggttagagggtgaaccatcaacaagaaaattatgttactcaattgtagtcaatgctttcttttgtgtaggtgggtgtgtggggtagcatatcgatcattcctgttcgacgcaaactatactcatccttaacgtattgccatttgcatcatatgctcacgacttctcttcctggacttccttttcttaatgcaatttttggggcaaccaattttttttttttttgtaaccagttttctgaaaccatcatccatcctgaatattgcaggcatttcaagaatggaatctgtacgcacggctgagctgagtcggtttcaaaagcaagtctaagaacagtacatgtctaacgttgaggggcagtataggtccaaagactcgatgagttgctgagtgtgcgtaatgacgattaggaacatgctgaggacatggccgcgcagaagattggagaagacatgttcaaattcgtagtacgagatagtgtctaataaataatgcatgccgtaaacttgagttcatgattatgcacctttttatcaactttggttagagattcacaaatagaatttagtaaatgtggggttctttatcttgtggtggtatctatagtttgtgtttgctttatgttatatcagtgtgtggtgagattgttcttgcgtgaattttgtaataattggctgtgaattttataataattggctgtagctcgttgagcaaaggctggtattattatctaaaaaaagggagattgtgactaatcgcgtacaagttattatattttgagacaaacactactacgaaaaccatctttcatgacggctattttgggttttcgctggcggtatttggcaccgccataaagcaaaggccagtgaaaatatagcatctccgctgacagcgctaaaccactagagaagataacttttcgctggtggctggttaaagacaaccactagcaaaaatcgttttcgctggcggctttcgtatgtgggccgccagcgagaatagtcttcgctggcggctgacttatgtgctccgccagcaaaaaaaatagtcttcactggcgggccgccagtgaaaatgattttccataaagaaattaatcaccaaaatctcttttcgcgaaaaagagaaaataaatcagattttccacggcatgtacagattcaaatccacatccaaatttttgagcatcgattcaaatcctcatccaaagttcattagattcaatcaacatgcaagtgaacacggcatacaagcattttgaacatgaaaaaaaaaaaagaaaaacagcatcaacaggagagaggaaggaggtcgtcgtcgccgtcgccgaccgagcagcaccggagccccatcgccgagcatcactgccaccgaggtcctcccgccgcaccaagccccacagcaccggatctgggaagcccagccgccagcgggaccgtgggagggggaggtggagggggaggaggagctcgccgcgcccctgtcaccgttgccgtcccgttgccgccgcgtcccccgacgactcatcccgtcgccatcgccgaaccccccgacgaccgcctcccgtcgtagtcgcgcgcccacctcccatcacggtcaccacctgcgcgagccaccaccaccactgccggagccgctgccaccacctgcgcgagccgccatcgcctgtgtatggggagggaggagaggatgctggtggctggatctggaggaaggagatgcgcgcggtagcggcggcaggtgtgagcagagcggaggaggaagggcgggtggtggcggtggcgggcgtgggagcgaaccggaggaggagcgaaaccggcggtgactgatgtgggagcggagaggaggaagcgcgtgcggcgatagagaggagacgaggagataaggttggggagagaaggagtggataaggagtggctggtaggcggcgattttttgtaatgggtggacgcgcgcggttttttttttaagggcggtgtttttagtaaccgctagcgaaaatgagattttctctgacggttagttaagaggcccgctagtaaaaatatggttatttttgcaagcgtattttgaacaaccgctagtgaaaatccacactaagtaaaaataggtttttttttcaagcggatttcttaagaaatcgccagcgaccctccaccccttgttagaatttcacaagcggatttctcatataaccgccagcgaaaataataggataccgtcatgaaaaatcgatttttctagtagtgaaatggactaggaacaagggaaagtttcacacattcgacatccgcttcagtcgccttccttttccgacgctcatgtatggagaaaatccaagaaatgacattaacaagtgctcaattccaaaaaaaaaaatgccatcgacgagtataaattctataaaatgccattgtacaaacgatttttttctagaaataccatcgccgttagggttccgtccattccgtgccgttaaatacactattcatcctatagcacttaacggagggttgctaacggaaccctagacgtttgtcaatggtaattcttgaattttctccttatgtacagtgacactcaagtttttccccgctggtatcaatcagattgttgcgggatgtgacgtcttgataacaatctgttgctgtataccatggagaaggctgtgaaatgtctttacattatacatgcatcatggataatatgcaatttgaagcacataaatttagaaccgttttgcaactttagagtgaaaaaaagacgcagttgtaccgagaaattcgttggatcttcacaacaaacatgttgagcgtacaaacaattcgaatggacatgctaattctttacaagatctacacatgtgggatcgccgctatttactgttcggtctcgctcagggaaaagcttctccaatacaaattgtctaaatcgtattgaatacaaattcggatcaacagctgataccgaaagtggatcgaacttcagtgatttgagagcatgttcaattctgttagacacattatactctagtagtatgttgagcgtataggacaacatcatactcttcaatggtgtccacgttttctagttctatgttgttatatatacacgcacacttttcgagcttgagtaaccaattgaccatagctgaacacggaacctgaaaaatgaaaataaggaaaaatgtgtcaaaaacagaaggcaatctttgtgagaacaaagaaccacgcagaccaaagtttccaaaataaaaaaggggattttctgcccttatgatatgcaactacacccatcaggattagcacaagtttaagaagcacactactatatagcaggggcatagacgcaaaaaaagtgcaaaaccaccatcacatgtgcaatacaagaagacaagcaatgtatattactgatattgccaaatatatatacacaaacttgtcatttttttatcatgcacaaatatagtcaacttttgacacctcttcaaatgcacaacttataatatgctctacatctatgaatgcttcaagaatttgcacttaattacggaccaagttaaagggtttaaagctaaaggctgatctaaaagttaaaaattcaaataacggaccaagttaccaaaaatattgaactttgcaagtaatacaacttcctcattgtattttgaactttaaacatgctaatatacttagaaatctttcctgaagagtgtgataactatactagatattatctcaatttgtgttctttcatttatgcatgttcaaagaccatacagtaataaatgtacccaatgctgacttgaactttgaaatatttgagatagaagtaaatctaccttccagggactcgcaaaacaagatcaattccttcataaccgccttttgttagccttttgttatgtgtgaacatatcttcctctttaaaaaagtgaccactcaaacttttgctgattcttcctcttgaattttctgtacacgaaaaattactgttatgacacattattctcaaacgaaataactagcaaatcacataataccttcaattttgaaaccaaagtagccattgagggacgatcatctggattgttaacaatacatgtatctgccaaaagtatcctgggacatttcgtggggctccactctttcctttctagtaaaaccagttctctgatgagatttccaaaacagaagacaccaattttttcctgggcactctctgttcaagtacacagatcattagttttaataagaacatattttggaacataacaaaatagtatagatgcaatacaaatctaagtatacaaatacaaatggtttggagaattgaaagatgacatttcatgtcttaatgaaatataggaccagcacccagcaacttacagttgcacgcttctgttagctctatgagataacaatgaatctgctctacatgaaagaggaagacacaaattcttattttattattattattttgcttggttactcatataactaatgcatgaacattgacgaatatatctacacttaaaaacaaaaataacaatcttaaactttcagatagaaactaaggactattttggatgtctgaggcaaatgcatgacatattatcttgaaaaagaatatcccccataaaaagtgagttgaaaaagctagctgataaatctagtaaagatgctagatccttctacttctctaactctattatgctactgaataaccttttacatccatctcccttctatcttgtgaaattcttcaattatgaactttactatcttctgaacttgatgtatgatgccaatgccatactaggtttagatataggacatagtattatagtttagggggaagtatgggtgcattttcttttatggctatccaaagttaagatcatagttaatataaggcccttcagggctgttaaccttcactcgcacacacacagaagtgcaccatataatgacttagaccatctaaaaaatatatatgttgcttggtcttattagagttcagacaaaaaaagcatacctttatcatttgcattaaagatgccaaatcttctatccttgaagaaactcatcttctctcccttccttgtggccaatccaaaatcagcaattttaactgtattatcctgaaattgttatcatttattagtcaaagtagacaattacatggttctctaacagcaacacatttttcccgtaataataaagtattgactgaatttcacaaaagtaaatatactttaaccaaactgttgcaaactacatatttaaggtgttgtatcacaaactgcagcttcagcacaaaaaaattatcatagaactacatatttaagaccaggtataacaaaactacatatttaatattgaagttatcaagaaactataggttttagagtataaatccctagcacgactgatatgtttgagctataaacattgtagtctttgtgattaaattggtgctaaatctgtagttttatgatacttttgttactaaatctgtattatcgtagtacattgacttaaggctgtaattttctgatagtttggtcaaagtatatatatatatttttttgaaatttactctaaattattcgtaaatacaacaagaatttcaccttcatcaaaagaatattcctcaactgaatgtcccaatggacaaagcctgcagaatgaatagcttccagtccagatgccactccaagcaagatagcatccaactcacctttattggatgctgttagtagcaaaatcaataccaatcaaaataagattagattggaaaccctaaaataaaaaaagagcagtaaaatttatttacctctgaatccttcgaggtcctgtttagccctttcataaactagagcatagtactcctctgtgtcagcaaaacccacaagatttatgacatttgcatgtgaaattgaacttagggcattgatctctgctgcaacaaaacagggtgcaacaatttattgacaggtcagaaacttaatcatttttaaatcaaataatggtaatttcttttactgtgtacagacaaccacaagctacctagacacatcttatataataatggaattcaggcaatatatatatatatatatctttcaaatatgcacaatctacccaaacacgcttgaataataatgcagcaaatgcattactgcaccaattaatttcatggcaattattaccttccacataatccggacatactcatccttccttttagaaattttgatagcaacttttcgagggcaatttgcatagttattccctttattcctgcccttgtaaacctgcccaaaggctcctggttttccaagcaacctcttctctgagaaacctttagtaaacttgtgtaagtcttcatcactgaagttgataagctccatcattgttaattcctgataaaaaaaatgacagaaacataataaacataaagcaaatagcatggataatttgggagacctagagacagcacaacattagaacacagtaaagtaaggggtggaagcctagagatgattggattccacttttcacgataactcatacctatggtgtagatgaagtgtatggaggtgagctcagttgctccaaaatcccacagtatgtagcaacggcgtaacagcagagcaaaaatccagaactccagatacaaaatgctattgttttaacatggacaacaaatgggcgaaggctaccccgaggattacccctcgtagaagccctcgcccttttgccctaggggccatgtgagatgagccaaaaacttgtgagatgtgttaatgttggtgtctaagacaagaagataaactttgtagaaagatagtagagtgaagtagatatggagaccatgagtaagcttaagtatagggaatcccctttccaccccttctagttgtattagccatgtactagaagtgcagcaaggggattctccaaactaaccctgcttggcactgggaggtattgcattttcaaatattgcatattggaaacaaacagatattgcatttttgtgatattgagccctcctttggatgatacctagggttcaggtcagcagagccaatgtggccagtggatgaagtatcaggtggggtaggggctttggggaacagggttggtgatccaaaaagatattattgggcttaaccggaggagttgggtcctgtcaacaacacatgaataaagacaatgaatatatgttagcaatgtcatgatgtgattaaacaaaagccaaatgcatacttagcatacaaaggataattaataatcatacgaagttaaagtccatgcgtactggaaatgtattctaatttggcttgttcatatagaagaatcataggattctttgaacaaaaaggtcaaaattgcctccaaaagaaaaggaaaaaaaggcatcttggggataaaacactcgatagaatttctcgattatccacctagagtggatgcatcggaattcatgaaagaatctcaataagccctgtagttatcaatgcttgatgggtcttggatagagaaagttaagtaattagtccattttccaacatcttatcgtgaattttgctatcctgatgtatgccttactcatgaacaaaataaccaaatgcaaataatcaaactgagaattttaaaagtatttcccaagcacatatgtaatatagaatacaagaataaccaataatcagtcaaaagtaacataattatacagtgaatattacatatgttcccaaaataaacatctaacaagaaaaacacgcaaacaagtattagttccattgtcccacaatgcagtgcaagctcatcacacagttcatccaggtgttatctcatcattgtgcaattcaaccattatggtcccaataagaaaatttaagtgattgtccagtacttcccgaaatttcttagaatgaccaatcagcaccaaacaactatcaatttgcaacgtacacatcactactaccttaatgttcttcccgaccaataactattttcttacataaggtacagcaggaaatcattgacgagtttagatggtaatttaatatagaatattaagtcagtcattgtttagatgactcttatttgattatgatggcctgcatatacataaaatcaacatgtgcatagggatgttctaaacattaaggtcagtagtaacatttgaggccagtgttacataatcccaagagatggtaggctttgggccaggctacatgtttaacaacttatgaaaccaaattaatagtacacattgtaccgcacaagtgcaaatggatcaattaaaggaccagcagagatgaaccatccaactttggaattgatcaatcgattagttaattcactgagtcacagaatcacagttgattaatcgattagttaattcagatttagcagaaaagtataatacgccaccagcaaggagtgatagctactactcaatcacttagtcatgtagcagctgttgtcgtgcaccaaaggaaacaaatcaatgtaaattataacagaaacgtataatatgacaccagcaacgggcgatagctactacagtatactcaatcactcagtcatgtagcatctggtgacttgcaccaaagggaacacattaatgtaaattatcatagatgctcctttcacccaacctgctttcagttacacagaacaactttgaaagacccatgcctcaagtggaatttccaaagggaaaactattaagccatctaataggaggtggtacaatcagcattgaatattatatgacctgtacaaacaataccaaaaaaccttggttgtaacttcaatggttccatcagaaccagcacataagaagacaacgattgtcatgcaaaaatcaaatcactggtgacaaaaaacaacaacaaagaaagtcagcactgggcggaaaacattcatcgaaacctgcagaactgaagcatggaggaaattgttggtcacattttgttatgctacttgtcatcactaaatcgcaagctggaaaaactgaagctatctctgctcgaaatgagattagagccaatggaccaaaacctatatatatgtgactcaaatactctccctctcccttgaccctaaagcactgagttgctagataccataattaaaggtcattctattgatgagaactcaaatgcagatgctacgcatgtgaaagtaatatagcattcaaacatgaagattaaggaaggggtaagctcaaaaacaaaaaaagaaggaaaacattcaaggtcattttcaaccattcaatccaaccataccaaactgttccaaattattcaatattttagctatggttctgaattgttggatcagaaaatctgcaacactatattaattgtgtgacagaatcacacatttttcgtatgccactaaatcggggggagggggggggggggggggg

SEQ ID NO: 44921 - DNA, 7496 bp, Oryza sativa
  unsure (1)..(7496): unsure at all n locations
tgagctccgtcgccgctggctccctcgtcgcttgcccgcgaggagacgagaaggcgagaatgatacgcgaagccgagacggagtgtcggtttcgagaaaaataaggagaatatatatgggagattgggagtgcgacaacgaggccgccggggacgatgcacgcgcgacgccgaggggggtcgctaatcggcgcctgggcgcgcgctagctgctcgcgccgtccccattgctgccggcagtaagtaaaaactctagatcgtgttgctgtagaaaattaagttgtatagtgtgtacaaataaattatattatattttgtaaaccaaaataaaatgacttcctatgttttatatagttaacacatgattgtaaacataatgcaaagtgaacatattttatttaattgatacttatgaattttgaataaaaacaattgagattgtagggttttatgagagaaggagaggagactttttttatcatatatctatcatccaaaagctaaaaataattgcaataatgtggcttcatgagagaagagagaaatagcattaattacacttagtggggatgaactatataagcatatacgataatgcgtacgatagcttaaacaatataatataagtttacataagttaatgtgatttaaatttaaatagtatgtggaataataattcaaatgtaaaagtaaaatgatgtggctctatgagatagcaaagaagataatttagaccatacatctaagggataagaaaattatgatgatatgacttaatgggaagaagaaaagataagaaataatttgaaccatagattaatcatttaagaacttaaaataattgacgtgatatgacttaaggagagaaaagaaaaataatataaactaagtaaaaataaactatacagatatacaggatattataaaaaatgaggaagtgattgtttgaatagtcatatgtagatcctattgtttgaactgcacagcaaacaatgcaaacaagcaacaacttcaaagctctagatccaaaccacaagcaaggaggtgagctcaaacaacaactacacaagcgtagaacaaagcaatgcaacaagaagataaagagggaggaggatatcaccaagatttatgtgacgatatattttccggaattcaaattcttgacggaattttcgttgagaagcacacaaaaacagagacttttttaatcctattctcatgaggttgcacaaatacattcctttcactaatggtatctttttcttgcggaggtgagatccggccttcacaaactttctttggtagatcggaggcacaatagcgacacctagctgtctatactgttggtaggtgaaaactttgacgtttaccgttatcttaaacttccataacttcttgtaagggaaggaacaatctactccctccgtttcaacttataagatgttttgactttggtcaaagttaaactgctttaagtttgattgagtttatagaaaacaataataatattttcaacccaagataaatttattataaaaatatatttaactattaatttaataaaaataatttggtgatgtaaatattactaatttatctataaacttagtcaaaatatcttataatctgaaacggagggagtaatttatatccaagctaataaagtatgccacttggacgttccattattttctcatgggaatattattccctattcaatcatatggataattgggaatttcatcagtgtcctcatccaatcataaaaaacatacaaccctaattaaaatcagccgtacgtgcaatatggcctcttttctcagtcctgtcgtcaaattaaaatcagacagctattcatcaagagtcagttggccaacttcgcccgatgctaagattcaaaccgaattattaaactcaaaacacaagacttaattcctagtatactagtacatggtaaacactatcaattccagtttttagctaccctaatcaattacactggctttcgtctgtacatgacgtccaacataaccatcaacacggacgattgtctcaaacaccatgacaataaccaaggctaaaagcttactaattaattcacccaaattaactgcatagatctcaaagcaaacaattttttttataccagtcacaaattcacaattgaactctatgcagttttctccagaaatcaaagggttaacatttgtcaccagtcatgagttgatgcgtacatagtggtctttgttgtaaggccatataaccgtatacattggctccagaagtatatctgtgctgaaggaagcaagtgcagcacagacaacaacaatgtgcaagatcttgttaatttgaatgcagtctgcactctgcagggaaattcaaatgattactttaagcaagaggagggtgagggttaaggcaaattgcaccaaccgcatacctcctcaagtgtagtctgttaagagcattatgtgtttatgggtatattggcaattcccatctctattttactcaatatatgacctttgggctaactcaatagatatagttcaatccccaaattccctaatttcctcaaattatgacatagtcaacaggtagatcatcaatatggacatctagattctcccttgctgccattttacattgcatacttagctcctcgctgcaacggcgtacatgcagccgtgtcagcgacggtggaaggcccatctccgggagcctcgcgacgccggggcagtcttcgacgtctaaccactcgagggaggccagccgtcgtaggcctgcaggaagcgaacggagattcggcaggtgccagaaatcgaggcgatggagggaggccaggagctggagagccctctcctgttcctccgtcaggtcgatcatcgtctcgccacgcctgctatcccatgaccagaaggatagccgtcgcagagacgcgagccgtctgcagagaggcacggtgaggacggagccatcgccgacctggagggtttccagtcgggacaagatctccgcagaggccagttgctgatgtgacagaagctccaagaatgcaggtactccaggtgagttggataccgccagggacctaaggtttgttaaggagccgaatccctcgatcgaagcaagtgagccgcagtctataatcttcagctcccgcagtgccttggagtatcccagctggagagatgtcagctctggactctgccaaatgtacagtgctgtgatggttgggaacaattgcagcaaacgggactggtccttgtctgtgaggttagagatatcgagttcttcgagtgacggatgaggctgcagtgggataatctgtccatgctcctgcagtttgagatcccacgcagcagagagctcaggactcatatcaatctccaggttctcaagagatggtgggagtaatgcaacatccaccttatcactcatgaccaacaacggcatcagcttggggcaacgctgaattcgaagacgctcaagagaggtgtatcctaggagtactctctcccctgcaacaaactccagttgggcagttggagatgtctagccaccttagagaatggatgatattagatggaatttccaacagctgtttatcatctctggctaagggccttgctgctgtagcttccaaactgctcatgccttccttctccgcagcttgatgactgaacgaaacaaattttagttgtgggatctcgtgtaattccaaactatggagggactgcacatgagaaagcatttctgttaaacaatgccctgatatgccacatgcctgaatggagataaattggagagatgggacgacaaagctgcttggaatgatcaaattagggcagttctttatatgcaatttctctaaaactgtgcactgattgagaccttcagtagatagagagactaaatttgggcaatccactagacagaatgatcttatgcgcgcaaagttatggaatgatatgatcttgtcatcaagcataaccaactcttcagatttgattttcaaatcatatgttaactccattgttggaagagttggaatcccgctgatggagaagcgccgcatctgagcagaaaacgggagaggatgtgaaactaccaaacgaggacaatcatgaattgtgagatcatgaagaccagatagcgactcatttcgatctcctaaggaagtggaaatttgcagggatggagaagttagcccactgcaatattccaggcttgccatcttaatcaaaaccaacttctccagtggaaggactaacaactctttgactgcatgcaggtgtactaactccaactccttcagtgattgcatctctctcagaggaagtatttcccatttgctgccatatcatttacagagaatctaagttattaaagaattgaaataacaactgttcaggaaaaggtaaagcaacgaaacaactgctataccttatatgaggacaacacccaatggtgagtttgtttagagatggaaaccatgacttctgctcggttctgaaagaagagaagctctggaaaggagtgaactcattcaattgagggcagtccttgatcttcaatactctgagacgggaagtcaattctgtcccataagtaccaaagcacttctccaatttcggcaactcaattaaaatcaacttctccaaagagggaattgagagttccactagattccacatcttaaccaatttcaattccctaagcactggaagcatttcaagagatccaagaattcgccactccctgcaattgacaagatgaattgtctgcagtgatgtcactgagagattactagaaagccatgttggagatgtaggaccagtgtaaccagctatacacagagctttcaggttatgatgtggttgaagaccctcaagcacatcttttgtcctctcaggttcaaggctcatgctgccaacactccatgacaagaacaacttttttagatactctttatctataagtctggccccgttggcttcatctttagtcttcacattttcaagatgagaaattacaagagttacaagcttattcatggattggagctgtcttatatcaaaaccgctaatattttgaaccttgaacttaagtttttgaagagagatcatgttgcccacaccacctatcgaaaagtgcactttagcatcagctataagatggcgcaacttaactagattattcatagcagcaggcacagaaatatttccagagaaccccacgtccaacacttgaaggtgataaaaacttgtcaaagctcgaggaaaagcagcatccttgtagtctccatataccaacatatctttagtctccgagacacgaataaattcaagatagcggagatgatgaggatttaggaaagtatgtatagcactgatgtcagcgttcaagacgcaaactcttaacaaccgtaaacatttggcttccttgcatacagtttgtatggacttcaatagatatacactgctgcttccaaaaagcatcaagctcctcaacttttgcaaaggcctaatcttttgtaatatctcatatttctcagtgggaaaattggtatttttatcattatcatcaccagtggttatgatagacaaatgacgaataccttgtcgaattgtgctagattgcaaccctcttaccgtataacattcttttgctgaaacctgttgtgctaaatcatgcataagatcatgcataacatagtgccggtcaaccttttggaaaaatccaaaatccaccaaactacctagctattgcaaccctgtctcctccaaccccttgcctatatcttcacattgcacaaaattttgagatatccaaacctgaaccaaagttgctgcactaaacgggtgatcctctgggaataaagaacagtaggagaaacagcgctgcaggtgagaaggtagataatcatagctaagtttcaggatgggtataaaatcatcatcttttatttgaagagatttccatttgtctcgaattgtcctccaatgttcatagctaacatttctgttcaaaagtgcaccaacacttcgtgctgctagtgggcagccctttagtgctttagcaatttgtcgcccaatggattgcaaactaggatcaccctcgtagttttccttgccaaacgcacatgctttgaagaactgccaaaactccttttcatccagaccactgatttggaatgcattcactgttcctatcatttctgcaactgagttttttcgggttgttgctagcaccatacagccggttacttgactatgtttcaatggagctaacagcttatcccatccactcatgtctttttccttccacatatcatccaatacgagaagaaatcttttatctctaatattcttcaaaagaatctcctgtagtacattgaaattgctaacatctttgaattcctgtttatcttgtttatcttcaaatatatgctctaagatctcacgtgttatgtccacttcattgaagtaagtggatacacagatccaaattcgcaaatcaaaatgatcaataattcttcgatcactgtatataaatctagtgagtgttgtcttcccaataccaccaatgccaactattggcaaaacacgtagatcactagattcctcatttaataatatctctattatcctgtccctgtccgcatccctcccgtacaccttaagttcaataggaacagaagttgtcaagcgtgtgttcctgatcttgctttgcctctgatttgatgttaaagctgggtgtgagacacctggtagaagaatccccctcacagaattgccagctttctgtaaatcgttcactattccattgatcctcttagaaatatcaagtctgatctcaagaggcagcatggtgcaatgagttgtgtctccctctccttgtttcctttttctacaatatgaggcccaaacagtaatttggctcctggcactgtgtagtagttgataaggagaaaatggagttgatgaagacgcatagcttgcctcaggataattagcagcagcagcactgcaaccttcgcctgcaaaggaaacccagtttgttatgggaacctgaaaaggaaagtcgcccaacttcttaagcaaaattagatggactcttgcaactgtgaatctagcagaggttaaatcatggattaaaaatataccggaactaaccaacatataaactgagatatggttcctatgttctcaactacaccaatacaagtaagagaagatcatagaacaagacagctatatatctcaaacctttttcaatctgttgttgtagccggtagtagtcaagctcatccataacgtcttctgcatcataaagcaactcccttagaacatccagcgactggataagtggcttcttgtcaatcctccttccctcggcagtagcaagcaccatctccacgttcctcatctcaaatnnnnnnnnnnnnnnnnnnnnnnnnnnnnnnnnnnnnnnnnnnnnnnnnnnnnnnnnnnn

SEQ ID NO: 44922 - DNA, 22526 bp, Oryza sativa
gtctccttctcatgggtggtgtatagcttttggcattatcaactgttcaactccctgtcagtcaagtttgtcacctttttcttttgtgttgtgattattgattacttcttatatttgttatctatgcaaacgctttgcacaaacataaagctgtcgcagttggcagaatttgtgttgcttctgtgccattgaaagtttcaatcaattggcatcactgactgctacactgcagctgtgcctgttcttttccatctagatctagaatcggatgtaacatatcctaatattataaatcggtactgtgttggttttttatgggacgaagggagtacacttcttctagctactaaatgctatatttttcttaaaaaactttctacatatatatttcttaaagttattattttaaatctattttttaactttataatagttaatttatccgtttgtacctctcgaatcattcatctattaagtattccattcaggtcaaaagaagacacccaattgaagtaaaacatgctagctgtatgatactttataatatatgattagtgtattttgcttgcacttggatgaaggggctattttaatattagaaaagattttgactaatggtgatgcctcgcttcgggatctgctcaaaatatgtttcttcttttctaaaaattgtttttgggtacagatggaccgtgtaaacagatcattgttcaaagccaactaggaaagtaaaataaaaattatttacatgttaaatgttaatgactagttattgactgctgatgaatgtgtttaacatgtgaattatatattatgaaaatatttctaataataaatctaaaagtataaattttatgatgttaaactatataagtttatagaaatctatggtcaaagattaaaatgttacttaaaataaaaacaatcctaggacgataaataatttgaaattgagggagtaccgtgtttgtactctagcagtctgactctaaataattgaacaatcatgaaaacttggccagagaacacaatccaataagtaaggcccccaagcttaaagttattccaaataatgtatttgactgatcattctgcaagcagtgaatatatatatatatatatatatatatatatatatatatatatatatataatttatttggtgctctatggtgcccgggctacatgattcaaattgggtatatactcaattcaaatgagtatgaaatttttaaaatgtttaggtattaacattaactactttactaactagttcaaaacaagtttaaactaaatttaaacttgtttttgttagattttgattctaggtatataggatccaatcatataattagttgggtatgtaatcatggattgtgaaataaagttaaatttgagttgctttgtttataggtataggtatgaatcgaattcttataactaggtatatactcataatttaaaaattttgaaaaatttaagtgaatttttatattttataccatggtgccccatatgggtgtcctatatatatatatatacatacgtatatacgtatatatacgtatatacgtatatatatacgtatatatatacatacgtatatatatatacgtatatatatatatacatatatacgtatatacgtatatatatatatatatatatatgaatctcaagtgaagtcaatataagaaaacgttttagaatcaaaaaaagaagaagaaagagaacatttcaatctgcaaatttccctcatgtacttcttgtttcatgcattccattccatgttactccgtgaacattcctgatcatccacactatttggcattgtatttctctgaccaatgagatcacgacaagtgcaaacgaaaaaactggcaacatctacatatgctctcccatgtgcattttgcagttttgactgcatcaatccatccaacacaaacactgtatatcttcatcttgtgctgccatttcagtttttaggagtggtcagtcctggcttgcacagaaaaaaaaaaagaccgtgaatggtcactcacaggtggggcctagccgcctaggaccaaccagccaaacccagcatgaggaaagccacccatagatatagcagcctacttacacataaaaataagagcttatcataataagataagacatgactagaaattacatattcagcttaccagggtttaagtcctaaattcagtgcatttttcaaaagaaattctaacactttccgaacgaatcatctgaaacaacacacctagaactctcatctcgagctggctcaagcgagattataaaccctcattggtactcgtgagcttccatttcagtttttaggagtggtcagtccttacttgcacaggcgaaaaaaaaaaaggccgtgaacagtcactcacaggtggggcctaggacgatccagccaaacccagcgggagaaaagccacccatacacatagcaacctacttacacataataaaaataagagcttatcataataaatgagccattggttatatattcagcttatcaggatttaagtcctaaatttgatgtatttttccaaagaaattgtaacacattccgaacgaaccatccgaaacacctgaaactctcatctcgaactggctggggacgtccaaaatccacgagactcgagtgagatctcgcgacatcataaaccctcgttggtaacagtttacaccaatttcaagacacgtgtataaaaatatgcacgcggctactacgaacacggtgcgtgtgtggttgtgtgcgcgcatcgtccagagcgaaaagtacactccataagagaggctggggattagatgataaaactaaaactaaacaaacagagcctgggctgtgggccattcttggcttggatttactgggacagttcttccctcttggatcaggaattcaggaggggggagcttttggccgaattgatcaggaaagatgcagctagctgcagcgttgcggtggaccaccggacggccggcgacgaccactggttgtaccgtggtgatggcatgtcccggcatgggaagctagcaagtgcatttcagatttttccaggtcccctcttctgctctgttgctgttgctgtgtgtgtctctttgttttttatgcttgttcatcggtcatatgctaagggaatcttttaatgctgatatatgaaggcccatgtgttagagcaggtacaatagcaggctataagcaagttataaacatattttaaagagataaaagaagatagagaagagcagcgggctacaaatctgtagccaactgcagcacggactccaaaacgtaatgcgtgtatgacaggtaggaccagacattaataatatagtaagaactattgtatgaattggctatagataaattggagctagtagttggctatactattaaacttgctcttagtgtgggtgggtgggggtggaagagtcttctctccaagagtaggactatcatttttctagtggttttatagggtttttcaccaatttattttttcacaggtttggaaaatagtttttcgaaatctaaaataggcctgagattcaagatactggggataaatacgaacttcattataggttgctaagtgtcatgtgtaagatagtatatgagttggcagctcttaaccacaacataccatgttgtaagctaaaagatttgtaaaataagattgttcacttttttttttagtattatcaaaagttcacacttagtaagataaatcaggtggctatacaggcatagatgccacacgaacaaacggagaaaatttttgtacattatatctagaagaggcagtatgttgaaccacatcttggattaggagggtggccggctgactcagcaccaacgagtgccattgttcgttgctgtaaaccgctcttacatgcttcatcttggtttgatggccacacaaatttaaatgaagatcaggaactgaattttctctttttatatataggtgtatgatgttgtgccctgttttatctaatcaaaagggtttcttaccactatgaaaataaactgtaaggcgcgttgatatcactatcaaatgcacaacctttttttttttaagagtgaacttcataaaactataactattttatcaaaaatgttagtatgctgaaaatttagctagacattttagagaacgacaataatattatataattttattagaaaacctcatctttacatctttgacaagtttgggtctcctgaaatacttgtgctcttgcatcccacatgacatacacacataggagataaaattatagttttgtaataaaatcgtccactattgttgcggttttgtaaaatacattcccttaaaattatagcaaaatgatagttttcatcaaacaattatagttttgtaaagtccacttttttaaaaaaaataatgaaactagtacatgcatgtacatctcgatggccagtgcattgtgtagtatttcctttaggctgataatccttgtcgttttagacaaggctattgttaaactaaaaaactttgactataaataatatttaaaacatttgtcaaataaatatggctcccatatgtataggttgatcttaaaaagtgctctgataaaattatatacttattgatatttctatatatatatatatatatatatatagagtaataaaaaatagttatcaaatttattttttgaaactgtgtccttgttcaaaatgataagtattattagtccggagggagtagtataatccaaagttcaaactctttgtttaatatagaaaaaccttgctttttgactgacatatttcctccgtcctaaaataaatcatcttatagagtttattttttttcaaaataaatcaacttctacattcttacctaccattggtctacaaataaaaaaaattatttcttcaataccctttacctatccacccatgcattaatataagtttataattaattaggggtatttgggtcgtccattttgggaatttaggtttgaagtatttgtggaacagatcgagggattatttctctagctatctagctaattaattcgattcattcatcagtttttatttgtagggataaatgagccatgtctgtactgcaaactgcaaacatggataggtcaaaaaccaaagtccacaatagctgaacagctagcggcgacaaggttccttccacgctatgaataagggtgctgcatggcacggcaaaatcatagtacgtaagtacatgctacatgcatattatgattgcatgctggttcacatgcggccattatatactccctccatcacataatataaaggattttaagttttttttacattgtttgatcagtcatattattcaaaaagattgtgcaaatataaaaaaacgaacagttgtgcttaaaatactttggataataaagtaagtcaaaaaaataataataattccaaaattttttgaataagacgagtggtcaaacagtgtaagcaaaaactcaaaaccccttatattatgagacggacggagtatatccgagtgcaacaagaaaccatcatatgattttttttttctttgtgatgaacaagcctgccattttttagtgctactttatttggggacaaaaaggttccaagaaaaaaaaaacatgagggaactaattatacctagtacaccaacaaagttagggtatgtctaataatagagtcaattatcattatttatcaataagttatgaaaaaaaaccatcgcatcgttatttacctttatttcctagaaaatgaaaactatttcttaattagcacccgctggctaggcaatagcaatatgtaggaaggtccttatattgtttttccatatagctcctagcatattacagatttatggtaagtttatcgtacatgttggggtttttttttatagagacaattagacaaacatttatatgttatactcaaccatcattttttcattgtgtttcaactgtttctaagattaatttgaaggttaccactcatctagtttgccagagtactccaaattctttcgaacagtgagcctatatcttgcaaaaaaaaaaaaaaaaaaaagaaaagaaaagaggaccgctctttccagccttggacacataggatccacagtaaagtttgcaccccgagatggatctagcatagaggcggcgggatctcgagcttccactactggcgtgaggatagatgattgatgctattaacttcttgatacacatttgatcattcatcttattaaaaattacataactattagtatttattttgtcgtgatttgatttatcattaaagaaaatatgacttacattttcaataaaaaaattaaataaaacgaaatgaccaacttatgtaaagaaatcaacagtatcatctatcaaaacagctattgcattttggtcatcaatatgcaactgggcattacttaggacatcaatgcaagcgaagagaaacacagctagctgccgtgctcattgcgtagtagagtaactggccattgcattttggagtaaatggattgatataattttttaaagtaattctcatataaaaaattttgtaaaaaagcattatttaataattttaaaagaaaaacaatgaaggtgaattggaaaagaaggacatgaagacacggaccattatatcttgtctcacttgagcattgcagccattgtgtagctagcaattagctaggcattcaggtttgcagagtaacaatcatggctttgatttgacacggcatctgtgtcatgcgtgcttttcttttaggactgacggatacgtgtacggtatacgcttccatcaccacaactggctacagctactactgtgtatcctacgcgtgtgccctggacagacagacacaaggcatgtctcggataggagtggctgcgttcgttgccttgaacttgagggaaattttctcgcactccaaacaaaagaaactcgttatcatatgattaattaagtattatttttttattttatattaaatttatttttagcttctttcatttatcttaaaataaatttatttttttaattattgaagaacttttaaaattacagaataattatatttggagtagataaagtgatcaatagttgtattgggatttgattaaaataggggtgttctagtctttttctgcaaatacactatccgtcctaaaatataataatttttagccctcagaatttatcccaaaatattaacaacttttccaccaacattctcttcccaaccaatcacaaccctccaccattcacttttcctatctacctccacactccccatccaatcacaaccctctaccattcacttctacctattttcttaataatcatgtccaactctaaaactttttatattctgggacagagggagtagaacataccatttcgtctctccacattttatactcgtattgcttatatactacttgcagagagtaacttttgccggtctttcaattgatgttcttgaattaatacacggatcactctggtttaacactttcaggagaagaatatgtgtccatctcaggaggtcgtgcccatgttaggatggcaatttccctattggaggtaggtacccgcccctacggggacgggacggggctggttttccacccgtgggttggctggggacaggacccaccacatttgcgggggcggggccggataaagggttccacccaccccgctagtccctgtggggcccgaaattaagataaggccaaccagaaaagcccatctagtccatgtaggggatgataaacgcgaattcccaatcccatccagcccccacacatgcaaacgcgagcactcgttcagacttctaaacgcatgaaggttgtggtgttgactcacagaagtcctcttctcgcgattgcggcgcagcgccagatgcctgcacctcctcgcatcgccggcatcttgctcctcctcgcgctgctgatatctcactactcctcgcgtcgccgacatcccgctcctcttcgcatcaccggcctctcccttctccttgcatcgccggcctctccttcctcctcatgacgccggccaccttttcctctttgtgccacatacctcctcgctcctcttgttcctctcccaactaagtcttcttcttccaatggcagagtgagtgacctccagcggggccccggtcaggtagcattttgtacccaagttcctcttcggggctggggccgggggatgaagtcaagggttagggcagggtcgttcttgcccaacccagccccgaccgaccccattgccattcctaacccacatacggctcatctatgtattgtccttgccaaccgagcatacgcatggcctcaggcgcatgggacctctgctagtgggcctcgagaagctcaacctcctcgttgtggcaggtctcaccctccctcaccccctccccctacggcacagatccactagcagcagcgatggatgggcggatccggcggcccctactcctcctgcatggatccaacgacttcgagcgaccatgacgacaacgacagtagcctcaagtgtgatggtggtggatcctgacgtgatggcggtggcggcttcaacacgatgacgatgcaggggatccggtgtgatggtggctagggttttgggttttggatctatggtttttgtatttttgggttttgcaatttttattttttttgtcaaaattatttttgtagattgatggcttaagcacctgcctacgaaaattgtattttttttcgcaagcagttgcgccaaccacatgcaaaaatattgattttcgtaggcatcttggtgtaggcgggtcacctagccgcttgcgaaaattggttttgaccgtattaaaaatttgattcctatagtagtgtatgttcagcactctcctttcacgacctctattctcttgtttttcacgtgtacgctttgcgaactactaaatagtgtgtaaaactttctataaaaaagttattaaaatatcttattaatctttttttatgtttttagctaatacttaaataattatatggagtatcggatgtgacacattttagtactacaagtctgaacagactctaaacatattaaaacatattaagacatgtcatatccgatcaaagtaaatattttgagacagatagagtattatttatctattgtgcatatatgtattttatatatgttgatgacttagcaagttgacaacatttgtgtccacttgtatagaaacgctatacatgcataattaaggctgtgtgtttggtatttcggtttggtaactacttgaggcacataaaataacttactattgttagtgtataattaattaatattagcctaaaatataaaaaaagattaatataatacataaataatttctctatagaaaattcttgaacacgcttagtagttcgcgaagcatgtgtatataaaaaaaaggagaaagtagatgttgataaaggagagtgccaaacatctcgcctacgtgtccaatgacatggacgcctagtttatttcaatttgatcgtgcataatactccttccgtttttaaatatttgatgccacttttttgaacatatttgaccattcgttttattcaaaaaagttaagtaattattaattcttttcatatcatttgattcattattaaatatactttcatgtatatatatagttttacttatttcacaaaaaaattttaataatacgaacggtcaaacatatgctaaaaagttaacggtgtcaaacatttagaaacggagggagtatgcgtgaaggtcaatctactctcggagtctgattcttttactgtatactagcattgtcttttatttatatttatagtaatcattatattccgaaacctacatacgtattttatatggtagcgatgcgttttgtatttacataataattctagttctttatcggagcaaatatgttggctccagtttttattatagaaactttgtaaattgagcctttcccatacaaaagcttaatttatacacgtgaactttttcgaaataagatttcaggccacgcgagcatcgacgtgtgtgattccgattcagcttcaaactttcggtgtcaaaaaattgtatataaaacctttgcagaaagtttgcatatatatagaaacatagattgcgcatacacacaaaccacgctaaacacgtcctcacgcaaaaaaaaaaaaaaaaaaaaaaaaaaaaaaaaaaaaaaaaaacctcaaaaagaccgcaaaaaaaaaaaaacacgtcctcacgcgccacgtctgtcgtctgagcaaaggttgacacattagaactgctccatgtacattaattcattcccaggagaaaaagaaaagagatactccctccgtattttaatgtatgacaccgttgacttttcgaccaatatttaaccatttgttttgttcaaaaaattttttgccaatatgaaaatatttatgtcatgcttaaagaatatttgatgacaaatcaagtcataataaaataaatgataattacataatttttttaataagacgaatggtcaaacgttggacaaaaagtcaacggcgtcatatatatatatatatatatatatatatatatatatatatataagttttttagctaatacagtaaattatcacttaatctattatataaggaaggagtacatcctaatgtgcccagctctcagcattcaaacacgaaataaataaataaaactagtcatgacaaatataaagctgccagatataagccatagcttacgctagatccataccaaaaataaataaataaataaatactcctatactccttacaaacatttataaaaaggtatggaaaaaaaatagagagagacaagagctgtgtttgtgttgtgtcgtgattggtatttaaatccggaaaaagggtccagccactacggttttattagttggcgacaagccaaagccgcaaccccacccccgacgtgctcctccgccaccgccgccgccgccgacgacgaccgccgcctccgccgcgatctctcgcctctcctccctccctcctctgtacgcagtgtactactacggtactaccgccgccgtagtactcgctggtgttggggagcggccggatggaggcggcggctgcggctgctgcggcggcggaggcgcaccaccacaatctacacgggtgcctggccgtcagggcgccggtgccgaggtgctcgctcggcggcggcggcgggggcggcgcggcggcgatgggtggatcttctggtgaggctgtctctctctcctgctgcgctcgcttgtgcttccattggcttctctggttttttttttcttcggttgcgatgtagtagtacgacggttttggtcgcctcccacctgcttgtgttattgctcgtgtggctggcggttgaagtttcttagtttttttttctctctctctctctctctccgaatttttgttttttttactcagaaaagggaagtttgatgcattctaggatttctttttgggggggtttatttgtgcgtcagaattatggggagatttttgcactgttccaaatgttgtgctgttcttgctggagttttttttttttttttttttggttttaccttccattggtgctgttcttaatctactgtgctcttgaacatttttctttcgattgatgctgctttcctctgctcctgccgttctaatccagcattcttgtattttatactatacattttcctttccctttttcacctttcttagaacagttccagtatctttggccactggtgtattctgatgatttttgtgatgttacctgaatatctcaaatttttatttttttttcttttttcattgacaagaagtcagcactggagacccaagaggaatcttataaaaaaaaaagctcttggtattgtcaatttctgtacttgctaccgcttttggccacatacttgtttgtggtggctcagagagaaagttgtggcataatcacacaaggaagctaatcattgatcttgtccttttatccttttgggtgccacattgctaacttctgtgcaattactcttcttttcggtattcgctagatttcaggcgcccgaaaatgtttcgatagtatctaataatgtcgcgcttcattgataatagtatcgcaacaagggactaattatctgcttcaataattatcagcacttaagtagctggttagtagattcacttgctgtccttcacctccttttttgtgctaatttcggtactaaatgatggcacctttcctctgtgttcttatcttggctccaaaagattgatatatattgatatgatatgactaaaccacatcatcaaccgatgttgattgtacagttgcaacatcaaaaaaaatgctggaccattagcttattgatgatggtggcaacccaactgttgcttttgcttttaagctgagttttggttgggttcatatgcgcctaatcttatcggttggaggcagcttagctgctctaatttggtgagaaatattggctgtgatggcatatttgttgggcaacttgagtagtgaccgatgagaaagctgcagagagaggggcatatatgataatgatatatctctgggttaagaacgttgtcgcctaacaccatgtgggaggtatcagtttggtcggctgcaaaaatgcttttgccatgtctgtcttatcctctggtgatagatccactggcttataaatataaataaggcatttgtaagcttgtttaagatggcataagcaaaggtttgtgtgtgtcagagtcactaggcctagctagctccatcagttttggctctgggatggtgctggggcagcttgcactgtggtccaagattgccagttcagtaatccttgttttttttcaatggtttaatcttgcctctcttttttttctttttgttgcattcggaatgcagatgttaattatggtttggtagtgtatattaatattattatattggtgatttttgccttgatagttttgaaaagtttgccattctcttctcttctttggtgaatatgtgtggtgtaatctgatacataaaagggattttttttttggtgaatcttatgagggaatgtacctgttcttgtgcagatgaagcatcctgtgggtcaccaagatggatagggaagagcctctcttgcgtatgcatcaagagaaaaggagcctatgagagaatatgcatgaaccttacaccagtgcaggtatgggcttgcgagatatctttactgtgcaaagatttgcaatgcttttatgccaatgtgcacagacagggcctttttctgctgtcagaaaaggatttatctgcagatcaaatcaatcaatagataagcgggcctgcttttgagtaaagatcacatcgcttaatcgcagactcgcagtgaccactcaaaagggattgtttaagctttggctttaagttattgtttttctttattcatggatattagtttttttttcaatttcagtatgtggtctgaccactgacatcagaaaatttacatttcagaacttcctttgaaactttatctcttcatatatatcactaatacagatagttaaaacaatcatctcttccaatttacaggaagagaggcttcagaggctgaggcaccgtatgaaggtttattttgatccttctagacgagatcatcaggtaaatcttgtactagcaataagccaataaatgaattcatacaatatgttacatttccctctgtctaactgcagtgtagatgtagacttgctatcacacactatccaatgctgtagctgtagataattattttggcactgaacatgatcagcagataaaatcatgcataacaatcagtgaactcctcagttttggtattgatgacactgatttgactagagtaccacagagttacatggtagtaacatgtactcgtatactttgatgtaagtttctttgtattgatatcacctgaatcctgataaatagcaaattatgatgataggaagcattgaaagctctttggcatgcaacatatcctgaccaagaactacaaggtttgatttctgaacagtggaaggacatgggatggcaaggaagagacccatcaactgacttcaggtactccaaactaaaacttgccacctgacagattagctccaaaaatatgttcagctggtgtgaagttaagtgaaaatgcactacatggtgcagaggcgcaggattcatatctctggagaatcttctattcttcgcgaagacattctctgtaagcaattcttcatcattgctttcattatctgaaacactgtagactgaagatcgccctcttgtttaatactgatcttctttggttggttaatccctgtaggcctcatttcagaggctgctaaagaaacaatgtggcaatcgagctacttgggagtacccatttgcagttgctggtgtaaatatcacattcatgatcatgcagatgctggatctccaatctagtaagcactgacccaattctgccagtaaatccagtctgtggaccgcagttgtactaattagacaataatattgtatgcagctaagccaagaacgtttgttcgagctgtttttatccaaatgctgtcaggtagggccagttaagtaaatacctttcctgcatcatacaatataccaacattttgaaacgaatttgtccttgctttgttcccccagaggatgagtgggcatttgatctcctctactgcgtcgcgttcgttgttatggacaagcagtggctcgacaagaacgcctcctacatggacttcaatgtaattttcctgtcaatgtacatgccatattttctccgtaactcatcagattgcattgttttgaccgatcttgcgattctgttgtgattcaggagatactgaagtcgacacggacacagctggagagggagcttctgctggatgatgtgatgcggatcgaagacatgccgtcatacagcctgctctgctagtagtggccatactggttgaacaatcatgattgagtcaatggttctgacctctgagtgtatagccccctcccttttgttgattccagggaagggaatttttgatggcatgtagagcaatggcctcctattgtcatgctgaacttgtcccactgtaaacaactcatctgggcatcaccacaatgaattagaattgctagcatccaatgtcaaagctggtgttaatctgtcatattttaccccatggatgtaacaacagaatcaacgagtgggtaaaatcaacttgcaacctctggtgaatggtgttcaatgaatcctcatttccttacttaacttgtcaaacttttccgatatgatgtcagccttgtcaacaatcctctgttcatgaacagaaaatcagctactatgaaattgccaaatgctgatcagttctgacatgctatgaaattgtcgtttattcttccaatgccgacgtcagctgtcgtcgccggccaccgtgctggagccggggatcttggaaagccgcgcccgcttcatcaccttcctcagcctgtccacgtcctgccacctcccggcctcggcgtacatgttggagagcaccacgtagacgccatggttgccgggatccagcttgagcatctcctgcaccgccctctcggcgacgtcgatgtcgccgtggttcttgcaggcgttcagcagggctccccagatcaccgtgtcggcgtcgcaggtcgtcatgccacggatcatctcctcggcttccgtgaggaggccgctccggccgaggaggtcgaccatgcagccgtagtgctggatggtcggcgccaccgcgaagtccttctccatggacgcgaacacgcggcgggcctcgtcgagacgccccgtgcagccgtaggccgacaggacgccgacgagcgtggcaccgttcggcggcacgccgtcccgcctcatccggtggaacgtagcaagggcgacctcgccgtggccgtggtgcgccagcccggtgatcagggcgttccacgtcgccgtttgccgctcgggcatccggtcaaacaccgccgtcgcctcctccatggcgccggtcttggcgtacatgtcgaccagcgccgtcccgaggatggcccccaccacgggcgccgtcacccgcctcgactccatgagctcgtgcacgcgccgccccatctcgagcccgcgcgaccccgaccgcgcgcacgacgacagcacggacgccagcgctgcgccgtggggctcgatcccgtcgccgaccatctcctcgaacgaccgcatggcgtcctcgtgcatcccgttttgcgcgtacccggacaccatggtggtgcacaccaccgcgctccgctcgggcaatccgtcgaacaccctgcgcgcgagggggacgaggcccgcgagcgagtacgcccggacgaggccgttggcgacgtaggcgtcgcgctccagcccgtgcctgacggcgagcgcgtggagctgctcggaggcgcggagggggaggcgggcggatgccttgaggaggaaagtgaaggtgtgcctgccgggagagtacgagccgccgccgccgccgctgccgcggcggaggagggagaagaagcggagggcggaggccgggtcgggggaggaggcgagggcgcggagcgtgatgttgagcatgaaggagtttggggcgcaggggagggaggcgaggaggcggagcacggctcccggaggggagagcgcggcgtgggcggcgaggaggcgggacgccgcgaaggcgtcgtcggcgaggcggccggagacgagcatggccgcgtggacggcggcgagcgcgcgcggggtcgcgcagcggtcggccaggagggacaggttcggccggcgccggatgccgccgcgggcgcccacggcggcggcggcggcggcggccattggcgtcgcgtgcgtcgccacactgtacacggaatcctcctctctgcgtcgccctcttcccaaaaaaatacgtatatagggcgtgtttagattaaaaaaattttcgttaaagttccaacttttccgactccgtcacatcaaatgtttggatatatgcatagaacattaaatgtggatgaaaaaaaccaattacacagtttacatataaattgcgagacgaatcttttgagcttaattacgctatgatttgacaatgtgatgctacaataaatatttgctaatgacagattaattaggcttaatgaatttgtctcggagtttacatgcagaatctgtaatttgttttgttattagtctacgtttaatacttcaagtgtatgaccgtatacttaaaaaaaaattggcacacgaactaaacacaaccatagtatcagattttaaacaacaagtaatatgattttatgaatttagatagatcatgaatattaggcatccatttataactgatggattttactgtaattttgtaaaacgtccatataaatccatttaatttgtgttcaaattgataaaatccttcatctcctagaggaagccagcaaatctagttgggtaggaggcagtatggaggttaaggcgttcctaaggtgtcgacttgatgtccttgagactgtaaagtgtcgctttaggatatactccaagttatctctgaggctctaaggcatcgcaccaaggtaagacagcttgaggcgacacctgggagtctcgcgctctatatcgctagtgaaaaaattagctttcgtgaaaagaagtttaagtgaaaacgagcccatgcactataggaaacatagagaggggcatctagcaaagcaatatgacatttggtgactttgctccctccccttcacatctgacagtagcgctctttgcatctggcaacgacgtacccatctctttcgatggtggagactctcccctcaacgagtactatctcctctcccccttcatcatctgctgagctactcctttctgttcttatttctatgctcttctcttcctcaatgctcatttcttgggccctccgttgctctggtgctctccctcgctgctcttggcttcccccctctccctaactactcttggcttcctagttcctcccgcttccttaactatttgcttcatgtgcatttgatgtagtacatagaatactgttgatgttattggttattaaaatgctaaattattatacccatctaacacttaaaatactcattatatcccaaaataaacaaatttagtactggatgtgacatattatagtactatgggtgtaacatgttataatactatgaatctggataggaggtttttcaaagacaattcatagtattaggatgtgttacatcccatactagattagtttattttgaaacagagagggtatgtactactatcagggctcaacaatttgcagcaacaaggtatataaagtgttgttaaaatgtagttatattacactatatttttgttgtcatattatattattacgattataggctgctttcggctgggctagctgccatagcggctgcggctacagctgttgtgaatggctgtagctaacagccgttttaaactatcacagtcgctgcggtagcaggagcaagtgcctccgaacaaagccttacctccgaacagacttgccaaaccactctccaagccgtattttaacaaatgtaggaaaaaatgccctccaacagcctctctaactgcctctccaagttatccaactggccaaaatacgcctctccctggccaaatctggccagcctctagctagccaccccagcttgccaaaggtgggccccaccctttttcaccgctccatcccaatctcgcagaaaatcaacgctccctgcactcgtcgtcggtcagccacctaccctcgccatccaccgtcgcgtggacgtcaccgcctcccctcgccgttagtcagccgcctgcccttgccgtccgccattgcgtggacgtcgccgccgcagcaaagggagaggggtggggaggagcttgggaatgtctcgccgtcgccgctcatgacttcagtcgatcattcccatctctgaaatatagagagggtgttgatgtccctgtcttgctttcatcacctgcttcaacccatcgaaaatcccccaaaaccaagatccccaattgctcgaaagagaagagagaaagaaacaagaagttgcttgaaagagaaaacgagaggcgcaaacaagaagggccactgccgccccgtcatcgccgtgcacggccaccgccaaccgccgcccgtcgctgcacacaaactacatctgccgcaagcaaaaacaggcttagggaatagggggagcaaggtgaggaagaaagaagtggtatagaggctgacgcgtaggtcccgctgtcatagactctgaatagagaggatgaatggagagatggttggagatgctctaaggatgaattgactagccaaattaaatggagagttaactaaatagatatttggcgtccgatttaaagagactgttggagatgctctaaggcgtgtagggccatcttacctcgccttaacgcctttacaaccattggaagcaggatttactgaaataattgttttccagtactatgcatgatgtcggtttcaggtgtttgcaaacagaaatgtagggttagtagacagtaaacaaaataagtaacaactttcgcaacaacaattttattattcctctttgctaaaaaagagctacaaaaccgtcgacggatggcacaataatgcaacaatatgcccacatttacaaatttatttattttgccaccattccggattttccatttattatttgcattgttcttacatatgctaggtagctcgccatcaaagcactcctgacattgtctttgcgtaccttcttcagatctcactaaacgacttgatagtccggaaaccatgattctcagggagcggtgcatttcccgggcgaatggagattattacctcaaaacctgaaaaagaaaatgtcgggaaagaaaaatataatatgaaatcttgacccaaggaaacgaatgatagcttgaaatgatcacatgattaggaatggcacccagagaggtcgactggttaaagctaaagcatcttatccaccaaataaaagcatgaacattcccatgaatatttgaccagaactagtcattacctgcactttttgcagcaacagcttcttggaagacatcggtgataaataagatctgagcaggactgtccaccccaagtgattgcgaaatctcaaagtagctccttgtttctcttttgttactgcggtttatgcgagatggaatcataatttcactaccatttttcagtatatgcagagaaatagaaatggaacaagaaatcatacccggttgtggtgtcaaagaaaccacagaggtattgtcgcagatcaccataagccgtattgccaaataatagcctttgcgcctcccggctgccacttgagtatatgtagacctatttgcaggtatattatttgttatcatgtcatctaatactaatacacctttttttgtattttttgcaatggatgattcaaaaatttgaaattgatattgtttagcactatctagggtcaacgttcttgacccaagttggcagctagtaataactatagtaaaccatgaaaacatattaggagccatgaaaagtttaaagttcacacttccacacgaatttgactaaagagataccttcatgccactagcatgccagtgctttagcgcctcggggacatcatcgaaaacaactccttgcagttctttactttcaaaaccagtcctccatatgtggccctggaatttgcattaaaaatgctgaaatccatcaaagaaacaggaatatgcttgcagcaccgaaaaagaatgtggactaatctacctggagttgtttcaacgacgtaatcttcctgtctgctttaatcatcgattcaacattagcaactaatgcattgataacctcttctttgtcagcatcgtcaggtggaattggaacagacccaacaattccatttttcaggtcttcttcaacctgaataatgaatgctaatatgttatatcttgcataaaacagagatgggcacattcacgtggcctagtggtaaaactcatggttctggtggtgaggactccagccactttccaccatggtggtaaaacagttaactacgtccacaaataggaagttgaggaaccaaaattggtatggtaacttagatcaaatctaacaattcaaaacaaaataattttcacagggctaatcaaatagtatgacttaaataccatcgacaaatacttagatggtacaagcttgcagccttacaggatcaacagcttcatgggatgtgcaaaattgatttatcataacttacttggatgcgcaatagtttgatgtcctctttggtttcatcagaactatatgttgaagtcagatgctttcgcacattatcacgggcatagggaaacatcacatcagtcacaaatgatattggagtagttgttccctcaatgtcaagaacaacacaatgctgcaagagaacacaaaggttagctatttgtattccagaaacatattatatggatgagttgaccagatgtagcaaccacaaagttaagaaagtacacaaacaataacacctagtactcactgctgcaaaacggtacactataagatctaaaaaaatcatttagaaggtagattttgcaaatactcagaacaaagaacagacctttgatgatttggaatcagggcatccatttggaatactagagcttagaacactgcgtggtcttttggcactgtttattggaccatgctcaggagttgtccaatcaatacccaattgatagagcttgatggcagcatcaaaaaggtaatgatagcattcagcctgaaaagcacaggcatagcaattaagtaaatatatgtcatggcataaagtccaggaaccattatccctcacaatgtgtgcatgaccacagttatatttagagtaaattgcacagttggtacatgaacttacaaggtggatgcgatttagtacatgcatatgtaaatcgctcatttcagtgcataaacttgtctaatacgtgcaaactagagccaaaacaatatgttgtaactaatttcactaagttgagcactgattaggatgttatgtaggctcacatgtcaatatgatgttacgtaaatatgcatatagtcaatcaaacatacaataagtcatgttaattatacataaagggagtatgcaatggatacgaaataaatgaagaacaaggttaaattatttacacatacgacatatctcataccctcacgtgtgcgcctgacattctataatcagacgaactcaacatgaatagtcacaagttttggactagcacgcacgctctagataagttcatgcaccataatgagtattttacaagtttgtgtactaaattgcacccacctaacaagtttatat

SEQ ID NO: 44923 - DNA, 2223 bp, Oryza sativa
  unsure (1)..(2223): unsure at all n locations
aacctccttcatcagtaccagggttgcaagcatcgcctgttccaccaccgccgccacctccacctcttccaatgattccagggatgaaaacaccacccaccccaccgccacctcctccagcagctccagggcagcaagcaccagctgttccaccgccacctccacctccacctcctccaatggttccagggatgcaaacgcggcccattccaccaccacctcctccatctcaaactaactctttggtttcttcatttccatccacaagtaaaagaattccaccgccaccccctcctccatctcaaactagctcattggtttcttcattgccatcctcaaggaaaggaaatgatgtggcagcccctcgtcccccacctcccccaccactgtattccaggtcatctcatgtcacttctgcaccatcagcaccacctgcacccccattgcctcctccgaagctagttggggccagcaaaccttcacaagagcaaatgataacctggccaccaccacctccaccaggcccacctcctaagaattcctcgaactctttgccaagtaagggtaatgttgtcagttcatctcctcccccacctcctacattctcatttggcgcaaaggaccgtagcacagcccggtccagaagtcctagaagtttgcggcccaaccagtcatctaagagacaccattgaagccgttgcactgggtgaaagtgtcaagagctacacagggaagcttatgggctgaaacacagaagtctgatgaagcatcaaggtattccaaacattttatgccattattttccaggtaaatgctaatggtagcactataacatgttagtccatttatgtcttcaccagaaccccagagatagatatttcggaacttgaaagtcttttctcggtagccatgccaaacatggaggagaaacgggcacgccaacgtccttctgttgcagcgaaacaagaaaaagttcttttggtacttatacttcacattccttactgcaaatattcacaagcagtgagaaaattcaagtgaaaagtaaacaagattaaccttttcttctgcagattgaccttcagcgctcaaagaattgtgaaattatgctgagaaacattaagatgccattaccagatctgatggtaacgaactaaacaattttgttgaagggatatggctcttgaaaagtaaaagtaatctggcatagttgatgcatacccttgctgatagactagaatagctaatcttactaatgccacttcctaaacctggtttgggttatattagttacctattgttgcaactgttactgagcataaagtatttggcagctgtactgaactagtggtttctgttgataatagtggttccttttttttcagaactcagtgcttgcacttgacgattccattgttgatggtgatcaagtagattatctaataaagttctgtccaactaaggaagaaatggaactactcaaagtatatatctactcagcagattgctctttgaaatatcattggactcttgaaattcttactgcgtctgttccagtggaattttttctgtattctgctaattgattaaggtttttcctcctactttttcaggggtttacaggcaacaaagagaacctagggaaatgtgaacaggtcactaataatcttttctacttgatcttttgttggtgatgagctttgttttttcggtaactatgtaaataataatgaatttcatagttcatcccaagatatacacaatcttagtgggagatcatacaaccaactatctcacccagtcatgtttggatgtttcttggaagttatgtagtggagtagctaataagatgatcatttttttcagcattttcccggtgccatgttatgtatatatagcttgtttattgcttagcctgtaccagcagttatactattaattttttgcttaatctcatgcatgaacacaaaggcttgatctgacttgcttctgtaattgtagttcttcttggaaatgatgaaagtcccaagagtggagtcaaaactgagaatcttatcctttaagattaagtttcttacacaggtcagcagaatatttgcatcattttttccccagtgaacttgtgtaactgttctgatagataagtagagtttaatttttttgccgnnnnnnnnnnnnnnnnnnnnnnnnnnnnnnnnnnnnnnnnnnnnnnnnnnnnnnnnn

SEQ ID NO: 44924 - DNA, 17653 bp, Oryza sativa
aggttctttctgacaagcttcctgaagttcttgattttaacaaggacctcacatatttagaacctgcatcaaaggtaacttagatatattaattaacgctagatccacgttggctttgttttgcttgcttatagtgtggtggtgaatcacagattcaattgaaagagttggcggaagaaatgcaagcgataacaaagggactggaaaaggttgagcaggaattgacaacatctgaaaaggatggtccagggtctgagatattttacaaggtcggttgcctgagattttattgttagtcatatgagcagaaatttctcatttattttcgctgattacaatcgagaaaatggtgcatggtatttggttctccaacttcccccattgattctctgttgcctccttgtggatgtagttgttggaactggaaattataaatataatttcatgtttctcaaagtattcttcttatgtaaaactcatcatcaaagattccgagttacactacaatagggatagtgacaaaatgtgaaaagtaaaaggtgatcagagacctttgccatactaaagggaatgaacatgaatcaacaatttagtccttactgctccatttgtattattagattatggaaaccataacacttgattgcagttttgcagttttgtacttcatcagtacataggctttatagatactccctccgttccaaaatataagtatttctagggttcaaaatgtgtgcctcaatataagcattttatgggacactgattccatggaaatccatacatttttagccaatcaggtgcttaggagacgaatctaagcgattcaaaaatcaaaatttgaccactgaggtgactgaaagggaatcttttcccttaaccttggtatttgctaaaaaaacctagaaatgcttatattttggaattgagggagtatattctattaatagtttgcaaattgtcataaaaggatggataagaacaaacatgacgacacccataactgaaacagttagtcatttagttgactatcattgcacaatgttttgctgttagtatattattaactgtaatactaatactcaaaagagctttcgtttcagaaattgaaggaatttcttgctgatgctcaagctgaaggaagatcgttagcttttctttacagtactgcggtatgcaaagactataaatagtttcattaccttgctgcatacgtcttctaacatgtatttgtactaagtttttgttattttattttcaggggaaaagtgcagattctctagcacattattttggtgaagatccagtgcggtgtccatttgaacaaggtattttatttttatatataaggcttaattaatattcctaactactctacaaaatgtacaaatcaaagataagtgggtctgatacaaaagggaatgggaaacgtgtatttatatgcaaggcatgtgacgaaaggtgctatgataattgagttagtcatcatgtttcagacagagggcactgcattcctctttccatggtatgacctgtcacaattggataacttaggagtaattgagtattgccatttttggggttgtacaatcaaactaagaaggggcatacaattctgggggtccctggtggttttaccagaatcatccaaattgctgctgttctttgtgtgctttgttccttagtgaacttgtattgccatgatagatactagaattgttgcatccaccaaatcttcagattaataccagttagcttttggatatctgcagcagctatatgatttcctgacctttttatgtggacagttgtctctactttgctaagcttcgtgaaaacgttcgagcgtgcccatgccgagaacctcagacagatggagctggagaagaaaagggcccagatggaagcagaaaaggagaaagtgaaagcagcagctcacaaggaggatttgctggagccatgaattttggtctgatgagttggcaaagtatgcattgtcgttgatttcttgccgtttcatattgcggccttagcttcatgaccaaggacagtacggcagaaaattttgtagcggtttattcgaagcttctaaccatgtgaaattggaggtgaagaaaattagcacatatgacaggtacatcaatggaagttactccctatatgcttggactactattggttcttacagttttgccctgcagacagagggagaaagacaaatataagctcactatgtagtgctaatatgacagtttacttagcagatagactatacagcaatacagatacagcttcactggttcagtggttcttactgtacataggaaagtgcagctatgcaactcaccggttccctggtgctgaacaaattttgcaatgtttgtgcccgcaaaatatgtacatttgtagagatgcttttgtgcattacgatgtataacactgtaagtagaacaaataaaacaatatttttccaaatggaatgtgtggccatttgatcattcattcatctggctggagctgtggaacaggcagcttgtatcttgttttttcctccttgtctggaaggatagacaaatgctctgaaccttatcagttatgttgtcaggtgctatgaatcgatcataatccatcaaactgtgaatcacatgcttggtcggtactccctcctatttttaatgttcgacactgttaacttttgaattttaatcattcatcttatttattttttatgcaactataaaataaaaatataagtcatgcttaaaacatatttaataatagttatatatcattttaagagtaaattgtactttgtaccaggtagagtatatacaccttgtttgacttttcacccggtagagtaaaccttgttttatttcgcactaggtttaacacatattttcactttgtatcagagaatatcgaaatatgagtaaaacatatgaaacttcttaaatttaaactatgtttgacaacattgcttttagatattataaaatttcattattttttatggtttgatgatagtgtcaagtgaaatttatttcaagacaatgtagtgcaaagtgaaggtatatgttaaacctggtataaagtgaaacatggtgcgttttacctggtgcaaatacaatttactattttttaatagggaaaattgtaaaaccaccacagaagtctgaagtttgacattccacaccataagtcattttgttgcaaatgcccgcccactactcggttttgttgcaaaccacatcataagtcattttgttgcaaatgcccaccctctactcagttttgttgcaaaccaccacagtgcacacatgcataaccgaatcaatatgttttcataaattgtgagccgtcaatatgttttttttacataaaattaatacttataagagtatagttttaacactctttatgagattcgatatatagaatagctaatgggagctttaaaattgttgcactgagttttgctatatgccaaaaaaaagaaagaaatcaatgaaatatataagaataaatctaatgtaaatactatgacaagattgacctccgtaacctatggtggttctacatcagcgttaactgacttatttggttaagcatgtgtgcaatggggtggttttaccaataaaactaagtaggatgggtatttacaataaaatgtcttatggagtggaatatcaaacttcaagagatttttggggtgatttttgtaatttcccctttttagtaagacaaatagttaaacataactgtgtatatgcataaaactcatgagcactaggatttaaaccctgctagatgaagccatgcgcccactactctatcaccgtgatgctactaacatacgaatctcaaaggaaaaaaaaagaacaactactccatgtaaccttagaaacacatgttatttttccataaattcttatgttatgtgcaacttgcaaggagttataagctctcgtagctaacaaaatcaatgtgcgacttctaggggcaaagctagagtatatgaaggcgtgccaaggaaccagtaaagaaaatttttagttataactcatctattttcaatgtaaacttagacgttttcattagcttaaactcgatccaaagtaaaaaaaaaattaacggaaatgctaaacttctgttgacagaaaatagaacctcaaatcttgtaaattttggatcactggatgtgcttcatgattcatgctcttcttctccaactctggcgtccacctcttcttctcctgcgccagcgaacccaaaatccggcagagggccgacgaattagggtcctgcggtggggtgggggtgggagggagggaggggagggggaagagggggagtcaccggctttagagggatggctgtgggaggcagcagcccgacggtgggcggcggatcgagcgggcggcgaggcagcggcggcggcgccgtagctgctgggtcgggagcgggcggcgggggcaaaacggaaagagtggtaggaggaggcggctggtggtggcgccccgccggcgacagggaagacaacagacagctcgccgctgccggcttgaggcaaaggagaggagagggagggggagggtgaaggggccggcccggaggcctcgccgacgccgttgacacctttcggccagccggcgaggccgggcggtggcgtgctcaggcggcggtggcggtggcggtggcggaggcggggcggaagcgctgaggagcggcggcgtgaggaatcgggagaggagagaggatttttatggtttggttgcctgcacgaatcttaaagcaatcgggtggtctaaaatttgcaagatttgtaagggggtttcctgtcaaatgatctatagacaatcccataaattaaacaagagatattttcattcattttgttctaattatgtccttagtgactttcaagagggattaagctcatctaacttacttttctctaacttgtgtcactgacatgtggaccatatatctattggactcacatattagtgcatcaaagtcaggggaacctcttccctctcgagagtcccctttcttctcgcggctcagttcttcagtttgttctttgagcttggtccctccccgaatcgatcaccggatttccacactttcccgtaaaaccgaaccccaatcgataaattcaaacaaactctcatcatcctagagctctactctagttttcctttttttttaaaaaaaaaatactacggagtagagctctacgccaccgtacactacggtctcctcctcatccccgaaacccaagctactatcctcttatcgccaactgacaatgacaagagggcccctagccccctactcctccgggcaccacatgtcagtgggcgtaacagaaaacaagtgttgacctcggggtgcgtggagtttttcccggagtcgtatcctttcgggtgacgcatacaagggcggttcggatcggacggctagtatatatccacctccgcctccgcgtccatggccaccgccgcatccacctccgccgccgccgtcgccgccgcatcgcgcctcctcgtccgccgcgcgccgccgcgcctgctgcgccggttaccccgcgcggcgctcgccgcctctcgcccgtcgccgccgtcgtcgtcgtcgtacggtgcagcagccgtcgccctcggccggcagccgctcggccaccgcgctaggatgggacacaccgccgccgccgccgccgccgcgggccccgcgctcgggctcaccaagcccaacgccgtcgagccgccgcaggtgcgtgttcgggatggggttcgggttcaatttcaggttcagtcgcttgcttggtgcttaggattgttgcagattcctgaactccccatctgtgtggtaaaatgaagctgctatatttggttgacttgatcacgactcgttatcgaatctctcgagctgctagatcgagatcgaactagtgatctcctacgcaaactacgtttgcatctttgtttagatttgccgatgttgcaagtgagctcagtctcaatctgtgcactactgtttttttttcaggtttcattggctgataaagacgtcgaattctccgaatggaagggagacatcctcgcaatcgcagtgacagagaatgatctggtcaaaggatcagactccaaattagagaatgcggtgttgaagaagctcgacggccagctcggcggcctcctgtcggaggcatcggcggaggaggatttcaccggcaaagccgggcaatcagtggtgctccgcctcccggggcagggtttcaagagggtgggtctgatcggccttgggcagaacgccccctccaccacaacggcttgcaagggcatcggcgaatccgtcgcgtcagttgccaagtctgctcaagctagcagcgcggctattgtttttgcttcagtgggtgggatccaggaagattttaagctgactgctgcggcagcaattgcttcaggtagtgtgatcttgatgctcctttcatggaattgttgtgatcttgtgggatgcattggcttgatgctgaattttatctgtatctggattgcaggaactgtgcttgggctgcacgaggacagcagatacaagtcggagtcgaagaaggtgcatcttaaacaagtagatcttatcggatttggttctggtccagaggttgaccagaaacttaagtatgccaatgatctctcctcgggtgtgatattcgggaaagaacttgtgaactcacctgcaaatgttcttactcctggtatatttcttttgttaaacgccaaacagtggatctcctccatagatgccattctgatgttttcttatttcactactcactcatctcctttatccagctgtgcttgccgaggagcatcaaacattgcttctacatacagtgatgtattcactgcgacaatattagatgtggagaaatgtaaagagttaaagatgggctcctacttgggagttgctgcagcttctgcgaatcctccccacttcatccacttgtgctacaaaccacctggtgggaatgccaagagaaagctggccattgttgggaagggtctaacttttgacaggtttgtgaaacatatgcatattttgtgaactattgcagtaacatacatcattgtgtaacataaatatgccatcttttatatggataattgttggttcttacaattgattaaccgatttttttgcagtggtggctacaacattaagactggaccaggctgcagtattgagctgatgaagtttgacatgggaggctctgcagcagtttttggtgcagcaaaagctttgggccaaatcaagccccctggagtagaggttcattttattgttgctgcttgtgaaaacatgattagtggcacaggcatgagacctggtgacattgtgactgcttctaacgggaagactattgaggtatgtttgttgtgatacaatgcgtatgattgtagaagactaggaatcatgattcattaacataaatcagtgatagtgtgaaaaaatgcgtttgcttatgtattcatctgtatttatttttcttcaggtaaataacactgatgcggagggaaggcttacacttgctgatgctttggtgtacgcttgtaatcaaggtgttgacaaggtaatgacttttatggtgtcatgttctgtccatatgattaccaatctgattttttttaatgctttgatgatttctctataaattaaaccttagtgcaagatattttattggcattgttggttttagttataatgctgatactcagctcatcaccctagcatagttgtatgctatttatttctaggccctttttatggaaatgtgatttatcttatggcctgatgtccctcacgaatctagtttgaggtactgacttatctttaaatgtcaaatgtagattattgatctggcaacacttactggtgcatgtgtcgttgcacttgggcctagcattgctggtaagattaaccaatcacatatcacttgcaatcttctccattaagtgaatagattagtgtgttcctttgattgctgcttgcttaaatgaatattttgtgcaggaattttcacgccaagtgatgaactagctaaggaagttgctgcggcatctgagatatcaggagagaagttctggagaatgccactcgaggaaagctactgggagtcgatgaagtctggtgttgctgacatggttaacaccggtggccggcagggtggttctattactgctgcactcttcctgaaacaggtaaatttaccactttattatgaatgaaattcaagcaaaacacacagccacatgctctaggtaggcacatttgaataaagttgtaagcagtgacatgctaatggagcctcatgcttgtatttgcagtttgtggatgagaaggtgcagtggatgcacattgacatggccgggccagtgtggaacgacaagaagcgggcggccaccggattcggcgtctccaccctggttgagtgggttctcaagaactcatcttaaatcatttattcccttgcattctcatccccctgaggatgagatgacacgaggatttcggaggagtttggtggtggcaaagcggccagctagggccaatgatatacaaaagtttagtgggcaatttagaataagaaaactggtcatcgtcgtttccttttcagttggggtgtcgaattgtttggtgaaatcatcatcatcatcatcatcacattcacaagatgttttggccaggacaagtctgttcgtgccgtgtagctctctcccttttctcttttgtcaaatgtggaataacgctcttccttttgatttgtgccccgggataatctgagtcataaatatttcgacaatagcctgaatcgtaacgtttccgctgtgctagtgactgaacaggggaactttctgactgagaaatcgcgatgcttctgtcgagagcacagccatttctgtgtgtgtattgctatgatgtgtctacgtcaggagtgtaaggtgaacacgtatctgatgcctacttgttcatgttggccactgcggatgccaccacacaagtgtgtgtatacaaatgcagaggcgaacgactgcacgtcactggaggataggatactttcccagcgaggcccaaattcatagaaattttcgaaagattttattcctatagaatatttttttaaagccctttctatcgaagaaatgaatcctatcaaatcttatgaaattcctatgaaaagttttggagaaaatttggcatgaggtagaatctcatgggaagttttctttgaatctttatctttctttttttttcctgcggtccaatcaaataatcatttatgtgtttttacgttttttttctatttctctgtttttcctataccccgttctcttaattgacaattttaacggtgcccgtaaaactaaactgtcattatatttgtagtatactatttacaatattatatattactaaaaaaatatccatgtgttgcaacgggtaattgctattttaattttatcattgttatacggtttagctagggtaaaattcactgtgggaactcgcttggatatttttttagaaaatcatgagcttcaattaagagtatgtatttcatctcaagttagcatgcaagtttttcaaaagatctcttatacaactccttttatacttccaaaaggaaacaagcttaaaattccaactcaaatacagatatgtatttaaaaaatgaaagaacttaattaaaaaccgactctaatatggatgacgtaccaaaataccataaaaacatcttcaatttttataatagtagagatatgatgcggtgtgtagtcatttgatggacaaagaagcttctagaatatactaaaataatttatttcaattaatcaaatcaattttctatatatctcaatcaaccacaaccttccaccatccggagccattgtttctcttattcgcggaataaacgaaacggcatatttggaaactaaaattaatttgtgaataaaacttttatatacatattcttagcaatctagaagcaaaggctgaaaactaaacttcgatgaaaaaacctcaaaaccagctccaaatttatggttgaaaattcaaaatttggctgataagcataagtataagcgaaaagatgaggctagaggatttcactattttttttttattttctgaagaatatctagacatgattacattttagaaggggggaagtatatggttactattgcagggtaagataaactttgactcccatgcaatgtcaaagtcctatctcctaaaatataataacttaatactggataggatcgaaagaaagacgtctactatgaatctggatatgacacaaagaaaaaaatcttgaaaatactagtatagaaaaattggagggagtacctttttttttctctttttcacgcggcctcatttgtatggagcccaatatactagtattcgtcggcggaaaattagttgggccgggccgggccggaatctttccttcctttcttgagctgcaagaagaagaggaggaggaggccggccattagaagcggaggacacgcgcacggcggtcgccccgcaaacaaaaactcgccgcggttttacagccaacgaaggcgcagcaaagcaaacgcggcggcgcagcgctcgccgtcgccggacttcctccccccccccgctccgattccgtccaggcaagtgcttccctctccctccctcctctctctctctctctcttcggtggaagcggcgcggctcggtgtacgctcgcgtcgcgcctcctcctttcccctcctcctagtcgcgccgtggatcgcgccgccgggatgggggttttgatctctatgcggtaagaccattcggtggccgattaggatccaaccatgcctaactgtgatgattccggtggttgtttcggttacctgtgcagatgcgaagattttgttacctttaggattcagtgaaggtgcttgtaatgttaaatccgtaaatgtagtagcattatggactatctatgatgaagggattaagaattttcttgctattagttttcatgaaaataatggatttttcccccacacattatgtggtttgattgtgctatttatcttaagcaaacagcaaaattagaccttttgttgattattactacgcatgtcatagtgcaatcttattagtacttgagttcagcaatactgttccggaacatcctttttttttaaaaaaaatgcagagcatctaaaagtggagtgtaaaataaggacaaactgatcttttttttaataaaaacacatgtgccgagagaagcacatctcttactagctctacaactagtgctcagattgttctgcacatcagtagcatagcaggcattaattagtgctgaaattttactcttgggatgtttaggctttccttgatcttctgtttcatagctttgaaatgtttcttaccgcagtgtttagttcagatagatagctatattttcttattccgaaaagaaaaataaagataggtagctagctatacttttggaccgggggagtaatagatttacaagactatcagttgattcatagagagattgattatttgatatgttccctttgcccttttgcctcctcatttcattgtgcagatactgagtgaaaacctgctgctaagatgggtagcacagaacacccaattcctgcgcagtcacctgcttgcccaactgtgagcgaaggggggtcggctgctccagctcctgctactgattcaaagccaaagaagaagatatgctgtgcgtgccctgatacgaagaggctgagagacgagtgcatcgtcgagcatggggaatctgcgtgcaccaagtggatcgaagctcacaagcggtgcctccgagctgagggttttaatgtctgaattttctctagtcatctaaaggtattacatttacttttatagaagaagtgatagaatatccggtttgagacttgagatgcaaattggatccaagagattagctgccctgtttttgcatgttatcgaagtgatagaatatccggtttgtgaattgagatgcaaattgaatccagagattagctgccctgtttttgcatgttatccctgtatgtcagggaacttattttcatgataaataaaggtacttccgttactggtgacactatacatggctatattcagcaaattacttcatggctcccttttgcgttgaattgcgtacatgatatattctttttcgatgagataattgctcagggttccttcagagcacaggaattttataggattttcacaggaaatagttcagttcctctaaaattccagcgaaattcctccaatccaaatggaaccttagtggtaaacagagcggaaggcttcaagtttattagctccttgttgcgatgcccatggtttccatggcacaaccatccttattctcttattatccttttcccaacaccaatcaatcacactcctcacctatcaactacactgcacctctaccaagcatcttttacagatttctagactttgtagctagacatcagttgttggcaggaaaccatcaggattttggcaatggctcccctgccaagaacgactgaaacatcctgaatgctctccttggctgaaacagtggcacctcatgcccagcacctctcactgacgcaaatgtgagcccttcatacacctcagaccatcctccaacctgcacacacagatgcaccatttgcagatgaagttacagactttaaagtgacaagatttctgcttaaactgcatctgacaaacagcaatggagattgttcactacctgtccagctgagtaccaagggtaccagcggatcttcgtcttcagtccaagatggctaagcgcaaacctcgttgcagtaaccggaacgactgaatccgtgtcgccactgcattttcatcaagtgacaaatagctcatgatctctgaagaactagttccatgctgaaccaaaaggataaattcaccaattccaggtcctccagctcacctgaacacccatatcctcagcccggccttcatcagcaacttgtaagtcggcagcatggagaactctgaatctcgccacgtcttgatgagcacatcactgtcaaatccaacccaaatgcattgttaaactctcccaattccaacctcagtgatgccaagaaatatcaagaaaaaaaaatgtcagctgatgcatcaacctgcaggctgtccatctgtaaggaatcccagtgatgttggcatgcatggccttctgaacatccggccggttgtagtacttctcggcgtatgtctccgtgcaggggtcgtagccgaacgaccggcgccgtaggaaggtgtccttgaacctcagcacggcggccttgccgcggcggcggccggtggcgttggcggcggcggcggcggcgcaggacggcgtgtagatgctgtactggtcgatgtcgccgaactcgtggttcatggcgtagctcatggcgcggttgcagagcctggagacgttggcgctggtgaagttgcacgacgacatgatggccttgtaggtggtgtccgagatcatggcgtgcgtccaccagtaggtcaccgtgccgatgttgtcgtagtagttgtcagtcaccccattgcccacctggtaaaatcaggatcaccatcactcacacggttaatttcagtctgaaactcgtgttctgatatactagaacatatggattggttttgtttgagttcacttggttattttcagcctgaaactctgtgtgagagatcatagaacatatgggttaagttttgagttcagggtctgcttgtgtttgatggtacttacaaggatcatcgcatggttgtttttagtctgaaactcttgccagaggtgcaatctatggttacagttttcagttgagaatttgttcgtgcttgatttaaaggactgtctactttagtttaataatactcacaaggatccccttgaggttgatgaaaggatatggtgaggccttgttgaactcaacgatcttccttgccaactggggaacgtaatgtcctagaatttgtgcaaattttgttgatggacagtagtcagatgatgcagagataatagtttcagagatggtgatgcaaacatcgccagtttacacattaccagcatagctttctccagcaatgtagaaatcccggtgccgatactgtgggaagcgggacatccaactgatcaagaactgcaacgcatcttgagctgcatcacatcacatcacattcagaagaacatcaagggaacattcagcagtttgccattttatgatgcagtgttaagacagatttggtcagtaaatttcagattacatacctgtcctctcatcaccagatgtcttgagatcagaggtggtgttggagtatgaaaagccaactccggcaggtgattccaggaacaggaggtttgcctctgcagtaacaaagtgttcatcagtcagtgacaggcattgcatcattaggcatgatgagtttctgagcttagtcttagtacctctgttccatgagtacttgttcagatagagccctgtcccgtttgtcttaatcctaaatgggccaatctcttcagatgctccatacgcaatcgatgagcatccaggacctgggaaattatcagcaaatattactggagttaaataaggatgtttctacagctacagtaactttaaaagataattagcaatccaatccaaagtgattagaacatcagactatcagagagatactagtagtaaaacagtaagcactactgctatcttcatgttacagttgctatttacatgacatgcagctccaatgagcatggatatacttgagaagctccaaatctcccaaaacaagcaagtcctaaggaaaaagaggagatagatctgataatccaatcaagaggtccatccttctcgcagaggcgtgctctgcaactccagaaccccattcccaatgaataactagtcaaagagaacaagccatggtgccagaggaacccactgcccttgcatctctctctctctctctctctctctctctctctctctcatctgaacttttattttatcttctctactccaaatcctttgtttatgtacaagaatgaagtccaaaggcaagaaaaggcatctgcaattctgcacgcaagcacaacttcacaagcaattcaagcagctgtggttgtttcgatctcgcaatgacaaatcgacaatgcagaggtcgtcggccattcagccacgctgcagcaaatgtgagttgttgtggggtaaaaggttactgtttggtttgtaccttgtggctttatccagagggaaggaagcagtggtctctgcatgtgtgtgatgatgaccagagagatgaggagcaaatggaataataataattgatcataataaggccgagtgagttgcaaacagggagaaaataacaaaatcaaagatgactagtagtagcctttgtagtttttcttagcttcagctttttatttggctttttctcccttctcttggcataagccgatctagctgattgcattgtgtaactataactcttttcttctaatatactgacgtgcaatctttttgcgcgtttggaaaaaaaactagtatagtagccttaaattggtgctgcagcttttgtgccactcattcactagcaaacatggtgtggtagtatggatccgcagagtgcagagtactactacagtgcagacagaggcttcatcatttcttggcccctcttggcttggcttggctacacattttacagtgcttggctacagattttattacagtgtttggcttggctacagatttactactaatacttcacatgagatgatgtgggatgtggctaagattgcgccgatctccaaggacgacgggatcattcatcagagcgcgccattccagctgcagctgcagcagatgctcgcggccggccggccggccttcagaagaattctgaatcagcagcagatgagctctgcatcatcgcggcgcggggcgaggtgtgagagctgtcgccttgccgctgtacgctgctcgattcacaggctcacagtctcaggtgtgtgtgtgtgcagcggcagctagcgctgattgcagatgttcagagactgttctttcctcctaggaatgagagatggagagagataacaggagtactcctatgctgtaaagcttggaatcgatttttgaattagagtggattaatgcaggctaagcaaggctggattagtggttagcaatgaagtgattagaagggcctaagctgaacagttttctagtatctccttagactccttacactgaataatcatgccatggcaacatggctggctgtaaagattaaagaatgaccagaactacacagctcagtgtaaaagggaaaaaaaaacagtacaccgtgcaggacaagagaagagatttggtggccaaggaataaatgtcaaaagtccaaaagccaggattacaattcgtcagcttgaacaaggaacaaacacacatgacaacatatgcctctctcacacagttgtagtcaactagtggctggctgatgataatatcccacagatcaagctcataaccacacttaccaggaataaactgcaaatgatccggcataagactcgacagttttgggcaagtatacaggttcagagtttcagtcagtgtgtttacttatgcttaattgcccctatgtaggagtactagcgagggcttgtttatccttacctatggagaaaagaaccatgcatgagtttcgaagcattgttcttgtctggctctctctctctcacacacactcaagtctcacacataaatacatgtaattctatttatgctgtgtttaaattcagggtaaaattttttgccgtatcacatcgcatatacgaacacacatttaaaatattaaacgtagtctaataacaaaataaattatagaatcggtcagtaaaccacgagacgattttattaagcctaattaatctgttattagtaaatatttactgtagcatcacattgtctaatcatggagcaattaggcttaaaagattcgtctcacaaattagtcgcgatttatacaattaattatttttttgcctatatttaatacttcgtgtgcaggtgttcgaacgctaaatgtgatagggtgaaaaattttgatatgggatctaaacagtaccttacacaatgtgacaaggaaaaacgcaaagggtttagaggttgcatgtcgtgttgcccggaccagtgcacggctgctgctgccgcctgcacggcgccggctgcccgcggtctcccctgcatttactctctacttcctcgtgatgctaatgtttgttcagccaggcattggtcatgtcttttgcacacacacatttactctcctgtattctctgcatttactatcactgtgccatcgctgtgctctgccttcaaaacagctagctatagtaacactaccaattgctcgatcaaaacactcgtgtgtccattagaggatcgaacacacacacacacacacacgcacaatgtcctttacaaagacaacaagatctcctatcagagctactagctaagctagcaggaagaaa

SEQ ID NO: 44925 - DNA, 9098 bp, Oryza sativa
cttgaaggtagtgccattgatgaagcactggtctttggcatcttaaccttagtaggtgacaacagcaccgatggaggccttgttcgtgaaggagctacttctattgtttgtattttggatggaacttcagctgaggttgaatgtaggggatcttgttgaagttcagtgcaaccaaccataacatagtcatctgttaacttcaaaacaagcgaagacgagctttcaccagagagactatcaaagtcaagttcttctttagtatcgaagaaagtctcggacccatcagcaggagattcatctatatttccttgagaagtggatgatgcttttcgttgaggtatgtgaagcgaagtatccttcttcccatccaaccagtctaaatggttgaatatatcaagcaccttagcaaactcttcaataccaagtccttgtttctcttgatgactaaccggctctgttgtgatgtgtgaagtagttgcatccatatcagagaaaataacctaacataatagaaggtgtatttaaaaatccatgtataaacagaaatatgctagtttgccacttggtataaaacacttgcctcagctcgaaaatctttagggaattggtcttgtgtgttccataaaatgtctatttggtcacgattaagcatcaatatgtttgacctgatgaaacctgtattgaacatgatccggaataccatgtcctcacgatccagatcctcatacagattgatacattctaggacaacatccccttggacatgacattgaaggtttattttcaccagttcatctgcctaagatcataaatggttagttcaatttcatgaaggttagaccagaaattgtacaaacttcaaatataatcaacatagaaccctattaatgatacagcgaagtagttttagctatacgaatgctgcaacgtacgtcacaacgcgtccacttcaaaacaaccacaatgcaagaccagggaaaagacaaggcaattacctgtgaatagaaacggacaacgttgcttctctttggagtcgaaaaaagaactttaggagtctgatcagtaggcataagcggatctgggccatatatcctgaatattggacggaaaccaccttgaccatgaaaatctggaaccatcctcaaaatcacagaatctaacgtcagggctctatcagctggaggccactcaggcacgacattcctcatcgaaacatagcgcaagtatctcaattgcgacggcatgggattcagaggtgaaaacatctccaagagctctactggcgattgcttgtaaagcatatccagtgttttctgctcatcagaatactgtcccaggtatatcaggagagcagctaacatgaaagccagaataggccagcatccttgttcacagtgcattatcagaaagttacgctgacccaaagagagccagctttcgctcgacttcaagatgcagtggaccatttccatggtgagaagtggacacccctcatagtggccagggtagtccaggacggtcataccatactcagataaaatgtgatatatggggctttcttcatctcgaatgccgaaattcgagatcatgaatgaatgatcaccaaaattatctagaagatgtgctgcaacacctcttatgtgggcttcaaaatggtcttcttccatctctttcatggagaagcaatgatcaaaaactgaaatagataaaagctacatgtgtcaagcatcctcaggacctcggctctattttgagttcttttatcttcacacagttaactaatgaacagataacgaaagtatgaaacagttcttttggaatataacacaactttttagggagaatataacataactgaaacgattaaccattcaaattgcaataaacagacaaaaacacaaatcttccaccactacattacgtataactctcatggccctaaaagtctctaatccatattgtgatacactatactaccaacacttcagaagtgccaaatcttaattcaactatgcttaaattagcagcctatccatatcaatcaagctgaaaccttttcaaaagagaagctaggttggatgaatctgtccatggtaaacttggcaagcaacataagtcatggcagtgcaaaaggaaatacttccattaccgtatatgttgtccgtgattagaagcaacccatcgggcggtttcttgaagaagaacttccggaacagcgccatggcgcaaccaaatcaagagctccaatctgcgaaccaatcagcgggaaatccaagaactcccgacccgtagcgacggatttgggtcaccaacttgcaatccaccccaagaagacgctttttttgagaactccactttagaaaatgctccgcctttgaggattcgggcagctagttgcagcattagaatataaatatcgcggaaggaaacaaaaaaaaaaaagaaacgctcgaaagctccgagcaatcttgttgcggtgagctcctaattagattagggccttggaatcgaagcgcacggagaaaaggtggtcgcttttgttgattctaggtggcgatatgggaaatggcgacaggaggaggaggaagaggagaagaaactcaaggaagcaggaagacgaagcattgggcgtttgactaaatttaattatttttaggcgcagctgttaatctgctctttactctacccctttcttctaagaatttattattattatttctcccatttttttatttggcttgtcaatgaaaaaaattgtgcttggtttcaaaataagtattttaggtcaacttcatggaaaacctacccaacctgacaatctttactgatggtcaatgtgcttgtccaaaaaatcttgaactttttttttaaaaaaaaagcaaatataatggtgcagtaaattacattttaggaaggttttgcatgataaatctgcttactgtttgttttaattgtaacattagttattagaaaaaaaaagtcagtttcatcctcctggggagagcaagctaagcatccgttgctttcgcaattgttccctttcagatttcgtttttggcttttttgtgctggctgctgggttctctaatttcttttttaagggttctctaatttctacgccaattaacgtgactaggatgattttgttaacagaaaaggaagatgattagagagtgagtcacggtgatttgggggatccgggtgggggcggcggttggtagttagcatctgccgccaatttcagaacaagccacatgctcttcagtccttcaccctgagcttgtactagtaatcctgtaaaaaccaaattcacctgaaggtttcaaccgagctgcaagagattagatttaaaaaaagagagagctttacagaatctttgtatctcctagcaaaagaaaaaagaaaatctctgatcctaaactctgcagtgagatagttttcatgtgctggatcttgatcttgactcatattaggaagcattgacactttgacagtaatctttatcaaggcagctgggagctggagcttaagatggccggtggccggtgtatgacagcaacaatgatcatgagacttgagagtagttattagtattaactaattgtagcctgcttcagtaagcttgtgctgcgcccaaaggggttggaagcacgtcacctgtctgcaatctgcaatggatttcttttttcctttggcatcttctcaagcttcctactactactccgtactagcacaggaaaaaagcatatatgtaatttgtttctttgtggttgctgattgctacctgcatcagagttgtttggtttcccgtggccagcagtcaccgacaagtcgacggcgagtcgccggcgtccaccatcaaaagggacatgcatgcagtgatgcaagaatgcatcgaagattcagaaattcaggatcagattgtttcttttcttcagactagtcacctacggtttactattgctcccagctagtatgaccgattaaaccgtgactacagagcaagcaagaataattctgtaggtaatattttacgtatgtatcatttgtggtttaaaagcctatatgaaaaaaatagaaaataataaaaatcttcaaaatcacctttaaatttaaattttggctaacgagagcggatgaaaaactcttcaagaactgcatcgtttcgccaaatactaataatacacaataatagtaatttataagtaaattttttatatatgtgttgttagcgattcaaatgtcattgttggaaaataaacttcgattaaaaaatcaactttaaaattagattttaaaaattaatttttggcattagctgatgcgaggagacgattacgactgcagaatcgctcaccttcttcttcttcttcttcatgggcagcgcgtacaaaatcggagctgattgcctgactatctctgtctccaccgagaacgacaaggtcgcgctccaatccagcgttgccaacatgggttgatgcgtcaggttggacgaatccccaaccccaacccatctggacactagactattttgtctccctctcaaccgtcgctttctccggcgacactccggccgccgccgcggcggcgctgcggttgagctccggccgccatcgtggggggagagcttccaaaaccgaaaccaatccaacggcccatatcagtccataacccaatccgttcaatcccagccgtccatccgtacaagccacgtcggttataaaccccaccacctcccactctcacctcttcgcctctctctctctctctcgcccaccaaatgccgaggcgaaaaatcacactatccaatcccaaaatcgatcgaagccgcaggttttaatccgagaaattgccccgaaaatccggtgatcctccgatccgtgcgagcgcgaaaaccctatgatgggggaggcggaggaggggctgatgcacaggaggattgagttccacgcggcgaggaggccgccgcgtgcggtggagggggcgggagggaggttttgggtggagatcctgagcccggatgccgataaggcggcggtggtggcggcggcgaggagcgaggggctggtcagggggttggagaagggggagggtagcgggggtgggatcgacccggagcttcgcgtcgcgaggatgtacttgcggagaattgtgagtgtgtaagcctgcaatttttcgtttcacattttgttgaatctaggtagcatagtatatacatgtagggtaggtggttttagttgttgcagttcagattattagaggggttttggtttacgaatagaatcagtaattataagatacattttatgaattttccttcagaaatgctggtttgttgttctgtaatgaaaaaaatatattcacgtttaactgtattatgttttgtttagaatacattttggaatagttatgcgcaaaaatttgcatccgcgtattgaaggtcctttttactggagtaatctgctcattcacctgaaacacgaggctttgcaagtgaatacttcactaaagatgccctattgccctatctatgtaaaacagggagctggcttgcaaaattttggcaatacctgctacctcaactcggttctgcaatgcttgacgtataccgagccgttcgtggcctacttgcagagtggggagcacatgtcctcatgtaagttcattgcgtctggtcgcgatcagcaattcagatactctgcatgatatgatgatgttgtcaatgaaagtcgagagtagtgaaccatcctttgttgctgtctgtgagcactctgcattttcttatcggatgttctatggtggtggttatcaaatatatttcctctctctataatcagtctcgaggcatctagagctagagctgcttcttatctatttggattgaacgaaacagatataaattttagtttacatgccttgaccaatgtactatgtctcatcacctgttctggagcaacctctgttttttgcggctgtatcatttctccagagaacaatataataacattttctgttttcttggcaagccctgtttctgtagttacttataatatcactttattattttttaaggtcggactatcggattctgtgctttatgtgctcttcaaagacatgtaaattctgctctacagtcaactgggaagatattgagacctgtgcacattgtcagaaatttaagatgtatcctttcatatgctattgcaaaataattgatccactttattttgaaataccgtatctatctataattttattcaacccttgtgcaatctttaactgcaaggtaggcatttctcgtagtttccgcatctcaaggcaggaagacgcacatgagctaatggttagcttgcttgagtccatgcacaaatgttgtttaccttctggtgtaccaagtgggtcgccaagtgcttatgagaagagcctagttcacagaatatttggtggtctcttaagaagtcaggtaaattgccaaatgcttaattaacttattactagtataatagcaagtaaaactttacccatatggccactggctgactatatctatatgcatgacaggtgagatgcacaacttgctcacactgttccaacaaatttgatcctttcctggatctcagccttgaaattgccaatgctgctactctggtaaaagcacttcaacactttactgcggaagagctactggatggtggggaaaagcagtacaactgcgagcactgcaggcagaaagtagtagccaagaagaggtttatgattgagaaggctccctctgtgttgacaattcatctaaagcgctttagtcctttcaaccctcgtcacaagatcgacaaaaaagtgcagtttcaaccaactttaaatttaaagccatatgtcagcaatcctgaggtatgtaatttttaatggtgttcttttttttttaacataagtttggacatgtttttaataagattctctttcatgctcatagtccttagtttatgtgtgtagggtatggagttcaaatacagcctttatggtgttttggttcatgctggttggaatacacagtcaggtcactattattgctttgttcggacttctagtggcatatggcacaatcttgatgataacaaggttattcttttttatgttgtgatgaatttattcttactgtttatcattgacacaacccttttttacattaatgcaagtcacatccttgtattgtgccatattgcttttttaaagttactcttttttttcttttgcctccatcaaccatgtcttgtcctgtgtaataacaaataccagccaaaatacaccatgttatatccaaaaacattcaatggtgaagtcgaccaactctatagtctatacttatgtccctcactctctgctcacaagagttcaccttgtaatatgtcttcttaaaatagtactagtactttatgaatgctagagaacttgttttgtcaggcaccttcttcgtgcactatattatgtagtggtctacagtcaacttaagggaggatatggggaatgtgttcactttgagggatggagggtaatccttttctttggcctgtttatgtgttcattttctgttggtgggattggtacaccaagttgtagttgagctgatcttatgttaattcagtactttctcatctgcactcctggcattctttattcagtttcttcctctctttttttttattttgaagtttgttttgttgatatacattaatacacccaggtttaccaagttcgtgaggcagatgtgctgaggcagaaagcatacatgctattttatgtgcgcgacagaacaaggagctcagtgatgtacagtgataattgtactgttaatttatcagtaaataaaatgatctccgagaagatcacatgtatgaatggttcaattaaaaaagatacagtggaaacgaaaacactgagagttccctcacttgtcaaagaagatgtgaacttgaagaaacagaactcagaaaatggtcaatctagcaatattagcaatgctccacaggaccagtgttcaaaaagtcatagcaacactgaagtgcttgaagctgcagcatccccaaacaatgacccagcttcaacacagaaagcttcttgcatacgtccagatacagctgctgttaacttgcccatgaaaacagagcaaacagctccagacaatcgaagggaaataacatctccagcacaagctgatgtttctgttcttcacaatgcaagtttcaatcagaagttgtatgagaagcagctacaggagcatcaactagaaactgatgatgcacttactgattccaggaaagatgcccctgctgccttgtgcacatatggtgttggggatggtttgttggggagaaatggccagtcttctgaacctcacataggtccatgccctgctgctcttcctatacacaatggtggtgaaggattgctgggggcaaatggccaggcatctgaagctcactcaggtccttgctcttctgcctttcctatacataatggtggcgaaggattgttgggggcaagtggccagtcttctgaacctcacacaggtccatgccctgctgctcttcctatacacgatggtggtcaaggattattggggccaaatggccaggcttctgaacctcacacagattcttgccctgctgcctttcctatacacagtggcggtgaaggactgttgggggcaaatggtcaggcttctgaacttcacacagatccttgccctgctgcctttcctatacacagtggcggtgaaggattgttgggggcaaatggtcaggcttctgaacctcacacagatccttgccctgctgcctttcctatacacagtgccggtgaaggattgttgggggcaaatggccaggattctgaacatcgaacaggtccaatccctgctgcctttcctgtatggaatggcactggtgtaatattggagaaatatggtcaggtttctgggccagcagatccattttgcaagccaactcctaccataagtgatacagtgtctattgcacaaatcatcccaactgaggtaactgtatgatgtttcctattgatctctctctctttttaatttttaa

SEQ ID NO: 44926 - DNA, 3891 bp, Oryza sativa
  unsure (1)..(3891): unsure at all n locations
tgtaagtttatttgttaaaaagtactttacagacttcaatgcagaataacacactggaagttggtaaggatgttgcaaaggacactgataatgtggcaaatgccgaggagcaggtattgaaccaccccttggccgagcaggtaaaatctgagaagcaaatatatcctggaatttctacaacattgatttgctctgaagacacaacacagttgatagataaggatacaggcagtggcaaattaaataaaaagatgaattgcaagtcaaagaggcaagtgaagtatcctgctgttcgcatgttttttgggcccaaacaactgttactggcatcagtaaaactgcacaagaaaaggaaacacaagagatccaaaaaacaccatgcactttctgtgcacattgaaagcatcatcactgatcagcagacatcaacatcagaaactgttttctcaaagatcatatcacataaatcccgtggacagaaacgttcttgtgccagtgcaagttctgaggatggcactcagctgttcaacaagaaacagcatatcgaaggaaccaccaacagtgttcccatggacaacaacgatacaaaacttgctagcgctgacagcaacgatgcaaaacttgctagcgccgagctaccaagctcatgtacaaactctctggtgaaccagactgattcaagaaacaatgtaaatgcaaatgagagaggcccctggcattttaatctcctcacaaggggtttaagagaaattactggttaacatctcttcgcaagaaatttctcattttccatcctgctgtcaacactagaaatttataactcattgttttgtttttgcagtgccacgttgggatgacactgagattaaaaatacgaaggaaacagagatactacatccaaggactagaagcatcggctatgtgctagatgaatggtaagcctgttaactgcagttaaatttctttctgatggtgatgttggatgtctcaattctcttgatgctgaaattcggaaaatcctccacccataccaaatctttgctaaacttctgagtaatatacgaacaactggcaggaacataacactggttcctaggtccgacttgaactaattttagaatcctactagaatatgcaaccagcagcagattcttctttgctgtgactaagatctgagatgaatataaagccctcttctttttttgtatatatctcgggtttcctcttgcctgtttgttatccttgaaactgtcttattcggaagataaacatgatccttaacaagatgcacctaatcgttgtgtcagggacgaggagtatgatcgcggcaagagaaagaagatcaggaaaccaaagcatggcttcagtgggccgaaccctttccaggagacggccaacatcagatcacggcagaggatgagactacagtctgaccagaccaaatctgggaaccagcctctcaggatataattgatatactggagcagcaacctgttgttgtatccttcagttttggaacagtaactacttctctagtagaactattatcctccccatgttttttttttcagttatgtgtagtgtcatcagagagtaagatttaggcctcatggctcagtcatttgtctgattgattagccgaggaacgaagcggactcttgtttgttgtcccatttctgtcgagcttatcatgccaatttttttttacgtcaatgcattcacacgtgttattcatcccggtccattcgcacaataaccgagcaattaaaagtcgtgatttctgatctgtgacttgtattctgcatcaacaaaattcagtaaaaactgcaaactttgccaaaccggtctgtgtagccattgtgaggctcagtaagcacgccatcacgaccgtcagatcgtgagcgaacggtgttgattgccaatttccggacttcccctgaaaacgcgggactcgcacccaaaatgcccaatattacgtacgtgtaatagttagcccgaaaatgattggaagaataatttgcgatccaatttattgcggtgaagagggtgaggcgcaccgagttaaggtggctcacgcgttcgctgtgatgacggttttactggcgcgaccgaccggaccggacccaacgcgcgcacccaactaccaacgccccccccccgggggggccccccgggaaaatttnctttcttgcaggcaatccattatccatgcgaggctgcatctaccgcatcagtttggtcatcgatcttcagaaagatgtacaagtctgattcaatgcatatcaaaccagcaaagttaaaataagcttgacattcagaattccagatatacatactccaaatatctgaatgccgcatgcatctattgttaacctatgctagctgcaaattaagggtctatttagatcccctgctaaaattttataccccgtcacatcgaatatatagtattaaatataaacgaaaaaaataactaattatacagattgcgtgtaaattgtgagacgaatcttttaaacctaattgcgctatgatttgataatgtggtgctacagtaaacatttgctaatgacggattaattaggcttaataaatttgtctcgcggtttatatgcggattctgtaatttgttttgttattagactacgtttaatactttaaatgtgtatccgtatatccgatgtgacacgtcaaaactttacacccctaatctaaacacagcctaaaccaaaatgcagcacataaagcagtgatattcatatgaactgatcgagccaacggaattggaaattcgacgagaacttcattcacgatgacgaggaggttagctgggggttgtaaatgagacgaggtgcaccgtgcacgcgcttaacgagttaatggaaacctaccatccaaacccaaatgaaacgaatcacgaaactgggccacaaaatttctccaaattttgaattccagaggcgaccagtccggctcgaaatccccgccttataaattacgcacgccgacacgatacgcccccatcgaattcaggcgcaaaaacctccaaaacctttgcaatattcctcgtaaatcgtaattccccctcgcgatcgagctcgcgacgcccatggcgatggagagaaacgcggcgccgcgcgtctcggcctcgtcgtcggcggcggcgtcgccctccaccgtcggtgcgctcctctcgaaggcctcggtggctgccgctcccgcacgcgagatcccctcgccgcggtcgctgctgtcgcgcatcctccataggagtggcggcggcggcggcttcgggtgtcgccttcgcctcccccgatactgctccagcggcgcggccgccaaggaggacgccgccgccgagtacgtggaggttgaggttgaggcggaggctgcggcgccgaaggtggtgggccgccaagcggttgatcgcgagtcgcctcggagctcgctcggtacgtgtccatggcgagagcgagtgatcggatggcgtggtctggttcgattgatttggttgtccgtcgtgtgcagggaagaaggcggcggaggaggtgtcgccggcgagcctggggctgggcgcgagcctcatgctgctgctctccaagagcgcggcggagctgaacaggatggcggagctccgcgcccagatggagcggctggtgctcgacaccaagggggaggaggaggcgcggagcagcaaccaccccaacgcgtccgacgatcacgccgacatcaccaaggaggagcccaccgccttctccggcggcgcattatcccgctgctcacgcacggccgccgccccgggaaacgcagggcaccacgccgccgttccaatggaccagatggaagcggagctcgaggcggagctgacgctcctgcaatgcgcgactcctc

SEQ ID NO: 44927 - DNA, 8385 bp, Oryza sativa
aagtagttcatcaaggaggaggagagcggggcggcggcgcagggcggcgtgtcggcgagggagctggagaggaggctgcacgagctgctccagtggcggcacgaggagcggatcgcggagctggagacggcgctggagcgcgccaggaagaggctgcaggagaaggagcgcgaggtttgctggtggcgcaacaccgccaagctcgtcacccgccacaaggacgactcccgcctcagatagcaagaattaatccgccatgagatgagatcaaacaagaacaagatcaagatcgatcatctcgcctcgcagtgatccgttttgtactctggtgatcatgctgcaactagactagaagaacaaattccaaccagaaaacattgattgcataaactaactgggatcacagattcacaggattcggttgctgcagcctatcaacatttggagcagatggtaaggtgttttttacctatctagtctacggattgattccaagatgattgtgtttcggcctttcattcgacctccaaacgtgactaaattaagatgcatggaatgacgcacaatctcttactaatttatactgttcggttcggttcggttcaatcaccatcgccgcgcgtaaatcgaattattcctactctacctgggccagcaaatcaggcctctcttggctcatcactttgatatatcatatcacaaaattcaataaaataaaataaaatgaattgaactacaccaccatcggctatgcaaaacctgcagaccatgcaacgtttccaaaattatgtggctaaattcctgtagaaacataataaactagctgtattctgcacaagtcaaatttgcatcagttgcggactttgccaagcaagacttgcttgccttcttgtcaaagatccgtctctcacaaggtaagagcaaagaaacctgatttctttttgacttttgagattcctcatccagattatctcaattgccgctagaatatgcaaaacaacttaatttgatagggcgatacaaaacatctgtgctgttcttttcttatattatatcatcaataaatatacagtgggataacattcacataacacggcagaggcaacaaggaaccagtacttccgagaagtttcgtctccgtggtgcctcagggcttaagaggtggccatcttgactcaaagaggtctccgcccgtggcagacacaagaaacatatacaacttgaaagtatttattctgtgtcgcagcaaacctcaaatacacaccagttaccattcattctggagcaactcccttccatatgcatcacagagactactggagctgatcctcgttatggatagtacatatatcctgtgagtgtgctcttcaaagaaccgtgcatatcacttgtcatccagttgtttttgtagaaagtcgagaaccgagagacgctgcaaaagtagcacagtacatgataaaagtcagtcaagagcaccacaaataggagcgcatggatgaaaggcagtacacaaggataagtagtagctacccgctgctcaagactggcctctccagattccagcttcaaattctcaaggcatttaattgcttcctcaaaaccctcaactgccatgctttcgttcccaagatttctatcgacatccgcaactttggcaagagaagttgctacatcaatgacctatatccaaaagtagacagatcatgaaatagcggcagctaaaggaaaaacactcaagaatatgtctgttccatgtagcagctaaatcctaccacaatcttacaaaatgatttgtgatcttctgttggttcatctcctgacattaaatttagataagataaagggcttgtttggtctgcaaccaatttgtgctgtacaaatttctgtaaagttgctcatttgatttgttgccaatattttttttgtgtacgcgctttaattggttttcgttaccaaaattttgtcagtgccaattttttggccacagaccaagtaatgaaataaagccatcatctcaatggtattgacaattttattggcatggttgaattgggaacaagcataaatataggttaaaagatctgttagccatcatttatggcaaattgccaaacttcctagtatggtctggcacttgctaccagacttcagacaacaatttgcttcagagaaaggaatacaaaaattctgtgtaggaacccctttttttacatccatttttttctgcctactatgtattatgtgcaatgtccatcagtaccaggaccatgaattatgggataaaatagctactggtccatgtgtaattggagcactcattgatatggtatctaatacacatttaaacacttaacatttctaattatgtctggataataaaaatctaagataaggaagaacttttgatcaatatctgttgatatcattttcatggacatatggtactctactagtgtaatgatatagaagagctagcacaaaagagcagggacaaaagagagtgatgaataaggttccttctgtttctaagatgataacagcagcccattttgtatttatagctaatcttaatcagtaatacagtaatcacctgggaagccacagctgagtgttcttttactgcacttctgcgaacgtccaacgaacgcgcataatagcttcttgctgagtggaggtccccatcataatagcaaagatctccaattttatttagtgaaactgagagagtatggaccaactgtagatgaatgcaaaagttaaattaacatgagaacttactatcatgctattatgatcatattaacaacaaaacacaacctccagatcctttttgggcaatttcgagaggaattcagcactttcttcatagtaagtgattgctgaaggagcatctcccaaggtccgactgtggcatggaatgaggtcaattatgaacaaacaaagaaaaaataagttaaatactgccatgattatgtgtcacaaatataatgaaaaataatagagcacaatgaaattcatggaaaaagttcagccagatattataacagagggatgaaaacaaaacaccctccagtgacatggaaacacaatgagttcagcaacaacttatgacagaccctaaggcttttatatgagaaggtaccagacatcctgactagaactaggctcttggtagctggtagttggctattacacaagctatcagcttgctattggcatcagtatgctggctggtgtagggcatggttaaaggtttcccacgttttccgagctgtgaatatactattcagacaaattgcgaccagtcataattggcatcactatcagcccacaacctgctagacaacctctgtggtctgtgcatcagtattgtagaacacactgaggcacataacagtttaatattttaatggataacaaacgttattacaacaagattctcctttcccttgtttggaaggcaagttctatgcctggtcgaaacatagaaaattcaggtattagaacacatgaaagataactaggttctgaatgagcagaaagatgaacgggccaaggctagaatgggcccttgtgcacaacagatacaaatcattgagcattgagcatctctcttcttttgaggaaagctacagacatttcaaagttaagaactgttctctcaattagaaggaaaaaaaacatgcaagaatttagctcaatactcccttcgtttttaaatgactgatagcaggcacgattcacttttgaactttgaccactcgtctttttgttatatatttacaaacacaagaaatgatgccatgttattaaagtgtgttatgtcctaaatattaagaatcaaacttttgttccattaggtctaacaacttaagagcaaataatggtcaaagtttaaatgggaaagtcaaacgtgtcaattatttagacacggagggagtaggcaataaacgtatcaatagcaggttcacatatcctcaagtccccaagagaaaattgccgtaccagcagtccccaagcattcctaacacagctccaagttgagaacacagttcttggttgtcttctttagatttcaactcttccctgatgtcttctgcacacatactgagccttgactttgcactttcaatgttctgtgcgcgaaaagcctggatatgtaaaagtcagaggtattgttaaaatatatagagcattaataaattaatacagaccagaggatgaaggatatatgcaaatttcaaaggtaaaagaagctcagagtaagaagcttatgggagttgatttggtaactgaccctcatcgcttgctggaccagaaaagctcctctctccatggagacatgctcgtaaatgaccttggtcttgtcacttgcggcttcaccatcgcctgcagcatgtgatctcttgattcgggcatggccatcaatgaagcggtcgacaaggccttgaagctcatcatcaggctcgatcccttggatgtcagcaccacacaatggacagtccttaaagcgcaatatgcatgccctgagaaggaaatccagtgttttggagaaagacaaggagatcaagtgagaaggtacatatattgacagaacgaattagaaagctattgaaatatgatacgcacttgcagaacttgtgcgagcacggggtgcatttgctgctttgatgtagcagagcgtggcagaccacgcagctgagtgggccaagcttgaaggtgttgttggagtcatagccaaaggggcactttgctggcaccacacgaggatcggtgttagcattgccagttttttcattatcgtcgtcgtcggtgtgattgttggctgtgacaggacatgaggtggttttgttgtctgattttacggggcatgtggcgccagcagaggcgagtttggcaaacgggcatagagagctcataatcggttggtcttaggtggattattatttacctgcataaaagattggtggcaagcagttgagtgaaagcatgagactagatgcagtagtagaattgaattgaattgagaagaatgagagagattgttaaagtagggagctaagcagaagcttgattattagatagaggttgggaaaaaaattggggttggtttattttgtaagaacaatttatctatcaatctctatctatatctatctataactaaatctatatcatcccaaaataaatccagcacatgagacaatccaatcggaaattgcaaatcacaaaataaatcacacataagatgagagaagaggtggaaatcacaaaataaaatcacatcacgtaggagatgagaggagaggtcgccggaccttatcctcgccgctgtggaggtcccgagctcggagccgaatcccgagccgcggcgccgccgggcagccgctgcgccagggagccactgagcagcctctgcgctgggagccgttgacccgcccctgcgccgctgctgcctcgggagatgccgagagggagagggagagggaggaggaaggcggagacgacgagaccgaggaggcacggccacgtgaagggggccggtggcagcaggcggatgcgggccggcagaggtaggggaggtgggcgtgcggcggcgctgggggtggggcgacgctggggtgggtgggagtggggcggcgctgtggaggcgtgcggcggcgctgggtgggtggaggaggaggaggggcggtagtgtggataaggttggatggctgtgagctgtgggaatcaggttggttttcaaaaaattaacacaaaatttaaaactttcgattaggattttcaaactttcaacccaaatttttgaagctttcaagttaaaattgaaaactttcaactcaaaatctaaaatctttcaactttcaccagaactcagccgcctctacgccctcgagcctttcctgacgccggatctgccgctcgcgcgcctcggcgaccgtagctattgcggggccatcatcgagaggtcgccggacccgcccctcccgtcgccgttgacggtggatccgtgcgagagtgaggcggagagacgacaggatccaggcggcggcggcggatccacgcaagtagcaaagacggcttaagccggtgttcgatatggtcaacgacaactcggatggaggagggagacagacgaagaaagactggatcaccgccgtccactctcttgcgtcgctggaggttggatcggggagagtaggagagaaaggggattttatcggagatcaaggttttcggaccctgccccctctggccggcgatttcatcggcgcgggaccgatccgagccatccatcagatctgatggctcagatcagccctgggtcaggccgccaccgctgttgggccacgtagtctttgggccgcggatgacaactgggccgtgctcagttcaccccgcgatgggccgttgccgataaatggccaactcgatgcgcgatcaactcgtgcgcttgcgctaaacgggccggccaattttttaggccggttagtcatgtacataattttctttggcattattttgagccatttaaaattgttggaaaattatgatcaattacttagaaaatatatatctatatctatatatacctaataaaaaaatgcaaagcttctggtttattttggtcagttggtttttttcccaacgctgccggggctgaatcctagcacaaccccgccgccatgtcgatcgtgcgtttcctcctccaattgattgcaaaaattgatgccccactccttcatcatcagtgaccttcctggtcttttttatcgtgaattttacgttttgatttgagaaaaacggaaagagtagatcgagtggattgaaagccctcatctaattttgggagatcaggaaagattcggccagatttgtggggaagatctgctctggcatcgtatgggcacgagactctcttcggacgttgaagacggagtcgactgtgggagcaaggcctgtggctccacttggggactgggctgaagggaggcaggttgagttgagggagttagcatactagcctagggcctaataggaaggaaggaatgggctttcggtccaaaaccaagaaaatttttttattaacttttaaattatagtatatagcaatcccaatattagaattttcattaacgttttcaatcgtaatgtatagcgagagagataagcctatctgaccaggcaaccgatacttttttaaaaaatacaattatagtagaaaaataattgttaaggtacacgtacatactttacagacgagtgatatttttaattattttttaatttttgacatcataatcatcgaaacttttactttaatatttgtttgagataaaaatttccatgaaacacgacatattaaagtatgcgcgctatatatcatccacatgtcaccactacgagactatgtgtaaatatgcaaaagtatttttgatcgatcgtggttttcattagttttataataaacttacctgttttaaatacaaattttttaatcatacaaatttttgtccatctactcttgcgtgaaagtgacctaaagaattcaccatttgttcctcccatgatacaatcattacgctaacacgttaggaatgtagttgatatcatacacatacatgtggaataattgtccaaacaaaaagaaaacctttgtgattaaaaaaatccttcaattaaactttatccaatgcgacattacccggtgcaacacacgggcattttgctagtaactaatataaatattcgtatttttccggtcgtcacatctaaattttcgtccgtttttcgtccatacccaatctgattcggttagcaatagccatggaaaaaaattgcaaaaaaaaaatctgcggccgtcgacgcccgcctccacgccgtccgggctgccacccctcccgctccgccgggaccaccgccgccgcccctcccctcccctcgatctagcggaggggagggcgtcgccggctctcccgccgctgccacacacagtgaaaggggaaaagtggagagagtgggggggatgggagggcgtcgcgctggggggagggtgccgccaccgccgccgctcgttgggggggagggcgcaccgccgctgctgccgctgctcgatacgggggaggcgtcgccgccgccgctcgcggggggagggcgccgccaccgctcgccgtgggggaagggcagcgttgccgccgccgccgctcgccgtgggggaaggtggcgccaccgccacaccccgccgcaccctgccgtcgtcgcgccgtgccggcgagaagggagggacagcgccggtggtgggagagacgacgctagtggcgggagagtcggccggctggggggaggggaagaggcgcccgtggggaaaaggagaaggggaggggg

SEQ ID NO: 44928 - DNA, 9818 bp, Oryza sativa
agggtgagggggagggttagggttagggttttcatcaattttaaacttatctgagccgtctatcaaaacgaacggctgagatcgatcgtgggtttgggccgcaccacttgggctgcacgtgggccggcggtccactaagtgagaggaggagtatgggggtattaagtagactttggtctcttgcaggctgaagaagaaaatgggctgaaaaaggcccatagagaaaaaaaggatttttatttagatttttatttcaataaattctgaaatgatatttgtattatcaaaattagcaattaagctatgtaaattccaagaaaatttcaatgagtgtaattaatatagaaaatttaataaaagttaaatccaaccataacattttatttcttacacttactttacttataaattaatttaattatatacctacctacttaaaaaatacccaaatatttcagaaaatttgtatttcatttaattataatttaatatgttttaattcaattttatctgtttttttcttttcgttgcaacgcaataccacttttgctcagaaaattttatatttcattaaattacaattcatttttttcatataaatagttcaaatcaaatttcattaaccatatcattaccctgtggaacgcacgggcattttgctagtaagattataatatagtaatagggaagagaattaaatcgcatgaacgattcatcctcgatacatgaaaccctagaaatcgtatgatgggggatgggggagtaatcaatacttacgtacgtaggaggaggagagaatgaaggaagggggcaggcggcggcgagaggggcgccggagtcggcgggaatctgggtgtgcgccgagagggagaagagagattgtgagcggagcggatgagagaggggatcgattgattgccaaccgcaagctacaagctaagaagacgggaggaggaggaagacgcgacgcaacgcaaacgaatcgaggagtaggcccaccagaccagaagcttacaatggagtatgttgggccgatagcccatttgcattttggcaacgcattccatgcattaatggtggtagtccccaccacaagtcagtctgggactgtccaccaccgcttttatgactcctgtatcactttgatgtaattatcttgatatcaatagaactccttttatatctctagaaagaaaaacatttgcatcaacatcattattattagagattaactatatctaattaatattctacattacaaagcaacaactattctctcaattgggacattggcccggtccaccgaagaacacatgcatacccatcttgagaacaccaaaaccatcaacagtgtagcacaatcccctagtggtcactgtagtggccttaccaacgtttggattgacaaagttgttgtccttgttggctatcctgatacccttcacaagtgcggctttcctatacccctctttggcgaaatggccgctccccattggtggaggatctaatgaaacagttggtccacgaacccatccaccccaaaatgcatatgtagccttctcttgtagggtgtcaaagagcttactcggccaatatccaagtggtcgatatccaatggcactgctcttgtctaggcgtgctagccaccaatctttagtctttcggtcctaattatataattaacaaaagaaaaaaaatttatatgagtacccttagaccggtttattacaagaaactattctaaactcttgaagggttgtcccctagttgtttgcatgtcactcaaatggttatagaaaaattcaacaagatagtttaatatgtgatagatcactacacaaacatgtaagatcaaatttaacttctacatattgcagcagaaaaacaaatttaactagaatatacgttaactagttgtagtttaattgacttatataagttaaattttaacttacatgtttgtaaagtgatatatcatatgttaatacattttctcaaaaattttcaatgtttttcataactatttgagtgatatacaaataacgaggggacgtccccttgagagtttaaaatccactctcgtttattgccttttgtaaaatcacactatgtagtcacaaaagtaaataatcatgtagaattattaaccacaaggaaaatacctgaaacagcatgacggtaattatatactgaggcccattgtagatagaaaccggtgttattttccctccaataccagcaagttggctaacttgcacaaaaccaggacaattaaaatcatagcatggcttatttgaactgtctacctatcgccaaaagtaatgccaaggatgtaagttggatggattttgtggtggtggctgtagagctattactaatattcgtttttatagccacgtcaagtaaggaaaacatatagaaaagtatgtgtgtattacccaacgaatgtgaaacctgacaaagttgtccccactaaaacttggccatacctgaaaaatatgatgatgaaaaccaacaattatatagtacatgaatgcataattattgtttaagtttgcaatactatagatgtgacaaaattattactaataactaagctagagggaatacatatgattaagcagaaattcttagacaaaagaatttatgcttaatcatgatataaataaacaatgatataactcatgattaatcacaatataatggaaccgtgataatttcaagtgttgaaaataatagcacggtatgcaatgggactatatacttacaatggaacctgcagctatctcttcgggtccattattaagttgtacaaatgatgcaatgtggtccccattatttcgtgttcaaaacggctggttaacacttagggtagcgtgtgttccatagaaactattatcgtcccagtatttgatacctgcatactacaagtgaaagaataatattgaaggtaagtcaaatagctttgcatgccacattagaatagaaaagaatttaatgaagataaactatttttatatacaatctataattgacaataagataactaaaaaaatgttaaagggtatacctcttcttgtgaaccaccattaggcatatgtgcttctgagctattgtgacgcagtatcggaattgttccggttgggcacttgatgtcggggaaatttgattctgagatattggatgacagaatagattgtatatcaagatctaatggataagagcttggttccatctgcgtaacaacaaaaatgaatcctaatcaaagatcgaaaacaaataccaaaaaatacacttatctttatattggacggtaaagggaataaatacgggaatccctcagttgatggctttcccaatatttcatattaaagtatcatgatgatatcttatataatctactaatggatcctaaataaattaaacttggatcttgaaactgctgttctattcatacaaaacacaaaacttaatcaagcataatatttatgtaacatgctcaaaagcatattcttctatacgaaaagtaatactctacctggattatatggtttttcaataatggatggttcatagcaggttgtttgtatatgtcaacacaatcgtaaacatcaccatctcctgtcttttgaacaattagttccttgttagccaccaaatgcaatgcaaatacagaagagaaggatttattaatcacatacctgaattgtcatgtttagatctttactaggtatggttgaaccaattatcccatctcgatcaatatgtatcttcactcctcctactagaacaagatatgtcaggcatagagttacaatactgatagctagattttcttccattgttgagtctcaagaggtcatctgttctgtatgcaaatggaccattttatagcttgaggaaacaatttatcttcacaaggccaatgaaacatttattcattgctgaatgagaattcaatgaatttgcaattaatattgagggtgtaaggacatgccacaataatgaagtaatcttcaagattatttacactattaattgaagatatctttacagattttgtaatcctctttttaatgcattgtgggaaaaataatataggaaaggcataaatgataaatgtggcattaaatgcacaagatttggtatactagacaaccgtacgatgtaaatttattgtagtaagaacaaatttaatagtatagccaactgctacctataacaattgatgcatcatctatagctaatctagcgatatacccatgcaatagttagctatagatatatgctaacaccattaagcatcaatacatggcttgcctaatcccctcacaaaatttgttggagcccgtgttgtagttggctactgatttatagtccacttaacttctctctactctcctctatcctccaactcatcacaaatatggtgtagcatttcctatagcctacttacatcatcttattgcatttacactaatttttggaagaactttaaaatatttaatgtaagaaatattaattacatgatatatgataataatactagattacatcgggtggacattaatttaatgttttaatgtttcttcaaaatatttaaagcatgctgattgtcattgtgatgcagtaaatccttttccatatactagtatgatttattttgttaatttcatgtttctaaagtgacatatataatgtagcagcaatgctaattagcgagcattctctagcaaaggaactagtgaaaactacatccacatatgacatatgtgctctctcactaacgttgatatgactcatatctcctatagtgggatatcttaatggctatcctttgatacctcggcctcctcctcgctagtgatccccacacttgatcctagtgacgccgatgaggtcccatgtcttcatcagatttggaggcaggttatcggtagaaacttccatgaattcgagtagaaagtttgaagtcatgcgtagaaagatttgaatttttttttgacttaaaccactgcaggtccccacaattaatatattagaaagaacgaaagtttcttacaaaccaaaacaaaaaaaaaataaagtgtcttaaaaagttctgaatattttacttgaaattttcaaagttggaaaaatattggttgaaagtttttgagattttagttggaagtttcagactttgattcaaaagtttagggattctggtataaaatttttgagaatgttttaattggaagtttccacttttgatttgaatgtttagggattttggtatataaaaaaagagattttagttggaagttttagactttcaattgaaagtttgtgtttcgaactagaagtttcgggatacaagtagaagatctcatatttgaatcgtaaagtgttgttgttcaatttgaaagtttcaacaacgcaagtagaaagttttagaaattctagattgaagtttgagaatttgattaactcccacagcttgctctagcctcttgtatagaaatagggaaaggaaaacaccccgtgttggaaaaggaaatgggcacaagtgttgagattcggagtatgactctaacctagatacttcaagtcaggacacgcgaatcgtgtgaaagttactgctgagttgaaaccattcacgacctcgtcatcttgcatgtgagtgcaaattagcaatccacataaggtactaccttgtagtacaatgcaaatttgatgatttgtcactctttgtattgccaactgccaccctgtgagaatgatacatgggactcttcgtgccaatgatgagtgggctaggatggcaaattatctaatttatctaaagagttgtaaatcatcaaatctgttgcaatacaactatttattggtgcttcaaaggttgaaatgtgcgtaagaacatatccgtggcacgcaatatatctcgaggtcccgctagaatgcgtttagggaaataacgagtttcgaaagaatgaatgaagctcacttgcttcttaaaaattaaaaaactcatgattggttgcttccaaaaattaaaaaaaacagtgagcgaatggctaccatgtgggccatgcctcaggtgaactattctacaccatgtcactgtcactttttttgctccgcaatgaggttaggttggatcctagtgtgggccaaacgaaacaaacttgtacttgtcgcgtaggcagtgggcatgcatcatgtgggcctcatgggctggtggcctaagtagtgcatgtgaccgtgggtagttgcagtggacgcaagaggagcgcgtgcgtcacgccacccgtgggacctcactggtaggccgacaccactctatgccacctcgatcggacaccaccaactactcaaatggtccaagctttgctccggcaagcccacttgttagtccttggatatgggagctagctactgactggctggtcaaaggagcctccgctcaaaactccagccccctccaacacacaacattaatttgcttctttttgggacaatgaatatctcatcagtctaactatcataggagcccgaatctgattattaaaaaggaaatagagggtgcatgcatgcatgcatacatggtgttatgttgttgtatgttccctttaattccattatttctaacacataaacttatgttattacaatttgcaaagcacatcacatcatttagatgtacttgcctgggccaccatagtatacatgcataccatcgtcattaagtccataaccatcatagctatatagttttagattattagaaaaaggattggcattacggatgtttggagtaacaagcttgttatccttgtcttcaataacttgaatattcctaataaaagcggctttgccaaatccttcagaagcaaaatgcccacttcccatatggcgtgcaccatttaatttatcttatcttaatggcgttacaatagaaaagttcaagaaattctctttacatgcatcggcataaattatttggctatgagatggtagaaaaaagattccaacttatcatgaatagctcaactaatatcattgtgagctgaacaaaaagaatatagcaaaaatacttgcacataaactacatgcttagacatggaacctatatgaccaatcatacaaatattaagaatataatattaccttaaaaataagaacatttattacatattgtggtccattatagacagatatgggattgattcttcctccaagaccaacactgtgactaacttgcatgaaaccagggcaattgtgatcactgcaactcttgttcaattcttcattatcctattattagaatttattccaaagtcagcaaggaactgtaacaaattatatttgtaatatccgggttatcaaatttatatggtccatcatagatggttactgaagaaaatgtttatgtctcacccaacgaatatggaacctagcaaagctatcaccacttcttggatatacacaagacccagcacctataccaattccgttggtaccttttgggacaacactaatttgtatccatgatgcactaacatctttgctatctttcttcacacttggttcatagacatttattgatgcctgcatgccatatatctcatcccaatattcaattcctgctccctacaagcaaaaattatgatgccttgttgggataaaaagactaacataaatactacgaagatcagctgatcgagttgaaaatttccattgccatatccaatgcaaggataacaatgtggggtctaggttggcagttatcctcacattggatatcattttccaatttgtgcatgctcaagtgttattgggcagatttcccaaatcaaagtatatatataattctaatggcatattacacagaaatttcaatcttctagtgttgtcaaataggaccaacactaatacatttcccccgataagtattagtaattggatacaacaaacatatttcaaatctccctttggttttattgaaaaaaaaagtaaagcttcagaattaaaataagttacttatttcttaaaattgcatttgatctctgaatttctatttttttatatataattgctcataagatgggaacattgcacatatttcatcttatattatgtctcgttgagaattttgatgttagcactcaaagattgagtcgaaaatgatcatacttcgtaaatatgcaacaactattcatgaggcaataccatacaatagtctataatatcataaccaaccttttattactatataatttcaaaattttattaaaaaacctaccagcattggtaaatcatcattagccagtgtgccaatacgttgtaccatcatgttggccaaattgttgttgcgcactattggaattgttccaatggggcaatcaatggtagacaattgtgcttgcgagattgcacctactaatggcgatttgatatccatccctatcgggaaagaactaggttccatctatttgtcatgaaaaaacttgatcaccgtattcattaaaaaaaacttgatcaccgtataataaatgactcccaacgcacaaccaattaaatagatatacacatagaaaaatatgcacacatgatttgaagtgcagttttcacatgtgtagacgatgaacaatagatacaaaaagaagttattgttcttaatgttaaatcaaagtgtagagagtggataaagaacgatttttaaaaacaaatgtagaagcaagctatgacctatcatgaatacaaactaatgtaaagaatcttgctatgatgatttttcctacaattttcagcctatataccatataattatgaatatgaagggacttgcaaatattttttgatttaaaattaaaaatatctaaatcaccgtcatgtgatagaaaatcagatctttatgaaagtggctaacctgaattttatgtcctttgaacaatggatgtttcaatgatggttgtagattcacatcgacacaatcatatatgtctccatcttctacctactttaatgtttctctgtgcttgttagccatcaaaggatcactaaatgtatctcggaaaaaggtatacttgctaatacctgaatagtcttattaacttgtaaagttgtcaggattcgactagtattttctccattgttaatgggtttgagctcttctcccctagtagttagaacaagatatgacaagaggagagccagttgagaaacattgtttcctttcatggtggaaatcttgagtggtttgtttcatagcatttagaccattatataggaaaggtttcactggctatcatttaagatgtaatacattacaattaatgacagatgtacaatacatttattacatagaacaatcccagtattaattgcacaagatatggtagagtaagagccatctcatatttgcacaggcatgactacttccacctaattagtattatataaatgtataaatgaccttcctgcctaaacatgttaaaaacaagacctcatttattgataagattggtagcattaagcgaagaaaataggggaaagtcgtcttgaagttctacaacaaccaacaaacttatatgggtttcctacaaccctgcgttatggatgctcccaagcttggctccgacaagccagcttcttggtcatggaaaatgggagctaccggttagacagttggaggagcctcctctacagttatcatactcctacctctgccaacaacacatcaatggcagaaggaatatgctagctatgtgttattaagttccatttgcttctttgggacaatgagcatctcttcattttaactattacaagaaatc

SEQ ID NO: 44929 - DNA, 16726 bp, Oryza sativa
gatgcatgcattgtgttgtcatgccatgtatgtaacctttaatcccattatttccaacacaaaagattatgttgttacagtttgcaaagcacataacaccatttagctatacttgcctgggccaccatagtatacatgcataccattatcattaagtccataaccatcatagctgtataattttggatcactagaaaaaggatcagaatcacgaatgtttggagtaaccagcttgttattcttgtcttcaataacttgaatattcctaataaaagttgttttgccaaatccttcagaagcgaaatggccacttcccatttgtggagggtctgaagcagctatcggaccttgaacatatccaccccaaaatgcataatcacctttggctttgaggtaagagaattgtgaacttggccagtatccgattggtgtattgtttgaaccatatgccaaccaccagttttcagtctttggatcctaaaacatgtcaagattagacaacaaatacttaatgcaaattctaaagtaatatttggcattgaatattgatatgtttgtgtaatcaaactaaaaaactgtaattaattcgtcttgatttgaactagtttggactagttttatttatgtggtcattgtaatcatactaatttcaaaaggaaattaatatagtttagattgttcttactcgacttattattgatatatcaagtctacatatatagtcaaacctgagtttccatgttgatcgagcacaaatatcgtacaattctcaatctgggcatgcattatgttacaattctcaatctgggtatgcaattatgtaatttatcttattttaatgaaactataacatcaaagttcctttttaataaattaattttctttacatgcactaagataaaatatttggctaggagatgatagggaagggaattgctataaaaactatgagttgcttagtttttaataaattaattttctttacatgcactaagataaaatatttggctaggagatgatagggaaggggattgctataaaaactatgagttgcttagtttttgaaaaacaaaaaaaatagcaataataaattacataaattgcacgattagacatagaacctatataaccaatcatacaaaatttaagaatataataacaccttaaaaataagaacatttattacatattgtggtccattatagatagagatgggatggattcttcctccaagaccaacattgcgactaacttacacgaaaccaggacaattgtgatcaacgcagccttttttcagttcttcattatcctgtcataaatatttattccagggtcaataaggaatcaaaacgaattatatttataatatctgagttggctaatttacatggtccatcatagattctttctggcccatcatatgccttacccagaatatatggaacctagcaaagttatcaccactaaggcttggagacacacaagacccaacacctatcccaactccaaccgcagcttttggcaagttactaatttgtatccatgatgcagtaaggtcctgactatctttcttcacctttgggtcgtagacatatattgatccccgtattccgtatacctcatcccagtattcaattccggccccctacaagcaaaaataatcatttattcttgcaaataaaaataacaataattgcaaagaccaaatgatcaagttgaatgttccatcggcatatccagtgcaagtaagacaatgtggggcctgggtttgtagtcattcccgtgttggatattatcttccaatttatgcatgtttcaatgctactagacagatttcacacatcataaatacatatatataattctaatgagttattacatagaaatttcattcacttagtgctatcgactagcaccaacgtggataaaccttcccaagaagtattagtaattgggtacaataaactgatttcaaatccctttagtattattgaaatattattcatttgatcgaatatcttgttaaaaaaccatcaaagtttcaaatttaaaactagttacttatttcttaaaattgagagagttttttttggggggggggatctctctgaatgtcttgttttatttataattgttcttacagtgggaacattgcgcatatcttgtcttactatatctctcgccgagaattttgatgtcagcactgaaagattgatttgaaaatgatcatacgttgtaattaggttatgaacagggacactagttgtgctgttaaatgccatatgcaattcatgggacagttccatacaaaagtctatattgtcacagtcagcctttcgttagtatatagttcaagcatttaactaaaaaaacttaccagcattcgtgactcattgctagccaactcgccaattcgttgtagaattgtgttgtccatgttgttgttgtgcagtatcggaattgttcctataggacagtcgaaggtagacagatgtgcttgcaagactgcaccttctaatggcgatttaatatccaaccctactggaaaagagcttggttccatctatttgacatgtaaaactttatcaccatataataaatgattcgcaacgcacgactacttaaatagatatctacctaacaaagtgctccaatgattccaaagtgcagtttctgcgtgtatatattatgggccatatatacaaaaaagaagtcataattttccttttttatgttaaggcaaaaagtgtagggagtgcataaaggttgattcttagaacaatctagaagcaagctatggcctaccatgaatacaaaccaatagaaagaattttgctatgatgagtttgcctacagttttcagcctacgcagtatgtatcatataatcatgaatatgaaagaacctaaaaatattgttttttgcatttaaacttaaaaaaaataaattgacccaccatatgaaagcaaatctcatgtttatgaaagtggcttacctgaattttatggtctttgaacaccggatgtttaaatgttgtctgtagattcacatcaacacaatcatatatgtctccatcttgtgcctactttgatttttgagtaaatcgtattagctgtatatgaatttgttaggtgggtgtaatctagtgcatgaactcgtaaaacattcattttggtaaatgaactaggtgcgtgcgaacgaaggccaaaagaacataacaagactattcttgctaatttaagtattgattagaatgctacataaatatgtacttgagaagaatgctacataaacatgcatattttcactaaaatggtttaataaggcctataacgattgcacggagaatgatataaaaaaaccgagaaatgatacaaggggtagaacaaagaataataaagtataaaccaagtttacaaatatagtatgtttcatgctcacctcacgtgtgcacgtcctatcctaaccagcatctaacttgatagaattggccatgacatgtccttttggtcttagtttgcacccatccaacaagttcatacaccaaaacaagtattttacaagttcatgtagtaaattgcacatacctgataagtttgtatatcaccaatataatttactcttgatatttcctcttgtttgtcatcaaggatgccaaatatacaacccctcccccccccccccaaactcagaaagaaagaaagaaagaaaaagaattatttctcatacctgaatagtgatattaacttgtggacttgtgaggctttcattagctttttctctactgtttatagatttgagctcttttcctccaatagttagaagaagatatgacaagaggagagtcacttgaaaaacattgtttgctttcattttggtaatcttgagtggtctatttcatagcattagaccattgtatatataggtttagaggttccgctagttttcacttaagagatactatattggaattaatggcagatataaaatgcatttaattacacaagaaaaatcatagtattaactacacaagatatatagagtaaagaccatctcataattgcacaggtatcactgcatccctctctttgttataaatgtttaagtgaccttgttgttgtacacacattaaaaccaatacctcatttattgataagatcaatatcattaagtgaacaaagagacaaatgtcttgaattctatgaataccttctccatctgtccaaaagtttaacgactactatgttccttttagagattaagaataaagaaaaaaactatgatatctcttattaaatgagtggtggttggggagaagataataagagatggtgtttggaggtaagattgagtaaaaataaaataagggatggttggtgaagggagtattgctccataagtaggacaaaatttaaatactaaaggttcttatattttagggcaaatagagcatatctgaataagagtaagaaatttaaaataaataagtgatttcttagaatcgaatggagtagataatgtggtggacatcaccagcggctatcaggagaatgctggcggaaggcctggatgaacaccggcggcaactggtgaggttgcgagcgtgaaccaccgtgagtgtgatgacggcagcggcggcaatgggcttgaggtcatcgtcgatggctccctaaataacgacgtcatgtcataagcatgtaggcatgtactccatataaatgcaatacgtgttagctgaaatgggcaagagaaaaaaaaaagaaaaacacccgaaccatctaacatgacccatagcggaaggcactactatgcgctcgctcctcattgtgaacggattggtgctgtaggggtggcaatttccttgattgggggcacccctaatgaaaacggagcggatagtttccgtccgctccgaataaaaacggatacggatatcttttggatcggataattctcggatagtttagatgcggatacgaatacgaataattcggatacggatacgaattaaatttagccaccatatgtaagaaagccatctctttaagaaagtggcttacatcggatgtttacatgctggttgtagattcacatcaatacaatcacatatgtctccatcttctgcctacttttataattcatatatatgttagccatcaaacaataaagccaaatatagcccaaagaaaagtattcttgctcatacctgaatagccctattaacttgttggcctacgaggatttgactagagttttctccattgtttatgtatttgagctcttttcctcttatagttagaacaaaatatgacaagagggtaacttggaaaacgttatttcttttcattgcataaatcttgaatggtcaattttatagtgtagaccactgtatttatatatgtttgtaggaatccgatgttggtatttaataggtaatattttgcaattaatgcaaaatatataatatatttaattacatagaaaactatcctattaattgcacaagtaggatcgatacttcctttaggtattagactgatagcactcatttattgagagcaggtacaatagcaggctataagccagctataaacatattttaaagagataaaagaagagagaagagcagcaggctacagagctgtagccagctgcagcatggactccaagacataatgtgtgtatgaaaggtaggaccaggtataatagtatagtaaacaactattgtatgaattggctattacattgacaacattcagagcaagtttgatagtatagcccactactagctccaaattatctatagccaatgtaatagccaataagaaggacataaagggaaaaagcagaagacaagtgtcaagtaagcactctaaagtgacatgcgttatttggaatgattttttttaaaaaaaaatgaaccttttaaatataagagtaaagtccatcaccagtccctaaacttgtaccgttgtgtcatttcggtccctaaacttgcaaatcgatcgttcaaatcctcaaacttgttcgactgtgtcatccggtccttaaacttgcagatcactcatttaggtcctccaacttgttcagttgtgtcaccccggtcccttaacaggacggtctaaaaactttatatcaaaaattaattcataactttttcatgtgaacgctaatgaagacaaactttatatcaaatttgtagccctcgacacgacctacaactttgtagttgaaaagtttttgaattaaaactgtttagggtcccaaaatattgttgcatgtttatagattttgatattttaatttaaaaatcacattttggggcaaagaaatgacttaaaataaaaaaaaatcaactacaaagttgtagatcgcgtcgagggctacaaatttgatataaagtttgtcttcattagagttcacatgagtaagtttagggacgggggtgacacaacttaacaagttggaggacctaaatgagtgatctacaagtttagggaccgggatgatacagtcgaacaagtttgaagacctgaacggtcgatttgcgagtttatggaccgggatgacacaacgatacaattttagtgaccggtgatggactttactctcaatataaattctttgagaacttattttcagatttgtatccttttggctacgctattttcactagcaaggtataacaattttaccacggtggtgtaatatcatggtgtgattttgctacaccagtaccaccactcgtagtggcatggcaggtcagtggtactatagtaccgcccacaccattgtttgtatccttgtcctaccatgctaccacggattgatttttcttaatttaaattcttcggaattggaagtagtagttattaatgtcaagagagcaaaggcaatttaaactatgcaaaataatttttggaatgattcaaaatatcgcttagaaaaaggttgatgcatgggcttgaattctcgttttgcccgatgcaagtcctatatactccacatgtttcatatggtaagactttctagttttgctcatatacatataaaagttaaagagtaaattgcattcacggtacatcaacttagtaagttggtgtaatttagtataggaacttgagaaatgagcatgctaggacaacaacttaccaagtgggtgcaacctagtacaaaaacttaataaatgagcttatgggtacaactacttgaaatgtgggtatgattttggtacaataacttgagaagtggtgtaaaaacttaattattttgagtatttttggctatatgtactcagcttttacgtactctgttgataatacttgcctgaatcttctctctcggttactcagtggagtgatctctctcttaaattcccataaggataaggaaaagtagacggttcgaaacccgtgcttaaatcctactcaaggttatacttatgtagatttgtacaagcattttttttttgtcattctagtaattcaaggtcaaacaaattttaccatgcagaaattttctagttggtaattgagatggtgaaaaaaatatctaaatcgatggtgcaaattaggtgagcaatatattcttacatattatataagattatatctacgggaatgctatgtgatgacatattaacatcgtgaactttcatagcactcattaaccaaaatagcatatctagccaagttattgcaccaaaatactaaattatcaaattcttgtattaaagcgcacccacctaccaagttattgcacttagacgtcacattctcaagttcttgtactaaatcgcacccacctgtcaacttgttgtaccatgagtgcaatttactcaaagttaatggatctagagacatatatatgtctagattcattaacatctatatgaatgtagacaatgctgaaatgtcttacattgtgaaacggagaaagtattatttagtgcgtttgagagaagggaaaaatgagaagaaatgttgagaagatatgtagagcgaggtgggtcattatcgcataattaattgagtataaattatttcaaaacttgaaaaggaaagattggtgttaaaacacctttctcataattttttttaaaggtactgtctaacagttcgagaagcatatgtgtctggaaaaacaaccgacttttctctacttgtgcttgtgtcaaacacctaatcttggtccaaattcagttacgcctagcaaagctttgggaaattggcagtgggtggaagacgcgtcggatgagggttaaacaaggttgactagttgagtacttcaggggctaatccaagcgtacatgggccggctgaactcttaacttgggttgggcccgccgttaaactcagaaaggaaatgccatcccgcgttttccctgggaagaggactcttcctcctaaggaaaaggaagagctaagaacccgacatgtcatctagctacccacattcccttccattttaaggtcggattaggtgttgttgtaatccaacaaggtttatagcaagattgctgatgatcaccttcttctcttccgatcctcttaataatttaatgttacttatctcacatgatgtcttaaatattgtgtagaaaccatgtctcatgcaaaacatggtttcattctcttttctcatttattcacatgtcacatcatttttcatactaggtgacagcttatttaagggcaacaacaatgtatatagcaaaagtagtccatatagatgggacccacacatatggactataactattgttatcttcacaatgtatatagatagcaactagtattaagaggggagaggaaatagagagaaataacatgttttattttatatgggcaacccatatgcttatagttggcttttactattttcttgctatggactggttccataatgttgttaggtggctgaatggaatattttattgcttatggactagttttagactacattgtggatgccctactgatatagacactattctagtcattgagttgaaaattgccttaggccattcccaacccaagacactagacatagttttcataaactccacatcataaaaaaataatagtactagacactactattccaatgcaaacaccactattccatacttaaatttaatgccacctatctcacataatgtcttggatgttgtgtagaaactatgtctcatacaaaacatggtttccttctctttcctcatttaatcacttgacacatcattttttatactaggtggcaacttatttaatgctattgacacaatcctagtcattgagttaggaatggtcttagtacctattaattaataagaagatgatatggtttaaattagatgtggcattcaaatcgactataaaacttcccctgagtagatagatagatgagacttgtaaagtgagatttataaaagcccacaccactacaaagctttcttccttcctttttaaacccaacctcccaacacctttcctcactctcctccctccctccctccctctccaacacgctcacccatgcaacccaacgcccgccaaatgcgcggcggctgcggctgccgatgcagcggacaggacgacttcttcgaccagatgctgtccacgctgccggcggtgtggtccgagctcggctccggcaagcccgcttgggacctcacggccggcgccgtaggaggaggaggaggagcctccgatgaccactccgccgcggcgttcgacgactccgcgctcctcgcctcccgcctccgccagcaccagatcgacggtggaggcgacaagcccatcatgctccaactcagcgacctccaccgtcatcacggcctcgccgccggcgatgacagcggcggcgctgccgggttccttcccctgtcgctgttcgctgaccggtcgcaggacgacatcgacgccgccttcaagtcccccaatggcgctgtacgattctatatttctatcgcttgctatatagctcaacgattacaacttgaagggtgaattgaagcttcggtttacttgagctatatatggtgtttctttgggttctcttcttcgcagagaggtgaccatgcgctgtacaatgggttcggggccgccggaatgcatggcgccgccgccatgcagccgccgccgttcgggcaggtacgcggccaagaagcggttcaacttctccccccaattcattctgcttctttaccaaggttggaaacaactcaggaatctggattgtttccttgatttttgctcaacggagtttggtttgctccctgttcgatcaattgctccactcgtaagaatgcacctcttgttttcctcatgtcaaagggaggatcaatgccggcgcagagcttcggtggcggagcggccgcgagcggcggcggcggcggcgggtcggcgtcggcggcagcggcggctggggcatcgtcgggcggaggggcggcggcgccgccgcggcagcggcagcgggcgaggagagggcaagccactgacccacacagcatcgccgaacgtgtataccactctcccaccacctttcccttctcgcccccattttttattgcctccatgccatgttgtgtgagtgtgttcttcttgctcctggagctccacaaattttggaccaacctaacaagtcaatttgacctgttgcacacttcaaatttcggctagaaatggtggtttcggtagtaagaagagcttgaaatgagatggaacttgttgtgttcttgtgatttcctgagactttgcatgtgtttgatttgcagctccggagggagaggatagctgagaggatgaaggcgttgcaggagctggtcccaaatgccaacaaggtagctgaaaattttcctcacttttgctcctcttcttttgctttgttttacttctttgcgccatctttgaacaaagtaggaagctttccttgaaatgcgatgaagatgcacccatgctttctgcttttttttttgtgtgtgtaaatatcttatcttaaaacttagtgaccagctaagtgtgttgatttattgcagtattaacacatatgttctgtttctcttacaattaacatgatgtgatatcttcattcttcactgtatgattggaaaatagtaagtgcatcatagggtaggaaagaggggacatgaggcatatgatgcattgctgatttgatgttctgatgcttacactgacacatgttggcctttcattggagtatttgggttggtgattagctgctaacggtggtgaatgacacgtgtcgggctttcgttggatgatttgggttggtgattagatgctaattgatggtgaaggcagtagtggggaaagggaggtcagacatgatgccgaaatgaatgagaaatgtttctacccgttaggccaccaacagtaacagatgaatagccacagctcaaatttaggggaatgcagattaaactatggacttgatcattgcattagccaccaggttcctagagaactgaacatcaagaaaggaatggattagtactaggtgttatataatatatgcacatgtcttaacttcgagacatgcatttatacttggactatgtgacggctgcaaaacacaagaacaggagacacgggcacttgtctaatgttccagcctcgtctgttctccatgaactggatagagagcactacaagtcccacagctacatgccatggttggcacttctggagcttccagcgtcacgtctgatatcttgttttgcacaaactgtaatctgttttgtagtatctgaagcgataatgggtgctgatctgatgggatttggaataaaaactgacatccatcttcatatcttagctgatagggttgctccagcacaaagtagagtgacacggatcactgtcactgaaatgacgatgtggaatttcgttttgcagaccgacaaggcatcgatgctcgacgagatcattgattatgtgaagttcctccagctccaagtcaaggtaatctaaccctgcttttctacagatagatgaattcctgcctgttgctaataagttagtcccttgaatgtctcaaatcgcgcaggttctcagcatgagcagattggggggagcttctgcagtcgcgcctctagtggctaacatgtcatcagaggtacttatattatatgatgctttattttgaaaatctagagcactaccaatgacgcaatcaatggttaatggtactaggcgaggacttgctgatatgtgtaggacaaacatgtttagcccaaaatgctataatgatgtttattacagcacaaagtgactagggaaagtgttatcttttttaccatcaggttggtgataataggtagtcattatctgtcctctttaaagttagtgtattgattctgatgcatttaactttctttatttttataaacgagcaaatggttatctcttgtctaaagtagatctgtcaagaagttcatataatggaatataagcatgttaaatcttatcagtgattctaactttggcatttggaggactagaagtcagacgagttactaaaaacaaatgcatgcttgcaaaatagcataaatcaaaaggagatgtgccataaatttgcttaagaaactgatcaaaccttagtgggtaccaacgcaacaaaaagataaggtcggaaggaatcttggtagttcaagaattggatccaaaaaggacaaacacgcctgaaaagtgacaaggtagtactactgaaaaaaaaaatcaagcataatagtattagcctgtagaagctactaacccactaaggacaattcaaaccccttaagtctgaacacacactagcagccgagctaccataaggtcaactacctcaaatgtgacaaaaacgcccatcaattccacatcacctctctgttgaagaaatggcacagagattttacaatctcgagtcatttgctcaaattttaggtgtgtttttttgcagagtaatgggaatggcaatgccaccagcagcagcgggaacggcgaggcggccaatggcagcagcaacggcgacaacaatggtggcggcacactgcgggtgacggagcagcaggtggcgaagctgatggaggaggacatgggctccgccatgcagtacctgcaggggaaggggctatgcctgatgccgatctctctcgcaacggccatctcctccgccacctcctcgtcgctcctcccccgcactgggggaggcgctggagggtccctacatgaaggtggtaatggtacatcaccaccattggtgaatggcaccgccaccggatgtgacgacgccggaggtaaacagtgaggttggacagtgtccatgggaaagttgagtgatcaggatatgtcttctaattctaggggtggaattgtgaaatggcgatgctcttttctttgcctctctctctctctcttttgttttgtttataagaaaaatgatgttaagcatgcgagctttagttccagcttttcttgttgatatggtatagtagcttttctgatatctttcctcctctccttttgagcaattgagctttgagctgctctctaatataatctctagcagtattcttttctgttaaatttgtcgtggagctgtcgtttctcctgctgaatgaagactgtagaggtaaggaggaatcgaaattattggtccagaagggaccctgatcatattctgattcaaaaaaaatatcagagtacttcgtagcctggaacaggcatcaagtgcaaaggtttgtcgttggagttgaagtttgtgcgtgaatcagggataggatatgctctgctctctaacagcagcttaagctgtaaagtctccttcacgctgatgcaatccaggcgctttccggaccatcagacatatagaagattagatgcagaaacaacaggctgtacctgttcctgaaaattacctacagaatgtgtataagaaattatatatctaacacttgagctggaacagttaggtttccccttacgacgaagcaccaatgattgcgatgcaggaggcaacaaagttgaatgatatgaagagggcaaggtgatatgttcatacatgctagctatgctactactccaaactgcaatattccttcgttgctttcaactcgcacgtcgcgatgggctggcttcaagtaaacaaatccagaaggaatgatatgatgaatagattcaaggattcggacgggagatgcacccacgttggtgaagtaaatgaagggcatctttggtcgtgctctaaacaaaaatatcgcagtgacaactctgatggatgagttaatacaatgaaaaatagtctagaattgctctagagaaaaccaaaatacaagactggacacaagatgatgaaaaaattttaatgcgagacagatgaagccgcacaactgttgcaaaaaggaaaatgaaccgaaacaaaggccaagggattctcaaccttctgcctgaaatttggaatctcaaaggcactagaaaatggagtaacaaaccgcattactaacagagactgtaatagtaatagatatttcaagtgtaaagcctaacaaaaaggttaacagcgacgatacattgatgtgaacgtacccaactttactttggggtagattccttcctagccatgaaaagcagtggatgtattataactacagaaggaaagaagaattccttccctggtgtaaaagcagaagagaactactgtaccgtgcaccaaaaataagcagcaggttgcagggatggggaaagctgcttggggattgcacggcaaatggattacatgacacatcaaaccatccctcttgttttggacatccatgattaaatgctgagcctgttgcagaattatcataggcgagaatcacctaaaggagacagcattggaatcactggaaaggcagcattataaatcaaacaagggataaatcatgatcaagtgggtgtttcgccctccatactttaaacgataaatggatagacccaacccgctttgaaccacatggtttaatgttcatcacttatcatgttcaaatctagcatatctccatattataagaactcaatgagctctggtgatatgtcatgtttaactccaaactctactctagcccatttttactggtactcaatgaacaccagagtcctgacagttttaccccttcctttctaactgatgttggatgatgttatcaaattaatagggctggtggatgaagctatagcagacaaaacagtaaataaaaagaagaaacttcatgccatctgagaaagtagaactcaccaaatctatgtagcagatgcagatacatcatacaaagaataaattagaacttcaactaatctatactgcttcacgtattgatggttctctttcttttagaagcattaggcgctttatctcccgacttagatttctttgttgcttctgattcaagagactcttccaatttctttagagctttgatcacccagtcagaaaaaaaaagattaaatttaacacaaatcatatgagtaataatgcattagtgcatcttaaacaaaacagactgcaaccttaccagaggaaaaaactgggcgaagggtttctaccgattcctctggtagtgaatgaagactgcagctagaattatctgccttcttgagcattttgtcaaaagccttaacctgcaaagacagcccaaataaaaagaaaagagttagaatgagattttagacttatggcacctgctctcagtattcaattaggcattcttttagtgaaataaagtagaaaggttacacagaccatagttatccacacatctggacatatgttgcaataaaaaataagcatcaggtgttttatgcattggtaagtcctaaaccaaaacagaaagtcccagtgctaggtaatcggtggtgccccttctgttttctacaccatatcaattagcgtcaatctaacatataccaagtcaataaatactcaacttcttttctatgtttttaaacatcacaaatacaggcatgcgattaatctttcatgtgcaagcttcctacacatatagtcatatcatgtaattaccatgtcatattaataaaatcaactcactgtatattattgtactagaagaacggaaaactacttataattgttcagcaatgtattacctcatgtttccttaaaaatgtgaagcaagaaccagactctcccgcccgagcagtacgacctgctcggtggatgtatgtttttacatacggtggcatgtcataattgataacatatcttaagccatcaatatgaattcctcgagccattctatctgtaccaatcagaacatctatcttcccttccttgaaggcatccagtgtcttcctgcaaaaaatatgtgttgctaatcccgtaacttatcatggtgtgaataagttcaacataccaaaaattacatcctatcatcaacagaagttacataggtcttgcagttcaaacttcaaatccacatgatccagaaaatattatgatccatagaacttgaacaaggaatggtcagctagatatgatatttgcatactatttttatgttgtctatttgctaacagctccatgaaactgaacttacctccgagtcgattcacgttgcaaacgtgaatattcactaaatttgaagggcaagtcttcgaaaaattccagcaaggtgctcagtctgtgactggattccacagatgaagtaaaaactaaacatttttccccac

SEQ ID NO: 44930 - DNA, 4680 bp, Oryza sativa
ttctttccactattcaacagcaagggatgttgcaactcaagttgagaaagcttgctaggatcttgagtcagtgtggcagacaaaactatcttcgccaatcttggaaaggatttacctttaaaaccacgctcaacacccctatatgccatagcatagattaatcaagttttgaattgaagtacagatcaacaaacaatcctcagagctacaatagcaggaagggctgaatcataacgcataagtattacaagtaatatgtgaactttactaaaaggggagtgtaaaatactaaaatatgacaatgtaattaggtagtgtgggactaacgatcgtctaatggtagtcaatggatgcagtagagtttctccgttcatgtctgaccaggaatggttttgatcactcgagcgagtaagctggataactgttggcaaccaagactgataagcttctctcaacatcctgtccgtctcatcaacaacctgaaatgtcaatatattaagtagaaattaaaggcactaaaaagatggaaaagaagactcttagtgctaaaatcaaagtgcatatccaagcataaactgctggtctggtcaatccaataattatgtgaaaccaacataaggtaaaatatattaataaactattttccttattccaagctgtcctggaataatcatgttcttgctattgctgattgaacaaaagaacaaacaagtaatcttaggaaaagtaagcaagcggggaagattaagggggtggaatataactcaagaggacacatagattgttcccatcaacctaccaggtattgaagatgctccaggctgaaaccttttgtcatgctgatatgatccatcagtcttccaggagttgccaccaatatatcaactttagtctgtggttccatttggatatattcttcatcaagacttgggaaaagcccttgtttagacttctcaataagatttgaaacttcatccgctattgatgattgaccaactgctgagcctactgacaagcccacaacaggagcaatagcatcaaaaacctctttaacctgaaattgaacaaagaattcatggaacatcagtattgttcaacataacctgaagaacatgaaatagacttgttgactagctgttctggttagactagcatgtagaaggtaaaaggaacagcacaaacctgcaatgctaaatcccttgtaggtagcacaaccaaagcacgcaagcaccttacttttcgagtagcgagcatttgaacgataggcaaagcataagcaagagtcttgccagatccagttggggagttaatacagatatccctctcaaaagcaccaggaccaatagtttccagccatgctgctacttgaactggaaaaaatgattctatccccattctctgcaatggcttcaccaacctaaagcagtaaaacatagccaacacaggagtaaacatgttagtatttcttaacagcatgaagtattaaaagcatcctttctaagtacctcaacaaaattaactgcactgaaaacgcattcaagaatagcgagggaataaaggagattcgcaagcaaaacaactgaaattacaaactctcttagaaccaaacaagatgggtcatgggtgcatatgtgtgttttagagctaaccgaacttgtacaaattccaactctgaatactcggacaccagctgaacactattagcttagtgaaattacacaacgccattgatgtccagttggagtaacatcttatggtcacacacaaatcgcctaatcccagaattacaaatcaaccgtgaccaaaaaaaaaaaaaggaaaaacctacttgatagttcataccccacgaggatgcaaactaattagcatcctcaccgcatagttatcgacagctaagttcattccatgcataaaactttcacagtgccacgacgcctaggagctcgcgtccaagctagcgaatcgcttattcaagtgatcgaaagtatacaaaaagaggggggtgtggaggggggggggagctcacctgggatcgagacggggaaggtgcgcgacggggcagccggagaaggagtcgatgtcgacggggttccgcatccacggaaggtgaggcacgcggctcgacggcccaccctcctcctccttcgtcgccatggccaccaccatcacacgccgaggacgacgattcaaccgccaaccagggtcgtcgccgtcgccggcgccggtgagtagaactcgcaccgagaggcgacaggcgaggaggtgagtaagcggcggcggcgaattagggcgtggagtagtgtgatgaattcgcggaggccgccgcagcgcggggaagacaacgggccatcttctcgtgggccgcaagcaaaccaagcaggccacgttttcgtgggcctcaggcaaagtagacaggccgagaataaataggccgcgtctgcccgtgcggtggcccattccatttcccccggggtccacccgcacccttcccttccaccgcaagctttcccgttgcggtgcggatcccccacctcttctccgccgcctcgctctccgggatggacccctccgccgccgccgccgccgccgacgacgacgacgactaccacgccaccacgggtgggatggagccgcgtggagaggaggacaacggcgccagtacaaggggcgtcaccggtcggctactcgcttggcgcggggaagaggaagacgacgatgacgcggaggattcgggaggagggagcggagcaggcgccaacgccgacgaagacgacgcggcctccgctgtttcccttgacaccatcagcaacgactcgatcctgcttccgccggagccgacgagcgccaacctggcgagcctcctccgcgcgaggaagctgatcctcgtcgtggacttggaccacacgctcatcaactccaccagattcgcccacctctccgacgacgagaaagccaacgggttcacggagcgcaccggagatgatcggagcaggggcctgttccgaatggggctcttccggatgatcaccaagctcaggccgttcgtccatgaattcctgcgagaagcgagcgccatgttcgagatgcacgtgtacaccctcgggaacaggaactacgccacggcggtcgccaagctgctcgaccccgacggcgcctacttcggcgaacggatcatatcgagcggcgagtcgtcgcagccggacaggaagagcctcggcgacgtcttcgggtgggcgccggagatggagcgagccgcggtggtcatcctcgacgacacggcggaggtctggaaggggtacagggacaacctgatcgagatggagaggtacctctacttcgcgtcgagccgcggcaagttcgggatcgcggtgaggtccctggcggagcggaaccgggacgagagcgagcgcgagggcgcgctcgccgtggcgctgcgcgtcctgcggcgagtccatggggaattcttctccggctcggtgtgcagcggcagcttcgcggacgtcagggaggtgatcaggcaggcgcggcgcgaggtgctgcgcgggtgcacggtggcgttcaccggggtcatcccaagcggcgacggcggccgcgccagcgaccaccccgtgtggaggagagccgagcagctcggcgccacctgcgccgacgacgtcggcgagggggtcacccacttcgtcgccgggaaaccggtcacccgcaaggcgctgtgggcgcagacccacggcaagtttctcgttgacacggagtggatcaacgccgcgcatttccggtggagcaagccggaggagagaatgtaccccgtgaaaggcgagcattgaggacattggaatggcggcggcggcgacgggcggcggtgcactggaatggcgttcatgatgccgtcgagatcgatatgcttcggatcgaagttgaggctgccaatcttggtctggcaatggtcgtgcagcgatgttgattttgattcgttgggtgcactgtattctgtaggaaatcgatctggaaatgaaccaatacagtactactgaccaaagatgatagcgaacgaggtaaaggttagaactctagatcagcgtaaaccatctcttgtattcttcgatatacgcagattctgatcatatatagcgacgccatatgtttctttgcccgcatttttcggttgggcgtcgatcgactcgatcgccgatctctttttagcagaaagtcttgcgttctctctcttcaatgcaaccatctttgtcttgggaagtgtctggttatcgtgcgcttaccgtggagtacagaaaggattaccggtttgctaaatgtgttcgaatttaaattttgggaaaaaaaacaaaaatcttttaaaagttgctagaagtagtgcaacacctaagagcacacatccaagccattgaatcggttgttcaagtgaagtgatcaggatcgaagggaaaggaaaaagtacaccgaaggtccctcaacttgtcatcgagttacagaatcgtccctcaaccgcaaaaccagatatatgacatccctcaacttacaaaaccggtcacaataggtcattcggtggttttcacaccagtttaatcctatgtggcggctgagtcagcgtgggacccatatgccaatatgccatgtctctctccgttccttctctctctcacccttctcttctcttcttcggcaagc

SEQ ID NO: 44931 - DNA, 4580 bp, Oryza sativa
cgagtttataactcaatgacaagttgagggaccttcggtgtactttttcctaagggaaatgtcacgactcacgagcagcaagcaaagcaggaaggccgagaataactgggctgcgtgggccatgcggtggcattttacgggcccatcctccttccccccgcgggtgggaacaaattggcacggccgcgcccaatttcatttccccccatttcaattcatttcctccgggcaccacccgctcccttcccttccaccgcacacttcccgttgcggcgccgatcgccaacctctccggcagcctcgctcgccggaatggacccctccgccgccgcccactggtgggatggatctggggggagaggtggaggacgacgccagtgcaggggccgctcctaaccctggtggaatcgccgggggaaaggagggagatctcgacgcggaagattcgggaggagggagcggagcagacgacgccgccgccgccgtttcccatggcgccaccagcaccgactcgatcgtgctcccgccggagccgacgagcggccacctggcgagcctcctgcgggcgaggaagctgatcctcgtcgtggacttggaccacacgctcgtcaactccaccgcggattacgatatctccggcacggagtacgtcaacgggttggcggagctcgtcacagatgatccggggaggggcctgttcatattggatcatgccagctggttctcggcgttcatcaccaagctcaggccgttcgtccatggcttcctgcgagaagcgagcgccatgttcgagatgcacgtgtgtacaccctcggggacagggactacgcggcggcggtcgccaagctgctcgaccccgacggcgtctacttcggcgaacggatcatatcgagggacgagtcgccgcagccagacaggaagagcctcgacgtcgtcttcgggtcggcgccggcatcggcggcggagcgcgccgcggtggtcatcctcgacgacacggcggaggtctgggaggggaacagcgacaacctgatcgagatggagagataccactacttcgcgtcgagctgccgggacttcgggtcgccgtgggagtgcacgcactccctgtcggagcggggcgtggacgagagcgagcgcgccgcggcactgcgcgtcctgcggcgagtccacgcgggcttcttcgccggcggcggcggcagcttcgtcgcggacgtcagggaggtgatcaggcggacgcggcgcgaggtgctgctcgggtgcacggtggcgttcacccgggcgatcgccagcgacgaccaccactccgtgtggaggagaaccgagcagctcggcgccacctgcgccgacgacgtcggcccggaggtcacccacgtcgtcgccacgaacccgacgacgttcaaggcggtgtgggcgcaggtgttcggcaagttgctcgtcaacccagagtggatcaacgccgcgcatttccggtggagcaagcccaaggaggaacacttccccgtccgttggtaaaccggatcgaagttgagattgtcagttacctcgccaccagcattttccagtgttgcacgtactggtatgccaatttcattgcatcgagcagtatcgtttgacagaaaaccccccttacaaatcttgcaaattttgaaccatccgattgctttaagattcatgcaggcaaccaaactctaaaaatcctctcgcctctctctctcccgattcatcacgcgccgccgctcctccgccctagcgcgccgccgcccggcctcgccggctggccgaatggtgtcaacggcgctcgcgaggcccccccgaccggccccctccctctccctctcctctcctttgcctcaagccggtggcgacgagctgtccgtcgtcttccccgtcgccggcggcggggcgccaccaccggccgcctcctccccactctttccgctttgcccccgccgccgtcctccagccccgcggcttcagcggcgccgccgccgcccgcctgatccgccgggctgccgcctcccacggccatccctctaaagccggcgaactcccccttcttccccctccccctcccccccacccccaccccaccctgggaccctaattcgtcagccctctaccggagtttgggtttgccggcgccggagaagaagaggtggtcgccggagttggagaagaaaagcacgaatcgtgaagcacatctagtgatccaaaatttgcaagatttgaggtaggattttctgtcgacagagctttagcaattccgtaaaactaaactttgtggaagtatctatatattgtcattctttgagactcttatcttagcgacatgcatgcatgcatctagaaaaagtggttgtgccttatattatggaatggagggagtatatactttggtggaacaggaaactatagctaatgatgtattttgtaaggtgcaataacctaagttttgtattggaaataacgggatttatgtctacatatatacatatggcacacaacaccatacatctcatctagtttctttaattatcagcactgagctcctttattagtgggcttgctggaggctagagcccaagcagttaggctgaggaagtgaggatggtgctcgctggctagtctgatatgtatacgggggctaaggacatgatatgtgctccctccgttttacaatataacactttttagcattgcctatgtacatatagatgttaataaatttaaacacatacatatgtctaaatttattaacatctaaatgaatgtggacaatgctacaaaatcttacattgtgaaacggaggaagtatatgcgatgcgtcggctacatcagagtttcatctcgttgagtctgggttttgatcttgcaccttatctaacgttttaaaactttgaccttttggtttctgcaaacaaattaaagacttatgggccttagcctataggtttagacaatgtaggccaagttattgaattgcctacaagtatgaaagtaccaaattacctataagtgcaaaaggctcgttctgtctacaatctaaccttgtcggtggtgtaattatgggcaattagtgtcacccatcgaactgctattggtcggtcaagtgggccatgaatgtgtcatttttttctttccagctaaactcacataatcgtatatatcatgcctctagataggggccacgtaatcatggtaactcaccgtaccatggtaccgaggaggtaccaatgataattttaggtatcacaaatattttattgttgcattatagagatagtgatatagtaagagtatgatgatatatccatggcacccactacttagaatgtattctctatacctatctatacctatctagttcatccccacttagtgtaattgctaccatttaccatttatatgtattctcatgcttccatatcacataaattgatttggacctgcgttagcgaaaaaaaaaagattcaaaccattaattagatcagagcagtgtggtcagatcgatactaaacatcatggtcatgactagacatagctaaaattagaggtagtaaccacttccactataaaacttgctcttagcaagctgtctgtaaggcttttcgggccatatcgtaagaggtttgtagagtatgaagtcaattaaaatggtttggctaaattttggtggagtaaggaatatgttcatgtccttatatattttcacactagacaatgtatgaaacatgggaatttcgctatcgtcacgtcatgatacaataacatctcttgtaaatatatgtccttttattttttggggaaacatgttggcattgcctcagatgttcaggtttggttggcaagagaagagacaagagggtgaagaagccgacatgtgggttccacgctgactcagtcaggttgaccactatcaagttgtcatgtgagccaaaaccggaaactatactgccctagaaccagtggcggagctaggtttggaggaggagggggctcagccttcttcttcctcctccagccccctctctccccccattttcttcttcctctccctcttttccctcctctcctccctcacatttccatggagtccagcagggtaggggggctcgagccccctccaccgctgcctaggatctcaggtacaccaatacacaattcaaacacgtcaaagacgaagggcttaaagtgaacttattccctcaacgcacgcacaacactgaattaagtgtggcgaaaacaacgggaaatcggcccatttcctatatcctggcccaatatcaatccatttttctagggaaaaagtgcgccgaaggtccctcaacttgtcatcgggatacaaaaacgtcctcgaaccgcaaaaccggatatacagggtcccttaactatataaaaccgatcacctgagatcctttggtggttttgaccccggtttttgtctacacggcggctgagtcggtgtgggacccacgtggaccccacatgtcagcgtgccacatcaccacccattacttcccctttcttttttctcttccttttgttacttctctttgccgtgagggagtagcacacggaac
